(12) United States Patent
DeNise et al.

(10) Patent No.: US 7,468,248 B2
(45) Date of Patent: Dec. 23, 2008

(54) METHODS AND SYSTEMS FOR INFERRING BOVINE TRAITS

(75) Inventors: Sue K. DeNise, Davis, CA (US); Richard Kerr, Davis, CA (US); David Rosenfeld, Sacramento, CA (US); Tom Holm, Salt Lake City, UT (US); Stephen Bates, Davis, CA (US); Dennis Fantin, Danville, CA (US)

(73) Assignees: Cargill, Incorporated, Wayzata, MN (US); MMI Genomics, Inc., Beltsville, MD (US)

( * ) Notice: Subject to any disclaimer, the term of this patent is extended or adjusted under 35 U.S.C. 154(b) by 295 days.

(21) Appl. No.: 10/750,623

(22) Filed: Dec. 31, 2003

(65) Prior Publication Data

US 2005/0287531 A1 Dec. 29, 2005

Related U.S. Application Data

(60) Provisional application No. 60/437,482, filed on Dec. 31, 2002.

(51) Int. Cl.
*C12Q 1/68* (2006.01)
*C12P 19/34* (2006.01)

(52) U.S. Cl. .......................................... 435/6; 435/91.2

(58) Field of Classification Search ........................ None
See application file for complete search history.

(56) References Cited

U.S. PATENT DOCUMENTS

| | | | |
|---|---|---|---|
| 5,582,987 A | 12/1996 | Lewin et al. | |
| 5,612,179 A | 3/1997 | Simons | |
| 5,851,762 A | 12/1998 | Simons | |
| 6,103,446 A | 8/2000 | Devlin et al. | |
| 6,218,119 B1 | 4/2001 | Kuiper et al. | |
| 6,242,191 B1 | 6/2001 | Fluharty et al. | 435/6 |
| 6,383,751 B1 | 5/2002 | Barendse | |
| 6,410,231 B1 | 6/2002 | Arnold et al. | 435/6 |
| 6,458,531 B1 | 10/2002 | Rothschild et al. | |
| 6,458,544 B1 | 10/2002 | Miller | 435/6 |
| 6,701,869 B2 | 3/2004 | Fuqua | |
| 2002/0012934 A1 | 1/2002 | Meghen et al. | 435/6 |
| 2002/0098534 A1 | 7/2002 | McCaskey-Feazel et al. | 435/19 |
| 2002/0107211 A1 | 8/2002 | Friedman et al. | |
| 2002/0119442 A1 | 8/2002 | Dunlop et al. | |
| 2002/0123058 A1 | 9/2002 | Threadgill et al. | |
| 2002/0137139 A1 | 9/2002 | Byatt et al. | |
| 2002/0137160 A1 | 9/2002 | Byatt et al. | |
| 2003/0009292 A1 | 1/2003 | Mei et al. | 702/19 |
| 2003/0017487 A1 | 1/2003 | Xue et al. | 435/6 |
| 2003/0104424 A1 | 6/2003 | Tuggle et al. | |
| 2003/0129609 A1 | 7/2003 | Tuggle et al. | |
| 2003/0190644 A1 | 10/2003 | Braun et al. | |
| 2003/0219819 A1 | 11/2003 | Marquess | |
| 2004/0018511 A1* | 1/2004 | Cai et al. | 435/6 |

FOREIGN PATENT DOCUMENTS

| | | |
|---|---|---|
| EP | 1 256 632 | 2/2002 |
| EP | 0566 793 | 4/2002 |
| FR | 2 779 153 | 5/1999 |
| WO | WO92/13102 | 8/1992 |
| WO | WO95/15400 | 6/1995 |
| WO | WO98/39475 | 9/1998 |
| WO | WO99/01576 | 1/1999 |
| WO | WO00/36143 | 6/2000 |
| WO | WO00/69882 | 11/2000 |
| WO | WO01/21801 A1 | 3/2001 |
| WO | WO01/67211 | 9/2001 |
| WO | WO01/75161 | 10/2001 |
| WO | WO01/92570 | 12/2001 |
| WO | WO02/02822 | 1/2002 |
| WO | WO02/36824 | 5/2002 |
| WO | WO02/38737 | 5/2002 |
| WO | WO02/40709 A2 | 5/2002 |

(Continued)

OTHER PUBLICATIONS

Ioannidis et al. Replication validity of genetic association studies. Nature Genetics (2001) 29:306-309.*

(Continued)

*Primary Examiner*—Kenneth R. Horlick
*Assistant Examiner*—David C Thomas
(74) *Attorney, Agent, or Firm*—King & Spalding LLP

(57) ABSTRACT

Methods, compositions, and systems are provided for managing bovine subjects in order to maximize their individual potential performance and edible meat value, and to maximize profits obtained in marketing the bovine subjects. The methods and systems draw an inference of a trait of a bovine subject by determining the nucleotide occurrence of at least one bovine SNP that is identified herein as being associated with the trait. The inference is used in methods of the present invention to establish the economic value of a bovine subject, to improve profits related to selling beef from a bovine subject; to manage bovine subjects, to sort bovine subjects; to improve the genetics of a bovine population by selecting and breeding of bovine subjects, to clone a bovine subject with a specific trait, to track meat or another commercial product of a bovine subject; and to diagnose a health condition of a bovine subject. Methods are also disclosed for identifying additional SNPs associated with a trait, by using the associated SNPs identified herein.

33 Claims, No Drawings

FOREIGN PATENT DOCUMENTS

| WO | WO02/009510 A2 | 7/2002 |
| --- | --- | --- |
| WO | WO02/059374 A1 | 8/2002 |
| WO | WO02/064749 A2 | 8/2002 |
| WO | WO02/064820 | 8/2002 |
| WO | WO02/072871 A2 | 9/2002 |
| WO | WO02/076190 A2 | 10/2002 |
| WO | WO02/090569 | 11/2002 |
| WO | WO02/090589 | 11/2002 |
| WO | WO2004/013346 A2 | 2/2004 |

OTHER PUBLICATIONS

Heaton et al. Selection and use of SNP markers for animal identification and paternity analysis in U.S. beef cattle. Mammal. Genome (2002) 13:272-281.*

Akhter et al. Bos taurus clone RP42-360C18. GenBank Accession No. AC092085 (2002).*

Lucentini, Jack, "Reproducible Gene-Disease Associations are Few and Far Between", *The Scientist*, vol. 18, 2004.

Wacholder, Shalom et al., "Asssessing the Probability That a Positive Report is False: An Approach for Molecular Epidemiology Studies", *J. Natl. Cancer Institute*, vol. 96, pp. 434-442, 2004.

Zhang, H.M., et al., "Rapid Communication: A Novel DNA Polymorphism of the Bovine Calpain Gene Detected by PCR-RFLP Analysis"; J. Anim. Sci. 1996; 74:1441.

Davis, G.P., et al., "The Impact of Genetic Markers on Selection", J. Anim. Sci 1998, 76:2331-2339.

Denise, S.K., et al., "Genetic Parameter Estimates for Postweaning Traits of Beef Cattle in a Stressful Environment", J. Anim. Sci. 1989, 67:2619-2626.

Du, F.X., et al., "Heterozygosity for Genes Influencing a Quantitative Trait", J. Anim. Sci. 2002, 80:1478-1488.

Unanian, M.M., et al., "Rapid Communication: Polymerase Chain Reaction-Restriction Fragment Length Polymorphism in the Bovine Growth Hormone Gene", J. Anim. Sci. 1994, 72:2203.

Zhang, H.M., et al., "Rapid Communication: Polymerase Chain Reaction-Restriction Fragment Length Polymorphism Analysis of the Bovine Somatotropin Gene", J. Anim. Sci. 1993, 71:2276.

Zhang, H.M., et al., "Rapid Communication: Diallelic Single-Stranded Conformational Polymorphism Detected in the Bovine Prolactin Gene", J. Anim. Sci. 1994, 72:256.

Ax, R.L., et al. "New developments in managing the bull: Factors Affecting Calf Corp: Biotechnology of Reproduction", CRC Press, 2001.

Denise, S.K., et al., "Genetic Technologies: Factors Affecting Calf Corp: Biotechnology of Reproduction", CRC Press, 2002.

Denise, R.S.K., et al. "Genetic and environmental aspects of the growth curve parameters in beef cows", J. Anim. Sci. 1985, 61:1431.

Denise, R.S.K., et al., "Relationships among postweaning weights and gains of cattle raised under range and gain test environments", J. Anim. Sci. 1987, 64:969.

Denise, R.S.K., et al., "Relationships among udder shape, udder capacity, cow longevity and calf weights", J. Anim. Sci. 1987, 65:366.

Tanida, H., et al., "Genetic aspects of longevity in Angus and Hereford cows", J. Anim. Sci. 1988, 66:640.

Zhang, H.M., et al., "Nucleotide sequence determination of a bovine somatotropin allele", An. Genetics., 1992, 23:578.

Lagziel, A., et al., "Geographic and breed distribution of an MspI PCR-RFLP in the bovine growth hormone (bGH) gene", Anim.. Genet. 2000, 31:210-213.

Denise, S.K., et al., "The use of genetic markers in dairy and beef cattle improvement: Proc. Southwest Nutr. And Manage", Conf., Tempe, AZ 1993.

Denise, S.K., et al., "Genetic screening for disease and production: Proc. Western Canadian Dairy Sem.", Red Deer, Alberta 1993.

Denise, S.K., et al., "Incorporation of molecular genetic information into genetic prediction models: Proc. Genetic Prediction Workshop, Beef Improvement Federation", Kansas City, Jan. 1994.

Denise, S.K., et al., "Gene mapping, marker-assisted selection, QTLs-Boiling it down to cowboy lingo. Proc. Beef Improvement Federation Annual Meeting", Des Moines, Iowa, Jun. 1994.

Denise, S.K., "Biotechnology and Animal Breeding: What can we use today and what does the future hold?" Great Plains Beef Cattle Handbook 1994.

* cited by examiner

METHODS AND SYSTEMS FOR INFERRING BOVINE TRAITS

CROSS REFERENCE TO RELATED APPLICATION

This application claims the benefit of priority under 35 U.S.C. § 119(e) of U.S. Ser. No. 60/437,482, filed Dec. 31, 2002, the entire content of which is incorporated herein by reference.

BACKGROUND OF THE INVENTION

1. Field of the Invention

The specification hereby incorporates by reference in their entirety under 37 C.F.R. § 1.77(b)(4), the files contained on the three compact discs filed herewith. The first and second compact discs each includes a file entitled "mmi1 100-1 Table 1A.txt," created Sep. 23, 2004, which is 8,960 kilobytes in size, and a file entitled "mmi1 100-1 Table 1B.txt," created Sep. 23, 2004, which is 11,817 kilobytes in size. The first and second compact discs are duplicates as required under 37 C.F.R. § 1.52(e)(4). The third compact disc includes a file entitled "MMI1 100-1. txt," created Sep. 22, 2004, which is 88,025 kilobytes in size.

The invention relates generally to gene association analyses and more specifically to polymorphisms and associated traits of bovine species.

2. Background Information

Under the current standards established by the United States Department of Agriculture (USDA), beef from bulls, steers, and heifers is classified into eight different quality grades. Beginning with the highest and continuing to the lowest, the eight quality grades are prime, choice, select, standard, commercial, utility, cutter and canner. The characteristics which are used to classify beef include age, color, texture, firmness, and marbling, a term which is used to describe the relative amount of intramuscular fat of the beef. Well-marbled beef from bulls, steers, and heifers, i.e., beef that contains substantial amounts of intramuscular fat relative to muscle, tends to be classified as prime or choice; whereas, beef that is not marbled tends to be classified as select. Beef of a higher quality grade is typically sold at higher prices than a lower grade beef. For example, beef that is classified as "prime" or "choice," typically, is sold at higher prices than beef that is classified into the lower quality grades.

Classification of beef into different quality grades occurs at the packing facility and involves visual inspection of the ribeye on a beef carcass that has been cut between the 12th and 13th rib prior to grading. However, the visual appraisal of a beef carcass cannot occur until the animal is harvested. Ultrasound can be used to give an indication of marbling prior to slaughter, but accuracy is low if ultrasound is done at a time significantly prior to harvest.

Currently there are no cost effective methods for identifying live cattle that give accurate prediction of the genetic potential to produce beef that is well-marbled. Such information could be used by feedlot operators to identify animals for purchase prior to finishing, to identify animals under contract for one or more premium programs administered by a packer, by feedlot managers to make management decisions regarding individual animals within a lot (including nutrition programs and sale dates), by cow-calf producers in marketing their animals to various feedlots or in making decisions regarding which animals will be sold on various carcass evaluation grids. Such information could also be used to identify cattle that are good candidates for breeding. Thus, it is desirable to have a method which can be used to assess the beef marbling potential of live cattle, particularly young cattle well in advance of the arrival of the animal at the packing house.

Another characteristic of beef that is desired by consumers is tenderness of the cooked product. Currently there are no procedures for identifying live animals whose beef, if cooked properly, would be tender. Currently, there are two types of procedures which are used by researchers to assess the tenderness of meat samples after they have been aged and subsequently cooked. The first involves a subjective analysis by a panel of trained testers. The second type is characterized by methods used to cut or shear meat samples that have been removed from an animal and aged. One such method is the Warner-Bratzler shear force procedure which involves an instrumental measurement of the force required to shear core samples of whole muscle after cooking. Neither of these procedures can be used to any practical effect in a fabrication setting as the need to age product prior to testing would lead to maintenance of inventory of fabricated product that would be cost prohibitive. Consequently, the methods are used at research facilities but not at packing plants. Accordingly, it is desirable to have new methods which can be used to identify carcasses and live cattle that have the potential to provide beef that, if cooked properly, will be tender.

It has been difficult for the livestock industry to combine genetics for red meat yield and marbling and/or tenderness. In fact, conventional measurement techniques indicate that marbling and red meat yield tend to be antagonistic. Hence, there is a need for tools that identify superior genetic potential for the combination of red meat yield, tenderness and marbling. Another trait of interest is live cattle growth rate (average daily gain). Currently, cattle producers do not have tools to identify animals with superior genetic potential for rapid growth prior to purchase. In addition, there are no methods currently available to identify animals which combine capability for superior growth rate with desirable carcass characteristics.

While many methods of measurement and selection of cattle in feedlots have been tried, both visual and automated, such as ultrasound, none have been successful in accomplishing the desired end result. That end result is the ability to identify and select cattle with superior genetic potential for desirable characteristics and then manage a given animal with known genetic potential for shipment at the optimum time, considering the animal's condition, performance and market factors, the ability to grow the animal to its optimum individual potential of physical and economic performance, and the ability to record and preserve each animal's performance history in the feedlot and carcass data from the packing plant for use in cultivating and managing current and future animals for meat production. The beef industry is extremely concerned with its decreasing market share relative to pork and poultry. Yet to date, it has been unable to devise a system or method to accomplish on a large scale what is needed to manage the current diversity of cattle (i.e. least about 100 different breeds and co-mingled breeds) to improve the beef product quality and uniformity fast enough to remain competitive in the race for the consumer dollar spent on meat.

Modern day breeding programs in animal agriculture originated from fundamental observations made upon the first domestication of animals. Early humans observed differences in a broad range of characteristics between the offspring produced by mating different parents and they took advantage of this observation by only mating individuals that demonstrated the most desirable characteristics. By following this strategy for several generations our ancestors were able to create populations of animals that exhibited only desirable traits that best fit their needs. This strategy, called selective mating or selective breeding, is based on identifying the best progeny from one generation and making them the parents for the next generation. Selective breeding results in the development of individuals that are superior for one or more traits and is the backbone for modern day genetic improvement programs in animal agriculture.

Through the utilization of selective breeding strategies geneticists have been able to define the fundamental genetic parameters that influence the expression of traits. Breeding experiments revealed that some traits, like coat color, were expressed in a qualitative manner and could be easily passed onto the next generation while other traits, like growth rate or adult size, were expressed in a quantitative fashion and only small progress could be made at each generation. Subsequent research in the field of molecular genetics has now revealed that qualitative trait effects are caused by the action of a single gene while quantitative traits are caused by the action and interaction of many different genes.

In addition to contributions of genetics, it has been determined that genetic source alone did not account for all of the differences observed among groups of closely related individuals and that environment and management also played a role in determining the expression of specific traits. In order to account for all of the differences observed between individuals for a specific trait geneticists developed the equation; P (phenotype or overall trait expression)=G (genetic contribution from parents)+E (contribution from the environment). Geneticists observed that some traits respond better to selection than others due to intrinsic differences in G and E and developed scientific methods for determining the genetic contribution, or heritability, for a number of unique traits. For any given trait a higher heritability indicates more of the total variation is accounted for by the genetic source and a faster response to selection can be achieved. The parameters that govern differences in the expression of specific traits between individuals as defined above have been used for decades to make genetic improvement in animal agriculture production. Utilization of these parameters in a "Classical Breeding Program" provides breeders with a set of tools to evaluate the genetic makeup of different individuals within a population and to make steady progress in improving the expression of traits that have economic significance to the commercial production of livestock species.

The primary objective of any genetic improvement program is to ascertain the genetic potential of individuals for a broad range of economically important traits at a very early age. While the classical breeding approach has produced steady genetic improvement in livestock species it is limited by the fact that accurate prediction of an individual's genetic potential can only be achieved when the animal reaches adulthood (fertility and production traits) or is harvested (meat quality traits). This is particularly problematic for meat animals since harvested animals obviously cannot enter the breeding pool. Furthermore, it is difficult to utilize the classical breeding approach for traits that are difficult (disease resistance) or costly (meat tenderness) to measure.

To overcome the previous problems with the classical breeding approach animal breeders and geneticists turned to the new fields of molecular genetics and genomics. These disciplines offered the promise that the underlying genes responsible for genetic variation of important traits could be identified. Targeted research programs were initiated to ascertain the location and functional differences of specific genes that contribute to genetic variation for defined traits. The primary goal of molecular breeding programs in livestock species is to develop genetic assays for economically important traits that can be tested on individual animals at an early age, can be used for traits that are difficult to measure, that provide an accurate estimate of an animals genetic potential for expression of the trait, and account for a large proportion of the total genetic variation observed for the trait in commercial populations.

To date, three different experimental approaches have been utilized to identify genes that effect economically important traits in livestock species: Candidate Gene Approach, Differential Gene Expression Approach, and Within Family Quantitative Trait Loci (QTL) Linkage Approach. Limited success has been achieved for each of these methods in identifying genes that contribute to genetic variation for defined traits. However, each method also has limitations, as the primary objectives of the molecular breeding approach described above have not been achieved. Accordingly, a need exists for methods that assist in a determination of the genetic potential of individuals for a broad range of economically important traits at a very early age. A description of each of the experimental approaches attempted thus far, and the limitations for each is outlined below:

In the candidate gene approach a specific gene or set of genes is targeted based on the hypothesis they may have an effect on a particular trait. The hypothesis is developed based on existing information of biochemical pathways and the function of the gene in another species, most often human or mouse where substantial gene characterization has been performed. The known sequence of the human or mouse gene is used to fish-out the gene in the target species. The DNA sequence of the gene in the target species is determined by sequencing a large number of individuals and any sequence variation is cataloged. The sequence variations are developed into diagnostic assays and genotyped against a population of animals where phenotypic variation for the targeted traits has been characterized. The data set is analyzed to determine if statistically significant associations exist between specific sequence variants and expression of the trait.

The candidate gene approach has been successful in identifying genes and sequence variants that have an effect on a particular trait. However, this approach does have limitations and is analogous to finding a needle-in-the-haystack. With over 30,000 genes characterized in humans and mouse as a result of the whole genome sequence the first difficulty is identifying a gene that will actually contribute to genetic variation for a specific trait. Secondly, a large enough set of individuals must be sequenced to find the sequence variant that is responsible for or at least highly associated with the effect. And finally, if an effect is present at all the population of animals screened must be large enough to ensure statistically significant association of the effect. While it is feasible to meet all of these conditions to discover significant associations the cost of this approach is high because it is a random method that cannot be targeted to genes that have the largest effect.

In the differential gene expression approach, differences in gene expression are characterized for specific genes and in targeted tissues with the hope of identifying genes that may be contributing to the observed genetic variation for a particular trait. As in the Candidate Gene Approach, targeted genes and tissues are chosen based on existing information of biochemical pathways and the functions of genes in other species. Differential gene expression has been effective in identifying genes that are turned on or off by extreme differences in environment or by disease, but has been less successful in identifying genes that contribute to phenotypic variation in livestock production traits. Current technology platforms for detecting differences in gene expression require large differences in gene expression, often up to a 2 to 3 fold increase or decrease. Gene expression differences that may account for genetic variation in livestock traits may be under the detection threshold for existing gene expression technology.

Differential gene expression technology has been successfully used to elucidate biochemical pathways and to understand basic cellular functions but has not demonstrated any utility in the development of diagnostic assays to predict genetic potential of animals for specific traits. Even if differential expression of a gene is observed and can be directly attributed to phenotypic variation for a trait there is no guarantee that a sequence variant can be found in the gene or that the sequence variant is responsible for the effect. In many situations sequence variants for differentially expressed genes do not association with the observed difference in phenotypes. This could be explained by the action of other genes or gene products that regulate the expression of the differentially expressed gene but are located elsewhere in the genome.

In the within-family QTL linkage approach, small families of related individuals are bred-up or assembled, DNA samples are taken from all individuals in the population, phenotypic measurements for the targeted traits are taken on the progeny and a set of polymorphic DNA markers that span the genome are genotyped against the entire research population. The data set is then analyzed to determine if a particular marker or a linked set of markers have specific allele(s) that predominately associate with the phenotypic variation observed in the progeny from a specific parent or set of parents. A large number of research reports claiming linkage between specific traits and markers have been published for a wide variety of traits and in several different livestock species.

Although the within family QTL linkage approach has resulted in a number of reported linkages between targeted traits and specific marker locations this approach does not result in the direct development of diagnostic assays that can predict an animals genetic potential for the targeted trait. In practice, the research populations used for these experiments are very small, often only representing two or three different sire families, and as such, they do not represent the broad pattern of genetic variation that is observed across commercial animal populations. These small research populations are also problematic because the QTL can only be identified when it is heterozygous for a particular family group. Linkages between a marker and a trait are determined by allele frequency differences in the marker between progeny separated into groups with high versus low expression for the trait. This implies that the QTL itself must be heterozygous in order to be detected and the smaller the population the less likely it is to find QTLs in a heterozygous state. Furthermore, research populations designed to identify linkages in livestock species are usually half-sib designs where it is only possible to measure the genetic variation contributed by the male side of the pedigree. Half-sib designs have limited effectiveness in discovering significant linkages because only one-half of the genetic variation is accounted for in the analysis. Finally, the research populations are often comprised of animals and/or breed types that have extreme phenotypic differences for the targeted traits to insure the discovery of markers that demonstrate linkage to the trait. These extreme phenotypic crosses do not represent mainstream industry breeding practices and therefore, any reported linkage is suspect because it may only exist as an artifact within the research population and may not actually be segregating in commercial animal breeding populations.

Another limitation of the within family QTL approach is the lack of marker density for the linkage map used in the study. Due to cost and genotyping throughput issues all reported QTL linkage studies performed to date in livestock species have only used 100 to 200 total markers to cover the entire genome. With such a limited number of markers it is impossible to pinpoint the exact location of the QTL on the chromosome. Linkage distances ranging from 3 to over 60 centi-Morgans are commonly reported between the QTL and the linked marker(s). These broad linkage groups can actually span an entire chromosome and contain thousands of genes that are possible candidates for the observed effect. Because of these large distances, recombination between homologous chromosomes does not allow the use of linked markers identified in research populations to be used as predictors of genetic potential in commercial animal populations. Markers linked to QTLs can provide clues about the potential location of genes that have effects for certain traits but substantial additional research and validation is required to accurately pinpoint the location of the gene responsible for the effect and develop diagnostic assays to predict the expression of the trait.

In summary, three different experimental approaches have been used with limited success to identify genes, chromosomal regions or DNA markers that account for a large proportion of the genetic variation observed in economically important traits in livestock species. The results achieved from research programs utilizing these methods have not been widely utilized to date because they do not account for enough of the total genetic variation to allow accurate prediction of an animal's performance for a specific trait. Furthermore, even when successful these approaches are only capable of identifying additive genetic components while ignoring non-additive genetic components such as dominance (i.e. dominating trait of an allele of one gene over an allele of a another gene) and epistasis (i.e. interaction between genes at different loci) which are critical to the development of diagnostics that can be utilized by animal breeders to accurately predict genetic potential for economically important traits in livestock species.

SUMMARY OF THE INVENTION

The present invention provides methods, systems, and compositions that allow the identification and selection of cattle with superior genetic potential for desirable characteristics. Accordingly, the present invention provides methods, compositions, and systems for managing, selecting and mating, breeding, and cloning cattle. These methods for identification and monitoring of key characteristics of individual animals and management of individual animals maximize their individual potential performance and edible meat value. The methods of the invention provide systems to collect, record and store such data by individual animal identification so that it is usable to improve future animals bred by the producer and managed by the feedlot. The methods, compositions, and systems provided herein utilize information regarding genetic diversity among cattle, particularly single nucleotide polymorphisms (SNPs), and the effect of nucleotide occurrences of SNPs on important traits.

The present invention further provides methods for selecting a given animal for shipment at the optimum time, considering the animal's genetic potential, performance and market factors, the ability to grow the animal to its optimum individual potential of physical and economic performance, and the ability to record and preserve each animal's performance history in the feedlot and carcass data from the packing plant for use in cultivating and managing current and future animals for meat production. These methods allow management of the current diversity of cattle to improve the beef product quality and uniformity, thus improving revenue generated from beef sales.

This invention allows the identification of animals that have superior traits that can be used to identify parents of the next generation through selection. These methods can be imposed at the nucleus or elite breeding level where the improved traits would, through time, flow to the entire population of animals, or could be implemented at the multiplier or foundation parent level to sort parents into most genetically desirable. The optimum male and female parent can then be identified to maximize the genetic components of dominance and epistasis, thus maximizing heterosis and hybrid vigor in the market animals.

In one embodiment, the present invention provides an isolated polynucleotide that includes at least 20 contiguous nucleotides of any one of SEQ ID NOS:24493 to 64886, a polynucleotide at least 90% identical to the 20 contiguous nucleotide fragment, or a complement thereof, wherein the isolated polynucleotide includes a nucleotide occurrence of a single nucleotide polymorphism (SNP) associated with a trait, wherein the SNP corresponds to position 300 of SEQ ID NOS:19473 to 21982.

In another embodiment, the invention provides methods to draw an inference of a trait of a bovine subject by determining the nucleotide occurrence of at least one bovine SNP that is determined using methods disclosed herein, to be associated with the trait. For example, the inference can be drawn by determining the nucleotide occurrence of at least one SNP identified in Tables 1A and 1B (i.e. a SNP corresponding to position 300 of SEQ ID NOS:19473 to 21982). The inference can be drawn regarding, for example, fat thickness, retail yield, marbling, tenderness, or average daily gain.

The inference is used in methods of the present invention for the following aspects of the invention: to establish the economic value of a bovine subject; to improve profits related to selling beef from a bovine subject; to manage bovine subjects; to sort bovine subjects; to improve the genetics of a bovine population by selecting and breeding of bovine subjects; to clone a bovine subject with a specific trait, a combination of traits, or a combination of SNP markers that predict a trait; to track meat or another commercial product of a bovine subject; to certify and brand a specific product based on known characteristics; and to diagnose a health condition of a bovine subject.

In another embodiment, the present invention provides a method for identifying a bovine target sequence, such as a gene, associated with a trait, by identifying an open reading frame present in a target region of the bovine genome, wherein the target region is located on the bovine genome less than or equal to about 500,000 nucleotides of a single nucleotide polymorphism (SNP) corresponding to position 300 of any one of SEQ ID NOS:19473 to 21982, and analyzing the open reading frame to determine whether it affects the trait, thereby identifying a bovine gene associated with the trait. In one aspect, the target region is located within about 5000 nucleotides of a single nucleotide polymorphism (SNP) corresponding to position 300 of any one of SEQ ID NOS:19473 to 21982.

In another embodiment, the present invention provides a method for identifying a bovine single nucleotide polymorphism (SNP) associated with a trait, that includes identifying a test SNP in a target region of a bovine genome, wherein the target region is less than or equal to about 500,000 nucleotides of a SNP position corresponding to position 300 of one of SEQ ID NOS:19473 to 21982, and identifying an association of the test SNP to the trait, thereby identifying the test SNP as associated with the trait. In certain aspects, the target region includes at least 20 contiguous nucleotides of SEQ ID NOS: 24493 to 64886. In another aspect, for example, the target region includes at least 20 contiguous nucleotides of SEQ ID NOS:19473 to 21982. The present invention also provides isolated polynucleotides that include the identified SNPs.

DETAILED DESCRIPTION OF THE INVENTION

The specification hereby incorporates by reference in their entirety, the files contained on the two compact discs filed herewith. Two copies of each of the two compact discs are filed herewith. The first compact disc includes a file called "MMI1 100-1 Table 1A.doc," created Dec. 31, 2003, which is 11299 kilobytes in size, and a file called "MMI1 100-1 Table 1B.doc," created Dec. 31, 2003, which is 11266 kilobytes in size. The Second disc includes a sequence listing which is included in a file called "MMI1 100-1 SEQUENCE LISTING.txt," created Dec. 31, 2003, which is 4770 kilobytes in size.

The compositions, methods, and systems of the invention are particularly well suited for managing, selecting or mating bovine subjects. They allow for the ability to identify and monitor key characteristics of individual animals and manage those individual animals to maximize their individual potential performance and edible meat value. Therefore, the methods, systems, and compositions provided herein allow the identification and selection of cattle with superior genetic potential for desirable characteristics.

The compositions, methods, and systems of the present invention are especially well-suited for implementation in a feedlot environment. They allow for the ability to identify and monitor key characteristics of individual animals and manage those individual animals to maximize their individual potential performance and edible meat value. Furthermore, the invention provides systems to collect, record and store such data by individual animal identification so that it is usable to improve future animals bred by the producer and managed by the feedlot. The systems can utilize computer models to analyze information regarding nucleotide occurrences of SNPs and their association with traits, to predict an economic value for a bovine subject.

Presently, feedlots contain pens which typically have a capacity of about 200 animals, and market to packers, pens of cattle that are fed to an average endpoint. The endpoint is calculated as a number of days on feed estimated from biological type, sex, weight, and frame score. Animals are initially sorted to a pen based on the estimated number of days on feed and incoming group. However, sorting is done by a series of subjective and suboptimal parameters, as discussed herein. The cattle are fed to an endpoint in order to maximize the percentage of animals from which Grade USDA Choice beef can be obtained at slaughter without developing cattle that are too fat, and thus get discounted for insufficient red meat yield. The present invention provides a method for maximizing a physical characteristic of a bovine subject, including optimizing the percentage of bovine subjects that produce Grade USDA Choice and Prime beef in the most efficient manner.

In one embodiment, the present invention provides an isolated polynucleotide that includes a fragment of at least 20 contiguous nucleotides of the bovine genome, or a complement thereof, wherein the isolated polynucleotide includes a nucleotide occurrence of a single nucleotide polymorphism (SNP) associated with a trait, wherein the SNP is in disequilibrium with a SNP corresponding to position 300 of any one of SEQ ID NOS:19473 to 21982. In certain aspects, the polynucleotide is located about 500,000 or less nucleotides from position 300 of SEQ ID NOS:19473 to 21982 on the bovine genome. As disclosed in the Examples herein, the linkage disequilibrium for cattle is about 500,000 nucleotides. Therefore, it is expected that other SNPs can be identified that are associated with the same traits based on the fact that these other SNPs are located less than or equal to about 500,000 nucleotides of the identified associated SNP on the bovine genome. In certain aspects, the polynucleotide is from an Angus, Charolais, Limousin, Hereford, Brahman, Simmental or Gelbvieh bovine subject.

The attached sequence listing provides sequences of contigs (SEQ ID NOS:24493 to 64886) generated from the bovine genome. It will be understood that contigs can be aligned such that SNPs that are on separate contigs, but are located within 500,000 nucleotides on the bovine genome, can be identified. For example, alignment of contigs and determination of distance between contigs provided herein, can be accomplished by using the sequence information of the human genome as a scaffold. Tables 1A and 1B (filed herewith on the compact disc), lists contigs that are "nearby" (i.e. within 500,000 nucleotides on the bovine genome) an associated SNP.

In certain aspects, the isolated polynucleotide includes a nucleotide corresponding to an associated SNP. Accordingly, in these aspects the isolated polynucleotide includes a nucleotide corresponding to position 300 of any one of SEQ ID NOS:19473 to 21982.

In another aspect, the present invention provides an isolated polynucleotide that includes a polynucleotide that is at least 20 nucleotides in length and is at least 90% identical to a fragment of at least 20 contiguous nucleotides of a bovine genome; or a complement thereof, wherein the fragment of at least 20 contiguous nucleotides of the bovine genome comprises a nucleotide occurrence of a single nucleotide polymorphism (SNP) associated with a trait, wherein the SNP is about 500,000 or less nucleotides from position 300 of any one of SEQ ID NOS:19473 to 21982. In certain aspects, for example, the polynucleotide is at least 90% identical to a fragment of at least 10, 15, 20, 25, 50, or 100 contiguous nucleotides of SEQ ID NOS:19473 to 21982. In certain aspects, the polynucleotide comprises position 300 of SEQ ID NOS:19473 to 21982.

As used herein, "about" means within ten percent of a value. For example, "about 100" would mean a value between 90 and 110.

In certain aspects, the isolated polynucleotide includes a fragment of at least 5, 10, 15, 20, 25, 30, 35, 40, 45, 50, 100, 200, 250, 500, 1000, 5000, 10,000, 25,000, 50,000, 100,000, 125,000, 250,000 or 500,000 nucleotides in length. Furthermore, in certain examples, the isolated polynucleotide includes a fragment of at least 5, 10, 15, 20, 25, 30, 35, 40, 45, 50, 100, 200, 250, 500, 1000, 5000, or 9549 contiguous nucleotides of any one of SEQ ID NOS:24493 to 64886. In another aspect, the isolated polynucleotide is at least 65, 70, 75, 80, 85, 90, 95, 96, 97, 98, 99, or 99.5% identical to the recited sequences, for example. In another aspect, the isolated nucleotide includes region that is contiguous with a region of any one of SEQ ID NOS:19473 to 21982 that includes position 300. In certain aspects, the isolated polynucleotide consists of any one of SEQ ID NOS:19473 to 21982. In other aspects, the isolated polynucleotide consists of any one of SEQ ID NOS:21983 to 24492.

The polynucleotide or an oligonucleotide of the invention can further include a detectable label. For example, the detectable label can be associated with the polynucleotide at a position corresponding to position 300 of any one of SEQ ID NOS:19473 to 21982. As discussed in more detail herein, the labeled polynucleotide can be generated, for example, during a microsequencing reaction, such as SNP-IT™ reaction.

Detectable labeling of a polynucleotide or oligonucleotide is well known in the art. Particular non-limiting examples of detectable labels include chemiluminescent labels, fluorescent labels, radiolabels, enzymes, haptens, or even unique oligonucleotide sequences.

In another embodiment, the present invention provides an isolated vector that includes a polynucleotide disclosed hereinabove. The term "vector" refers to a plasmid, virus or other vehicle known in the art that has been manipulated by insertion or incorporation of a nucleic acid sequence.

Methods that are well known in the art can be used to construct vectors, including in vitro recombinant DNA techniques, synthetic techniques, and in vivo recombination/genetic techniques (See, for example, the techniques described in Maniatis et al. 1989 Molecular Cloning A Laboratory Manual, Cold Spring Harbor Laboratory, N.Y., incorporated herein in its entirety by reference).

In another aspect, the present invention provides an isolated cell that includes the vector. The cell can be prokaryotic or eukaryotic. Techniques for incorporated vectors into prokaryotic and eukaryotic cells are well known in the art. In certain aspects, the cells are bovine cells. In other aspects, the cells are bacterial cells. In still other aspects, the cells are human cells.

In another aspect, the present invention provides a primer pair that binds to a first target region and a second target region of SEQ ID NOS:24493 to 64886, wherein the first primer of the primer pair and a second primer of the primer pair are at least 10 nucleotides in length and bind opposite strands of the target region located within 3000 nucleotides of a position corresponding to position 300 of any one of SEQ ID NOS:19473 to 21982, and prime polynucleotide synthesis from the target region in opposite directions across position 300. In another embodiment, provided herein is a primer pair that binds to a first target region and a second target region of SEQ ID NOS:19473 to 21982, wherein a first primer of the primer pair and a second primer of the primer pair are at least 10 nucleotides in length and bind opposite strands of the target region, and prime polynucleotide synthesis from the target region in opposite directions across position 300 of SEQ ID NOS:19473 to 21982. In certain aspects, the target region is within SEQ ID NOS:19473 to 21982.

In another embodiment, the present invention provides an isolated oligonucleotide that selectively binds to a target polynucleotide that includes at least 5, 10, 15, 20, 25, 30, 35, 40, 45, 50, 100, 150, 300, 500, 1000, 1500, 2000, 2500, or 3000 nucleotides, for example, of SEQ ID NOS:24493 to 64886, wherein the terminal nucleotide corresponds to position 300 of any one of SEQ ID NOS:19473 to 21982. In certain aspects, the isolated oligonucleotide includes at least 5 nucleotides of SEQ ID NO:SNP1 to SNP4000. In certain aspects, the isolated oligonucleotide is complementary to the nucleotide or a complement thereof, at position 299 or 300 of any one of SEQ ID NOS:19473 to 21982.

In another embodiment, the present invention provides an oligonucleotide that binds to any one of SEQ ID NOS:19473 to 21982, wherein the oligonucleotide is between 10 and 50 nucleotides in length, and wherein the oligonucleotide comprises at least 10 contiguous nucleotides of SEQ ID NOS: 21983 to 24492. In certain aspects, for example, the oligonucleotide is at least 15 nucleotides in length. In certain examples, the oligonucleotide binds to a region that includes position 300 of any one of SEQ ID NOS:19473 to 21982. In other examples, the oligonucleotide includes at least 15, 16, 17, 18, 19, 20, 21, 22, 23, 24 or 25 nucleotides of any one of SEQ ID NOS:21983 to 24492. The isolated oligonucleotide can be any one of SEQ ID NOS:21983 to 24492.

In another embodiment, the present invention provides an isolated oligonucleotide that includes 10 nucleotides, that selectively binds to a target polynucleotide of any one of SEQ ID NOS:19473 to 21982, wherein a terminal nucleotide of the isolated oligonucleotide binds to position 298, 299, 300, 301, or 302 of any one of SEQ ID NOS:19473 to 21982. The oligonucleotide can be, for example, 10, 15, 20, 25, 50, or 100 nucleotides in length. In certain aspects, the terminal nucleotide binds to position 300 of any one of SEQ ID NOS:19473 to 21982.

In another embodiment, the present invention provides an isolated oligonucleotide pair effective for determining a nucleotide occurrence at a single nucleotide polymorphism (SNP) corresponding to position 300 of any one of SEQ ID NOS:19473 to 21982, wherein each isolated oligonucleotide comprises at least 5 nucleotides from SEQ ID NOS:19473 to 21982 and wherein the terminal nucleotide of each oligonucleotide pair is complementary to a different nucleotide at position 300 of any one of SEQ ID NOS:19473 to 21982 or a complement thereof. In certain aspects, the specific binding pair member is a substrate for a primer extension reaction.

In another embodiment, the invention provides a method for drawing an inference regarding a trait of a bovine subject by determining the nucleotide occurrence of at least one bovine SNP that is associated with the trait. A SNP is associated with a trait when at least one nucleotide occurrence of the SNP occurs more frequently in subjects with a certain characteristic of the trait in a statistically significant manner, for example with greater than 80%, 85%, 90%, 95%, or 99% confidence. Therefore, in certain aspects, the methods include identifying whether the nucleotide occurrence is a bovine SNP allele identified herein as associated with a trait. A bovine "SNP allele" is a nucleotide occurrence of a SNP within a population of bovine animals. The inference, in certain aspects, is drawn by determining the nucleotide occurrence of one or more SNPs corresponding to position 300 of SEQ ID NOS:19473 to 21982. These SNPs are referred to herein as "associated SNPs." The inference can be drawn regarding a variety of traits as discussed herein, such as, for example, fat thickness, retail yield, marbling, tenderness, or average daily gain. In certain aspects, the bovine subject is an Angus, Charolais, Limousin, Hereford, Brahman, Simmental or Gelbvieh bovine subject.

As illustrated in the Example provided herein, a high density SNP map of the bovine genome was constructed and analyzed for the presence of SNPs that are associated with a trait at a confidence level of 0.01 or greater. The identified SNPs are referred to herein as "SNPs that are associated with a trait" or "associated SNPs." The predictive value of the associated SNPs allow a determination of the genetic potential of a bovine animal to express multiple economically important traits, termed the molecular breeding and selection value. This information is utilized to enhance the efficiency and accuracy of breeding, sorting and cloning of animals.

The analysis disclosed in the Examples herein, utilized methods of the present invention, to generate a high-density genetic map of the bovine genome based on single nucleotide polymorphic (SNP) markers. The high-density genetic map was created through a whole genome sequence of the bovine genome using the shotgun sequencing approach as described by Venter, J. C, et al., (*Science* 291:1304-1351 (2001)). Shotgun sequencing was performed with four different bovine individuals that represent different breed types. Upon whole genome assembly of the sequenced fragments all sequence variants were identified and cataloged. Sequence variants that differ by a single nucleotide became candidate SNP markers for the high-density map. The relative position of each candidate SNP within the bovine genome was determined by using the assembled human genome as scaffolding. Candidate SNPs were chosen based on their locations so that the map is evenly distributed across the bovine genome. The genetic SNP map is evenly distributed where the average genetic distance between any two adjacent markers is 0.5 cM.

Furthermore, phenotypic data from 3791 bovine animals was collected from a three by three factorial feeding and carcass data collection experiment, comparing three biological types (English, Continental and Brahman crosses) within three different days on feed (early, optimum and late). Animals were randomly assigned to treatment groups based on biological type. All cattle entered the experiment within 90 kg of body weight. These groups were blocked across starting and harvest date. Blood samples were collected on each individual animal at the start of the feeding period and assigned an electronic ID that was matched to the collection sample. At the completion of the feeding and harvest period data were compiled and analyzed for relevant statistical parameters. Statistically significant associations between specific SNPs and targeted traits were identified by methods disclosed herein for utilizing a high-density genetic SNP map in the performance of whole genome association studies in bovine animals. Using methods and results provided herein, the effect of the associated SNP on the target trait through allele frequency differences in the SNP was determined. Furthermore, as disclosed herein, SNPs that are adjacent to or in close proximity to some of the associated SNPs were identified that are associated with the same traits as an associated SNP.

As discussed in detail in the attached Examples, DNA samples were pooled from bovine subjects that represent high and low phenotypic extremes for the expression of a target trait in a population of bovine animals (e.g. high fat). The traits selected for analysis were marbling, tenderness, fat thickness, yield, and daily gain. A total of 2510 SNPs were identified that are associated with these traits (Tables 1A and 1B).

Tables 1A and 1B, both of which are filed herewith on a compact disc, disclose the SNPs identified by the analysis, and provide the SNP names for the SNPs corresponding to position 300 of SEQ ID NOS:19473 to 21982. The sequences disclosed in SEQ ID NOS:SNP1 to SNP4000 are regions from which amplicons were generated. Table 1B also indicates the location of the amplicon-generating regions within a larger bovine genomic sequence contig (SEQ ID NOS: 24493 to 64886) (See column 2 of Table 1B, labeled "In Sequence," which lists a contig name (e.g., "19866880525139") and positions (e.g. "923-1522") within the contig of an amplicon which includes the SNP at position 300. A sequence identifier for the amplicon (SEQ ID NOS: 19473-21982) is listed in Table 1A. Furthermore, Tables 1A and 1B identify the nucleotide occurrences that have been detected for each of these SNPs, and identifies traits that have been identified to be associated with these SNPs using methods disclosed herein. All of the SNPs listed in Tables 1A and 1B were associated with the respective trait(s) with a confidence level of 0.01, or higher confidence. Finally, Table 1A provides the sequence of an extension primer that was used to determine the nucleotide occurrence of the SNPs (SEQ ID NOS:21983 to 24492).

Each SNP in Tables 1A and 1B is characterized by the trait(s) found to be in association: marbling, tenderness, fat thickness, daily gain and retail yield. For each of the five traits, "High" refers to animals reaching the 90$^{th}$ percentile of that phenotypic measurement based on numeric ranking for the trait. "Low" refers to animals in the 10$^{th}$ percentile or less of that phenotypic measurement based on the numeric ranking of the trait.

In certain aspects of the invention directed at methods for inferring traits such as the traits listed in Tables 1A and 1B, nucleotide occurrences are determined for one or more associated SNPs. Therefore, in one aspect, for example, the method is used to infer fat thickness, by determining a nucleotide occurrence of at least one SNP corresponding to the SNPs indicated in Tables 1A and 1B as associated with fat thickness. For this aspect, as a non-limiting example, a nucleotide occurrence of the SNP at position 300 of SEQ ID NO:19473 can be identified and compared to the nucleotide occurrences listed in Tables 1A and 1B 1 for SEQ ID NO:19473. A thymidine residue at position 300 of SEQ ID NO:19473 infers a higher likelihood that the bovine subject will produce meat that has high tenderness. In addition, as a non-limiting example, a nucleotide occurrence at position 300 of SEQ ID NO:19474 can be determined and used alone or in combination with the nucleotide occurrence at position 300 of SEQ ID NO:19473, to infer tenderness. For example, if position 300 of both SEQ ID NO:19473 and SEQ ID NO:19474 are thymidine residues, there is an even greater likelihood that the bovine subject will produce meat that has high tenderness, than for either nucleotide occurrence alone.

In another aspect, the method is used to infer retail yield, by determining a nucleotide occurrence of at least one SNP corresponding to the SNPs indicated in Table 1A as associated with retail yield. In another aspect, the method is used to infer marbling by determining a nucleotide occurrence of at least one SNP corresponding to the SNPs indicated in Table 1A as associated with marbling. In another aspect, the method is used to infer daily gain, by determining a nucleotide occurrence of at least one SNP corresponding to the SNPs indicated in Table 1A as associated with daily gain.

For any trait, a "relatively high" characteristic, indicates greater than average, and a "relatively low" characteristic indicates less than average. For example "relatively high marbling", indicates more abundant marbling than average marbling for a bovine population. Conversely, "relatively low marbling", indicates less abundant marbling than average marbling for a bovine population. Furthermore, in certain aspects, methods of the present invention infer that a bovine subject has a significant likelihood of having a value for a trait that is within, for example, the 5th, 10th, 20th, 25th, 30th, 40th, 50th, 60th, 70th, 75th, 80th, 90th, or 95th percentile of bovine subjects for a given trait. For example, a method presented herein can provide an inference that a bovine subject has a significant likelihood of having a marbling value that is within the 10th percentile of marbling for a bovine population. SNP nucleotide occurrences listed in Tables 1A and 1B as associated with a "high" trait characteristic (e.g., high tenderness) are likely to be associated with a value greater than a 50th percentile of the bovine population for the relevant trait, and in certain aspects, in the at least 90th percentile. SNP nucleotide occurrences listed in Tables 1A and 1B as associated with a "low" trait characteristic (e.g., low tenderness) are likely to be associated with a value less than a 50th percentile of the bovine population for the relevant trait, and in certain aspects, less than or equal to the 10th percentile.

In one aspect, the methods of the invention can be utilized in combination with various hypermutable sequences, such as microsatellite nucleic acid sequences to infer traits of bovine subjects. As used herein, the term "hypermutable" refers to a nucleic acid sequence that is susceptible to instability, thus resulting in nucleic acid alterations. Such alterations include the deletion and addition of nucleotides. The hypermutable sequences of the invention are most often microsatellite DNA sequences which, by definition, are small tandem repeat DNA sequences. Thus, a combination of SNP analysis and microsatellite analysis may be used to infer a trait(s) of a bovine subject.

In another embodiment, the present invention provides a method for determining a nucleotide occurrence of a polymorphism in a bovine sample, wherein polymorphism corresponds to position 300 of any one of SEQ ID NOS:19473 to 21982. In one aspect, the nucleotide occurrence is determined by contacting a bovine polynucleotide in the sample with an oligonucleotide that binds to a target region of any one of SEQ ID NOS:24493 to 64886, wherein the target region comprises a position corresponding to position 300 of any one of SEQ ID NOS:19473 to 21982 or wherein the target region is within 3000 nucleotides of a nucleotide corresponding to position 300 of any one of SEQ ID NOS:19473 to 21982, and determining the nucleotide occurrence of a single nucleotide polymorphism (SNP) corresponding to position 300 of any one of SEQ ID NOS:19473 to 21982. The determination typically includes analyzing binding of the oligonucleotide or detecting an amplification product generated using the oligonucleotide.

In certain aspects, the target region is within 3000, 2000, 1500, 1000, 750, 500, 250, 200, 150, 100, 75, 50, 40, 30, 20 10, 9, 8, 8, 7, 6, 5, 4, 3, 2, or 1 nucleotide of a nucleotide corresponding to position 300 of any one of SEQ ID NOS: 19473 to 21982, or the target region includes position 300 of SEQ ID NOS:19473 to 21982. In certain aspects, the target region is any one of SEQ ID NOS:19473 to 21982.

In certain aspects, for example, the oligonucleotide binds to a target sequence that includes one of the SNPs and the nucleotide occurrence is determined based on the binding of the oligonucleotide to the target sequence. Methods for determining nucleotide occurrences at SNPs are disclosed herein. Some of these methods utilize flanking primer pairs. Accordingly, in one aspect, the bovine polynucleotide is contacted with a primer pair, and the nucleotide occurrence is determined using an amplification product generated using the primer pair. One or both of the primers in the primer pair can include a detectable label.

In certain examples, the terminal nucleotide of the oligonucleotide binds to the SNP position. For example, the terminal nucleotide of each oligonucleotide pair can be complementary to a different nucleotide at position 300 of any one of SEQ ID NOS:19473 to 21982 or a complement thereof. In certain aspects, one oligonucleotide is the oligonucleotide of any one of SEQ ID NOS:21983 to 24492.

In certain aspects, the method further includes managing at least one of food intake, diet composition, administration of feed additives or pharmacological treatments such as vaccines, antibiotics, hormones and other metabolic modifiers, age and weight at which diet changes or pharmacological treatments are imposed, days fed specific diets, castration, feeding methods and management, imposition of internal or external measurements and environment of the bovine subject based on the inferred trait. This management results in improved, and in some examples, a maximization of physical characteristic of a bovine subject, for example to obtain a maximum amount of high grade beef from a bovine subject, and/or to increase the chances of obtaining grade USDA Choice or Prime beef, optimize tenderness, and/or maximize retail yield from the bovine subject taking into account the inputs required to reach those endpoints.

The method can be used to discriminate among those animals where growth implants, vitamin E, and other interventions could provide the greatest value. For example, animals that do not have the traits to reach high choice or prime quality grades may be given growth implants until the end of the feeding period, thus maximizing feed efficiency while animals with a propensity to marble may not be implanted at the final stages of the feeding period to ensure maximum fat deposition intramuscularly.

The method also allows a feedlot and processor to predict the quality and yield grades of cattle in the system to optimize marketing of the fed animal or the product to meet target market specification. The method also provides information to the feedlot for purchase decisions based on the predicted economic returns from a specific supplier. Furthermore, The method allows the creation of integrated programs spanning breeders, producers, feedlots, packers and retailers.

Examples of feed additives include antibiotics, flavors and metabolic modifiers. Information from SNPs could influence use of these additives and other pharmacologic treatments depending on cattle genetic potential and stage of growth relative to expected carcass composition. Examples of feeding methods include ad-libitum versus restricted feeding, feeding in confined or non-confined conditions and number of feedings per day. Information from SNPs relative to cattle health, immune status or stress response could be used to influence choice of optimum feeding methods for individual cattle.

In another embodiment, methods are provided for selecting a given animal for shipment at the optimum time, considering the animal's condition, performance and market factors, the ability to grow the animal to its optimum individual potential of physical and economic performance, and the ability to record and preserve each animal's performance history in the feedlot and carcass data from the packing plant for use in cultivating and managing current and future animals for meat production. These methods allow management of the current diversity of cattle to improve the beef product quality and uniformity, thus improving revenue generated from beef sales.

The methods can use a bioeconomic valuation method that establishes the economic value of a bovine subject, or a group of bovine subjects, such as those in a pen, to optimize profits from beef production. Accordingly, in another embodiment, the present invention provides a method for establishing the economic value of a bovine subject. According to the method, an inference is drawn regarding a trait of the bovine subject from a nucleic acid sample of the bovine subject. The inference is drawn by a method that includes identifying nucleotide occurrences for at least one single nucleotide polymorphism (SNP), wherein the nucleotide occurrence is associated with the trait, and wherein the trait affects the value of the bovine subject. Furthermore, the inference, in certain aspects, is drawn by determining the nucleotide occurrence of at least one SNP corresponding to position 300 of SEQ ID NOS:19473 to 21982.

The method, in certain examples, includes identification of the causative mutation influencing the trait directly or the determination of 1 or more SNPs that are in linkage disequilibrium with the associated trait.

The method can include a determination of the nucleotide occurrence of at least 2 SNPs. At least 2 SNPs can form all or a portion of a haplotype, wherein the method identifies a haplotype allele that is in linkage disequilibrium and thus associated with the trait. Furthermore, the method can include identifying a diploid pair of haplotype alleles.

A method according to this aspect of the invention can further include using traditional factors affecting the economic value of the bovine subject in combination with the inference based on nucleotide occurrence data to determine the economic value of the bovine subject.

As used herein, the term "at least one", when used in reference to a gene, SNP, haplotype, or the like, means 1, 2, 3, 4, 5, 6, 7, 8, 9, 10, etc., up to and including all of the haplotype alleles, genes, and/or SNPs of the bovine genome. Reference to "at least a second" gene, SNP, or the like, means two or more, i.e., 2, 3, 4, 5, 6, 7, 8, 9, 10, etc., bovine genes, SNPs, or the like.

Polymorphisms are allelic variants that occur in a population that can be a single nucleotide difference present at a locus, or can be an insertion or deletion of one, a few or many consecutive nucleotides. As such, a single nucleotide polymorphism (SNP) is characterized by the presence in a population of one or two, three or four nucleotides (i.e., adenosine, cytosine, guanosine or thymidine), typically less than all four nucleotides, at a particular locus in a genome such as the human genome. It will be recognized that, while the methods of the invention are exemplified primarily by the detection of SNPs, the disclosed methods or others known in the art similarly can be used to identify other types of bovine polymorphisms, which typically involve more than one nucleotide.

The term "haplotypes" as used herein refers to groupings of two or more SNPs that are physically present on the same chromosome which tend to be inherited together except when recombination occurs. The haplotype provides information regarding an allele of the gene, regulatory regions or other genetic sequences affecting a trait The linkage disequilibrium and, thus, association of a SNP or a haplotype allele(s) and a bovine trait can be strong enough to be detected using simple genetic approaches, or can require more sophisticated statistical approaches to be identified.

Numerous methods for identifying haplotype alleles in nucleic acid samples are known in the art. In general, nucleic acid occurrences for the individual SNPs are determined and then combined to identify haplotype alleles. There are several algorithms for haplotype reconstruction based on pedigree analysis. These are the Maximum Likelihood method ((Excofier, L., and Slatkin, M., *Mol. Biol. Evol.* 12: 921-927 (1995)), the parsimony method created by Clark, A. G., *Mol. Biol. Evol.* 7: 111-122 (1990) and the phase reconstruction method of Stephens, M., et al., *Am. J. Hum. Genet.* 68:978-989, 2001, which is incorporated herein by reference) can be applied to the data generated regarding individual nucleotide occurrences in SNP markers of the subject, in order to determine alleles for each haplotype in a subject's genotype. Alternatively, haplotypes can also be determined directly, for each pair of sites, by allele-specific PCR (Clark, A. G. et al., *Am. J. Hum. Genet.* 63: 595-612 (1998).

As used herein, the term "infer" or "inferring", when used in reference to a trait, means drawing a conclusion about a trait using a process of analyzing individually or in combination, nucleotide occurrence(s) of one or more SNP(s), which can be part of one or more haplotypes, in a nucleic acid sample of the subject, and comparing the individual or combination of nucleotide occurrence(s) of the SNP(s) to known relationships of nucleotide occurrence(s) of the SNP(s) and the trait. As disclosed herein, the nucleotide occurrence(s) can be identified directly by examining nucleic acid molecules, or indirectly by examining a polypeptide encoded by a particular gene where the polymorphism is associated with an amino acid change in the encoded polypeptide.

Relationships between nucleotide occurrences of one or more SNPs or haplotypes and a trait can be identified using known statistical methods. A statistical analysis result which shows an association of one or more SNPs or haplotypes with a trait with at least 80%, 85%, 90%, 95%, or 99%, or 95% confidence, or alternatively a probability of insignificance less than 0.05, can be used to identify SNPs and haplotypes. These statistical tools may test for significance related to a null hypothesis that an on-test SNP allele or haplotype allele is not significantly different between groups with different traits. If the significance of this difference is low, it suggests the allele is not related to a trait.

As another example, associations between nucleotide occurrences of one or more SNPs or haplotypes and a trait (i.e. selection of significant markers) can be identified using a two part analysis in the first part, DNA from animals at the extremes of a trait are pooled, and the allele frequency of one or more SNPs or haplotypes for each tail of the distribution is estimated. Alleles of SNPs and/or haplotypes that are apparently associated with extremes of a trait are identified and are used to construct a candidate SNP and/or haplotype set. Statistical cut-offs are set relatively low to assure that significant SNPs and/or haplotypes are not overlooked during the first part of the method.

During the second stage, individual animals are genotyped for the candidate SNP and/or haplotype set. The second stage is set up to account for as much of the genetic variation as possible in a specific trait without introducing substantial error. This is a balancing act of the prediction process. Some animals are predicted with high accuracy and others with low accuracy.

In diploid organisms such as bovines, somatic cells, which are diploid, include two alleles for each single-locus haplotype. As such, in some cases, the two alleles of a haplotype are referred to herein as a genotype or as a diploid pair, and the analysis of somatic cells, typically identifies the alleles for each copy of the haplotype. Methods of the present invention can include identifying a diploid pair of haplotype alleles. These alleles can be identical (homozygous) or can be different (heterozygous). Haplotypes that extend over multiple loci on the same chromosome include up to 2 to the Nth power alleles where N is the number of loci. It is beneficial to express polymorphisms in terms of multi-locus (i.e. multi SNP) haplotypes because haplotypes offer enhanced statistical power for genetic association studies. Multi-locus haplotypes can be precisely determined from diploid pairs when the diploid pairs include 0 or 1 heterozygous pairs, and N or N−1 homozygous pairs. When multi-locus haplotypes cannot be precisely determined, they can sometimes be inferred by statistical methods. Methods of the invention can include identifying multi-locus haplotypes, either precisely determined, or inferred.

A sample useful for practicing a method of the invention can be any biological sample of a subject, typically a bovine subject, that contains nucleic acid molecules, including portions of the gene sequences to be examined, or corresponding encoded polypeptides, depending on the particular method. As such, the sample can be a cell, tissue or organ sample, or can be a sample of a biological material such as a body fluid, for example blood, milk, semen, saliva, or can be hair, tissue, and the like. A nucleic acid sample useful for practicing a method of the invention can be deoxyribonucleic (DNA) acid or ribonucleic acids (RNA). The nucleic acid sample generally is a deoxyribonucleic acid sample, particularly genomic DNA or an amplification product thereof. However, where heteronuclear ribonucleic acid which includes unspliced mRNA precursor RNA molecules and non-coding regulatory molecules such as RNA is available, a cDNA or amplification product thereof can be used.

Where each of the SNPs of the haplotype is present in a coding region of a gene(s), the nucleic acid sample can be DNA or RNA, or products derived therefrom, for example, amplification products. Furthermore, while the methods of the invention generally are exemplified with respect to a nucleic acid sample, it will be recognized that particular haplotype alleles can be in coding regions of a gene and can result in polypeptides containing different amino acids at the positions corresponding to the SNPs due to non-degenerate codon changes. As such, in another aspect, the methods of the invention can be practiced using a sample containing polypeptides of the subject.

In one embodiment, DNA samples are collected and stored in a retrievable barcode system, either automated or manual, that ties to a database. Collection practices include systems for collecting tissue, hair, mouth cells or blood samples from individual animals at the same time that ear tags, electronic identification or other devices are attached or implanted into the animal. Tissue collection devices can be integrated into the tool used for placing the ear tag. Body fluid samples are collected and can be stored on a membrane bound system. All methods could be automatically uploaded into a primary database.

The sample is then analyzed on the premises or sent to a laboratory where a high-throughput genotyping system is used to analyze the sample. Traits are predicted in the field, in real-time, or in the laboratory and forwarded electronically to a feedlot. The feedlot then uses this information to sort and manage animals to maximize profitability and marketing potential.

The present invention can also be used to provide information to breeders to make breeding, mating, and or cloning decisions. This invention can also be combined with traditional genetic evaluation methods to improve selection, mating, or cloning strategies.

The subject of the present invention can be any bovine subject, for example a bull, a cow, a calf, a steer, or a heifer or any bovine embryo or tissue, and includes all breeds of bovines. For methods of the invention directed at sorting bovine subjects, managing bovine subjects, improving profits related to selling beef from a bovine subject, the animal can be a young bovine subject ranging in ages from conception to the time the animal is harvested and beef and other commercial products obtained. The method of the present invention can be performed after the animal is purchased and first enters the feedlot.

A "trait" is a characteristic of an organism that manifests itself in a phenotype. Many traits are the result of the expression of a single gene, but some are polygenic (i.e., result from simultaneous expression of more than one gene). A "phenotype" is an outward appearance or other visible characteristic of an organism. Many different non-bovine livestock traits can be inferred by methods of the present invention. Traits analyzed in methods of the present invention include, but are not limited to, marbling, tenderness, quality grade, quality yield, muscle content, fat thickness, feed efficiency, red meat yield, average daily weight gain, disease resistance, disease susceptibility, feed intake, protein content, bone content, maintenance energy requirement, mature size, amino acid profile, fatty acid profile, milk production, hide quality, susceptibility to the buller syndrome, stress susceptibility and response, temperament, digestive capacity, production of calpain, calpastatin and myostatin, pattern of fat deposition, ribeye area, fertility, ovulation rate, conception rate, fertility, heat tolerance, environmental adaptability, robustness, susceptibility to infection with and shedding of pathogens such as *E. Coli, Salmonella* sp. and other human pathogens.

Methods of the present invention can be used to infer more than one trait. For example a method of the present invention can be used to infer a population of traits. Accordingly, a method of the present invention can infer, for example, quality grade, muscle content, and feed efficiency. This inference can be made using one SNP or a population or series of SNPs. Thus, a single SNP can be used to infer multiple traits; multiple SNPs can be used to infer multiple traits; or a single SNP can be used to infer a single trait. Where certain traits have either positive or negative correlations to each other, the methods allow identification of all SNPs that enhance or uncouple the correlation.

In another aspect, the present invention provides a method for improving profits related to selling beef from a bovine subject. The method includes drawing an inference regarding a trait of the bovine subject from a nucleic acid sample of the bovine subject. The method is typically performed by a method that includes identifying a nucleotide occurrence for at least one single nucleotide polymorphism (SNP), wherein the nucleotide occurrence is associated with the trait, and wherein the trait affects the value of the animal or its products. Furthermore, the method includes managing at least one of food intake, diet composition, administration of feed additives or pharmacological treatments such as vaccines, antibiotics, hormones and other metabolic modifiers, age and weight at which diet changes or pharmacological treatments are imposed, days fed specific diets, castration, feeding methods and management, imposition of internal or external measurements and environment of the bovine subject based on the inferred trait. Then at least one bovine commercial product, typically meat or milk, is obtained from the bovine subject.

Methods according to this aspect of the present invention can utilize a bioeconomic model, such as a model that estimates the net value of one or more bovine subjects based on one or more traits. By this method, traits of one, or a series of traits are inferred, for example, an inference regarding several characteristics of beef that will be obtained from the bovine subject. This inference is typically made before the bovine subjects enter the feedlot. The inferred trait information then can be entered into a model that uses the information to estimate a value for the bovine subject, or beef from the bovine subject, based on the traits. The model is typically a computer model. Values for the bovine subjects can be used to segregate the animals. Furthermore, various parameters that can be controlled during maintenance and growth of the bovine subjects can be input into the model in order to affect the way the animals are raised in order to obtain maximum value for the bovine subject when it is harvested.

In certain embodiments, meat or milk can be obtained at a time point that is affected by the inferred trait and one or more of the food intake, diet composition, and management of the bovine subject. For example, where the inferred trait of a bovine subject is high feed efficiency, which can be identified in quantitative or qualitative terms, meat or milk can be obtained at a time point that is sooner than a time point for a bovine subject with low feed efficiency. As another example, bovine subjects with different feed efficiencies can be separated, and those with lower feed efficiencies can be implanted with growth promotants or fed metabolic partitioning agents in order to maximize the profitability of a single bovine subject.

In another aspect, the present invention provides methods that allow effective measurement and sorting of animals individually, accurate and complete record keeping of genotypes and traits or characteristics for each animal, and production of an economic end point determination for each animal using growth performance data. Accordingly, the present invention provides a method for sorting bovine subjects. The method includes inferring a trait for both a first bovine subject and a second bovine subject from a nucleic acid sample of the first bovine subject and the second bovine subject. The inference is made by a method that includes identifying the nucleotide occurrence of at least one single nucleotide polymorphism (SNP), wherein the nucleotide occurrence is associated with the trait. The method further includes sorting the first bovine subject and the second bovine subject based on the inferred trait.

The method can further include measuring a physical characteristic of the first bovine subject and the second bovine subject, and sorting the first bovine subject and the second bovine subject based on both the inferred trait and the measured physical characteristic. The physical characteristic can be, for example, weight, breed, type or frame size, and can be measured using many methods known in the art, such as by using ultrasound.

In another aspect, the present invention provides methods that use analysis of bovine genetic variation to improve the genetics of the cattle population to produce animals with consistent desirable characteristics, such as animals that yield a high percentage of lean meat and a low percentage of fat efficiently. Accordingly, in one aspect the present invention provides a method for selection and breeding of bovine subjects for a trait. The method includes inferring the genetic potential for a trait or a series of traits in a group of bovine candidates for use in breeding programs from a nucleic acid sample of the bovine candidates. The inference is made by a method that includes identifying the nucleotide occurrence of at least one single nucleotide polymorphism (SNP), wherein the nucleotide occurrence is associated with the trait or traits. Individuals are then selected from the group of candidates with a desired performance for the trait or traits for use in breeding programs. Progeny resulting from mating of selected parents would contain the optimum combination of traits, thus creating an enduring genetic pattern and line of animals with specific traits. These lines could be monitored for purity using the original SNP markers and could be identified from the entire population of bovines and protected from genetic theft.

In another aspect the present invention provides a method for cloning a bovine subject with a specific trait or series of traits. The method includes identifying nucleotide occurrences of at least one or at least two SNPs for the bovine subject, isolating a progenitor cell from the bovine subject, and generating a cloned bovine from the progenitor cell. The method can further include before identifying the nucleotide occurrences, identifying the trait of the bovine subject, wherein the bovine subject has a desired trait and wherein the at least one or at least two SNPs affect the trait.

Methods of cloning cattle are known in the art and can be used for the present invention. (See e.g., Bondioli, "Commercial cloning of cattle by nuclear transfer", In: Symposium on Cloning Mammals by Nuclear Transplantation, Seidel (ed), pp. 35-38, (1994); Willadsen, "Cloning of sheep and cow embryos," *Genome,* 31:956, (1989); Wilson et al., "Comparison of birth weight and growth characteristics of bovine calves produced by nuclear transfer (cloning), embryo transfer and natural mating", *Animal Reprod. Sci.,* 38:73-83, (1995); and Barnes et al., "Embryo cloning in cattle: The use of in vitro matured oocytes", *J. Reprod. Fert.,* 97:317-323, (1993)). These methods include somatic cell cloning (See e.g., Enright B. P. et al., "Reproductive characteristics of cloned heifers derived from adult somatic cells," *Biol. Reprod.,* 66:291-6 (2002); Bruggerhoff K., et al., "Bovine somatic cell nuclear transfer using recipient oocytes recovered by ovum pick-up: effect of maternal lineage of oocyte donors," *Biol. Reprod.,* 66:367-73 (2002); Wilmut, I., et al., "Somatic cell nuclear transfer," *Nature,* 419:583 (2002); Galli, C., et al., "Bovine embryo technologies," *Theriogenology,* 59:599 (2003); Heyman, Y., et al., "Novel approaches and hurdles to somatic cloning in cattle," *Cloning Stem Cells,* 4:47 (2002)).

Furthermore, methods have been reported for culturing bovine embryonic stem cells (See e.g., Saito, et al., "Bovine embryonic stem cell-like cell lines cultured over several passages," *Roux's Arch. Dev. Biol.,* 201:i34-i40, 1992). These cells can be used to produce tissues with predetermined characteristics based on SNP information using the methods of the present invention.

This invention identifies animals that have superior traits, predicted very accurately, that can be used to identify parents of the next generation through selection. These methods can be imposed at the nucleus or elite breeding level where the improved traits would, through time, flow to the entire population of animals, or could be implemented at the multiplier or foundation parent level to sort parents into most genetically desirable. This invention provides a method for determining the optimum male and female parent to maximize the genetic components of dominance and epistasis thus maximizing heterosis and hybrid vigor in the market animals.

In another aspect, the present invention provides a bovine subject resulting from the selection and breeding aspect or the cloning aspect of the invention, discussed above.

In another aspect, the present invention provides a method of tracking meat of a bovine subject. The method includes identifying nucleotide occurrences for a series of genetic markers of the bovine subject, identifying the nucleotide occurrences for the series of genetic markers for a meat sample, and determining whether the nucleotide occurrences of the bovine subject are the same as the nucleotide occurrences of the meat sample. In this method identical nucleotide occurrences indicate that the meat sample is from the bovine subject. The tracking method provides, for example, a method for historical and epidemiological tracking the location of an animal from embryo to birth through its growth period, to the feedlot and harvest and finally the retail product after the it has reached the consumer.

The series of genetic markers can be a series of single nucleotide polymorphisms (SNPs). The method can further include comparing the results of the above determination with a determination of whether the meat is from the bovine subject made using another tracking method. In this embodiment, the present invention provides quality control information that improves the accuracy of tracking the source of meat by a single method alone.

The nucleotide occurrence data for the bovine subject can be stored in a computer readable form, such as a database. Therefore, in one example, an initial nucleotide occurrence determination can be made for the series of genetic markers for a young bovine subject and stored in a database along with information identifying the bovine subject. Then, after meat from the bovine subject is obtained, possibly months or years after the initial nucleotide occurrence determination, and before and/or after the meat is shipped to a customer such as, for example, a wholesale distributor, a sample can be obtained from the meat and nucleotide occurrence information determined using methods discussed herein. The database can then be queried using a user interface as discussed herein, with the nucleotide occurrence data from the meat sample to identify the bovine subject.

A series of markers or a series of SNPs as used herein, can include a series of at least 2, 3, 4, 5, 6, 7, 8, 9, 10, 15, 20, 25, 30, 35, 40, 45, 50, 75, 100, 150, 200, 250, 500, 1000, 2000, 2500, 5000, or 6000 markers, for example.

In another aspect, the present invention provides a method for diagnosing a health condition of a bovine subject. The method includes drawing an inference regarding a trait of the bovine subject for the health condition, from a nucleic acid sample of the subject. The inference is drawn by identifying, in the nucleic acid sample, at least one nucleotide occurrence of a single nucleotide polymorphism (SNP), wherein the nucleotide occurrence is associated with the trait.

The nucleotide occurrence of at least 2 SNPs can be determined. The at least 2 SNPs can form a haploytpe, wherein the method identifies a haplotype allele that is associated with the trait. The method can include identifying a diploid pair of haplotype alleles for one or more haplotypes.

The health condition for this aspect of the invention, is resistance to disease or infection, susceptibility to infection with and shedding of pathogens such as *E. Coli, salmonella, listeria*, prion diseases, and other organisms potentially pathogenic to humans, regulation of immune status and response to antigens, susceptibility to bloat, liver abscess or the buller syndrome, previous exposure to infection or parasites, or health of respiratory and digestive tissues.

The present invention in another aspect provides a method for inferring a trait of a bovine subject from a nucleic acid sample of the subject, that includes identifying, in the nucleic acid sample, at least one nucleotide occurrence of a single nucleotide polymorphism (SNP). The nucleotide occurrence is associated with the trait, thereby allowing an inference of the trait.

These embodiments of the invention are based, in part, on a determination that single nucleotide polymorphisms (SNPs), including haploid or diploid SNPs, and haplotype alleles, including haploid or diploid haplotype alleles, allow an inference to be drawn as to the trait of a subject, particularly a bovine subject.

Accordingly, methods of the invention can involve determining the nucleotide occurrence of at least 2, 3, 4, 5, 10, 20, 30, 40, 50, etc. SNPs. The SNPs can form all or part of a haploytpe, wherein the method can identify a haplotype allele that is associated with the trait. Furthermore, the method can include identifying a diploid pair of haplotype alleles.

In another embodiment, the present invention provides a method for identifying a bovine genetic marker that influences at least one trait by analyzing bovine genetic markers of a genome-wide genetic marker map for association with the trait. The genetic marker can be a single nucleotide polymorphism (SNP), or can be at least two SNPs that influence the trait. Because the method can identify at least two SNPs, and in some embodiments, many SNPs, the method can identify not only additive genetic components, but non-additive genetic components such as dominance (i.e. dominating trait of an allele of one gene over an allele of a another gene) and epistasis (i.e. interaction between genes at different loci). Furthermore, the method can uncover pleiotropic effects of SNP alleles (i.e. SNP alleles or haplotypes effects on many different traits), because many traits can be analyzed for their association with many SNPs using methods disclosed herein.

In one aspect, expression products of genes near the at least two identified genetic markers are analyzed, to determine whether the expression products interact. In certain aspects, at least 2 SNPs are identified for inferring the genetic potential of a bovine animal for one, two, or more traits. At least 2 of the single nucleotide polymorphisms are located on different chromosomes. Furthermore, at least 2 of the single nucleotide polymorphisms can be separated by at least 10,000 base pairs on the bovine genome. In certain examples, at least 2 of the single nucleotide polymorphisms occur in different genes.

Accordingly, the present invention provides methods for identifying genes, chromosomal regions and SNP markers in bovine animals that account for a large proportion of the additive and non-additive genetic variation observed for any trait that has a genetic component. The methods and systems of the present invention utilize information regarding genetic diversity among cattle, particularly single nucleotide polymorphisms (SNPs), and the effect of nucleotide occurrences of SNPs on economically important traits.

The present invention provides methods to allow the simultaneous discovery of any and all SNP markers that associate with one or more traits in one or more regions throughout the entire genome. Furthermore, the present invention provides methods for utilization of the predictive diagnostic to determine the genetic potential of an animal to express any targeted trait(s). The genetic potential of a bovine animal to express multiple economically important traits, termed the molecular breeding and selection value, is utilized to enhance the efficiency and accuracy of breeding, sorting and cloning of animals.

The present invention provides methods for developing a high-density genetic map of the bovine genome based on single nucleotide polymorphic (SNP) markers. The high-density genetic map is created through a whole genome sequence of the bovine genome using the shotgun sequencing approach. Shotgun sequencing is performed with several different bovine individuals that represent different breed types. Upon whole genome assembly of the sequenced fragments all sequence variants are identified and cataloged. Sequence variants that differ by a single nucleotide become candidate SNP markers for the high-density map. The relative position of each candidate SNP within the bovine genome is determined by using the assembled human genome as scaffolding. Candidate SNPs are chosen based on their locations so that the map is evenly distributed across the bovine genome. The invention includes methods for creating an evenly distributed genetic SNP map where the average genetic distance between any two adjacent markers is 0.5 cM (i.e. 500,000 nucleotides).

Furthermore, in one embodiment, the present invention provides methods for utilizing a high-density genetic SNP map in the performance of whole genome association studies in bovine animals and the identification of statistically significant associations between specific SNPs and targeted traits. The invention provides methods for inferring the effect of the associated SNP on the target trait through allele frequency differences in the SNP. Furthermore, the invention provides methods for identifying all SNPs that are adjacent to or in close proximity to the associated SNP and ascertaining the effect these SNPs have on the target trait, as disclosed in more detail hereinbelow.

The invention provides methods for pooling DNA samples from bovine individuals that represent high and low phenotypic extremes for the expression of a target trait in a population of bovine animals. The target trait can be any trait that has a genetic component and where phenotypic differences for the trait can be measured in bovine animals, for example marbling, tenderness, fat thickness, yield, daily gain, or meat quality grade.

The invention provides methods for identifying all genomic regions, and any SNP or set of SNPs contained in these regions, that effect the expression of a target trait. For example, an inference can be drawn regarding a beef characteristic such as marbling or red meat yield and allele frequency differences in one or more SNPs.

The methods infer the discovery of one or more, and in some cases, all SNPs that show association to a target trait and therefore, account for a large proportion of the genetic variation observed in the expression of the trait in a population of bovine animals. The methods allow identification of SNPs that account for additive as well as non-additive genetic variation, such as dominance and epistasis, observed in the expression of the trait.

The methods infer the discovery of any and all SNPs that show association to one or more target traits. Furthermore, whereby certain traits have either positive or negative correlations to each other, the methods allow identification of all SNPs that enhance or uncouple the correlation. For example, the presence of external fat on beef carcasses is highly correlated with marbling or intramuscular fat. External fat is an undesirable trait that causes discounts in beef carcasses, whereas marbling is a desirable trait that results in premiums. The present invention provides methods for the identification of all SNPs that may uncouple the correlation between external fat and marbling, for example.

In another aspect, the present invention provides a method for developing a predictive diagnostic through the identification of one or more, and in certain aspects all SNPs that are associated with multiple traits having economic significance in bovines, and any and all SNPs that affect any single trait that are located throughout the entire bovine genome. The methods of the invention result in the development of a predictive diagnostic system for determining the genetic potential of individual animals for any trait that has a genetic component.

In another aspect, the present invention provides a method for utilizing a predictive diagnostic to determine the genetic potential of a bovine animal for multiple traits located across multiple genomic regions. The genetic potential determination for the expression of multiple traits in a bovine animal is referred to as the molecular breeding and selection value. The present invention provides methods for using the molecular breeding and selection value to enhance efficiencies and accuracy of breeding, sorting, purchasing and cloning of individual animals.

Accordingly, nucleotide occurrences can be determined for essentially all, or all of the SNPs of a high-density, whole genome SNP map. This approach has the advantage over traditional approaches in that since it encompasses the whole genome, it identifies potential interactions of gene products expressed from genes located anywhere on the genome without requiring preexisting knowledge regarding a possible interaction between the gene products. An example of a high-density, whole genome SNP map is a map of at least about 1 SNP per 10,000 kb, at least 1 SNP per 500 kb or about 10 SNPs per 500 kb, or at least about 25 SNPs or more per 500 kb. Definitions of densities of markers may change across the genome and are determined by the degree of linkage disequilibrium from marker to marker.

In another embodiment of the invention, a method is provided for identifying SNPs that are associated with a trait by using the associated SNPs disclosed herein. The method is based on the fact that other markers in close proximity to the associated SNP marker will also associate with the trait because markers in linkage disequilibrium with the associated SNP marker will also be in linkage disequilibrium with the gene(s) influencing the trait. SNPs in linkage disequilibrium can be used in lieu of determining a SNP or mutation to predict the presence or absence of a phenotypic trait or contributor to a phenotypic trait. Accordingly, in certain embodiments, the present invention provides a method for identifying a SNP associated with a trait, that includes identifying a test SNP that is in disequilibrium with a SNP corresponding to position 300 of SEQ ID NOS:19473 to 21982.

As illustrated in the Examples section, it has been determined that disequilibrium exists across the region of 500,000 bp from the associated SNP in each direction. Other markers within this 500,000 bp region will also be in disequilibrium with the associated SNP and with the trait of interest, and can be used to infer associations with the trait of interest. Genomic segments containing the markers can be adjacent to the associated SNP marker or contained within a separate island of sequence distant from the associated SNP.

Genetic markers within 500,000 bp of the associated SNPs disclosed herein in Tables 1A and 1B (position 300 of SEQ ID NOS:19473 to 21982), can be discovered by a number of different methods known in the art. In one aspect of the invention, bovine sequence that is within 500,000 bp of the associated SNP can be used to identify new DNA markers. This sequence can be created from whole-genome shotgun sequencing, BAC-sequencing, or sequence generated from comparative maps. The bovine sequence can be used to develop bovine specific sequencing primers. These primers can be used to sequence at least 2 individual bovine animals and the alignments from these sequences can be used to identify SNP markers and microsatellite markers.

New markers can also be discovered using heterologous sequences from other mammalian species. Degenerative primers are developed from regions of known homology among species and used in PCR. Amplification products are sequenced and used to develop bovine specific primers.

These new markers can be genotyped in pools of animals or individual animals representing the high and low ends of the phenotypic distribution for the trait to determine association between the new marker(s) and the trait. Markers with a significantly different allele frequency in the high and low groups are also in disequilibrium with the trait.

Accordingly, in another embodiment, the present invention provides a method for identifying a bovine single nucleotide polymorphism (SNP) associated with a trait that includes identifying a test SNP in a target region of a bovine genome, wherein the target region is less than or equal to about 500,000 nucleotides from a SNP position corresponding to position 300 of one of SEQ ID NOS:19473 to 21982, and identifying an association of the test SNP to the trait. In certain aspects, the target region consists of at least 20 contiguous nucleotides of SEQ ID NOS:24493 to 64886. In other aspects, the target region consists of at least 20 contiguous nucleotides of SEQ ID NOS:19473 to 21982.

In certain aspects, the test SNP is located less than or equal to about 500,000, 400,000, 300,000, 250,000, 200,000, 100,000, 50,000, 25,000, 10,000, 5,000, 1,000, or 100 nucleotides from a position corresponding to position 300 of at least one of SEQ ID NOS:19473 to 21982. The test SNP is expected to be associated with the same trait as a SNP that corresponds to position 300 of SEQ ID NOS:19473 to 21982 that is located less than or equal to about 500,000 nucleotides from the test SNP, as discussed further herein.

The trait can be any bovine trait as discussed herein. For example, the trait can be marbling, tenderness, quality grade, muscle content, fat thickness, feed efficiency, red meat yield, average daily weight gain, disease resistance, disease susceptibility, feed intake, protein content, bone content, maintenance energy requirement, mature size, amino acid profile, fatty acid profile, milk production, susceptibility to the buller syndrome, stress susceptibility and response, temperament, digestive capacity, production of calpain, caplastatin and myostatin, pattern of fat deposition, ribeye area, fertility, ovulation rate, conception rate, fertility, susceptibility to infection with or shedding of pathogens. In certain specific examples, the trait is fat thickness, retail yield, tenderness, marbling, or average daily gain.

In another embodiment, the present invention provides a method for identifying a bovine gene associated with a trait, by identifying an open reading frame present in a target region of the bovine genome, wherein the target region is located on the bovine genome less than or equal to about 500,000 nucleotides of a single nucleotide polymorphism (SNP) corresponding to position 300 of any one of SEQ ID NOS:19473 to 21982, and analyzing the open reading frame to determine whether it affects the trait.

In certain aspects, the target region is located less than or equal to about 500,000, 400,000, 300,000, 250,000, 200,000, 100,000, 50,000, 25,000, 10,000, 5,000, 1,000, 100, or 50 nucleotides from a single nucleotide polymorphism (SNP) corresponding to position 300 of any one of SEQ ID NOS: 19473 to 21982.

It will be recognized that a variety of methods can be used to determine whether the open reading frame affects a trait. For example, biochemical methods can be performed to determine a biochemical function for the product of the open gene product. The biochemical function can be compared to known biochemical functions related to the trait. Furthermore, the open reading frame can be mutated and the affects of the mutations on a target trait can be analyzed.

In another embodiment the present invention provides a method for identifying a target bovine polynucleotide affecting a trait, that includes providing a polynucleotide derived from a bovine subject, or sequence information thereof; and determining whether the polynucleotide is at least 90% identical to a SNP-containing polynucleotide. The determination can be carried out by comparing the polynucleotide or the sequence information to a polynucleotide consisting essentially of:

a) a polynucleotide according to any one of SEQ ID NOS: 19473 to 21982;

b) a contiguous fragment of a polynucleotide according to any one of SEQ ID NOS:24493 to 64886 that is at least 300 nucleotides in length and that comprises a single nucleotide polymorphism corresponding to position 300 of one of SEQ ID NOS:19473 to 21982, wherein the polymorphism is associated with the trait; or c) a complement of a) or b).

If a polynucleotide is identified as at least 90% identical to the SNP-containing polynucleotide, the bovine polynucleotide is a target polynucleotide for the trait.

In certain aspects, the polynucleotide is derived from a bovine subject that includes bovine genomic sequences. In another aspect, the present invention provides an isolated polynucleotide identified according to this method.

The invention, in another aspect includes methods for creating a high density bovine SNP map. The SNP markers and their surrounding sequence are compared to model organisms, for example human and mouse genomes, where the complete genomic sequence is known and syntenic regions identified. The model organism map may serve as a template for ensuring complete coverage of the animal genome. The finished map has markers spaced in such a way to maximize the amount of linkage disequilibrium in a specific genetic region.

This map is used to mark all regions of the chromosomes, in a single experiment, utilizing thousands of experimental animals in an association study, to correlate genomic regions with complex and simple traits. These associations can be further analyzed to unravel complex interactions among genomic regions that contribute to the targeted trait or other traits, epistatic genetic interactions and pleiotropy. The invention of regional high density maps can also be used to identify targeted regions of chromosomes that influence traits.

Accordingly, in embodiments where SNPs that affect the same trait are identified that are located in different genes, the method can further include analyzing expression products of genes near the identified SNPs, to determine whether the expression products interact. As such, the present invention provides methods to detect epistatic genetic interactions. Laboratory methods are well known in the art for determining whether gene products interact.

The method can be useful for inferring a beef characteristic from a nucleic acid sample of the subject animal (i.e., the trait is a characteristic of beef). Beef characteristics that can be inferred by methods of the present invention include, for example, overall quality, marbling, red meat yield, tenderness, and the like. Accordingly, the present invention provides methods for identifying live cattle that have or that lack the genetic potential to produce beef that is well-marbled. Such information could be used by the cattle producer to channel calves into particular feeding regimens and to meet the requirements of specific marketing programs. Such information could also be used to identify cattle that are genetically superior candidates for breeding and/or cloning. Such information could also be used to identify cattle that are genetically inferior candidates to be screened out of a breeding or cloning program.

Where the trait is overall quality, the method can infer an overall average USDA quality grade for beef obtained from the non-bovine livestock subject. For example, the quality grades can include one of the current eight USDA quality grades (i.e., from highest to lowest, prime, choice, select, standard, commercial, utility, cutter and canner). Alternatively, the method can infer the best or the worst quality grade expected for beef obtained from the non-bovine livestock subject. Additionally, as indicated above, the trait can be a characteristic used to classify beef, such as color, texture, firmness, and marbling, a term which is used to describe the relative amount and distribution of intramuscular fat of the beef. Well-marbled and well-distributed beef from steers and heifers, i.e., beef that contains substantial amounts of intramuscular fat relative to muscle, is classified as prime or choice; whereas, beef that is not marbled is classified as select. Beef that is classified as prime or choice, typically, is sold at higher prices than beef that is classified into lower quality grades.

Where the trait is red meat yield, the method can predict the total and percentage of edible product from a harvested animal. For example, Yield grade is assigned to an animal from an estimate of its back fat thickness, kidney-pelvic-heart fat, ribeye area and carcass weight. Grades range from 1 to 5, with 1 being the greatest retail product yield assignment. This method can predict the traits for red meat yield and quality grade and tailor a feeding, management and harvesting program to optimize the value of the animal.

The methods of the present invention that infer a trait can be used in place of present methods used to determine the trait, or can be used to further substantiate a classification of beef using present methods (e.g., visual inspection of a region between the 12th and 13th rib of a beef carcass by a certified USDA grader). Where the trait is tenderness, for example, methods of the present invention can infer from a sample of a bovine subject, such as a live bovine subject, whether beef, if cooked properly, would be tender. The method can be used in place of current post-mortem taste tests or shear force methods, or can be used to improve the accuracy of determinations made by these traditional methods.

In aspects of the present invention directed at identifying a bovine genetic marker that influences a trait, present methods for determining a trait, such as a characteristic of beef, can be used in the methods to identify an association between a genetic marker, typically at least one SNP or haplotype, with a trait. For example, DNA samples from bovine subjects can be obtained, and nucleotide occurrences for at least one SNP in the DNA samples can be determined. Traditional methods can be used to determine the trait. For example, visual inspection of a region between the 12th and 13th rib of a beef carcass can be performed to determine the quality grade of meat obtained from the bovine subject whose nucleotide occurrences are identified. As will be understood, statistical methods can then be used to identify associations between the nucleotide occurrences and the trait. Accordingly, methods of the present invention enables a correlation between carcass value and genetic variation, so as to help identify superior genetic types for future breeding or cloning and management purposes, and to identify management practices that will maximize the value of the arrival in the market.

In another aspect, the present invention provides a method for identifying a bovine gene associated with a trait that includes identifying a bovine single nucleotide polymorphism (SNP) that influences a trait, by analyzing a genome-wide bovine SNP map for association with the trait, wherein the SNP is found on a target region of a bovine chromosome. Genes present on the target region are then identified. The presence of a gene on the target region of the bovine chromosome indicates that the gene is a candidate gene for association with the trait. The candidate gene can then be analyzed using methods known in the art to determine whether it is associated with the trait.

In another aspect, the present invention provides a method for identifying a breed of a bovine subject. The method includes identifying a nucleotide occurrence of a bovine single nucleotide polymorphism (SNP) from a nucleic acid sample of the subject, wherein the nucleotide occurrence is associated with the breed of the subject. The method typically includes identifying nucleotide occurrences of at least two SNPs from the nucleic acid sample, wherein the nucleotide occurrences are associated with the breed of the subject.

In another aspect, the present invention provides a system for determining the nucleotide occurrences at a population of bovine single nucleotide polymorphisms (SNPs). The system typically includes a hybridization medium and/or substrate that includes at least two oligonucleotides of the present invention, or oligonucleotides used in the methods of the present invention. For example, a solid support can be provided, to which a series of oligonucleotides can be directly or indirectly attached. In another aspect, a homogeneous assay is included in the system. In another aspect, a microfluidic device is included in the system. The hybridization medium or substrates are used to determine the nucleotide occurrence of bovine SNPs that are associated with a trait.

Accordingly, the oligonucleotides are used to determine the nucleotide occurrence of bovine SNPs that are associated with a trait. The determination can be made by selecting oligonucleotides that bind at or near a genomic location of each SNP of the series of bovine SNPs. The system of the present invention typically includes a reagent handling mechanism that can be used to apply a reagent, typically a liquid, to the solid support. The binding of an oligonucleotide of the series of oligonucleotides to a polynucleotide isolated from a genome can be affected by the nucleotide occurrence of the SNP. The system can include a mechanism effective for moving a solid support and a detection mechanism. The detection method detects binding or tagging of the oligonucleotides.

Medium to high-throughput systems for analyzing SNPs, known in the art such as the SNPStream® UHT Genotyping System (Beckman/Coulter, Fullerton, Calif.) (Boyce-Jacino and Goelet Patents), the Mass Array™ system (Sequenom, San Diego, Calif.) (Storm, N. et al. (2002) *Methods in Molecular Biology*. 212: 241-262.), the BeadArray™ SNP genotyping system available from Illumina (San Diego, Calif.) (Oliphant, A., et al. (June 2002) (supplement to Biotechniques), and TaqMan™ (Applied Biosystems, Foster City, Calif.) can be used with the present invention. However, the present invention provides a medium to high-throughput system that is designed to detect nucleotide occurrences of bovine SNPs, or a series of bovine SNPs that can make up a series of haplotypes. Therefore, as indicated above the system includes a solid support or other method to which a series of oligonucleotides can be associated that are used to determine a nucleotide occurrence of a SNP for a series of bovine SNPs that are associated with a trait. The system can further include a detection mechanism for detecting binding of the series of oligonucleotides to the series of SNPs. Such detection mechanisms are known in the art.

The system can be a microfluidic device. Numerous microfluidic devices are known that include solid supports with microchannels (See e.g., U.S. Pat. Nos. 5,304,487, 5,110745, 5,681,484, and 5,593,838).

The SNP detection systems of the present invention are designed to determine nucleotide occurrences of one SNP or a series of SNPs. The systems can determine nucleotide occurrences of an entire genome-wide high-density SNP map.

Numerous methods are known in the art for determining the nucleotide occurrence for a particular SNP in a sample. Such methods can utilize one or more oligonucleotide probes or primers, including, for example, an amplification primer pair that selectively hybridizes to a target polynucleotide, which corresponds to one or more bovine SNP positions. Oligonucleotide probes useful in practicing a method of the invention can include, for example, an oligonucleotide that is complementary to and spans a portion of the target polynucleotide, including the position of the SNP, wherein the presence of a specific nucleotide at the position (i.e., the SNP) is detected by the presence or absence of selective hybridization of the probe. Such a method can further include contacting the target polynucleotide and hybridized oligonucleotide with an endonuclease, and detecting the presence or absence of a cleavage product of the probe, depending on whether the nucleotide occurrence at the SNP site is complementary to the corresponding nucleotide of the probe.

An oligonucleotide ligation assay (Grossman, P. D. et al. (1994) *Nucleic Acids Research* 22:4527-4534) also can be used to identify a nucleotide occurrence at a polymorphic position, wherein a pair of probes that selectively hybridize upstream and adjacent to and downstream and adjacent to the site of the SNP, and wherein one of the probes includes a terminal nucleotide complementary to a nucleotide occurrence of the SNP. Where the terminal nucleotide of the probe is complementary to the nucleotide occurrence, selective hybridization includes the terminal nucleotide such that, in the presence of a ligase, the upstream and downstream oligonucleotides are ligated. As such, the presence or absence of a ligation product is indicative of the nucleotide occurrence at the SNP site. An example of this type of assay is the SNPlex System (Applied Biosystems, Foster City, Calif.).

An oligonucleotide also can be useful as a primer, for example, for a primer extension reaction, wherein the product (or absence of a product) of the extension reaction is indicative of the nucleotide occurrence. In addition, a primer pair useful for amplifying a portion of the target polynucleotide including the SNP site can be useful, wherein the amplification product is examined to determine the nucleotide occurrence at the SNP site. Particularly useful methods include those that are readily adaptable to a high throughput format, to a multiplex format, or to both. The primer extension or amplification product can be detected directly or indirectly and/or can be sequenced using various methods known in the art. Amplification products which span a SNP locus can be sequenced using traditional sequence methodologies (e.g., the "dideoxy-mediated chain termination method," also known as the "Sanger Method"(Sanger, F., et al., *J. Molec. Biol.* 94:441 (1975); Prober et al. *Science* 238:336-340 (1987)) and the "chemical degradation method," "also known as the "Maxam-Gilbert method"(Maxam, A. M., et al., *Proc. Natl. Acad. Sci.* (U.S.A.) 74:560 (1977)), both references herein incorporated by reference) to determine the nucleotide occurrence at the SNP locus.

Methods of the invention can identify nucleotide occurrences at SNPs using genome-wide sequencing or "microsequencing" methods. Whole-genome sequencing of individuals identifies all SNP genotypes in a single analysis. Microsequencing methods determine the identity of only a single nucleotide at a "predetermined" site. Such methods have particular utility in determining the presence and identity of polymorphisms in a target polynucleotide. Such microsequencing methods, as well as other methods for determining the nucleotide occurrence at a SNP locus are discussed in Boyce-Jacino, et al., U.S. Pat. No. 6,294,336, incorporated herein by reference, and summarized herein.

Microsequencing methods include the Genetic Bit™ Analysis method disclosed by Goelet, P. et al. (WO 92/15712, herein incorporated by reference). Additional, primer-guided, nucleotide incorporation procedures for assaying polymorphic sites in DNA have also been described (Kornher, J. S. et al, *Nucleic Acids Res.* 17:7779-7784 (1989); Sokolov, B. P., *Nucleic Acids Res.* 18:3671 (1990); Syvanen, A.-C., et al., *Genomics* 8:684-692 (1990); Kuppuswamy, M. N. et al., *Proc. Natl. Acad. Sci.* (U.S.A.) 88:1143-1147 (1991); Prezant, T. R. et al, *Hum. Mutat.* 1:159-164 (1992); Ugozzoli, L. et al., GATA 9:107-112 (1992); Nyren, P. et al., *Anal. Biochem.* 208:171-175 (1993); and Wallace, WO89/10414). These methods differ from Genetic Bit™ Analysis in that they all rely on the incorporation of labeled deoxynucleotides to discriminate between bases at a polymorphic site. In such a format, since the signal is proportional to the number of deoxynucleotides incorporated, polymorphisms that occur in runs of the same nucleotide can result in signals that are proportional to the length of the run (Syvanen, A.-C., et al.

Amer. J. Hum. Genet. (1993) 52:46-59 Other formats for microsequencing include Pyrosequencing (Pyrosequencing AB, Uppsala, Sweden, Alderbom et al (2000) Genome Res. 10:1249-1258).

Alternative microsequencing methods have been provided by Mundy, C. R. (U.S. Pat. No. 4,656,127) and Cohen, D. et al (French Patent 2,650,840; PCT Appln. No. WO91/02087) which discusses a solution-based method for determining the identity of the nucleotide of a polymorphic site. As in the Mundy method of U.S. Pat. No. 4,656,127, a primer is employed that is complementary to allelic sequences immediately 3'-to a polymorphic site.

In response to the difficulties encountered in employing gel electrophoresis to analyze sequences, alternative methods for microsequencing have been developed. Macevicz (U.S. Pat. No. 5,002,867), for example, describes a method for determining nucleic acid sequence via hybridization with multiple mixtures of oligonucleotide probes. In accordance with such method, the sequence of a target polynucleotide is determined by permitting the target to sequentially hybridize with sets of probes having an invariant nucleotide at one position, and variant nucleotides at other positions. The Macevicz method determines the nucleotide sequence of the target by hybridizing the target with a set of probes, and then determining the number of sites that at least one member of the set is capable of hybridizing to the target (i.e., the number of "matches"). This procedure is repeated until each member of a set of probes has been tested.

Boyce-Jacino, et al., U.S. Pat. No. 6,294,336 provides a solid phase sequencing method for determining the sequence of nucleic acid molecules (either DNA or RNA) by utilizing a primer that selectively binds a polynucleotide target at a site wherein the SNP is the most 3' nucleotide selectively bound to the target.

The occurrence of a SNP can be determined using denaturing HPLC such as described in Nairz K et al (2002) *Proc. Natl. Acad. Sci.* (U.S.A.) 99:10575-80, and the Transgenomic WAVE® System (Transgenomic, Inc. Omaha, Nebr.).

Oliphant et al. report a method that utilizes BeadArray™ Technology that can be used in the methods of the present invention to determine the nucleotide occurrence of a SNP (supplement to Biotechniques, June 2002). Additionally, nucleotide occurrences for SNPs can be determined using a DNAMassARRAY system (SEQUENOM, San Diego, Calif.). This system combines proprietary SpectroChips™, microfluidics, nanodispensing, biochemistry, and MALDI-TOF MS (matrix-assisted laser desorption ionization time of flight mass spectrometry).

As another example, the nucleotide occurrences of bovine SNPs in a sample can be determined using the SNP-IT™ method (Beckman Coulter, Fullerton, Calif.). In general, SNP-IT™ is a 3-step primer extension reaction. In the first step a target polynucleotide is isolated from a sample by hybridization to a capture primer, which provides a first level of specificity. In a second step the capture primer is extended from a terminating nucleotide triphosphate at the target SNP site, which provides a second level of specificity. In a third step, the extended nucleotide trisphosphate can be detected using a variety of known formats, including: direct fluorescence, indirect fluorescence, an indirect calorimetric assay, mass spectrometry, fluorescence polarization, etc. Reactions can be processed in 384 well format in an automated format using a SNPstream™ instrument (Beckman Coulter, Fullerton, Calif.). Reactions can also be analyzed by binding to Luminex biospheres (Luminex Corporation, Austin, Tex., Cai. H. (2000) Genomics 66(2):135-43.). Other formats for SNP detection include TaqMan™ (Applied Biosystems, Foster City, Calif.), Rolling circle (Hatch et al (1999) *Genet. Anal.* 15: 35-40; and Qi et al (2001) *Nucleic Acids Research* Vol. 29 e116), fluorescence polarization (Chen, X., et al. (1999) *Genome Research* 9:492-498), SNaPShot (Applied Biosystems, Foster City, Calif.; and Makridakis, N. M. et al. (2001) *Biotechniques* 31:1374-80), oligo-ligation assay (Grossman, P. D., et al. (1994) *Nucleic Acids Research* 22:4527-4534), locked nucleic acids (LNA™, Link, Technologies LTD, Lanarkshire, Scotland, EP patent 1013661, U.S. Pat. No. 6,268,490), Invader Assay (Aclara Biosciences, Wilkinson, D. (1999) *The Scientist* 13:16), padlock probes (Nilsson et al. *Science* (1994), 265: 2085), Sequence-tagged molecular inversion probes (similar to padlock probes) from ParAllele Bioscience (South San Francisco, Calif.; Hardenbol, P. et al. (2003) *Nature Biotechnology* 21:673-678), Molecular Beacons (Marras, S. A. et al. (1999 *Genet Anal.* 14:151-156), the READIT™ SNP Genotyping System from Promega (Madison, Wis.) (Rhodes R. B. et al. (2001) Mol Diagn. 6:55-61), Dynamic Allele-Specific Hybridization (DASH) (Prince, J. A. et al. (2001) *Genome Research* 11:152-162), the Qbead™ system (quantum dot encoded microspheres conjugated to allele-specific oligonucleotides)(Xu H. et al. (2003) *Nucleic Acids Research* 31:e43), Scorpion primers (similar to molecular beacons except unimolecular) (Thelwell, N. et al. (2000) *Nucleic Acids Research* 28:3752-3761), and Magiprobe (a novel fluorescence quenching-based oligonucleotide probe carrying a fluorophore and an intercalator)(Yamane A. (2002) *Nucleic Acids Research* 30:e97). In addition, Rao, K. V. N. et al. ((2003) *Nucleic Acids Research.* 31:e66), recently reported a microsphere-based genotyping assay that detects SNPs directly from human genomic DNA. The assay involves a structure-specific cleavage reaction, which generates fluorescent signal on the surface of microspheres, followed by flow cytometry of the microspheres. With a slightly different twist on the Sequenom technology (MALDI), Sauer et al. ((2003) *Nucleic Acids Research* 31:e63) generate charge-tagged DNA (post PCR and primer extension), using a photocleavable linker.

Accordingly, using the methods described above, the bovine haplotype allele or the nucleotide occurrence of a bovine SNP can be identified using an amplification reaction, a primer extension reaction, or an immunoassay. The bovine haplotype allele or bovine SNP can also be identified by contacting polynucleotides in the sample or polynucleotides derived from the sample, with a specific binding pair member that selectively hybridizes to a polynucleotide region comprising the bovine SNP, under conditions wherein the binding pair member specifically binds at or near the bovine SNP. The specific binding pair member can be an antibody or a polynucleotide.

The nucleotide occurrence of a SNP can be identified by other methodologies as well as those discussed above. For example, the identification can use microarray technology, which can be performed with or without PCR, or sequencing methods such as mass spectrometry, scanning electron microscopy, or methods in which a polynucleotide flows past a sorting device that can detect the sequence of the polynucleotide. The occurrence of a SNP can be identified using electrochemical detection devices such as the eSensor™ DNA detection system (Motorola, Inc., Yu, C. J. (2001) *J. Am Chem. Soc.* 123:11155-11161). Other formats include melting curve analysis using fluorescently labeled hybridization probes, or intercalating dyes (Lohmann, S. (2000) *Biochemica* 4, 23-28, Herrmann, M. (2000) Clinical Chemistry 46: 425).

The SNP detection systems of the present invention typically utilize selective hybridization. As used herein, the term "selective hybridization" or "selectively hybridize," refers to hybridization under moderately stringent or highly stringent conditions such that a nucleotide sequence preferentially associates with a selected nucleotide sequence over unrelated nucleotide sequences to a large enough extent to be useful in identifying a nucleotide occurrence of a SNP. It will be recognized that some amount of non-specific hybridization is unavoidable, but is acceptable provide that hybridization to a target nucleotide sequence is sufficiently selective such that it can be distinguished over the non-specific cross-hybridization, for example, at least about 2-fold more selective, generally at least about 3-fold more selective, usually at least about 5-fold more selective, and particularly at least about 10-fold more selective, as determined, for example, by an amount of labeled oligonucleotide that binds to target nucleic acid molecule as compared to a nucleic acid molecule other than the target molecule, particularly a substantially similar (i.e., homologous) nucleic acid molecule other than the target nucleic acid molecule. Conditions that allow for selective hybridization can be determined empirically, or can be estimated based, for example, on the relative GC:AT content of the hybridizing oligonucleotide and the sequence to which it is to hybridize, the length of the hybridizing oligonucleotide, and the number, if any, of mismatches between the oligonucleotide and sequence to which it is to hybridize (see, for example, Sambrook et al., "Molecular Cloning: A laboratory manual (Cold Spring Harbor Laboratory Press 1989)).

An example of progressively higher stringency conditions is as follows: 2×SSC/0.1% SDS at about room temperature (hybridization conditions); 0.2×SSC/0.1% SDS at about room temperature (low stringency conditions); 0.2×SSC/0.1% SDS at about 42EC (moderate stringency conditions); and 0.1×SSC at about 68EC (high stringency conditions). Washing can be carried out using only one of these conditions, e.g., high stringency conditions, or each of the conditions can be used, e.g., for 10-15 minutes each, in the order listed above, repeating any or all of the steps listed. However, as mentioned above, optimal conditions will vary, depending on the particular hybridization reaction involved, and can be determined empirically.

The term "polynucleotide" is used broadly herein to mean a sequence of deoxyribonucleotides or ribonucleotides that are linked together by a phosphodiester bond. For convenience, the term "oligonucleotide" is used herein to refer to a polynucleotide that is used as a primer or a probe. Generally, an oligonucleotide useful as a probe or primer that selectively hybridizes to a selected nucleotide sequence is at least about 15 nucleotides in length, usually at least about 18 nucleotides, and particularly about 21 nucleotides or more in length.

A polynucleotide can be RNA or can be DNA, which can be a gene or a portion thereof, a cDNA, a synthetic polydeoxyribonucleic acid sequence, or the like, and can be single stranded or double stranded, as well as a DNA/RNA hybrid. In various embodiments, a polynucleotide, including an oligonucleotide (e.g., a probe or a primer) can contain nucleoside or nucleotide analogs, or a backbone bond other than a phosphodiester bond. In general, the nucleotides comprising a polynucleotide are naturally occurring deoxyribonucleotides, such as adenine, cytosine, guanine or thymine linked to 2'-deoxyribose, or ribonucleotides such as adenine, cytosine, guanine or uracil linked to ribose. However, a polynucleotide or oligonucleotide also can contain nucleotide analogs, including non-naturally occurring synthetic nucleotides or modified naturally occurring nucleotides. Such nucleotide analogs are well known in the art and commercially available, as are polynucleotides containing such nucleotide analogs (Lin et al., *Nucleic Acids Research* (1994) 22:5220-5234 Jellinek et al., *Biochemistry* (1995) 34:11363-11372; Pagratis et al., *Nature Biotechnol.* (1997) 15:68-73, each of which is incorporated herein by reference). Primers and probes can also be comprised of peptide nucleic acids (PNA) (Nielsen PE and Egholm M. (1999) *Curr. Issues Mol. Biol.* 1:89-104).

The covalent bond linking the nucleotides of a polynucleotide generally is a phosphodiester bond. However, the covalent bond also can be any of numerous other bonds, including a thiodiester bond, a phosphorothioate bond, a peptide-like bond or any other bond known to those in the art as useful for linking nucleotides to produce synthetic polynucleotides (see, for example, Tam et al., *Nucl. Acids Res*. (1994) 22:977-986, Ecker and Crooke, *BioTechnology* (1995) 13:351360, each of which is incorporated herein by reference). The incorporation of non-naturally occurring nucleotide analogs or bonds linking the nucleotides or analogs can be particularly useful where the polynucleotide is to be exposed to an environment that can contain a nucleolytic activity, including, for example, a tissue culture medium or upon administration to a living subject, since the modified polynucleotides can be less susceptible to degradation.

A polynucleotide or oligonucleotide comprising naturally occurring nucleotides and phosphodiester bonds can be chemically synthesized or can be produced using recombinant DNA methods, using an appropriate polynucleotide as a template. In comparison, a polynucleotide or oligonucleotide comprising nucleotide analogs or covalent bonds other than phosphodiester bonds generally are chemically synthesized, although an enzyme such as T7 polymerase can incorporate certain types of nucleotide analogs into a polynucleotide and, therefore, can be used to produce such a polynucleotide recombinantly from an appropriate template (Jellinek et al., supra, 1995). Thus, the term polynucleotide as used herein includes naturally occurring nucleic acid molecules, which can be isolated from a cell, as well as synthetic molecules, which can be prepared, for example, by methods of chemical synthesis or by enzymatic methods such as by the polymerase chain reaction (PCR).

A method of the identifying a SNP also can be performed using a specific binding pair member. As used herein, the term "specific binding pair member" refers to a molecule that specifically binds or selectively hybridizes to another member of a specific binding pair. Specific binding pair member include, for example, probes, primers, polynucleotides, antibodies, etc. For example, a specific binding pair member includes a primer or a probe that selectively hybridizes to a target polynucleotide that includes a SNP loci, or that hybridizes to an amplification product generated using the target polynucleotide as a template.

As used herein, the term "specific interaction," or "specifically binds" or the like means that two molecules form a complex that is relatively stable under physiologic conditions. The term is used herein in reference to various interactions, including, for example, the interaction of an antibody that binds a polynucleotide that includes a SNP site; or the interaction of an antibody that binds a polypeptide that includes an amino acid that is encoded by a codon that includes a SNP site. According to methods of the invention, an antibody can selectively bind to a polypeptide that includes a particular amino acid encoded by a codon that includes a SNP site. Alternatively, an antibody may preferentially bind a particular modified nucleotide that is incorporated into a SNP site for only certain nucleotide occurrences at the SNP site, for example using a primer extension assay.

A specific interaction can be characterized by a dissociation constant of at least about $1 \times 10^{-6}$ M, generally at least about $1 \times 10^{-7}$ M, usually at least about $1 \times 10^{-8}$ M, and particularly at least about $1 \times 10^{-9}$ M or $1 \times 10^{-10}$ M or greater. A specific interaction generally is stable under physiological conditions, including, for example, conditions that occur in a living individual such as a human or other vertebrate or invertebrate, as well as conditions that occur in a cell culture such as used for maintaining mammalian cells or cells from another vertebrate organism or an invertebrate organism. Methods for determining whether two molecules interact specifically are well known and include, for example, equilibrium dialysis, surface plasmon resonance, and the like.

The invention also relates to kits, which can be used, for example, to perform a method of the invention. Thus, in one embodiment, the invention provides a kit for identifying nucleotide occurrences or haplotype alleles of bovine SNPs. Such a kit can contain, for example, an oligonucleotide probe, primer, or primer pair, or combinations thereof. Such oligonucleotides being useful, for example, to identify a SNP or haplotype allele as disclosed herein; or can contain one or more polynucleotides corresponding to a portion of a bovine gene containing one or more nucleotide occurrences associated with a bovine trait, such polynucleotide being useful, for example, as a standard (control) that can be examined in parallel with a test sample. In addition, a kit of the invention can contain, for example, reagents for performing a method of the invention, including, for example, one or more detectable labels, which can be used to label a probe or primer or can be incorporated into a product generated using the probe or primer (e.g., an amplification product); one or more polymerases, which can be useful for a method that includes a primer extension or amplification procedure, or other enzyme or enzymes (e.g., a ligase or an endonuclease), which can be useful for performing an oligonucleotide ligation assay or a mismatch cleavage assay; and/or one or more buffers or other reagents that are necessary to or can facilitate performing a method of the invention. The primers or probes can be included in a kit in a labeled form, for example with a label such as biotin or an antibody.

In one embodiment, a kit of the invention provides a plurality of oligonucleotides of the invention, including one or more oligonucleotide probes or one or more primers, including forward and/or reverse primers, or a combination of such probes and primers or primer pairs. Such a kit also can contain probes and/or primers that conveniently allow a method of the invention to be performed in a multiplex format.

The kit can also include instructions for using the probes or primers to determine a nucleotide occurrence of at least one bovine SNPs.

In another aspect, the present invention provides a computer system that includes a database having records containing information regarding a series of bovine single nucleotide polymorphisms (SNPs), and a user interface allowing a user to input nucleotide occurrences of the series of bovine SNPs for a bovine subject. The user interface can be used to query the database and display results of the query. The database can include records representing some or all of the SNP of a bovine SNP map, such as a high-density bovine SNP map. The database can also include information regarding haplotypes and haplotype alleles from the SNPs. Furthermore, the database can include information regarding traits and/or traits that are associated with some or all of the SNPs and/or haplotypes. In these embodiments the computer system can be used, for example, for any of the aspects of the invention that infer a trait of a bovine subject.

The computer system of the present invention can be a stand-alone computer, a conventional network system including a client/server environment and one or more database servers, and/or a handheld device. A number of conventional network systems, including a local area network (LAN) or a wide area network (WAN), are known in the art. Additionally, client/server environments, database servers, and networks are well documented in the technical, trade, and patent literature. For example, the database server can run on an operating system such as UNIX, running a relational database management system, a World Wide Web application, and a World Wide Web Server. When the computer system is a handheld device it can be a personal digital assistant (PDA) or another type of handheld device, of which many are known.

Typically, the database of the computer system of the present invention includes information regarding the location and nucleotide occurrences of bovine SNPs. Information regarding genomic location of the SNP can be provided for example by including sequence information of consecutive sequences surrounding the SNP, that only 1 part of the genome provides 100% match, or by providing apposition number of the SNP with respect to an available sequence entry, such as a Genbank sequence entry, or a sequence entry for a private database, or a commercially licensed database of DNA sequences. The database can also include information regarding nucleotide occurrences of SNPs, since as discussed herein typically nucleotide occurrences of less than all four nucleotides occur for a SNP.

The database can include other information regarding SNPs or haplotypes such as information regarding frequency of occurrence in a bovine population. Furthermore, the database can be divided into multiple parts, one for storing sequences and the others for storing information regarding the sequences. The database may contain records representing additional information about a SNP, for example information identifying the gene in which a SNP is found, or nucleotide occurrence frequency information, or characteristics of the library or clone which generated the DNA sequence, or the relationship of the sequence surrounding the SNP to similar DNA sequences in other species.

The parts of the database of the present invention can be flat file databases or relational databases or object-oriented databases. The parts of the database can be internal databases, or external databases that are accessible to users. An internal database is a database maintained as a private database, typically maintained behind a firewall, by an enterprise. An external database is located outside an internal database, and is typically maintained by a different entity than an internal database. A number of external public biological sequence databases, particularly SNP databases, are available and can be used with the current invention. For example, the dbSNP database available from the National Center for Biological Information (NCBI), part of the National Library of Medicine, can be used with the current invention to provide comparative genomic information to assist in identifying bovine SNPs.

In another aspect, the current invention provides a population of information regarding bovine SNPs and haplotypes. The population of information can include an identification of traits associated with the SNPs and haplotyopes. The population of information is typically included within a database, and can be identified using the methods of the current invention. The population of sequences can be a subpopulation of a larger database, that contains only SNPs and haplotypes related to a particular trait. For example, the subpopulation can be identified in a table of a relational database. A population of information can include all of the SNPs and/or haplotypes of a genome-wide SNP map.

In addition to the database discussed above, the computer system of the present invention includes a user interface capable of receiving entry of nucleotide occurrence information regarding at least one SNP. The interface can be a graphic user interface where entries and selections are made using a series of menus, dialog boxes, and/or selectable buttons, for example. The interface typically takes a user through a series of screens beginning with a main screen. The user interface can include links that a user may select to access additional information relating a bovine SNP map.

The function of the computer system of the present invention that carries out the trait inference methods typically includes a processing unit that executes a computer program product, itself representing another aspect of the invention, that includes a computer-readable program code embodied on a computer-usable medium and present in a memory function connected to the processing unit. The memory function can be ROM or RAM.

The computer program product, itself another aspect of the invention, is read and executed by the processing unit of the computer system of the present invention, and includes a computer-readable program code embodied on a computer-usable medium. The computer-readable program code relates to a plurality of sequence records stored in a database. The sequence records can contain information regarding the relationship between nucleotide occurrences of a series of bovine single nucleotide polymorphisms (SNPs) and a trait of one or more traits. The computer program product can include computer-readable program code for providing a user interface capable of allowing a user to input nucleotide occurrences of the series of bovine SNPs for a bovine subject, locating data corresponding to the entered query information, and displaying the data corresponding to the entered query. Data corresponding to the entered query information is typically located by querying a database as described above.

In another embodiment of the present invention, the computer system and computer program products are used to perform bioeconomic valuations used to perform methods described herein, such as methods for estimating the value of a bovine subject or meat that will be obtained therefrom.

The following examples are intended to illustrate but not limit the invention.

EXAMPLE 1

Generation of a High-density Bovine Genetic SNP Map

This example illustrates the generation of a high density bovine genetic SNP map created through a whole genome sequencing of the bovine genome using the shotgun sequencing approach. This approach was selected to provide hundreds of thousands of SNP markers, as described by Venter, J. C, et al., (Science 291:1304-1351 (2001), in order to perform a whole-genome association study with adequate density of markers to ensure discovery of markers in disequilibrium with mutations influencing the targeted traits.

Shotgun sequencing was performed with four different bovine individuals that represented different breed types. The shotgun sequencing was performed according to the methods of Venter, J. C, et al., (Science 291:1304-1351 (2001)). By this method, random fragments of bovine sequence were generated and size selected to 2.5 and 10 kb. These fragments of bovine DNA were inserted into a sequencing vector to create high quality plasmid libraries suitable for high throughput sequencing.

Shotgun sequencing was performed with four different bovine subjects that represented several different breed types: Angus, Limousin, Brahman and Simmental. Upon whole genome assembly of the sequenced fragments, contigs were formed from consensus sequence, and sequence variants were identified and cataloged. 786,777 sequence variants that differed by a single nucleotide became candidate SNP markers for the high-density SNP map. The relative position of each candidate SNP within the bovine genome was determined using the assembled human genome as scaffolding creating a candidate map of 242,181 human-mapped markers. Upon positioning of the SNPs within the genome, individual markers were tested to determine informativeness within the cattle population using 210 animals representing diverse breeds (Angus, Charolais, Limousin, Hereford, Brahman, Simmental and Gelbvieh) and Mendialian segregation (21 trios of parents and progeny). Selected markers were polymorphic in the majority of the breeds tested. Any markers within a region that failed the test were discarded and replaced with another marker in the region. These markers were also validated against the test population. This process was repeated until a relatively evenly distributed genetic SNP map was obtained, where the average genetic distance between any two adjacent markers is 0.5 cM.

EXAMPLE 2

Identification of Bovine SNPS Associated with Tenderness, Fat, Marbling, Yield, and/or Daily Gain This example illustrates the identification of SNPs from the high-density bovine SNP map identified in Example 1, that are associated with the traits meat tenderness, fat thickness, marbling, yield, and/or daily gain.

DNA samples from bovine subjects were obtained by collecting 50 ml of whole blood from the 4,791 bovine subjects. 25 ml of whole blood was used for DNA extraction using standard methods and concentrations of DNA were calculated using standard fluorimetric methods. Animals representing less than or equal to the 10th percentile of low numeric phenotypic animals (44 individuals) and the 90th percentile and greater of high phenotypic animals (44 individuals) were identified for each trait. The low numeric values were identified as "Low" and the high numeric values were identified as "High". DNA samples were pooled from bovine individuals that represent high and low phenotypic extremes for the expression of a target trait in a population of bovine animals with each of the 44 animals contributing equally to the pool of DNA. A separate "High" and "Low" pool was created for each biological type (English, Continental, and Brahman crosses) by treatment group (Early, Optimum, Late) for each of the five traits resulting in 90 total pools. In addition to the 90 pools listed above, another group was formed based on animals that were 5 standard deviations above the mean for numeric tenderness values. Eleven animals were included in this group of individuals and the pool was compared to the other tenderness groups resulting in a total of 91 pools. Each pool was tested against each of the 6189 mapped and validated SNP markers. The SNP detection platform utilized in the experiment was the Beckman Coulter SNP-IT system, utilizing single-base extension of the SNP base. Allele frequency was estimated for each pool based on the fluorescence intensity of each of the two incorporated fluorescent labels corresponding to the SNP alleles. These estimates were adjusted for marker specific characteristics and incorporation differences. A test statistic was developed based on a Chi-square distribution of differences among allele frequencies of the high minus low pools. These test statistics were summed across the 9 breed by treatment groups within each trait resulting in Chi-square distribution. SNP markers reaching a threshold test statistic of 46.96294 for the trait of tenderness and 21.66599 ($p<0.01$) for the remaining four traits of retail yield, daily gain, fat thickness and marbling were identified as associated SNPs and are listed in Tables 1A and 1B.

The high-density SNP map was used to identify SNPs that are associated with a series of bovine traits. The traits included marbling, tenderness, fat thickness, yield, and daily gain. Tables 1A and 1B (filed herewith on a compact disc) provide the identity of SNPs that associated with one or more of the traits analyzed. Twenty five hundred and ten associated SNPs were identified for all five traits.

Table 1A provides the following information, from left to right columns: SNP name; a sequence identifier of the sequence listing filed herewith, for an amplicon, wherein the SNP position is position 300 of the amplicon; position of the SNP within the amplicon (i.e. position 300); The nucleotide sequence and SEQ ID NO: for an extension primer capable of priming polynucleotide synthesis across the SNP position; trait(s) that are associated with the SNP; Characteristics of the trait that are associated with specific nucleotide occurrences at the SNP; Nucleotide occurrences that have been detected at the SNP position; And the sequence identifier of contig sequences that are located within 500,000 nucleotides from the SNP on the bovine genome. Table 1B provides the following information from left to right columns: SNP name; A sequence name of a contig that includes the SNP position, as well as the position numbers within the contig for an amplicon that includes the SNP; Position of the SNP within the amplicon (i.e. position 300); The nucleotide sequence for an extension primer capable of priming polynucleotide synthesis across the SNP position; trait(s) that are associated with the SNP; Characteristics of the trait that are associated with specific nucleotide occurrences at the SNP; Nucleotide occurrences that have been detected at the SNP position; And the sequence identifier of contig sequences that are located within 500,000 nucleotides from the SNP on the bovine genome.

EXAMPLE 3

Determination of the Distance of Disequilibrium in Cattle

This example utilizes a few of the associated SNPs disclosed in Example 2, to identify additional SNPs that are associated with the same traits, using the physical proximity on the genome of the SNPs. Furthermore, the results are used to calculate a distance of disequilibrium in cattle. In this example, "shear force" is used to refer to tenderness, "vision retail yield" is used to refer to retail yield, and "average daily gain" is used to refer to daily gain.

In the past 10 years numerous methods have been developed to identify alleles associated with phenotypic effects, traits or diseases. Linkage disequilibrium and measures of linkage disequilibrium have been of particular interest for studies of complex traits or diseases (see reviews L. R. Cardon and J. I. Bell, "Association study Designs for Complex Diseases", Nature Reviews/Genetics 2:91-99 (2001); N. A. Rosenberg and M. Nordborg "Genealogical Trees, Coalescent Theory and the analysis of Genetic Polymorphisms", Nature Reviews/Genetics 3:380-390, 2002). LD occurs where blocks or regions of neighboring markers are co-inherited from a common ancestor. The degree of LD varies considerably throughout the genome and is a function of time, recombination events, mutation rate and population structure. The extent of LD can vary from a few thousand base pairs to several centimorgans. This has been most extensively documented in human studies (K. W. Broman and J. L. Weber. "Long homozygous chromosomal segments in the CEPH families". Am. J. Hum. Genet. 65:1493-1500 (1999); A. G. Clark, K. M. Weiss, D. A. Nickerson, et. al. "Haplotype structure and population genetic inferences from nucleotide-sequence variation in human lipoprotein lipase. Am. J. Hum. Genet. 63:595-612 (1999); D. Reich, M. Cargill, S. Bolk, et al., "Linkage disequilibrium in the human genome". Nature 411:199-204 (2001); J. Stephens, J. A. Schneider, D. A. Tanguay, et al., "Haplotype variation and linkage disequilibrium in 313 human genes". Science 293:489-493 (2001); E. Dawson, GR Abecasis, S. Bumpstead, et al "A first generation linkage disequilibrium map of human chromosome 22". Nature 418(6897):544-548 (2002); S B Gabriel, S F Schaffner, H Nguyen, et al. "The structure of haplotype blocks in the human genome" Science 296: 225-2229 (2002)). Similar results have been observed in other species including cattle (F. Farnir, W. Coppieters, J-J. Arranz, et. al., "Extensive Genome-wide Linkage Disequibibrium in Cattle" Genome Research 10:220-227 (2000)). These studies and others have also shown that a SNP or multiple SNPs associated with a phenotype can be used as predictive of gene(s) causing differences in trait phenotypes within a region of high LD although they may or may not be the precise causative gene (as further examples, see also: A. M. Glazier, J H Nadeau and T J Aitman, "Finding Genes that Underlie Complex Traits" Science 298: 2345-2348 (2002); M. Blumenfield, et al. U.S. Pat. No. 6,531,279; A, Hovnanian, et al., U.S. Pat. Pub. No. 20030190637A1; M. Blumenfield, et al. U.S. Pat. No. 6,528,260; M. R. Hayden, et al. U.S. Pat. No. 6,617,122; C. M. Drysdale, et al. U.S. Pat. No. 6,586,183; M. Galvin, et al., U.S. Pat. No. 6,586,175; L. Bougueleret, et al., U.S. Pat. No. 6,582,909; S. Van Dijk, et al., U.S. Pat. No. 6,558,905. A. E. Anastasio, et al., U.S. Pat. No. 6,521,741). While it has been established that markers can be identified that associate with a specific trait, and, therefore, become diagnostic for the trait, the distance that disequilibrium reaches has not been determined in cattle with a dense marker map. Therefore, an experiment to determine the disequilibrium distance in cattle was performed using the high-density SNP map disclosed in Example 1.

The high-density SNP map disclosed in Example 1 was used to identify SNPs that are in physical proximity to a few of the associated SNPs disclosed in Example 2. Nucleotide occurrences of the SNPs were determined using the method disclosed in Example 2. A determination of whether on-test SNPs was associated with a trait was performed as disclosed in Example 2.

As discussed above, the study was performed to verify the assumption that markers that are in close physical proximity on the bovine genome will associate with the same trait(s) because markers in linkage disequilibrium with the associated SNP marker will also be in linkage disequilibrium with the mutation(s) influencing the trait.

As indicated in Table 2, SNP3 (MMBT22302) is significantly associated with the trait of average daily gain ("ADG" in Table 2). Several SNPs were identified using the high-density SNP map of Example 1 that are located at various distances from SNP3 on the bovine genome (Table 2). For example, SNP2 is 466,047 nucleotides from SNP3. Furthermore, SNP5 was identified which is 408,732 nucleotides from SNP3. SNP6 was identified which is 1.0 million nucleotides from SNP3. Finally, SNP4 was identified, which is 308,742 nucleotides.

As illustrated in Table 2, SNPs that were located within 500,000 nucleotides of SNP3 also were associated with average daily gain, whereas those that were located greater than 500,000 nucleotides from SNP3 were not associated with average daily gain. For example, linkage disequilibrium reaches 466,047 bases to SNP2, but not to SNP1 at 1.5 Mb; linkage disequilibrium reaches to 408,732 bases to SNP5, but not to SNP6 at 1.0 Mb. SNP4, which is 308,742 nucleotides from SNP3, was discovered by sequencing the contig of DNA that maps to this region in 4 different breeds of cattle. It is also in disequilibrium with average daily gain.

TABLE 2

Disequilibrium analysis in relation to SNP distance from MMBT22302.

|   | SNP | At Position 300 in SEQ ID NO | Marker Association P < .01 Trait | Human Chromosome Location | bp location | Difference from MMBT22302 |
|---|---|---|---|---|---|---|
| 1 | MMBT22310 | not in patent | Not Sign | HC16 | 45425130 | 1,507,460 |
| 2 | MMBT13976 | 20291 | ADG | HC16 | 46466543 | 466,047 |
| 3 | MMBT22302 | 19666 | ADG | HC16 | 46932590 | |
| 4 | MMBT09532 | 21944 | ADG | HC16 | 47241332 | 308,742 |
| 5 | MMBT09533 | 19999 | ADG | HC16 | 47341322 | 408,732 |
| 6 | MMBT09535 | 21078 | Not Sign | HC16 | 47958246 | 1,025,656 |

To further analyze linkage disequilibrium, a similar analysis was performed using another SNP identified as an associated SNP in Example 2. SNP9 (MMBT03905) is significantly associated with vision retail yield (VRY). SNPs 7-8 and 10-12 were identified that are various distances from SNP9 (Table 2). Again, SNPs that were located less than or equal to about 500,000 nucleotides from the associated SNP, were also associated with the trait, whereas those that were present greater than 500,000 nucleotides from a known associated SNP, were not associated. For example, SNPs 8 and 11 were identified as also being highly significantly associated with VRY and are located less than 500,000 bp from SNP9. (Table 3). On the other hand, SNPs 7 and 12, which are greater than 500,000 bp from SNP9, were not associated with the trait. Furthermore, through additional sequencing, SNP10 was discovered and also found to be in linkage disequilibrium with VRY.

The results of this Example indicate that disequilibrium in cattle exists across the region of 500,000 nucleotides from an associated SNP, in each direction. Therefore, it is expected that when an associated SNP is identified, other markers within this 500,000 bp region will also be in disequilibrium with the associated SNP and with the trait of interest, and can be used to infer associations with the trait of interest.

Although the invention has been described with reference to the above examples, it will be understood that modifications and variations are encompassed within the spirit and scope of the invention. Accordingly, the invention is limited only by the following claims.

TABLE 3

Disequilibrium analysis in relation to SNP distance from MMBT3905.

| | SNP | At Position 300 in SEQ ID NO | Marker Association P < .01 Trait | Human Chromosome Location | bp location | Difference from MMBT03905 |
|---|---|---|---|---|---|---|
| 7 | MMBT12437 | not in patent | Not Sign | HC04 | 177035705 | 518426 |
| 8 | MMBT03904 | 20327 | VRY | HC04 | 177201331 | 352800 |
| 9 | MMBT03905 | 19816 | VRY | HC04 | 177554131 | |
| 10 | MMBT03906 | 20240 | VRY | HC04 | 177900170 | 346039 |
| 11 | MMBT05906 | 20045 | VRY | HC04 | 178047550 | 493419 |
| 12 | MMBT03907 | not in patent | Not Sign | HC04 | 178113631 | 559500 |

As indicated in Tables 1A and 1B, SNP16 (MMBT02782) is highly significantly associated with shear force (SHF, Table 4). SNPs 14, 15, 17 and 18 were identified which are located within 500,000 nucleotides of SNP16 (Table 4). Once again, all of these SNPs, which are within 500,000 nucleotides of an associated SNP, were found to be associated with the same trait. That is, SNPs 14, 15, 17, and 18 were all found to be associated with SHF (Table 4). On the other hand, SNPs 1 and 7, which are located beyond 1.0 million nucleotides from SNP16, were not associated with SHF.

TABLE 4

Disequilibrium analysis in relation to SNP distance from MMBT02782.

| | SNP | At Position 300 in SEQ ID NO | Marker Association P < .01 Trait | Human Chromosome Location | bp location | Difference from MMBT02782 |
|---|---|---|---|---|---|---|
| 13 | MMBT02777 | 19767 | Not Sign | HC04 | 46401363 | 1594271 |
| 14 | MMBT02781 | 20791 | SHF | HC04 | 47777758 | 217876 |
| 15 | MMBT19460 | 20790 | SHF | HC04 | 47778002 | 217632 |
| 16 | MMBT02782 | 20901 | SHF | HC04 | 47995634 | |
| 17 | MMBT03688 | 20765 | SHF | HC04 | 48379141 | 383507 |
| 18 | MMBT02784 | 20764 | SHF | HC04 | 48492482 | 496848 |
| 19 | MMBT02786 | not in patent | Not Sign | HC04 | 49190953 | 1195319 |

SEQUENCE LISTING (64922 sequences)

SEQ ID NO: 1 - DNA, 600 bp, Bovine  MMBT02545
tatggggaaaattgttggtaatttactaaaagcattttaatataacaaaaagatagagcaaataattatttatcatttagtgtaggaggatagggcctggcaaacaaataaggcagatgtcggattaaagaaacaatccaatggtgacaaagaaatatttataacataaatcataattaaatattagataaataaacataaaaataatgtcccaaaaggattcccaagaaagacaatttaatggacaaaggcagggatatatatgaatgcttaaatggtttcatgaatattgattagctrgattttttttagtgtgtgagtgaaggagtagtatgctgagggacaaaagtgatggacccaaatctgagttttatggtttttcagataaatacgcatttttgtttatttacacagagagatattgtcctactaatatgatatctccaccaggcccattaaaacttatgtgctaacctctgtttcacacattaacgacaaacaggacataacgcttctgcacgaaaggaaacacatactgagagttgtttgaaacaaaaaaaaaaaaggaagaaggaggaaaaacctgatcttttgtaaata

SEQ ID NO: 2 - DNA, 600 bp, Bovine  MMBT05243
aagcaggaagcatcattcatctgccacatgtttccaactatggaaaattaattccaaaggacagactcatgaatctacttataaaggtgtgacactgacacatttcttcactgtaggaacgcccatgactgtgtgccagctacctcgaacatggggaaatcgtttctcatcaattgtaccttttagcgcaaaagtttcttaagctgtaggtgcagaagagattgtcccagtctgacagatggagaaactgaggcagagaggacgaagggcttgtttcctcatcagagctagagagcagaygtgtttcatattttttttcctcagactacgtttttccacctgctactgtaaggaccctcaccaagtttatgacccttaaaatgtcttttatttcttaaaatccaaaagtaataattaatagccccaagaacttagtgccactgcagctgctgaggccaggaacggttactcggtaggagcctaatgctggagcagtgctgccccctggtgcctactgggagtattcccagatttccctaggtggggatcctggcgcgtacttggtccccacttaatcttctccagagaagtgggcagggc

SEQ ID NO: 3 - DNA, 600 bp, Bovine  MMBT09018
ggcagcctttttatcaactatagtaactaacctaaaagacagcaaacggtcaaaataaatgccaagaagaaagataaaggtatgtgaagtaacagactgaaatttttatgtttaaaggaagcttccatttttaatcctctttgtgttcactactttatattgaaagtattcttcaggctgattttttttttcccccctccaacccttcagtcatacgcagtgaaaaaagtcatatgaattaaatataaataggctttctaggctttaaaaattattaaatattcacagttcctaagtctygactctttctgtggcagccaggcactactcaggggaagagatataaaagtagctttaaaacagaaggacaagatgctactttctttagtaaaaaggtgaaagaaattttaagatgagattcagaaaaggggcaggttaggttctaaactaagattctcaagttctaaacagaatttcgcttaaggacacttatttattaaaactccttttcctttttcccaatgaagcctaataccctgagttgtaaaccaactgttttcaaaagcacaagctctcaatgttgagtcaggtcaggtgttc

SEQ ID NO: 4 - DNA, 600 bp, Bovine  MMBT06945
ttttccagacaactgaaggattaaaatgttgctgtgcaaacttcaacacttggctatttttgtagcaatgcctttaaagtaatttttgagaaagataacacacaattaggaaggtgcagacaacacaaacatggatctagatggattatcataaagcaaacatctctggacccaccacaggagtcaataaatacaacacaggagacatcacagaagactgctgttagcctcccaatcccgaggcctcttctctcccagaaaaggcagtctctaacaaagttgtcttagtttctcttcccrtttctccaaagttttaaaatcttagcagacccttcacatttaaagttgtggacctctttctatgctaattaattcatcactccttttaatgactctattttaaaaagagaggtacctgcktacattttttaactgctcagattttaaatgtctacttgtcatattaacgtgaattgttttactgtgcagtatgcrgatgcttccaggtgccagtcatttggataagcattgccatttgcccccagttaaatggccttagacctctgaaatacttctaattcattcctttgtgccctttca

SEQ ID NO: 5 - DNA, 372 bp, Bovine  MMBT17660
ttttaatgttatgaaagtatttaatattttaaaatcagagtccacatcaaataatttttctttattcaactcttatctgagtttccaattctgaaaaatcaagaaattcattcaaaaattatagatagctgtagatataagtatcagtctcagtactcacatggcattttttttcctgcttgcttttgaataaaaacctacataatgaacacgataatatggtaggatttgggccatgtaattttcccatttagacttttttcattcattttctgtaatctgatctcatggtcttcttgmttttctccctcttgaagtttaacgtcattttcattttttcacaacgttggctgtaagttttctttctttttt

SEQ ID NO: 6 - DNA, 600 bp, Bovine  MMBT17471
cctagtctacactgaatctggcaatcaggaaatctgctaggcccctgtgaacacaggtgacaatttctcttagtgccatcggtgtatgttacaagggcggggattgggctgatccgactcatgcagttattcaagaaaagaggtggctcagactcgctctgcttcaccaaggatagaaggggagcggcttaggaaggttttaatttagctgaaaatacaaatggcaaaatcaaaggtaattttttccctcctgctgtaagaaacccagtgacatctgtgaggtggtttgattcacatcargggaagcttttgaaaaatggagatggcaattaattggacttcagaggatggtgacagttttttctaatgtcttgatttcctatcaagacattggccacttttctgcagggcctcaagacagtaattagatgtcatgtcggaatgtgactccaaggtctcaggcgacaccagttctaactagagcgcccccaaacacaggatgagacaatcagcttggccggcggcgtcacctgagagtcaacgcagccttccctcttcaacaacatgggaaaacccgagtcaatggagcagtttcacttt

SEQ ID NO: 7 - DNA, 600 bp, Bovine  MMBT14829
ggtcagagtggttaagcatcttgctggaggtcacacagctggtaaagatttgagttgcgaatttgagacatttattctctatctcaaacatgtacccttctggtcttctaggataataagaaacactactgtgaattactgttggattgtggtggtggtggtggtgcaggaggaggagaggagaggagacccctttaggggaatgtgttggggttgagcattgagaactaggatgtttctgtgtggatcaggtttgtgcagagatggatcaatgactcaggagtgtacacagatcctatkctttgtaccctttagaaattaggctgatcatcagcctcaccttgaaatatctcttattcctttgtaatcaacatgtggaactgttgaaagaatgtctgctgatggatatctttcaactaatcttaaaatggtggatgtctgtttaattttaaactgggtaccatgacatcccctgtgctgaacattcacaaacagctggacttagaaggaaatgtacaaatgtagtgttcacagattactaatataatgagggctgacagaattattataggtcaccgagcctttaaataacatttattt

SEQ ID NO: 8 - DNA, 598 bp, Bovine  MMBT00031
  misc_feature (1)..(90): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtccagccttgtttagatccaccagaagtgttgaatatatggactttcatgacgttacctaaacacttggccttcctctcaacatcctaaacatttgcttgtgaattttcttgatttgggatttatatttctgaagcatacacccaagggaagggattcaggactgtcctcacccacctctgtccatggctcttttccacaaaaacrcctattccttctaggtcatccttttgttcactgccttccctgctggtctacccagctcctatggcaaggcctccttcacgccagacttcctccragaaatcactmtggacccctcagcccatcttctcctgcccatctctgaatacatctgggacctgatttcatctggactgctgctctggttgtgtcattgataagttagctgacaaagacaaaatgaagtctaatacaaaatgaaccatccgttgattcataaccatacagcaarggagtctctctggtcactttcctggacagg

SEQ ID NO: 9 - DNA, 600 bp, Bovine  MMBT00078
gctttatggggctggtttgggcaaagcctgtgctattttttttaaatgttgcctggggatccaggtttctatatggacctgcacagatgggggtttaagctatggatttggaaggcaaagccacacgtctcctctggttttgagaagagatctaatccaggatctgactgctcatgctccatcctcattgggacattttctgagctgaggtgtgagcaaagcatcagctaaaacatgcaccctgaggagcaaatagaaacctaggtggggccccatcctccttgcatggctgcaggggtrgtgtttgaatgggtggtccttcctgactgatggccaccgtcagagggaaatctctgaaagcagataccagtttgagccatggctctgcccgctctgggctgtgtgacctcagataagtcactgcgtgtctctgagaccatttctctttttcgtgaggaggtgagggtcagggctatggtgaggtgttccagagaaggtgggtttgcacacacctggcacttgtgctgggcagcagaggatgcatgggaacccgaacctgggttggggtcagggggctgggggaaaggaggagagtgggga

SEQ ID NO: 10 - DNA, 598 bp, Bovine  MMBT00032
  misc_feature (1)..(31): n is any nucleotide
nnnnnnnnnnnnnnnnnnnnnnnnnnnnnnntcttctgactccccccaccccccgcattccttttctctttttcccccccttttagtagtcaagggaaaaaaaaaaagagcaagcagagctgacaggtatcattcagccgccctggcttgtgaggggtggtataaatgaatctcagggctcctggcttcacatgattcaaacatgcgttattgaagatggatgttccttaaaaaaagattgatggtggatgccgggcttagggtgccatttatcattttgaatattatttagacttgccrtgtaaacctgtaacttgagagttggacgagccgrggctgggtaggggcctgtgtgtgtgtgtgtttccatcgattggccttgggttatcattgctgctgaccagatgcagtccctcccatttacagtatagaagacacccccctcccgtaaaggagggacggtttaattttgaataatttccaaggacactggggaaaatgaagtatctgtgatttacactaacaggcaacttctttctctctccttctctccctctctcttccccgacagaggcagtcatgtacgaaacattaaaat

SEQ ID NO: 11 - DNA, 598 bp, Bovine  MMBT00008
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaacccagcacagaggggctggatcagaactcacttctcatcgggttttccaccatggggttcccctcgcccggacgctcgatcttgaaaacttcatccacgaagacaatccgacagtcattgagagaatcacccctacaagagaacaggcctgttaggatgaccagcrggccagtctcaccgatgaccccaaaagacccggccacttggacatgttctcagagcccatgaacagctctgattctaattataysgtagaagaggttttcgyggggccctatgaactcgcctagctactaccctcgmaaattcaagtcctaccacatcaggaacgaggtgaaaacaaataagccagagtttcagtatgtgatgcattttcgagaataatttttaacctttggcaggtgaggcccactaagaggcaaggcccactaaacaaggctcaataggcaaaaactatgaagaag

SEQ ID NO: 12 - DNA, 600 bp, Bovine  MMBT00087
ccctcaaggggtctctstgtttcgaaagtcatttctaaactttgattatatttttttctacgtcagagatgataatctccaaagaactgattcaaggtaacccacttkgtgggaggctgaagcttaaatcagaaaacccsttctttaatacagagtgagaagtggaatctctgcttagtgtgacatgaaaaatccagtctctgtgagtttgctattagagtaagagggattcgttaggtgagactaatgggtagttgctccatggcatacgggatcttcctggaccaggaattgaacccrtgtcycctgcatttcaggcagattctttaccactgagccaccgaggaagccctgtgcttgctcttytgtttgtttttcttggtgctgagagtcacagggatagatctgcctggttgaatctgttgtgaaagctttagcctcaagatattcatgctcagcacagattcagaaaatgttctgaatcatctgctggctgaaacatccraggactcagtacatcgtctgacagatatgtggacaggagacatccagtaaggatgcacagtggccggtgatcactcgaggtgtgtgacactcttg

SEQ ID NO: 13 - DNA, 600 bp, Bovine  MMBT00070
caacttccagttgagaaagctgaggctcagagaagggcaggaggggttggccagagccaagccttgtcctcccatccccactggagatctttgctgggtgccctgccctgggaggggtggacacagagggtgagagaccctctctgcgcatgcggtctgatgggcagaggccagtgacccgctgggcagctcaggccagccctgggcctcactgaaacctgtccctggcccagcaggcccctgcttccagggaggttctggggtgtgatgtgggaagcggccttggtctgtaaatgcacrgtgcggaggatgcgtgccgtcccctgtggagtgcggtctcagggcctgggcctaggtgcatctgcacccagacagccttgtttcattatcttatgtatttgtctgtggctgtgtcaggcctcagctgcggcacgcagagtccaggcgtgcgggcttctcccttgtcgaggtgtgcaggatcagtagctgcgacccacaggctgagctgctccgcggcaggtgggactcagctccccaagcaggcatccaacctgcatcggatgggcaggcggatcctcagccactggaccccccagcagc

SEQ ID NO: 14 - DNA, 598 bp, Bovine  MMBT00430
  misc_feature (1)..(163): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgctaggttacattcactataggcctaggagggctaccagctggggagagcggatggcccactgaaaagagcatcctaacagggccacctagtgaatgctcagcttcttagggaaacttcttttcagtattggtrtctgaagtattgatctgatggaggaagagccatgctcttcatggagaccattatcagggattttatggactattgcttcaggtggagtgtggagtaattatttccttaagactctttgtatgtataattgtattcctgctactcaggatatgttcagaaaataattactattgaattaactgcattgacagtctttcarttctactaccaagactgtttgcatttaagctaagtttcctccttgccaatatgtgtctgttacaataagcatttcaactaaattagcatctcagtaaca

SEQ ID NO: 15 - DNA, 600 bp, Bovine  MMBT00039
aacacattaatcttaaaggagaaaaaaaattacctcattggtgaagcctgaaaaattgttctgccttgtaatacactgtaacatacttctgttgtagtacccttaccaccagtcttgtagatttgcgttgacacatactttcttaaaagtatgtgtttaaaaaaaaaaaaagtatgtgttgcatgctttgcagctgtaacttcttgtgagcagagactgtgttttgtatatcttggcaccccagtaaactaacgcaatttgggattacaaagtgacttcacaatacatttttagaatgcrttattaagtaaatttggtggcaagtatctcccctttgattttttgttgttgttgcttcccttacaatctaaatcacaaaacaagaaaaatggtaggctttctttacaagtttcatatgaatgccagaaaggagcagratcaaaactagtccccaaggacttccctggcagtccagtggttaagactctgtgctttcactgcagggagcaccagttcagtccctgggtggggacctgagatcccacatgctatataggacagccaaaagataaaataagttataaaataaaaatctagtcc

SEQ ID NO: 16 - DNA, 600 bp, Bovine  MMBT00130
tagcacacagcacacacacatgggctctaaggtgggcttcctggtggctcagatagtaaagaatctgcctgcactgcaagagacctgggttcaatcccatggtcaggaagatcctctggagaaggggatggcaatccactccagtattcctgcctggagactgagtgactaacacacatggggtctaaggcagttgaatgtgtctcagaagcacaaagatcccagaccatgaagacctgagttcagatcctggctcctccagtttctagctatgtgaccttggcaagtgattcaactacyctgtgccaccgtttctgcatctgccaaatgggtgtgatggcagtgccttcctctaggaccatgggagaatgaggtgagctattcagaactgcttctgggctgtctctcttcctcacagctcccttctggaatgtctaggcaagtctgggaagcggagggctgagcctccggcagttaatgaatccagaaaggatctcagctgtgtcaggggagccccagtgccaagttggcctgatttttatcccaagagagctgagaacgggttctggtgtcagacatctgcggtgtgattggcataaa

SEQ ID NO: 17 - DNA, 600 bp, Bovine  MMBT00171
atctctatctcttcaagactatttgcacattttttttcaactagaaaacacttatctcctaccttctccactcttaagcttttctagtgtactcacatttaattgcataggattaaaacattatgttaaactaaatcagtaagcctcaaaatttattgtcatgagatgcaagccaagggctattaaattttcccaggacataaggctctttcagacagacacaaatatataaggaccccaagcaagtctcatcagtcataagggctttaggagagtagtggactgtgttcctaggcaagytttctgaaggattagcacaaactccaaagccctgaataattctcctaaaaggaaaactaagatgcttaaaccttaaagcattaagcaagactacataataaagagcctttaggattttcgttttatactcccaacttttgagatcaggtcaagagggtcagtgtaactgtccttggttctgaaacggtgttgacttggaggtaattcatttattttaaaatgtctactaatgtctactggattcccaatatccacttgtgtaacttgaatcagtgatggcccacagctctttggtttatg

SEQ ID NO: 18 - DNA, 600 bp, Bovine  MMBT01317
tcctgtcgaagtcrgcagatgaactaaataacttcttgctcagtgaggtggttgaaatctagggttctagagggacacctgttggaggrtgaatcctgaatttccacctattagctgtgtgatgctgggtaaggcacttaacctctctaagcctcagttttcccatttatgaaatgagaataatacgagggcctgcagcgcagggcttggggtggattcagtgaggtgctgggtgcgcctagcacagagrcagtgcccagtgccagcccacagctgtcattgtcgttaaagagactgttsctgtcattattaatcatcacacccattctagttcttgggtggaggcttctgtcacatgcatcctggggccctagtccccacactcctagcagtgtagacaccctttactcagaagctcatatatgagtttgtaataagctgcctctaatcttttgtgctctccttatggacaagtatcaaatccaggcaagatctgctaccaagctagcttttaatgagggacttagcctgaaccactggaaccacgggaagccactatctcagccagccatgcattcattcaagagtcagggtgttcaa

SEQ ID NO: 19 - DNA, 598 bp, Bovine  MMBT01326
  misc_feature (1)..(87): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnncttgacttggcaggcaagataactgaggcgtagagaggttaaatgagttgtccaaagccatataacaggatgggaggctgacctggggaatgcggtcctagatgcatgggaggagatggttggctcaatgcctataactttgagggtgagtcatccatccccttgaattacagaatcctcgggctgtagggatcctcaggaagtcagctgtcstcctggccttcaagagaagtccacttattgtccaccagagggataaggacctttcatatctttagaagacaggcttctctccagccctcaggccacatagccttcaaggccaggccatcttccttggcctcattcacacattcacaggcctgaaagctgttgagggtgctctgtgttgagtggccctctgtgttgagagtcaggctcatagaaagtggtgatgggttcagttcccctctgcccccgcagtcaatggtgctcatctcctgtggaaagtttcaaagcagggatgcttttg

SEQ ID NO: 20 - DNA, 598 bp, Bovine  MMBT02162
  misc_feature (1)..(1): n is any nucleotide
ntcttagaatgattgttaggttcacaggtgtttgttgtattatgacccactggtgactgactgccccccacaggccactgacagtcctgtatcgtacaggaatattattaaatcctgtgcgcctgaaagtagacagaggaaaaggagaaagaaaggaaccctttagtccttatgaagatttaaaggcctctttattgcctatgcttgacttgactgcattgcttttcagatgctcaaagactgttggagagaaggactaaagatgacagactgaatgaagcagattttcaggaaggaggsaagatgagtatcttaggctccaggaggctggaaggagcttgtccaaaggagcaatgggatcccaaacagcaggccattaaggatagtctcaatccagtttttcacttcattcccaagggtcctcttccctcggtaccaccagagtggcatgaggggccaggcctccgggacttttgtcaggacccgcctcctgcctcctgagtcaagggcgagttgaatgctagcagcatagaaaccttggaaagcactcttgggtaattgtgaccgtttattaaggtacaatattaatgcattgttt

SEQ ID NO: 21 - DNA, 600 bp, Bovine  MMBT01006
ttctcgctttcatacacttcacaaatcggagtggacacactcaccatgctatgtccattcactaacaggaagaaggcttgatyagcattgagctgtaagcgccttcttattatcttgatgagctcactcatgttgacatgatcaggcaccagaaactttgttttatccaggacaggaagctgtttctcacctttgtatckttctattattaccgggattttggtaggatgctgctctcggataagtcggacatcttctactctttgttygaaggttcggcgctgtttgaaggttttctcsgacggcatggcgctgcaggctgggtgggggcggcgagttggaggctgcaggcggcggcagaggcggcgacagctccgacagaaaaacattttttaaagtgttttctctattcaaaatctgtgacagtgttattattattctaagactgttgtacagttgtcatagcttagagcaaatgatgggatattctgattctgtcagctttgcggtccttgagaactaggattgttggttcggaataaagggtgcaatcccctagtrgctctagtcctgatacactgtgttcccttaaaagaaact

SEQ ID NO: 22 - DNA, 600 bp, Bovine  MMBT01705
ggagtgggttgccatgcccgcctccagggcatcttcccttaccaccgtgagcactaaatgaattagaaagctgagaccatgaggcaaggatacaaaaagcaacctgggaagctctaaaacaccaaggatttcataaactttgattatttacaacgccaccccaggaaatgaatagaacacatcaggttttaggaaatcagagaagaatcttcagtactttctaaggcaccgacaccggtctcccattgagaaacggcctggcctgccccgtctttggttctccccacttccgctggtgcsgtggccctgttctcctctccctgaagtaacttctccgtgggcacttacatcgcttagttgtttcccgcttttgacagcctgaacgtagacaggagtgtcagtaaccagcttgtaattgttccttgttttcagcacgtgagctttgtacttgatctgtcaaaaggaagaaggaaaataagcctgtgttagaccattcattatatttgaaattgttggttttcacatagagcctggttgcttttagctcatggcatgcacatacattggccctgaatttcataacaatcagcataatcaatg

SEQ ID NO: 23 - DNA, 600 bp, Bovine  MMBT00564
gaggaaaccacttgctcaaggcccttacagccaggctccagaaccaggtatgttttccgagcccagcatggagttgtaaagagcatggactccagagccaggctgccttgggagaacctggccgatcaccagctgtgtggcctgcagcaagctgcacgacctctctgtgcctcagttttcacatgggaaaaagggagataataattgtacggctcctaggattgcggtgaggatgggatgtcctggagcacgggaagccttttagccccgcctggagcgtggtaaagtcagggccagccsttctgcttgtgctgctcccgctggtctcykgtctgccaccaagtcctacagaccccaggtccttaacagggccagtgttgtttctctccacttgtccctggtctaggacatcattatttgtcctggttctctgtcgcagcaccccactgccttcccccgcccacccctctctgcccatgcagcagagccatcttcctgtttcactcttccctgcccagaaccaccacctcagtggtcacccctgcccccagcccaccccgagcgccagcctctcctggccctggcccaccctggtttcag

SEQ ID NO: 24 - DNA, 600 bp, Bovine  MMBT01385
cacgttttttaatgagcttgagttactctctatgattttggggaaagtttgtaaatgtactctacattgttaatgaactatcttctaatcatctgtgccagtagcctatgtagcagtttatccactccccaagatggccactccccaatagggcactcaggctacccaagtgcttatgggatccttgaaagttaaatgaacagaataacatttgggggactggtaattgcaattacacatgtaagaaaagtattttctctttacatttcacaaattgctgtggttctttaaaatatactstgtgtttcaatatgcggtatgtacaaaaaacaagttctactccagaaagaatgttggttcttgtcaaagcagtaatatgatccagagacccatctatatgaaaaacaaacaaaaacaacaacaagagagatggggagggaacagagggaaataggcagatcagatcagtcgctcagtcgtgtccaactctttgccaccccatgaatcgcagcacgccaggcctccctgtccatcaccaactcccagagttcactgagactcacgtccatcgagtcaatgaggccatccagccatctcatc

SEQ ID NO: 25 - DNA, 600 bp, Bovine  MMBT01416
atttttgagcttctacactgtctagaattaattagctcccccatagtaatttctggaaatttataatgctgtttatcaagtttatgagcaaattaattgctttaaatctattttgaaattcatgtaattacatcagttgtattgaagttttctgaattgaggactttatcagcttttaggctatcttaaaatttgttcattatctcaagtgagaaatttccacattattttatattactttttgcataaaactgaaaaattgagaagtccaatttgataaattaaagttgcatgctgatscccacaacacatcttgtggttggatgacagtcttccattaaggcaagtgwcctgtataaaattagcattgtaactaatatataggacctttgtggggaagaaaaaaattattactcattaaacagctttgaatgaatggaaatatatatgatgctttggatggaaagtactaatattaaaaaacatagtcactttaggatggataaataattgttataagcctttaaaattaagtgtaacttacaatacatatatgctaaaatatgcatatatgctaaaatacacaaatcttaaagtaya

SEQ ID NO: 26 - DNA, 600 bp, Bovine  MMBT01195
aactttctgttaattcttcttaacatttacactactaagttattttatgacttcagaatttgaattaagcttagatttttacatattttcttcatttaaatctgttaagacatttatattccgcactttgaggcattgccaaatcttacctctccagtgtttttcctctcctttctccctttattttgttttaaaaatagatttttttcccccaaaagcatgctgtaagtgattccccctttacctaattcctgtaaatacttttgacaaaaattgccttttaacctcttctccaagttsagctaacatctgttctgctgtggrtaggctagatgaccaagggttggaattgctccttggcacttccttctatacactgaccttttccattttgtctcattttaatgacattaaamtgtctcattttaattcatattgctamggcattgggaaagatggaatccttaaccatatttatcttcaaagaagcatgaaaactgctatcagattttattctataagcaagcaaggattccttggccagatgtttttataggtgtgtcccttacaaagatcagttttacctcaaccagagaacta

SEQ ID NO: 27 - DNA, 598 bp, Bovine  MMBT01719
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnngagtatgagaaaggacttgaaaagccactaattccaggagttctagtcaatacctttaaccctcaccttccccttttgagaatagagtctctagttcctataatttccacccagcactaaaagttcttttaagggccctggatgcctttggatcctgagaccctggcctcaccgctccttatttcttccctctggggtatgtttaatgtagtgtttactgggttaaaagsctgaggtggttcaagaatctaccagcatatatgcatttatgtgctcgtgccagccacatgcttacccagcctttcctcttggacaacactgggcagatctggtgagactattgtccactgcgtttgcccccgctacctgtggctgaatgttcccagagactcctaacctcccaaatgctaagaagctgaagtattttaatattcaggattatttcaggatatttttctaagtgcctgagtatatgccctgtgtggtgcttaatgaggctgcagtgtgatacacacacacacacacata

SEQ ID NO: 28 - DNA, 600 bp, Bovine  MMBT00562
agcaaacctcattttttctccagggaacagcccgttgcccattgcatggggtggtcaagatgcctcgccttccccttggctaggggcacgtgacccaggtcaggctgtttggargctcgcgtccttgaagggagacacagtagaatctggagctaacatttggaytyacccgtactggcggtggtgcctggggaggctgccccctgattcttgcaacctggacccctggcaacatcttctttcctgtccttcttgaggtctggctgttctctcctgagccactccgaggcattctaatastgtattgttattattaatttttcttgcttaagttagaaagtgttggtttctattatttgtagctaaagaatcggaactgacacaaacccaaatgcccagcaatcggggcttaaaagcatgatacagcycacgatggagtactatacaccaggtacagcaacgagacacaggcacagaaaagatgcttacaacatatagtttagtgcagagcagattctaataaaacaggatgccatggtatgatacaatgcttgcaaaatacactctgtaccatcatagaaaaaggtctggaaaaaaata

SEQ ID NO: 29 - DNA, 600 bp, Bovine  MMBT02802
tattttcatggtagacttttatgttagtttcagagtatcttctaattatcaaatgtatttaaaattatgtatactttaatttcctatccagaatataaataaaccttttcaattaatgaattaatgcacaattattgtaggcagttcagaaagttaaattctattacactccctaagtgttaatcaattagccattttcattagctataagtcagaatactggagtgcccccaaagaatgaattctttttaaaaattaaaatatttttataattcaatttaatgaaatatgtcatatctstggctaattttaccttttccttttcattctcactcaaatcctctacscttgccctttgggcatgcacagaagcccagctctgtacatccacacatgacattcgattacacatattcctaactgctggcatgagctgtatactaaatattgtacctatcaagctttacatgttttcattttaaaattcccatttaaatgcaaattctgccatttaaatagagtcytcgtgtgctttattacactataattactatttcccatcttcctggaaccaactgcaagaaaggccataggtcactt

SEQ ID NO: 30 - DNA, 600 bp, Bovine  MMBT02056
ttaaacaaaatttaaacagcacaatgaaactttttactaaaaaaccttttcaatgaaatggctctaattaaaacttttaaagaaagacattggtttaaaaaaaaaatgaataaagtaacaatttaacttaaaaaggcctgtgttaagagacgatttaataaaattgagattagaaagtattcacagatacaatctcatttaagaagtaatcaccaacaaaaagcaaggtaacttcaatttttccttttttgcctcttaaactgaactatagttgatctacaaattttgtgttaatctccscttttcagcaaagtgactcaattatacatacatacacacagacacataaaaacagtcttttttttaaaaaatattcttttctattatggtttacccctggaggctggatatagttccctgtatgtttcttgaattcatcttcagcagttttaatgtacatattttcctaacgttttagagtttgaatagctagtcgtttgctgacctcttgtgttagctggtagaactacatggcctcaaagcaaacttcagcaccttattcaaacaccgtagtgggaacatgaagacaaacagcttagc

SEQ ID NO: 31 - DNA, 600 bp, Bovine  MMBT02065
taaagtgagtacttgggattccaagccatgaatatgtgtccaccaattgttaatctgtaaactaacctgccaaccagcttcagagcagaactggtactctggccagcggaactgttgttccctttgtttttgaaaatacaaagggaaggaagtgatgagacagtcatcgatgattaaaagaggtcatttactttccatgccttgtggctttggtccaaaggcagaaagtgaaaaggaatgggatctgcccttgcaagggatgaaatctactaatgatctcccatgtttcccagtctcatscagcatttttcagctaatcctttgaaaatattttctgaagccagtctgagtttttacctgtgggagagaaatatcctgtcggtaaataccaacattatggccactgcatgtatttaaagacagagtgcagggtgcctcatggagttccgtcaattgcgtgtaacggttttcagaagtcctcattcttctggaagctaccaacagacatgcacattcaggccttcagtggaactaaaggggaattcatagaaaccagaactgcacgaaggcaactgaaaaattgagcttcccaggtagctc

SEQ ID NO: 32 - DNA, 600 bp, Bovine  MMBT02111
gcctgctggcttgcatctctcacaatcatcctatattaataaatctgcatcttgcctatcaaagaaaaaactaacctaaaatcagacttatcatacaacccagtaccttcaccttgggcatttatcctaaagaagtgaaaacttatattcacacagaagtttacacaaaccaagtcacacaggaccagccctcaacagccccaccctgagatatcaagagtggagagtaccatgacacatatctagtttgtttgttgaatgagggaacaagatggacctgactgggctaaggatacactsamatcttttgacaactcaaggcaggtgaaaaacttcaaactggaaatattgaattttctgctcttcagtgatgaattagaaaaataaaaaccatatgaccaaatgtatatcttgagttatgaaacagctccatactggactaaayagaaatagaaatgcagagaaaagaatttgtttctagtacagtatttttctttttttagaactatttccatttttttagaacagttaatgttttattatacagctatttgtttgctactaaataacagcttttaaaaggctttgctgctttctgta

SEQ ID NO: 33 - DNA, 590 bp, Bovine  MMBT02189
  misc_feature (1)..(3): n is any nucleotide
nnngagcatctgacacaaatttagtcaagccattaatgactaatgaccggtgacatggtaggattttaaaaaaaagagagagagagagagaaaatgagccaatgtaattttctcttgggagtttaaactgggagacagagaaggtaggagtaattagtaggagttaaggctgtaggttaagcagggctagaytggagtgagctgcagctaaatctaaaaccagaacaaactattagctagaagatgaggataatagcaacagagcagacagccaggaagtcacagttgagcaaggcctatagstcagtcatgagtatcttacataatcctctccttttcccctttcttttcttccttccatttttactttcttgctcatctcttcttttcacaaggaacacttgctgctgaacactgactatatcccaggaggcagatatgatgataaacaagacagacacagttgctgccatcattatggaggtttaagtcaaatgaaggtgatggaaaagtcccagggccgtgctctaaccttggtctccggagcgcttgggtaatacaaattaaggcgttgcttcaatgtcaggatc

SEQ ID NO: 34 - DNA, 600 bp, Bovine  MMBT02132
ttaagctgactaccttaccgacttttaaaaataaattcctttaggactactaggtccataatcaaattatttgtgaagcactgacagaattatatcctcctttctggtatttctcatttgtttctctcaccttattgctttggtgggaacttccacagtgatgttaaataatagtggtgtttctggttcctgattgtagttagacatccaccctccaacctttcaaagtccccaaaggacaaaaaagatattattaatttgaaatctgttttattctaaaactttactaaagtggaaaastgcyatgcctgtgatgaagagtgctgatccttgacagtagtgggagtttggttgaactcagtcatgtctgaaaaagggccacgtgctgaatgatatcccagtttagtaacatcagtaatctggtgtgtgtgtgtgtgtgtgtgtgtgtgtgtgtgtgtatttaagtgttgagtctttctgaggaggatcagcctctcaggtgaacttgatgaatcttctraagtatatataacagcaggggaaggagagggtgggacgatttgagagagtagcactgagatatgtacactagggtgagtg

SEQ ID NO: 35 - DNA, 598 bp, Bovine  MMBT00996
  misc_feature (1)..(75): n is any nucleotide
nnnnnnnnnnnnnnnnnnnnnnnnnnnnnnnnnnnnnnnnnnnnnnnnnnnnnnnnnnnnnnnnnnnnnnnnnnncaggtgacattctggaccggtaagtcgccttgcaagtgtaaggtattccgtccttacacttgcacttaaacttgtgatccttcaaatgatgacgaaaggctgggcttcaggtcaggcaatgtaggttcaaatctgggcttgacttctgaagcctcagtttccttgcctacaaattaggcataacagctaccttgtatattgtaaggattaattgtgatggcacasacagcaatgctagaaagcaataattttaattattgtaggccaagataatctgaagggattcaattatttctttccctgcygtaacccatgaagtacaaccttctaactctgattaatgcgccaccatcagttttatgagagtgggtttagatctgataacaaagtgggctgtcttcattccatttatttctgtgaagtcttgagtttaaatggttgaggagggggtgttgggaggggaaaggccatgttcttgttttaaaaaacgttaattttcagttgccaggctgccagaagtgag

SEQ ID NO: 36 - DNA, 600 bp, Bovine  MMBT00542
aaaaaaagagaatcacaaagactcattgtaatggaaaactcaaaggacagagtgttggagctgcatgcaggggccgcccgagccagacccacgctatgtccccgtgcttagcacatttctgggtgctcgagamacaaaggcgtgagtgaaaccggagactgatgaaccctgcgacacaatctgagggccagtgttagaatcctgggcgaacagtattcacatatcagaagaggggactgagatcccaggggacgggttgtggaatcttccgggtgtttcaggagccccctgcccccggtstggctctttttgagggcgctgtggccagggaggccagggacggtccagggctgagtctggggcctctcagggaaggatgggcttacgggaaaggagttttctggcgggagagcctttggtgctaaccctcccgaggcctggggccccggcagctggaggcctcagcgggaggcagagcgcacccttagcagggcggggtgggcccagtgcacagcttgttggggtaatgggcgtatttgcggttgtaggtgcccaggttgcggcgaaagcagagcgcggccttcttgtcacactcgcagg

SEQ ID NO: 37 - DNA, 602 bp, Bovine  MMBT02679
  misc_feature (1)..(2): n is any nucleotide
nntctagctatgtcgcagatgttcttccaaggagcaagctgcagtctatgatgggaaagagtaatttgttacggatctgaatcgtcaggtccagtcatttggcttgaaggattcagttgactccactgaaagcacatggcaagtatagctcctaaatgacagtaagaastccctcatttatattctctcatgtctctatctcatctaaccctgtcgggtgaacccctgctgccctttaaatgcaaattccatccattcccccatctgcatggagctgacaacccatcttccatgatgcttcrgcaytctgtatgtacttctgttagggcccctgcatgcatatcagagatttgtgtttccattcttgtgtccctcactggagaattacgtccttgaaaggagaacctcatttcactgtcgtttgattccccaaagtgaactgtgttcctacctgtggagtaatgtgttttgcacatttgctgaattgaatcagaatttcaggtttggaaggaaactttcccatcattctaggaagcctagaacagtagaaccaataacatctgtggcccgtccacccctcatttagtcgatggggttacagg

SEQ ID NO: 38 - DNA, 598 bp, Bovine  MMBT02149
  misc_feature (1)..(64): n is any nucleotide
nnnnnnnnnnnnnnnnnnnnnnnnnnnnnnnnnnnnnnnnnnnnnnnnnnnnnnnnnnnnnnnntgcacacctgtgggacggaaccctggcttcttcctatgggacggctcccagctgtgctggaggtgtgcccccacccccccactgatgtcaggtaagtactgaatctgagatgacacttccttgatcaaatgacaatgctctagttacagactctgctgaagtggtttctacttctcccttctcgcctcactctcctttgccatttctcatcaacctccagaacccacagtcagacrgctgagatgctgaccaaycccaccagactgcagaccccctcacagcttgaggacagaggagcctgcttcccagagacacagctgcccatgcccctctggctctccaggtgtaatggagcctcagaatcggccagaccactccactatctccacagtgtctcttcccacccaagcacagggtttacggcgggtggagggattcttgagttcaggagctgggaaaacaactgcagcaattgactgtttggaaaacaatttatagtttacaaaacactcttttcctttatctcatgggaat

SEQ ID NO: 39 - DNA, 600 bp, Bovine  MMBT01938
taagcacacctctcttccagagctagtccctctcccagatcataactaccattgtttttttttcaaaaagaccagtgtgtatagagatgcttagagaccttgaaacacccttaaaaacaagcactgggcagcggctagagacataaagatgaacagatgctgtccttagcccgagggaactcatagtttcagagaaggagacagggaagcgaatggaaaatgtgaaaacgtgaaagcaatgtgaaaacatgatccagacaggtgttgggtgtaaataagatgctctgggagccctaagcrggagggcaggaggggctggccaaggcaagcttctctgcagcaggatttggagtttcagttttcagctgcctgaaaacttaagacaggtctataggggtggacggagaaggcaatggcaacctactccagtactcatgcctggaaaatcccatggacggatgagcctggtaggctgcaatccatggagtcgctaggagtcggacatgactgagcgacttcactttcacttttcaccttcatgcactggagaaggaaatggcaacccactccagtgttcttgcctggagaatcccagggatg

SEQ ID NO: 40 - DNA, 600 bp, Bovine  MMBT02005
cctctgaaatcctcaactggaaaattcctctttctagctgcaactcattcattatttctgctactacctgactcccaacaacccctgttctcagcctcctagagacctccagtcctgggttctcctyttgtgaaccatagccttgagagagacattgcactctcactaccaatggaagctcactgacagcagtgattcccacaggcagaaagaagggggccattggtcctcaaggggctgggtgtgctcctccgtgggctctttccagcatccatctgcctgccctctctgtggcccctrctaggccaccattttctcctaccactcaaaccataagaggccactgctcatcttgctggctttctgtctactccctctccactctccccstcattctctacagctmgttcccttctgaacttgacacttggttccctggcatcatttctcttgctcttctctactcacatctcatgttctccttaagcaaccttgccccatgcctgtgccccagcttcacatacttgctggtaacacccacatctgtgccccatcctctgaccttgcacctgagttccaggagctgaattctccgcctcc

SEQ ID NO: 41 - DNA, 600 bp, Bovine  MMBT02644
ttaaaaaaagtgataaatatctgtgaaattataatttgacaaaagaaggaatgaatagatcacaaaattgacctgaactttctaaatgaacatatcaaagacattttataatgaccaatggtcacttttttctatccctacctgcaggaggtttactgtgaagttgagagtgttcggtacaatggggaacctctggctttgggccttttctcacactgaaactctgaaaaccaattcgccccagcaccctggcgggaggagttttcacatagaggagtcacctgtctcttcctggacctrtggcccctttggaatttctccgttacgaggcagtaggggtggagcagagaaagcattaggagccagagcactggtgcaggctgtgtgacctcagggaacttgcttcacctctctgggctttggtttccttctgggaagtctggatgatcttcatggacccctttaggacccctaaagggtcaggggagacggtgtaattggctgccatgaagcaccatacccatcatggatgcagttgtggcaactttcactgattttggtactggggagaatgtagctcatcatggaaaaggacataga

SEQ ID NO: 42 - DNA, 600 bp, Bovine  MMBT02066
ttctgggttacattggagcagcatctaattcccttcagcgtgtgcagggggacaacaggagcaaagaggagcctggggagatgtgtgccatgtggagtcctaaatgctctttgttgtgagcctgggatttaaagagaaagtggggagccctcctcactccccgggagagcctgcctccttgcaggatcagtatgaagrctcttttgtgtcctgcagaggcaggaagggcagtctgatcccagaccactgctcacagcagcgacttccccataacaaccgaaatactggctacaatgcatrcccccttgagggttcagtgyctcctgacagtaaaaccgaaaagggtccccttcctgtttcctgacctttatttccaaacagaggtatataagaatcttgtgttgcctctcatggtgcctgctgtataattaatgtcccaataatggatgtatggatgtccagatgtattcatgaataaatggaaatatgaataaatgaatgaaaaactaagctctcttcatcaagtcatacataaggcacagtcagatacctgggcctagagtctagcctctgagcagctcggaaaggcttctggaatat

SEQ ID NO: 43 - DNA, 536 bp, Bovine  MMBT02323
ttcatatgtggtttgaatagttaagtcagaaacagaaaatattgggatattttcatgtctctgtaaatttgttctcatacttaatggccttcatatgcttttcaaagctctttttcaaaatctgagccacataatagtctactaaataaacacctaaggagatatttagagcactatttgtttcttattttggcagattaggaaaatacaatataaaaatatcatctcaagaaaagattaaatttttacaaaagtgtcaattactcaccactggtctttggtttccccatttgtcatcartgctaaccctattctaccctttctgctgcttctaccgctctccagatatgcatggtctaacctgaccagatttcttctatcacaaagagaaattatctatttcataaattgatatctttccctacataaaagtatttttaaagatgagtctgtggcatgattgcaaaactaaaacaaggcagtggtttactacatgaagaattccaaacacaaatacttagaaagaggaaaagttt

SEQ ID NO: 44 - DNA, 598 bp, Bovine  MMBT02184
  misc_feature (1)..(64): n is any nucleotide
nnnnnnnnnnnnnnnnnnnnnnnnnnnnnnnnnnnnnnnnnnnnnnnnnnnnnnnnnnnnnnnnatttttttaaaagtttttcccaaattcatggatgaatcataaattatgccaggtatgatataaagaatattgaccttttttttttggtcacaacacacagcttgctaaatcttagttccctgatcagaaattgaacttggaccatggcagtgaaaacaccaattcctaaccactgaaccatcagaaaattccctaaaactgactttaaaaataaaatatgttgtgaatgccctaarcaagttgattagttgggtttttaaaaatttaatgtatatgtaaatctgcatrtataaatatacattcaatgtgtatgtttgtatgttctttattcaactgctccagatgatatgatatgggtccctctaagatttttttctgtgatgatcaaattgagccaataaatgtttgattaattcctatggtgagccccataaaggccagtcacagatagaaaggatagttaaggagggaactgctagttaaggagattttttaaggcttagagtagagcctgaartcaaatagaacagaaaa

SEQ ID NO: 45 - DNA, 600 bp, Bovine  MMBT02122
gttacttcatcactagacctcttcttggtggaatgtctattgccattctctggcactttaggttgtgctacacataaaatgccttgatgcgtctttttttcctttatcttactgaattttttcaatgtttttgttatacaagcagtacatgttcattgtaaaaaaaaaaaatcaaacttgaaatatgcaaatgagcaaaaaggagaggggaggcactgaggcataatcactgtggacttcagggttctcctccggtggtgttcctttgtggaaaaggggttttgttgtagcaagagtcartctgcatttcctggactacattcagttccatgactcctgattctaagtagcaggtttcattaaaaaaaaaaaaaaggcacatatttcagccaaaacaacggccacagaatcattctgaacgagttccaaaacctccggtggaggaaaattcctttaccatatgttgcacctttcatagggaatggcaggctaagaaaatcaacaaattgggaggaaaaaggaaaaaatgctatacagtgatttctcagctatgtaaaaatatttatgataataaagaccttcataaaatacaccccagaa

SEQ ID NO: 46 - DNA, 598 bp, Bovine  MMBT02016
  misc_feature (1)..(50): n is any nucleotide
nnnnnnnnnnnnnnnnnnnnnnnnnnnnnnnnnnnnnnnnnnnnnnnnnnagcagatgcaacagcaacactgtgaaagccccttttttccctaccgctctccgtgagtcactcatgctaacctcatttggcttgttcagatcatataagtattcgttagatgaaacaaaggtactgtccccgccaccagaatcctcaaaaagaaagctacacgctccttaaaattattccagcctaactgaggaagtcaacagataaaagaactcataatcaagacacataaaaacaaaattaccaaaargaaaacattctgtacacatcatggtgaagtgccctgtcccggtacagacacacccaggtgctgttactaacatcggtgcctatgcgtcctgtcctcaaattctctcctcaaagtttgactcctaaaaaayaggcttggtaaaaggttgaggtcccaggtggtgctaccggtaaagaaccctcctgccaatgcaggaggcgcaagagatgcgagtttgatgcctgcatcaagaagatcctctggaggaggaaatggcaacccactccagtcttcttgcctcggaaaactgcagtccatg

SEQ ID NO: 47 - DNA, 600 bp, Bovine  MMBT01988
gtcaaggccaattttctgaaaatatagttgaggaagctatatccttgagtgattatgcgactagcccaggatcacgatgttgttgctgaccttatcaccctgtgggtctggagtctggtccagggttttccatctcataaagtaagttcgagttaacttatttcctatttgcttccaacaattgattacccaatgtaagctggagactgggcttggcactaagatactttaactcatgccctcaataacccttcattttaccaagaggaaacagaagttcatggagttttggcagttcarccatgttcatgcagttattaaatggtagagccaaaattgacaatcaagtgtgtctgacaccaaactgtgaaattttcctggcaccacaaattggagattttactgaatggaagggtacagtgtagactcagcaggcttctcagtccagctagaatgctctacctagaagttactttgcccaaacatcctcctgtagaagtatagaaatcccctcctgcagatatctctaccttaaacctctagtgagagaggagccctttctttcttttggcctgccatttggccttgagtttcccacag

SEQ ID NO: 48 - DNA, 600 bp, Bovine  MMBT01980
gctgtaatttttacaaggaattagaaacatgacttaagtaaatattctctctttaagaatgtcattcacctaattaaatatagtaaaagtactgtctacactcccaattaatttgctaatctacaagaaatctagaatcaatagctagctaatagctactcaaatgagtcactaaagacaaaaatattcatatttgtatttggtagttgaagagcaatcataatacagatgacaatatacatttgtgcaactcaaaatgatggcaatgtgtctagaatcaagccctataaaacttactcrgggatttgaatcatgccatttgtttttttattgtttgactttcttctccttcaaattggacccatgtcagcataagcacactggctgacaccggtcctcactggacatttccatgacaaacctaaaagtcacaggcaacataaattgtcaaggttttatgartacagctctgctaagtgcaaagtattttctagacaaaagttwagcgcaaaggtagaagggtcattttagtgtagtaaaaacagaggagtcctggatgcatttttttagaacctcaaattaattatgraatcaggagtg

SEQ ID NO: 49 - DNA, 600 bp, Bovine  MMBT02487
aatagcaatatgctatgaaattcataacagtctctaaagagcctttgaaaatattataatacctatttagttcttgaacaatttattaataaaacktaaaacttaataaaacctttatctgagttaagttkctcttttaggcttacaaaaataaaacaaaacagaaccactaactctgaagcatgtagataagaatgagtcaaaattctatgacttttatgtttcaatacaagttgtgtgtaacatacctcaggatttgtgtcaaactccaggcttaaacagtggaaaccgttttatctrtttacttggttcagaaaggctcagtgcctctaggcaatcaatctaactctttgcagcaagacataagttatttgagatttctacctcaaaacctattatgcccccaaagtgctatctctgattattgttaaacgaagtctcagttggcagaagagttcaccatactagaactcttgatagcttcagagaaatactttattaaattctaaagcactcaagccatacctccaaaatacaggcaaacctccagagtctccttgaaaaattactcatggcccaagcactattggagccataaaa

SEQ ID NO: 50 - DNA, 601 bp, Bovine  MMBT01955
  misc_feature (1)..(1): n is any nucleotide
ncaacagaattcatttgtctgctgctgttctctcaaatatgaaaaagtcagaattggctgcctgagacccttgggttggatggggtgttatgcagctttgtgccatagattctatgtcctaaaggcaatagatccaatcataggacttcattcaattttctctttctattgagcattagtaagtcttttttttttttttaactggtctcattctacaaagaatttgagatgcctttttccttttcatagctgtccacttgaaacttataaagacacctctcattatgaagattaccctccrtggcccttcaactcaaaattgcattcagagtccaatgacattcccaagctrttttgcaatttcatgaaattaattttcattaagtctactcaaaagctttttcattttccatgtctggaaatcttttttaagaaagagacacacacatgcacacaaggaaatcattttccaacaaagacttaaatgtatccagagctcccaatttgaagtcatttatttagtcttctccaagcactgctttttaaaaccaggctgggcctcctatcaagttctagcactctgttaactcctgactgtccc

SEQ ID NO: 51 - DNA, 559 bp, Bovine  MMBT01808
agaagaaatctagtagggattcataattaggcccttggggtaaacataagaaagaaatataaagttgagacaatgtaaaggaaagtcagttttcagaaactatatttagtcagaaataagcaagtactagtttggttttaaaatatgaactctccaggagtcaaccttgatgctatatctttgaacatccaaatacagcagaccttgaaaaaaaaaacaaaaacctctcatcacttcaaaaactaggaccaacaatccatttacagcagtaatctaaaaacaatcgacaccaagacatartaaaactggaccaggaggctatcattatatttgccagaagctgagcaaagttgctagccagaatcratgttagaagtaaattttctttgagtacttcaatttttcctgggcagataaatgcaaaatctgtaagcaataaaactggtcacctctttcatttctttcaagcaactggagaactggtcacccgctctctctataattattcttgtcttacatttctacatccattctgagatggattctcctggaaagagtg

SEQ ID NO: 52 - DNA, 600 bp, Bovine  MMBT02614
ttttttttaattatttggaggcttttcttgattggtgctatacttttaagtatttgcatcgaatagaaacaatttaaaattaaacttcaaagatgacaacagagccataaatatattgatactctggttagtagcattatgttctctaccttgtttcctgcttaaaaaattatagttcaagtattaatttatagtgtgtttgtcatcttagtatggtagctgatgatgaagatgcattgagtgattcagaaaccactgaagccctgaccccagatatcttagctcggaagtaagtattgrtaactataaagcatattccacaactgtaaagctgtgtttaattttgcagagtyaaagacattttactttacttgtacaagtgtaaataaaaagcatgtgctaaatgaattaagtttcatctagatttttcatagcaacctgtatagtcttatttctaggttaaaatcaaagtatgtagatgagtaccagaagctggtatacagattccctatgttgattgcctgcatagagatttttttttttttttttaatatcctgctacctgggtattaaagatacaagtgagataggtaaaaataa

SEQ ID NO: 53 - DNA, 600 bp, Bovine  MMBT02689
gagtctggaactaatgttacataagtagcaagcacactagagttagcatgtccaattaatgtctggctattggggcaaaatgacattctgaggcatgaagaacaaaagggtaattggatataaaagggatctcattttaacaaacatgaatctacatggccattcctatgagcatgattcactgcaacactgcaaaataagagacattctaatattgaaactttcttaagattataacaaagatacatccaaaacaggcaatattctaaattataaaagtgtactgttaatcattattcrtaagttcttcataaaatatttataatttttgaagttcttctatatctcagctgactctctcaacaaccttgtgaacaaactgggcagtgagcatgtagttttatatatgagaaaagcagatatatatactcttcaaggtcatatagccagtaagaattcacccttcattcattcattcacttacccacatttttacaaagtatctactatgtggcaaacactgtactgctatatgttgagggaatacaaaaattaatgagattaatcttttaattagaaaatcatatagcagatcaaatt

SEQ ID NO: 54 - DNA, 600 bp, Bovine  MMBT02932
actaaaaaataaaaatccatagtaaaagcaaatttgccgttaatcaaggatcattcttcttaaaagtaagaatttattagatatctagcaaattttaagtccaacaagtaagttttagtggatttttatcttgatgatttttaaaactatgcgttgtttttaaaatattttggcccgttgacgtttatattttcattttatcaccctttacacactttcctcttatgcaaatatatctactcttatcacctctttatgtatttcttttcatattacatgtttcgttatcacatttattcrttttcatagtgataaggtttcaaaacattccccttcctttcataggcacagttctttctcctagaaatatctgaggagttgatttcttacattttaaaatactccagtttacacttaaaattgacattatgcatatgtctataaaatagtaaagtaaaaagaaaaatacaaaaatttgacttagattttttaacaagttgtttttcaagtagccatatcctttctaactaaagaaataaaggctgaactagaaaaagaagcccccttaaaaaaagatatatacatatatatgtatgtaca

SEQ ID NO: 55 - DNA, 598 bp, Bovine  MMBT02014
  misc_feature (1)..(72): n is any nucleotide
nnnnnnnnnnnnnnnnnnnnnnnnnnnnnnnnnnnnnnnnnnnnnnnnnnnnnnnnnnnnnnnnnnnnnnnnctagaaattttatgaaaaatgttatttttctacacacacacaacatctctgaaggccaaacaaaatatatctgtggaaggaattcattccataggccactagtttgaaagtactggtctaccacctacatcgtggctttcctctctatattcccgtctctttcataagcccctgagctttgaaagggccaggatcaggattgtcttgtttaaagttaggcaccgcatrcctagctcagttcttggtgtgtggtagagatctatacatgcatgaatgggtgaatagttagctggatgcaggcatgtatgtgcctcctccatatggatggagagtgagtagatagatggcgagatggatggatgagatcacacaactgatgcaggaagacagtgcatagatatgatcggtgccagagcaggcagagggagggggagagaggagagaggtgagtttgatgtcttcatttgggtggttatgccattagctggctcttgtgttggggtccatgagagtcacaccgatccct

SEQ ID NO: 56 - DNA, 600 bp, Bovine  MMBT02179
caagtctccaaatacggttcagcaatgaggaccagtatagaatgaaaaaaaaaaaattgggtgttttccttttttaatttttgtttctgtgaaaaacatcattaaaatagttaatattcacaggcagtatctgaggcaagagtaagtgtgtcaccctttgcagaaacatggagcatgtacaagtataatgttgcttttttttttagaatcgtgtgatatatttgaacatatagcagctataagaaaaaaatgctgccagtatgttggtaatggttgggaggatggttagatggctgcatrttgaatwaagcagaatcaaggtccagaagaacaaggctgaactgccacacacatccttactacctcctgcgtaccttgactccaagtattattgctccagtaacaccccaaaacttacagtgttctgaacttgatagtgtcttggggtatctgtayctttttttgacactgtaattcttgattgaccattagaattttctgcagtgtctcatatggtagctgctaaccatatgtggccaccgagcacctgaaacgtggcttacgcagcctgggaactgaacgtttcattttattgattta

SEQ ID NO: 57 - DNA, 600 bp, Bovine  MMBT01576
tttctaggtcatcagaacctagatattttaaattgtgtaactagatgtggtctctatccttgaggattcagattagaatagtcactcacctaaagacatcagttgaatctaacaaagcatatcaagcacccccgcagggaaaggagaaggggcagtgatgccaactcacctttggctccggctgatgactttgcaatccaaacgttgccctctccctcctctttctttctgttatatgaagccaggaaaaattctctctcgtctgtccttgaactatggagtggtggatggattccattytgagctggagcaactggggtcttgaggttggttgggtaaatcacgtaggactcggggaaccatgtgcaggactcagccagttctgggctggttttgatgagcctggcagacgatagaaggtcagtctctcttctgaggacagtctctccctctattcagaaaagccagtgcttcgcccacagctctccaaggaggcatggccagggcccggagctggtctccttatcccacacctcactcttggcctcactgggcagacctccaatggaccacagagcagcacacagctgttacacacga

SEQ ID NO: 58 - DNA, 600 bp, Bovine  MMBT00845
atattttgctgtttgataaacttcgtaaaacagtggagctgagtgattttgctgctgcctgaatggaagtattctaagaacccatgccaagaagataaataaggctgtggctccaggaggggagctgaaacaaatgtgcagcggagaggtacatcaaagtaaaactagctctcctgacgacccagctctgcgtgtgacggagcgtgtgcgtgtgcgcgggtgtgtggcggaccaagtgtttggcagacactaggctacatcgaggggcctgaagatgtaccctgggctcttgccagcccytctgacggcagccctgtacacaataggcctgcttgacatttaagtaggattaggcccagccctgcttggtacaaagggaaagcagtgttagccactgctggagattcaggccctacagccagccagcttggggttaattcagactggaatatgtgtagtgagaggacctgggatccttcagtgggcagggggcctcagtccctattggccagtgaaagatttattctgcactgatgacagggggtacaagcttcgagtgtaaaaacatcagcccctctcatatgtggctccagactcctc

SEQ ID NO: 59 - DNA, 600 bp, Bovine  MMBT01542
ggtgtgaaaatgatattctgggtacctttttgagtctttgtatttgcgagatgcatgatgaactatctacagatgggatgaagtgatttctgggatttgcttcaaaataaactgggcagtggggagctggtgggcatacagatggcgatcatcactgacgctgtgagatgggcacgtgaagatctcatcagaggttcctttctacttcggtgtgtatttgacattttcctgagtataatgcttagaaatcaaatcatgaaattatggatttaagtctggattatgaatcggcttcaagcyattacttggatggttaatagggacctgggcatgcctgcacacacagatcatcagctgaaagggaagatccacacttgcttctaggattgcgtgagactttggaaagtcaggtatacagaggactgtccagaaagctatcaagaaaagaaacccagtgtctctgaagacagactaaagccatgtaacttccactaccatcagaagccttcacatactgaaatttaaactgaaataaacgtcctggtatttaaaaacgaaaaagatacacaccaccacaatatgaagcaaaagttataagaa

SEQ ID NO: 60 - DNA, 600 bp, Bovine  MMBT01355
aactaaattttagaagagttgttacacagtgataaataaccagaaaaatttccactcatcttcttagaatagatccctagaaaaggaaagattgtgtaagagcatagctattttaaaggctcttgatacatgtagccttgcagacctctagaagaactgtgtcagtcgcactcctctcatctgtgtatgagcatctctttcattgtacacttgccagcattgaagattatgttaaaaaagtacttattttatcttttttctttttgatttgtcctttaataaaagaacactatttcttaycatatttctgacacgtttccccagcttatttgatttgaaaatgtttatctttttaattttgcttacagtttttatggaaatgaatttactattctgtaatcaatgtctcgtttccttgaaaggacaagcaaagaaggataactcatacagaattaccagaaattacacctgaggctcctataaagacagccaacttcacaaagcaaagcaatctgtcgatgtcacatgcatagtgcaggcaactatagatccctctccagaggtgactgtggcagtgatcctatcaccagggaagggcag

SEQ ID NO: 61 - DNA, 598 bp, Bovine  MMBT00662
  misc_feature (1)..(41): n is any nucleotide
nnnnnnnnnnnnnnnnnnnnnnnnnnnnnnnnnnnnnnnnncagtgaagaaagtggggggggggagctataatctgtaattgtatttgataaaatgataaattgaaaagataagtaactttaaatgtttagacgttacctataacctattaatcacttttatttatcttctgataaaaatttcactacaaggatagctaattaaaaaaaagcagttattctgataggcaaattctgaacaacctgataaaacgataatttttactgtttgtatgccttagatcacttttgaaataagtgyaaaatggtttatcttacctgtaccactgaggaattgaggtactctgcacatacccctaagggctgcactagtgctgagactgcctgaaaaaaagacagcaaatktgagaaataaatgtgagcaagttctttcctttcaacattaaacaaatccttttttatatgtcagagaacattttatmctcttgggcaggaaaagctgatataaagatgtcagttcatttaaattattgtagaaatttaatgtaacttaaatcatactatgccaataaaacttctttcaaggcttggatgagatg

SEQ ID NO: 62 - DNA, 600 bp, Bovine  MMBT00575
gttgcattgaagcataaaagaaatgggtttataaatcaaaatctttttctgtaggcccctggtgagtgcagcatttcaaggaaggctttggcaaaccttttctgtaaagtgtagaattgctttctattgcaaacagctcttctttgtaaggctgtttcacacacacgcatgagcttgtgtgcacaaattacagaggtaatatgtgattttgggtagaaggaaagagagagagagaaggagttagggaagaagaaaggaaaggaagaagggaggcaggaagccaggaaggtaaggcgagargggtgaacaagcagttggatatacaagcctggagttcaggaaaaggtccaggctgaaatgtacatttgggagctatcagcatatgaaaggcatataaagccacaagttggtgatgtgcccaagagggtgggggaggataaggagaagagaacatggggcagaaccctagaataactcaagggtaataggttgaggagccaagaaagaaccagcaaaggagacagaggagaagaattcagggaggtagcagtcaagagagggtgagatcccagaacagagaggagaaaaggtttcagagag

SEQ ID NO: 63 - DNA, 600 bp, Bovine  MMBT01509
ctgaggtcattgctgcctgaagtcacagtgccctcttttccatctgatcaatagcaagagttctttcttcccatacttgctccacggcggccctctcatgaatcatgaatgcctgggtgtgaataggcatgcgccattccaggcactgaggatgtgccagtgagactggtctcacccatttcacaagtaggcgtgtggccctacttgtcagctgatgccttcacaagtgagttagtctgacaggggtgctgtcatcacacaggggaccctgggaggctccttcagccagaatagaaaccrcacctgtcttctctataactgagaagtcttstgttcctcaggattgaggacaggcccactttatcaccagtgctttccatgacattctcacttactggatcccccttccatcagcgctgaccggtttcttctctcttctaacccactgggtcgagggaccatttgtctctctcctgtgtcatacgtacccagcccaagggggccagtccaggtgaccagacagtcggtcaataggtgatgctctagggcagcttaccgcctcatatgttgtcgatgcacacggacaacatcgatttatga

SEQ ID NO: 64 - DNA, 600 bp, Bovine  MMBT00552
ggttctgatgtccaggctcccatcctgctcatgtccagaggtcttggggccctgttggaggctgcagaagatggatttagagccatcaggtgggggctgaggcctctgcctcccgaggaggtctcaccaagggacgccatgtgactaagaggagggcggacactggggcctggagacctgggttcaccctgccccccactgcccctgcactgacttgccagcccttgagcaaaacccaggaatctctaagggctcgtctcctcctctgctcagtgagggtctcaacaggctcagagggtrgcctgtgcctgggttcctgaaccccagtggctagttggagatgagtctgatttaggagtttcctcccggggatgcatgagagtccagcaagctcttaactcagtatggaggggtctccatgaatggccacgatgacagctgttctcactgttttctgggaaatgggatgtgatggcaagctgtcggaagcctgagagaggtcatgcggatggtagcgggcttgctgtgcactggctgcwgctgctcaccacaaggaaggcctggcctccgtccaggagcactggttccgtgattcccaga

SEQ ID NO: 65 - DNA, 600 bp, Bovine  MMBT01215
tagcagctgtaggccttgcctagttgtgcaaatgacaaagaactacctacactgttcaccaaaattgtgatttatttggtcacttagacacattcttgtccttttagaatttcagagaaacatgcttccttcacgaattcgggtggtaaagtgacggtgactccatacggcaaatgcaaggtcatcgttaatggggtgcccatcacgaccaagacgaagctgcagcatttggtaaactcccctgcggagccacaggatttcctaagtccaaccaggagagctggagtgaggccggcaggrctgggcgctaagccccttctgtccctctgccaccgtgtcccagtgatgacgaggtcacagctgtggagttgggatattaactccctgagtgtctgggggaagtcgtttcacctccctggaccttgcttacaaaacagagaggggtgaactaggtgctcgccaagatccttccagctctaacgctgtatgatattttagattttaacaacctgccatggagggacttccctgatggtccagtggctaagattctgagctcccaatgcagggggcctgggttcgatccctggtcagggaact

SEQ ID NO: 66 - DNA, 481 bp, Bovine  MMBT00927
  misc_feature (1)..(180): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcactttctgaattttagtctggtccaatagacagtttaatggaatcagaaaagcgagagactaaatgacctattaaattaagtgtatctattaactgttccctggggcagtgttcrgtttgattcaaaatgacttcacttccctcggggagcggggagagagggagagcatttccattaatgacttcttattccacggaacaaagctctccaatagaatcagctgatcagcttcctctgttggcatcctggctcaggcagggacttgccatatatttgcttttgtctcagaatgggg

SEQ ID NO: 67 - DNA, 600 bp, Bovine  MMBT00583
gggaaaaggttatttgaatcacctttcaaaataacctacagcacaggagcagcatgcaaagcaaaaacttccaggctattgttagcattatttaaaatatatgtttcagagcttagcagtttatgggtcagcttaactctttcatttccccattctgtctaacctattgagcatatttaaaggtcctcttcaagtatccaccactagaagcggggaaggaagctctctatgtacaggatatggaataaaaacattccaaattacatcttgtcagcataagttttgtttgagccccasaarcttttctgctgttagggcattttggtccaagtttcccctaagtcagttacacttcacttcctctcctaaacttcttataaatcacattatacttctcagccatctctctgtgcactgagtatagtacaagataaacagacaagaacccaaatcattcaatttggatctgctggtggccttttaaaacatactgtctatccactaattgcccaataatgacttgatgtttattttcataaaatgcaacgttcaaaaatcttcagaaaccatacagtgaaggcagctgtttcacattacatg

SEQ ID NO: 68 - DNA, 600 bp, Bovine  MMBT01628
tagctccctaggttccaggatctcaatagaaaataacatcaacagttagtgaaattgtaggtgttaacataccatggaaaacagagcttgtgcaaatattaacacccaggacttctgtatagatgatttttattataaacaataaaatatatgtaatgtctgaactacaaacctttcgtgttgaaatggtctctaacatgagttgctttaatattatgaagcgaaaaagtttaagaatctcacagtggaaacaatccaacactgataaactctagtgatcaaagacattctcttttaatraagaacaaggacaattcgaaattacagaatgtcctagctgtgggtattatgagacaagccaactttccagaccgaaaggcactcacagctagggatgaaacgaactccgaaccaaaccagccacagtgggctggtcccttaaaaacagtggttactgttcagcttgagcagtccaaggacaaaggaaacactgagcagaaaacattcccttctctttaaacctaccactcacactacatatactggccaccctcatcactgctttggtcaagcaacatggaaggcaggtcagttccagtt

SEQ ID NO: 69 - DNA, 600 bp, Bovine  MMBT01205
gaaatgatagtatttggatactatttagttgattaaaatatattattttaaatrattttacctgtttactttttaaaatgtggttttagaaatattaaaattggatatgtggtttacattatgtatctgttgaattattttgtcctgagatcagttaggagacttaggaaaattcaggtgagacatcaggaggatcttgaatcagggttgtggcaacagggtatggtgggtaaatctgagaactgtctaggagataaaactgataggatttggcatttgggtaagagaggtggcaaactrgttgtaaagagaaaaagggagcctccaagtacttaaaatataggaaatggtattgtaatactaggtggcaagtgaggcacaggttgttatataattttgagtgtgtaatgtttcttaacaccctccagtttgatgtctttgaaatttatttgcatgttttctttaagattaaacttatttctgtttaaaagaataaacactttaattacatgtgaaggttactgagatccatctttaaagttgaagccctaaagtatctgatgaatgttaaacatttaatactttttcctattgaccttc

SEQ ID NO: 70 - DNA, 600 bp, Bovine  MMBT01734
agataaacacgagtctatttttcatcctcctttgcagtccttactcaatcaaaacttaacttttgagttcctactgtctaacagtaagcaagacaggcatgattcctacattcataaagctttcaaacattaaatgaataaccacctagaggaatatatgattacaacttttgattagtacaatcaaggaaaattttgctaagagacgaatggagatgggtgtttatatggaaagagggatcaggcaaagcatttttagggagaagtacagctgggggaggctgacacagaactggttarcctgrgattgggactatttcaggaagagggatgaatatctgcaaaatccttgaggcaagaaggagcttggtttatatgaaaaccagaaggaaggccactgtggttggaacctggtgagggagagggggagaggtatgagatgtagctagaaatctggacagaggataaatcccaagattctgcagaccatgctgaggatgtggggttttattttaaatacattagggaggcattggaagattttagggagagtgacatgattaccagatattaagcacacaaagaagttagaaaatagaa

SEQ ID NO: 71 - DNA, 440 bp, Bovine  MMBT01518
gtcccaatcccaagatgttattgacttacacgagaggaaacgcgcccacaaacaagataatcacacagagttaataattttcccagaggcccactgccgctgtgctctgagggttcaaacattacctggacgggaggatcttacaaaatgttgacagcggagtctgcaatagatgctgggaagtggtggagactgcccacccccacccggctgccccaggctgctctgcctccctgcacaacgcagcccccagcccatctttgccacttactcttctttccttccctcttccttctttcrctttattttgggtaaaacaaaaattacgacaatagctaacatgttgagaactttcctatgccagacctcccgcatagtttcattcaagcttcaatacagcaatactggggcttaccctggggctcagggtagggagttca

SEQ ID NO: 72 - DNA, 600 bp, Bovine  MMBT01791
gagttctgacttcaaggccagagaactttctggagttggacactgatatatcacagtgtgaccataggttggaaaaccgtggttgaagtttgtcaaccttacatgtaaagtagattaaatgggttctacatagtatttgcaaggtctttcccatggaatagcagatacatttagtatatgacattcatcctggatactcagaaacgttataagatttagctcatgaagcctaccctgacccccagagccaggaatcatgtctctcgtcctcagaacaccgagagctctttgactgaactraaacacttcctacggcatttatattgtgtggtctgtccattcttttcccttaggaccacmtcgcatctccctactagtttgtacatttcttggcagcatgggctatgtctttttcatggtggtatcacccactgtgtctagcctaacacacagcaggttcccaaaaggtttactttatagatttgtgaaccccacaagtggttacctgagaatgtatctgcccatggtcctttgtaaaaacaggagaagcagtgtgatccaaagagccggtgtggaggagattgttgatgtggaagggcc

SEQ ID NO: 73 - DNA, 600 bp, Bovine  MMBT01313
tttttggattatcttggcttgcatctcctgttgcatctcctctgtttatcagtcttctttaaataggggtagctttatctggtactgagggtaaattcgtcactcagccctgttgaccttggcttccttccaaaagcagactggctctcygactgttgccattggtttgtaatctctgtttacctctttggcttcttggatgactagaggggtatgacctggattagtaggcagttgagtgtctcagtttggttatgttgcctcagaatatttttcacacgagtctgatgaattatgatraattatctaccatgggggcatgtgtagccatgggaggagttctcctgtgagatttgaactatctctccacagacaagaagktcactctggttgccagctagcactctgtggcacacggggttttggtatgatgagtcatcttctgtttatttctgttgaaataacttcaatccacagttgcacagttgacttttaggctgtcctctctttcctatgtgaaaggttcctatatgaaaggatgatgcttggtccttcatgactctttcactaaaacacttcacctaaggctcagagagaaaa

SEQ ID NO: 74 - DNA, 600 bp, Bovine  MMBT01637
aacacctctagattttgtaattctcaatttcttggtttgatagtaatttgtaaaagttatctgcctttatttagtctttccaggatcttcccaacccaggaatcgaaccaaggtctcctacattgcagatggattcttcaccatatgagccacmagggaggcctaaagtatctgacttagttgttcttaaaatatctcagtatcttccttttctacattcctgtttggatcatttatgtaaagattaaattaggtaattaaattaagtacagtttggaaatgttccccagctgactttgrtaaagayttagcttttggtaggaacagagatgagctgcaggagaagttggctcctggtcatggagtgagggggtccttctgtggagctaaagctggaatgcagatttagattttccaggggtctttaaattaggtcagctatagggtcctgctgtattacatgttactagttggagttgcctaattgaaatttttaaaatttcaaggctgtgattatgaatgctacagttcaccagttatgtagtttaaatattacattaaaaaaagaaaatccttgcttctagtgttattgtctgacct

SEQ ID NO: 75 - DNA, 600 bp, Bovine  MMBT01631
gacccagggattgaacccgggtctcccgcattgtaggcagacgctttactgtctgagccaccagggaagtcttaagtcctactcaaggtaggtagagggggaaattttttaaaaggtttaggaaatagtccttggcattaacacagttccagaaatgttttttattcccataagccaaactggcaagtttatagtttagggtaattgtgtagaaaactcagtagcagggattaattaaccctagatgggaataccaattgggacctgcatagcaaatcataaaagcaacactcaagaaaracaaactatttctgagtaattaaactgcatcctgggcataattcacaaatatttatgtgagtacaaaaatactcagcacccagcaagttaaaattcacratgtctgtcattaaaacaaagattaccaggcatacaaagaagcaggaaaacatgacctgtaacaaggaaaataattaatcaatcaaaaccagcctgcaactgacacagatgttagaattagcaaacaagtacatttaaacagttatagttattctgtatgttcaaacagttaaacagggaaatggaagacataagaaagac

SEQ ID NO: 76 - DNA, 600 bp, Bovine  MMBT01474
catgctcagggttagagttcaaggagagttagggatgctgcctcaaggctgtgtctctaggttctccaatgctccttctgtttttccttgctcagcctcgtgagcagagtgaattaatccccttaggccctccagtgaatctagctcccctacaggcatggtcatccattctttccctagagtgttttagagaggaagaggcctccatatgaatgatttcttctttactccgccatggcaatgcagacttggaggaaatgttaaattacctttttgtatgctccttgaatttttaacagrtcatctttgaattatcttaaaaaataaaagcaacatggttttcctgattgtaaaattaaaccttgttcatgaagaacatagacacaaaaatgcaaatcacccacgactccaccatgcaaaagtaacacctgttaacatttgaatttctctttttatgactatttcattacattaytgargtaagattctaggtaatttggtaggttatttttttccattgatattaatggaaaacatgaataatattttctcatgttattaacactcttcagtaacataatggtagtggcttcctcttaa

SEQ ID NO: 77 - DNA, 600 bp, Bovine  MMBT01770
accaaaacccttatgtcttcaataacatacaatacaactccatggtgactttaaaatttttgtttgactttattatttatttattgttttaataatgcagtttccctggttgtggcatgtctggatcttttttctctcttgtgctaaaagcaaatggtttacatgccagtttgtggtggatgtagttggggatctccattaatgaaactatttctttagtttctgttcattctaatctgcaaacacaatgctcaggaaatgtaggaaaatgagctccttctattagggctgccatatacrattgtgcaagttgtggactgtacaacttacacaactgtacacagcaactctgtgctgcaatcgtcaatagggccccgtgctccagtctttcatccgtgcaaaaataagctgactgaaagagtgggatgtaaaggaatcttatgaaatcctgtgcttttcttcccccacacatgaggcaaagtttatcattcattatgtaattttaggttccagtctttattatggaataaacaacatttagggggttgagaaaaaaaagtacagtgaaataaaatttgaataaaattttgaagtgaaagt

SEQ ID NO: 78 - DNA, 600 bp, Bovine  MMBT01502
aaaggccctgatgctggggaagattgaaggccaaaggagaagggggtggcagaggatgatggttagatagtatcactgactcaagggacatgaacttgagcataaactccaggagacagtgacagacaagggaaacctggcatggtacactccatggagtcacaaagagttggatgtgacttagcaactgagtaacaacaacaaaggttgactttggtgggtgcaattgttttactagttgactgcttwacagaaggttatttgcatgtgttaacagataacttccggagacaaggctarggttaaaagaaggatgccattccaggttctgtgtcagsctgtggggctgtgtgtgagtggctgtggttgtgagaagccctttaaaacactgttcatatcatayccttcaggccacagcctcctgtagagctcatgtcagcccttggagtatatttcagggtgacagtcttttctgcccatgctactggacttggaatgagagagtagatgaaatgtaaattcagatacrtgtgggaatgagcagttgcttcttttgaatagactggcatggagttgaagatacaggtgacaggccaggga

SEQ ID NO: 79 - DNA, 600 bp, Bovine  MMBT01477
aatttactgagccactataataagataaccagatggagaagctaatgggctgagacaacgacagttaaatattatttgccaacatcagtacagtggaagtggagtatattataggccagtacttaccttttaattaaaataatactgttttcagcattattttaatatagcagttaggcagcagggactcagactattagtcttattatttttttaagcctcttttgggatgactaagcaaagtcagacaacctgaatgtcatagtattttgatccagctgttcaaagtctattttgttrcttgtttgatcctattaagttaatattttaaagaatatgaaacagtatagcaatattcacaaagatcaaaaatcttagaattgaaaataaaatttttaaggattcatttagcacccatctctacattctttgagaactttccaagagttattcaataaatcattgaaatttaaaatatcctcttaagtttctgtttttaagtacttctaatctgtttggagaaggcaatggcaccccactccagtactcttgcctggaaaatcccatggatgggaggagcctggtgggctgcagtccata

SEQ ID NO: 80 - DNA, 598 bp, Bovine  MMBT01746
  misc_feature (1)..(31): n is any nucleotide
nnnnnnnnnnnnnnnnnnnnnnnnnnnnnnnactcgagtttctccctgggccgggaagatcccctggagaaggaaatagcagcccactccagtatgcttgcctagaaaattccatggacagaggagcctggcgggctacagaccatgggttcgcaagagtcggacatgacttagtgactaaaccaccaccattttttaccctatcaacaaatttcctgtccagggactggacatctaatttatcaattaaaaaaaaaaaaagaccacagtactcaagcagcatgcaaatttaataggagrgaatcacgtccccagctccatgataaggaaaaatacatttatctctcaagagcaccagcttcactgagggtttttctggaagaactgatcatgggaaacttgggaggaggcagatcttgtgcttccagtgtaattgaaaggcaggaggcaggggtgtgtatgtggaaagtttcaggagaagggctggaggcaatagtgtaagaactcactgtgaatctactatagagagaatgtcacttacaggcttgagattagaacagataagtggagtgagtcctgctaatggagagctttgaag

SEQ ID NO: 81 - DNA, 601 bp, Bovine  MMBT01373
  misc_feature (1)..(1): n is any nucleotide
ngtcttaaaatgtggacagagttggatacttcacagatgttagagatgaagttagtaatttatttaatgattgaaaagaagcatgtttataattatgtgtttgatattattaaatcacatcaaaatatgagaaggaggaattacctctaattaaataaagttggttttataaagttcaggatattatgttctagtttatgttttgggaacattttatcctacacctgtacaatggtagatgttctattttttttaatcaactttattacttaagaagttcacaacaaaactgagcagaagrtccagagacttcccatatatccttctccgtaaacttgcataaggtcccccaatattaacatcgcccaccacagtggtacatttgttaaaattgttaaacctacattgatacttcatgatcacccaaagtctgcagcttacattaggattcactcttggtattgtacattctgtgggtttagacaaatgtgtaatgacatgtatctaccagtgtagaactatccagcctctttctaagctatgtcagttcatctcaccctcacctctaatcctcggcaaccactgacagttttattgtctc

SEQ ID NO: 82 - DNA, 600 bp, Bovine  MMBT01489
caactgtgcaagaatctgccctgtgtctgacttcagcaaaattctgaagtttctgttttttttttttaagtttatgcttaataaagaagtgtgctgatayarttctaagcttccagtgatggacttggccttcctccacacctggatgatcctgctttagtaaagctgttcaagtaagaggctgatcgagcactttcaagggatggccagagtgagtcactcccctacgtggaagtttactggataacttgaataggcatccagcttctaaccagaaaggagggtttcttgtaaatgggrtaacagatgtaatatgagcaaagtcccaaggagtttcccraagaaacttgaatgctttctgggaaagaaaggccattttttggtcacattctcttagcttctaatgcctctgtattttgatgtgtcacaagtgactcagcttctagggagatgaaaccagcttagaggagccactaaaacatccatgagcaaatagacttgggtgcaagactgaaaacgcagagtatgtgagagaacggggctggatagatagagcctgtgcatatagtcttggggagaacgtcccccgacacagtggat

SEQ ID NO: 83 - DNA, 600 bp, Bovine  MMBT01348
gtagagtcaggccttgatctaggttccttgtctccaaattgttggctctttgctcatatctgtgcttttggctctaaaaatcttaaggatggttttaaaaattagatgtgattaaaaggtaaaaatatacagaaataaatgttttactgttattgtcatcaacaaatgggcttcctccagtgtgcagcaatgcatttttttctgagtccttgaaacagaaaagctgcggcttcttgcattagacgaagcttgcacgtggatggcaaactacagcaatgtctaccgatgccgggtgtggarcattcgtgcttcaaaagttcatttgtggttgtttagaatggaggcytcattttcacaaacgagtaatgttataaatggtggctagattcttgagttatctcacaaggctgtttaattaacaatgtcttagagtacatttctagtttatcaggtggctgaagtaatgcatatattatgccagccactgcaacataatcatcaakttcttgatcaattaaggagtgtttactttgagccctgagaactgtctcctgacagcagtactgaatctgtcactataggttctagagtatgtaggag

SEQ ID NO: 84 - DNA, 600 bp, Bovine  MMBT01160
taaraaatgatgactagcagatctggggtgttcaagccctgcacattattaagaaaagtctggcccttgacccgtttctaggagacagcttctaagccttggaatatgttgcctcrtaacagtatccttrtttaacctgggccttaatgcatatcatataatttttgatgacagtgtgatctatggtgggagtcttaggccatgaaaaaccagtttgacttcaggtgtgactggagactgaatacctaagatcagccaggtatatctgattacttatctacaatcagtaaaatccctggrgactaacacttggataaacttcgctggttggctayattccatgtgtgttggtatgcgtcactgtttgaatcattaagtactattcacatgattccagtgggagatgaccactgaaagcttgtgcctggtctctcctggactctacccatatgcctttttcttttgctgattttgatctgtatcatttcactgtaataaaccataaccaataggtgtaataacttttctgagttctwtgaatctttctaktgarcaattgaatgtgagggggtcttgaaggccctgarcacactgtgttat

SEQ ID NO: 85 - DNA, 600 bp, Bovine  MMBT00618
cagtcagaggccacatctgtctaactgcttgcaagagccttttcagctccacgttaatccattccattcttcrtttattaaaggcttcagttggaatgagccaggcctaaagatttacctttggagaagagagatgaagtcctggtaagacttctaggtgtacgtgaatctgcttgtcgaggctgagctgtctctgtccatgtgtggttggtatttccagaaatgactgaattcttttcttcccatttagaagtttaactgtttgtctgtggtctcctgttaagatttaaaagccagatrtttctgctgcttctcatctctctaggtcacttttctgttgcaaagccatttttctcatcaggtggtgcaaatctccataaagtgtcctaccttgctccgtagaatgtctgtgcagtaaaaatgccggtgccttgcatatgcatagcatttcgtagttcttaaagcatttttgcatatattacctcattatgtaatgtcgttctgggctgtcacttttcccctgactgttctgtatttactcacctttttcaccaacttgaatacttttctttcttctcctaccaattttgaggatattac

SEQ ID NO: 86 - DNA, 465 bp, Bovine  MMBT00609
aggcgttaggtagatgtgcaataaatatttgagagcagaataaactcatttgagatgcttgactacgatgggaatgtaagctaggataataactggaggcagacgtggaatctgggtttgtttatttttgcttttgttttattttaagatggaagtgaatagggcatggattgagcagcaggaaactatccctctgtggattctatgaaggcgcttccaccttaactgtgaagttcttgggggtagaagtcatttgtgtttttcattatcatgtcccttagtgcctagtaaagtgtctcrtgcagagtaaacatttaaaattgttgtgagggacatccccggtggtctgatagctcagactccgcactcccaatgcaaggggcccgtgtttgatccctggtgctagtgataaagaacctgcctgccaatgcaggagacacaagagatgcgggtggatcccggatc

SEQ ID NO: 87 - DNA, 600 bp, Bovine  MMBT00573
aagccgagaggaaagggaaggaggagaaaaagggaaagagggagagatttctccaaagcaatgaaaacaactcattgcagactgaatgtcaaaaatggaaatagttaatagtaatgtatgcacttagcatatatgaagagcagtacctactatacagctaacacttaacatgtgttaattcctttccttaagaacaaagagcatagtagaaaaatgccgtctcaagttttggattttaaagaagttaaagtgtgatgacattagaacagatacccaacagcaacgatgacaaaaactctrtatctccttcttgaaaaaatactccgcaagtgaaaaaaaacagaatggggctgactataaagctattgatcagtcctctgtttcaaacaaaaagaggaacacattatctcacttctccaatatgtttaaacacagaaacacaaattcacraattattaactgcacaatcatttactgttttattagtctacagcaataaggtagaacatcttttgtatcttctaamagtcagaaagattcaaggcacttcaaatttcaggtggcttgtgtacagttcccctgcaaaaacactctcccaac

SEQ ID NO: 88 - DNA, 600 bp, Bovine  MMBT00509
gatttaatgtgctatcctattacccacagacacagaaatcgtaaaagcttcaatacaccttgcccgtaaatagttggtcctgtgcagtttcagtgcccatttactctctctgaaaaaaaatcctatcagtgagttttccattccctcacctgactcagcttccagtggaactctgcaggtttgtatttcttctcttctgaaggatcctgacggaggaggaaaaccagccggcagccgtggacatagagtgagtaatggtgtcggttcatctctgcagagagaaattctactggtaaaccrccagcttaactcactactcaccagacagcttttgcagaaactaacacctgtgcccagccatttttattctggctggccaaaaattaattctgttatttcacgaacactttgtgggttattacattcaatagttacacctgacacatctgtaaatcttctccagcaccgttgartttcattttcactttctacatgagaattaatcactaaggttttttgtctgttagttgaatattcacatcatctgaagtataactatattctgaagaactaccatcttatgagaytccagtatacatg

SEQ ID NO: 89 - DNA, 600 bp, Bovine  MMBT01284
tcttaggcaattaagcccaaataagatgaccatttgaagcataatgcacagattgatttgaagaggactcagaaaagctggtcccagagtggactctgccaacaggtatctacaggacctgrgacaaatcacttttcccatctgaacttcagtttctgtatatgaagataaatatgataattacccagcttatttctggattctaaagtaataacaaatgtgatattttggaaaaaatgtaaatataagtaattttgagtgtcttattttggcaattattaaggaaatacagaatatcaracttcatattcattttcttgccaaagtcaagacttttatggagtaaaagttgaaaaatattagacacatatcagtctattttccaaaaccatgcaaagtaacttttcaatttaattattattcatgcccaagaaacacttgccttaattatccaagttgtgatctggctgtaatcagcagaatttttctccatagagttgccatttattggcctaggataggtctgttatgggtctcgacttggagataaatatgttacctccatcaagatatttaccctagaagagagttttgcttctc

SEQ ID NO: 90 - DNA, 600 bp, Bovine  MMBT02148
catgtggctgtttggaaggacacctggtgtggccgagtgcttgttccagtcgctgcccctgctcactcaatcatttaattactcctctgacacttcctgctcccaggagggatttgcaggggtttaggaggctggcgagctacaagcccagcttagcctgagtcctggctggggtgggagctgaggggtggccacagaatccgggctcaagtcacggctcagctgcaggcaaactcctgaccctggatgagttagttaaccctgctgtgcctcagtgtccactccgggaaaaagggaatkcggctgcctgtgtcctcactcgggacaagggaggtcacaagatcttgtctgtccctcctggtctggaactcagtccagccagccctctgcccgagtcctggcttctcctccctcaggggctacatcatcatgtagtcttccctgactgtaccccctcccrtgggtctaacttttggagaatcccagtcacycttccttcaggcccctgctttttttttttttttaattttaattggaagctaattactttacaatattgtggtggtttttgccatayattcacatgaaccagccatgggt

SEQ ID NO: 91 - DNA, 600 bp, Bovine  MMBT01087
ttatagaggaaaatgatttgcaccttagagttctaaaccattcgaattatcaaccatgcatgattacagaataaagsaaggtctcaaaagttttccttcttaaaatttctttctcagggagcttctaaagctatgattgccaaagcaacatcagcatcttttagagatttgtttagaaatacaggttctgagacttcaccccaactctactgaagtagaaactcaggggctggcacaggagtggaggggtgggaaagactccagggagaggagagtttacaacctgtatcctatcaaackttgagcacaagccaaagcctgagaagcactttaccagtggatgtactccttccaaaataaggagtaaaccaaggaagaggaaacataagccccaagacacaaaacacaagtactccagagcagaagaacagaggctacaggagagctattacaaattaacatttacaacacatctgttactgttctaaaagttagccatttcttatgttcatatcaccccaacatcctcttaaaccttatgaaaagtgtgaaagtgttagtagctcagtcatgtctgactctktgcgaccccatggactg

SEQ ID NO: 92 - DNA, 601 bp, Bovine  MMBT02129
  misc_feature (1)..(1): n is any nucleotide
nagagcytcagaccscagcacagcttgaaaattcttgagcaggccggatgggaaatgctgagagtcccaagtcaggaggcaatgcctgctctggtccgctcctcccaggagggcacaggctgccatcaaccccggtgggtccagagatgaaagagctggaagccatgggtcaactgtgctctttgaaacaggctcttatagtgagtgtgctcaattattaaattagattcttcagagccaagtaaatcccaggtataggaaaaatgaaaaagagtaaggaagagctttggtaataccctckttggccctgcagtgaactgcacttgtgcagtcacaaatatgyaaagttattaacttaaatgaaagtaatgatgcaagtgtacagggagggtagaagagagagagtcagygagctgagggcatgacctcttagcatatacagtcactagataatttccaatactgataaatgaacaaagcatataaacatatttttaaataattgccaggaaaaaagcatctgaaagggttaaaagtggctaagtgacaggtaggaggtgtggggggagggtagtgaaggaatgggactagacaccactgt

SEQ ID NO: 93 - DNA, 600 bp, Bovine  MMBT01686
acagtttttctgtgacagattatttaactctgagtcaaaattatgccttgtgagaggtgtaaataagggcatatggaaattttgtgggaaaccaactaatgcttgtaaatgtttgtgacttagagcctgtgccgggatcagcttcactttataggacttcttggtcaggaagctcagatccctttattctctcaccaaatgttgtagaagaaatgcctttgggaaatggccctatttttggcaacttcctgaagcaagtgaatatactcttttaaagaagaaataaaccttgcattcggkgtatgttttttcattgaaatacatttcatatgtatcagatggcaaattcagattctgttgacttaatgaggaatcttcagatatttattcaaaaatatgtgtccattttttaaaaagttcactaatgaaatttcagctatttcaataccctagctccatacattctctagtggaaatgccactctccctttttccactaaatcaactctattattgaaacactgctactgaattacctccattttccatttactgaagttttcctaattgtctcattccttaacaacctctaattattag

SEQ ID NO: 94 - DNA, 600 bp, Bovine  MMBT00745
gttcgtggtatctgactttctcctcctagcttaacatttctttttggatgactgtctattttaagaaaatgtttactctttcagattccacctcttccccctcaccctcctygagatggtgcttggaggggatatgagaagctgatmgtgatgggggagyggagcacccatatacagctttgagctgagacacccatttccacttgygtctgcgttttcactttggtccctaccattaccaagtgtgcaagtgatgtaaggagccctacctggagaagagcacccactgcagctgagggmtgaccctactacttctgactgccacctcccacttattcagtcacactgagagcttctcttagacacctatacccagtacgaaaattgccaaaaccagaaattttatacttccacatgycaaagaaaaagatttgtgaaagcytgtgaaaaattatttatgcataggttcagttttgtagaatagtcaagacattgagcggaatcattttgtattctttatttgaagaatataatagttctatgaagttgggaaagatcaaatatttatgaaaataaggcaaggctttaatatctactgac

SEQ ID NO: 95 - DNA, 600 bp, Bovine  MMBT02382
ttgagtgagattgttcagtcagtcttttacctaacaaattcaacttggtaagcatttagtgagcacctactatgcctcaaaaattattttgggcacagaagatgaaaactgtccctgctatcagggagctagatgggaagaaccgcagaaacagaaccatcccatagtgataatttatgacacagacaggcttacagatcgatgagaacactgaggcaagaccgcttagcttttcaggctgcccgtggaaggtttccctgtaagatgacacctggaggacaggtaaaaattgatggccarggtttggcatctctgaagaatgccatccagcctctaccagaatatctccagagcccagaagcagagttcaggagaggagggaactcaggatctcattattgtgttgaaccaagatctccttctgcccttttctcctgcttctgctctctggagaaacaaaacaaatctgttcccgctttttggaagctttaacatatttgaaaatgttcgtcataggcctcttttcctttatccagaaagtgttgagattgtgaaagttatttctgcagtcccctctaaaacttcaataactacttctct

SEQ ID NO: 96 - DNA, 600 bp, Bovine  MMBT02540
cctattgggttatcaagcctggagtgggtgggggtggggatcaaatctccattaagaagcaacacattcacagcatgcagccttcatcttagaggtgagcactgagaagctgtggatgggattcgacaagcactgcttcctgatcagctggggcccttcacttatgcacatgtgagaggtacttaatctattactaagaaatagatgtttctgatcaagggaagaaaccacctgaggctatctcctgtcaccaataactttccattgagagttcaaagcagggcctcctgagagaccccraggcatcatttaaaatggatgagaccttgctattcagataaaagctctcttctttatcctcagtcacctaactatctgggcttcccaggtggcactagtggtaaagaacctgcccaccggtgcaggagacatgaaagacatgggtctgatccctgggtcgggaagatcccctggaggagggcatggcaacccacttcagtattcttgcctggagaatcccacggacagaggagcctggcgggctgcagtccacrgggttgcaaagagtcagacacgaccgaagtgactttgcacgcacgc

SEQ ID NO: 97 - DNA, 600 bp, Bovine  MMBT02776
tttatgtctgctacttttgttcctatggcatgtcaacrtgatgctgctgctgctactgctgctaagtcacttcagtcgtgtccaactctgtgcgaccccatagacagcagcccactaggctcctctgtccctgggattctccaggcaagaatactggagtgggttgccatttccttctccacagtatgatgctacaaaactaaaattcaaggaggttttaaatttgggagccaaggagaaatattcacaggctaactgctctcttttctatgttgtccaatgaaaacagataggttaacrttcccagtattttacattaaaagatcattgtttggacacagccagctacctgatattaaaacattcttctctgtttgccttcaaaattaagaagaggataaagatgtaaactattcagaaaagtacggatagaattatataatcaatttgttggaacttcagaggccagttaaatttttgcatcttttatgcttaaccatgcattctaagttgcctctacctctgatacctaacccctgaaagttataagctattttcattaggcatttgccatgaccctgccaacatctctacttaaaa

SEQ ID NO: 98 - DNA, 600 bp, Bovine  MMBT01568
aataagttttttcatatcaggaaggcctcttattctggagagactaacaaaacatactcagtgaggctgagggcaaaaatttttattcaagctttcccctttttaggtgtgacaactaccaaactgcgagaacaccagtggcttgacactctcgttgcaccagggtgcaaggcttttagtacatgtgttttgggggttcttcacctgggcctcaacaacctctaatcttactcctgaagacatgatgatgcattgcagaagtcctttaggactgccctcagagtctgtgcctgtaattcytactcctgaaaacatgatgacgcattgcagagtctgtgcctgttaccttggattgtaatccagttagaattcacagtcctcagaatcatggaggatcttctggcaagtcgatgcaaaatacatttaggtaatggctctgctgttttgatgctggcgtgctattcaggtgagatgcaattagtgtgcttacttctccctgcgatgagaactattaatggcagaatccagtcattaagaaggaatattatgggaattttgaagtgattttctatggctgtttttcactccgactttgcacat

SEQ ID NO: 99 - DNA, 600 bp, Bovine  MMBT02443
gttgagggggaccaggacagcatctggtctagggctctctctacctaacaggctttcccaggactgaggcaagcctctcttgagtattcctctcagtrccccagaagtaagaggttttccagtcatgttggtgggaacaggaactattctcaattctrttatgagctctgaggattgttccttttgatcatttcaagtggttctctcctggccttgagtaatttcttcacaagcatatgccagtcattactcaagggagctctcacggggagctcggcaagtctccagctcactttctcygtgcagccctcttttctggtaccctgccctrtgaagtctaaccaccttggcctccctggacttgcagctccatctcctcaattcagagagaacgctgggggccgcctgggtccccctccctggacgatccccacacgggagacaatcttacagatcaccacctgtttcctctctttcaagcattatggtctttctttccttgggyttttgrttgkttttttttttacctttctaatcactgacctatttatttattttttgaactctttattgttggagtatagccaattaacaatgttg

SEQ ID NO: 100 - DNA, 600 bp, Bovine  MMBT01525
acaggcatgcgtgtggaagggaaatgacttttctgggtaactgagggttaactggaagcctgtgttcttctgccttgttgaatttttttttttttttttctacaaatgatgagcatttccccaactgagtattttgaaaagttccaccactttctaaatatgtgaccttggtcaagttacctaacctcagtaacctcagtttccttatctgtaaaaatgcaccgcgcgcygcctctctaggttgtgaaaggcactagaaagaggcgtgtgtgcttgaggtggaggcgccagcaccgtaaytgttctyagtgggtcagcggagcggccagattggctgaagctcttcgtgggtatttagcattatgctttggaatccaatgtgcgttttgtacacgttgacrtggagattagccagaattggcattcatctgcaatttctatcgcagctaagtcctcccaaagagatggttttttttatgatttgctgctttctcataaaakccagtgcctgcaacgcaccaaggactcttgttctgtcgggacctgaatgctgtctttatctgggaaatgtctacagataaagggcagggctagggctca

SEQ ID NO: 101 - DNA, 600 bp, Bovine  MMBT01763
ttttaaaaatctcattttaactagaggagagattggtacttccatctccgtatcttcaatggggaaggtgtaacttttgagagtttattcactcactaaccacaagttgtgggtttgttgtgagccagtcactgggtatggataggaatgcgatggaatacttactaccctccacagagctaaaacttgtctgagaataccaaggcaccttggaaataacattctttccttttcagagatgatgacctgccgtcctggatattttcagtgtgatagcgggcactgtatttctgaacataygaagtgcaatggggtggctgactgtcgcgacgcctctgatgaagccaattgtcgtaagtttctagacaattcgtatggttatggctgtttagacccattagccaccacttcttagattgaaaggtcatagatattttctattcagcattcattgataattatcaatttacatggggcttgagtcatcatgtctatatatttcacagtagtcattcaagtatatttcacaaataatatttcaaatattatatatagatagagaatatgttatgtctgtgctaatgaaagtatttatatatt

SEQ ID NO: 102 - DNA, 600 bp, Bovine  MMBT02133
tctttcaggaggttccacattttgacaaaaccccctgtgggctctgagattttcaaaatgtctttcctgagcagggctggctttaggtaggaggcctattcgcagaaaggccttgtgcttggtgtaatactctgctgtcactttcttgaaattcttaataatctttggacagggatctcatattttcatttttcactggtcccatatattatgtcagtgatcctggcttgttgggcaggggagggtctctctaactagattgagaggtcctggagggtaagaagtaggctacaccatgaytcaagctacagcctcctggagggtgtcctgtacttgcagcccaggccgctgggctcctggttcatcctaggttttcctccccaggctcttgagaggacctcagaccccagaggacaggctgcatcctcctcaacctccctgaggacaagccggggctcctcctggctgtgagagcctgcaggaggacacagaccttgccctggggcgttcacctcagacagagttattccaggagtggttttctggctcagggcggctgtgcccacgcaagctgggccaaggcatggagctggcctgtcc

SEQ ID NO: 103 - DNA, 598 bp, Bovine  MMBT02152
  misc_feature (1)..(71): n is any nucleotide
nnnnnnnnnnnnnnnnnnnnnnnnnnnnnnnnnnnnnnnnnnnnnnnnnnnnnnnnnnnnnnnnnnnnnnntgtgtcggtaaggagctggcccgccttcagtggacatttctcaagcacctgagtgggccaggcttggtgcttggctccagggaatggcgtgaatgaggcagagggtcctcatcctcatagaacctgcatgtcggtgtataggacagaaacagggaagcgatggggaagagctgggggagattgaggtgagcttgcctagggaggaggcggcctccaaggagtctgtacytgcttgacaagggcaagtgagtgtgcctctgtctccacgtagagccccacagagcactctcgagggggctccctgggcctgacctctgtctcgcctgatgtagcccaggtccccttcttccctctttccatgaactcccaggggctggcgttccgcagaggcacccaccagctctacagcacatcccacgaccgctctgtgaaggtgtggaatgtggcagagaactcctatgtggagacgctgtaagtgtgcccggggagagggcatgcacacgtgtgtgttcaggttcatgggtgac

SEQ ID NO: 104 - DNA, 600 bp, Bovine  MMBT01875
tgcaacatgaaatgtcaccaatttcaactaagtgtttatattattttcctatttgtaaagagttggggttttcttcctataatgtcagaagctacataacagacataaactacaaaattttattctaatgcttcagttggtagattctccattggacaagactcattagtgctgagagaggggactgagggatttgggaatggaaaggtcagttgacaccagggttcaccctaagcagagttccaagaatttagtcctgtcaaaagattcttgggtgcagaaacagaagaactgggtgayctggggcccagggaagggctgggctgatgaggcctgggtggagtttggggtagtaggggaggagggatgtctgtgtacaaaagataaggtgagtcggaatggtagatgcagaaaactacacagtgactggctttccttttccattttcatctacaattagctggaaggaggtgttcctccccaggggtggagatggggaagccttctttctgcattggtgtctttgttcctccatcccatttaaccatatcattagcctaaaattctgtggtttactctcatcaaaggtaccaacttctt

SEQ ID NO: 105 - DNA, 600 bp, Bovine  MMBT00790
tgcagaagttgaagtcagcatccrcytccactgtgttcaagggagtacrctctggagctctgagaattccagcattggtccagcctcttcacttttcttcccagagggccagcagattggcttgtaaatagacctcctaaaggcttactctgacatctcaggattcctgaggagggcaggtatgttggcaggatactcccagcatacataatcacagtattccctcaccagtgacctggcccttagggtttaaggtgctctgaaaacatggtgttttatgattccatcttcctctacttyatactcatggtccctgccagaatatctggaccacctgttagccatgaatggttcaaagccaagtttctggaaactttgccaatagccaggagaggccactctctttaaggagcagggataaaggtgggctgactcctgggtggtcctcctgcttcactctgagaggcagtgggaaggagaaggttggcttcagacacattcacaggtgcaaggaagagccagctctcagttactatggtaacaactagggctggagggaggttgtaaacctataaaactatcctcaaactttctttccac

SEQ ID NO: 106 - DNA, 600 bp, Bovine  MMBT00567
agctgagacatgaaagttgagtaggagttaacttgataaagatagtggggacgatgttcccagcaaagggactggcaggtctaaagaccctgattcagggacattagtgcctccaggacacttcagggaagcctggctggagcacagaggaggggaaggtgggaagatgagactccagttgacactttatggattttggactttatcgtggggttgaatgtagttcaaggctggaagctgggtggtagccaactggtgtaacaaactgacaggggtcagaatggattagggtcaagggtyaagactgagcagatgagaaagcagagcagtacgaggagccccatctagaaactctgggcagacacaggatagcctgtcaggtgtcatcttgcaaagggcagactttataaggaccaagctaagctgragaccagagtgaatttctcatattcattttcaaagtgaaaaaaatgagaaaaataaagatttggacaaggacatataacaaacgagatacagaactagattcacaacacctaccattaacttgctgcttatctcactgtattaattttctcaaggtgaataatctcagtacca

SEQ ID NO: 107 - DNA, 597 bp, Bovine  MMBT01453
  misc_feature (1)..(1): n is any nucleotide
nggtataaaggggtcctcacaaaaaatttgacggaggccaccccagattccctggtggctcagatggtaaagattccacctgcaatgcagggcacctgggttcaatcccttggttgggggggtcccttggaggagggcatggcaaccctctccagtattcttgcctggagaatccccatagacagaggagcctggggggctacagtccatggggttgcaaagagtcagacatgactgagtgactaagcacaacacagcaccccagattatcacctttgaagtacttctgcttcaggaggaygagacaggttgaaccctctccaccctcacttaccatcagggccagagatggagctaggaaaaggaccataaggatcgaaggcacaatctgaaatggaaacaaatgtcagtgtacagggctggctcccttagcctcagatgagcccagggcgtggggctcagagtgagccgagggttggaccctttttaaaagatctgtaactttcatagtgtctcttgccctagaggccccagatgcatcaggagactgtcattgccgtgtgttctatatgggatgtactggctgctcaagaagga

SEQ ID NO: 108 - DNA, 600 bp, Bovine  MMBT01519
caaacaccatgctgccagaggataagacacaatcgagccggaccgagcctgtctcaacactggtcacccaacttctcggaggcctacgtgtttcaggtgacaacatgtcccagggagaggtgacaggaggtgactttcaaaccgcaaaatgacatttggacttccattcaaatgaggggtggtggcatctaaagagagaaaggctcactccatctccaccagtttgcaaggccacgrccaccagcaggrcctggacgctggccacccacacagaaggcacgcaagagagctggggaagcygcgtccaggggaccgaggtgagtctgggtttgaggacagagactgggctttgcttcccgttggcaagmggcaaatacagatcactggtaccactccaaacgctaggcttctcgctgaatccgagtgcaaaatgacaatggtttccaagcgactcctggaaataaactgtgggtaaatagcatctacttaaagcctggaaacccagcttcctttggtttgtgtttttaaatgctttgacgatgtggtttgcttctctccaagaacaaaaagaaaaaaaaatagtaaataaaggctgacagc

SEQ ID NO: 109 - DNA, 600 bp, Bovine  MMBT00930
catttagaaaagtcattcaaaaccccctcctgtgggagtggtccacaggggctcttgaggtcagactgggaggaactccagcctccgacrcaggactctccctggggcttccttsatctccccatctgaggggtgtgcagcaagcccctttcctgctgaaagcattaaaactcacacactgtcaggaccagaagcgtggtggttcagaaagtaacagtgatggtggaaaggaaggtaagtggaccccaaccaggtgaccctccccagagcacccccagcatgcacacagccaagcagagyggaacatctggggccaaagtcatccgtaagaaagatggtatcttacctgtccgagaaaggggctcggaaagcaggtgggaaacaaacgagagagagacacgttttatgtagtgaccgaccacgtggggagtgtcatctcctgtctgggccaccagcaacaacacaccaagaggacatagcatgcaagacaggggccctgttatgaggcacgcaggacgaccgggtgcttgttaataaccagatcaaaacagagtcagattttaaaaactctcccaacaggctctgatgtagcctcttgta

SEQ ID NO: 110 - DNA, 600 bp, Bovine  MMBT01943
ggtggccaaagtattggagtttcagcttcaacatcagtccttccaatgactattcaggactgatctcctttagggtgcactggttggctctccttgccatcttactggatctcagtaagaaactcccctctgtgtctccttcaccaaagtggagtggggaattggaccaaggcagccaagagctggtctctggaggctgtccattccatccgcagggcacagtaccccgggctggctgagcccccagggggccaccagctgagtcactgatgcctcaagttttggccttgaccttggacycttgccctggggatctgctagtttagagagagagaattgggagtgtcccagcttctccacaaagtggtgcctgaaacctggatttctattcaaagcctggagaatgtgggctcccctgcccctccttccatggtgggttgggtggcctccaacacctcctcctggaagagctaggctgaggctmtctgttcccagtgaatcatcagtgactcaggagcccctggcccagagcaggtgctcagtaggtgaaggcatgaaggcacgcacagctgcctctcgttgggggtgtctgcacaaaac

SEQ ID NO: 111 - DNA, 600 bp, Bovine  MMBT00571
cctccctgtagccatctggggaggtattaaccccattttcttggggaagggggcagagggaggatctgtccttgcccaggtagctatctacaggttctttggaggcagtgttaggatcaggaccttggtaaaattatgtccttgttcataacctccagattttattttcggaaagcataaaactgtgcttattcgtgaaccttttagagagcctttctcagaatgggagtcaggcgtttctggtcagggagcttcatcagttgaggcctaagtgtttgggtgccagtggctcttccggtyccctcttgagctagacatctggatgtaacacaactgcagttgaatcaaaaaggaaacatttccaaattgattgacttagttttccttgacctttctactaggagtgaaattagagggtgaaacttaagggcttccctctgagaggtacgttgagttgtggcaggatttggggtgatccaagttaaaggtgaaatgcaagaccagatgctcttgaattcaatgagaaaggataatgttatcagaatactctcccatttctgtttctgttcccttccactaccttaagataattgtggccct

SEQ ID NO: 112 - DNA, 600 bp, Bovine  MMBT01135
tgtgaatagtgtttttggaatctaatatgtaagcctgaaataagtgagcctgttgaatagtgattaaaatgataaaagaacagaaattaagggagagagaacaaaagggccaccctgttctccagtcttgctttattcatatatttagttcttytgctttatatttttccaaaagactgagagattaagcagttcatttgtcttgatcctcaacattcagttttctttcccgtgttagtgtgataaggacctgcaatttttgaaaaatcggaaatcttcatatagtcagtgtgtcaaggyttccatcacccatactgagctgtaagggttgtactgctgagggtggctctgatccagtcccagaaatcaaagtagtcagaatgaaaggcaaagaactgactcacggcaaacactgaaaggcagatcccccgttaccaaaaaggggttgagtggtttaagacacagtgaaaagacaactggaacgagactaaaattttggacgaatccattttataatacatatcatttcctggactgaggaaaggttaacatgtattttactacattgctttgtaggtcaatcatttcagactcttaaac

SEQ ID NO: 113 - DNA, 598 bp, Bovine  MMBT00858
  misc_feature (1)..(8): n is any nucleotide
nnnnnnnngatctgaattcaagtttaaaacattctgtctttagaggtgaacctgctgtaaatgattaaaaaaatatatatatatatagcttcagtctttttgcttcctagagtttacataagtctaacatgttgagcctctaatgatagtgaaaagtcctcagtagattgagcagccttattttatttttactgctttcatagtttttcttttgatacttaccattttgtatagtagaagtggcagaagttaayggttttgagtgagctttagctcaaaatacttagctgcttttgttaycctagaagcagaggaagaccaaatggaaaaactgattccagccaatcttcaggggttttttgttttatggcatttgggggatgggattggcatttttcttaatttccctgaaattttaagcctttgaagcctaacagttatcacatgttatggctatctttttaaaaaagtaagttattgggtagcctggcccctccctatgacctacctctcagattttgaaatgtcttcctggtatagtgggaatggcaaaatcaatctgctgctcttcaattgatgtttaggaatgttctaagcc

SEQ ID NO: 114 - DNA, 600 bp, Bovine  MMBT01149
agagctgactcatttgaaaacactctgttgctggcaaagattgagggtggaaggagaaggggacgacagaggatgagatggttggatgccatcaccgactcaatggtcatgggtctgggtggactccaggagctggtgatagacagggaggcctggcatgctgaggttcatggggtcgcaaagagtaggacacaactgagcgactgaactgaactgattctaaattaaattaaactgaaaaaagcatgccttcaaatataaacctttgctttctttctccaaaaccgcaattctattcayctttaaatttaacccttgtatcaagttcagttccaaaaaaaaatcaattgcctccacagcctcaaaatgtacatagaggcattcattacaggcatgcctggctacctaagtgctatgagtcatgcttattttcaaagacaacactaagggaatgtcaatcaaaaaaactgtgaaaaagcatattaagaaaaacgttgaaagtgaaagtgaagttgctcagttgtgtccaactctgcaaccccatggactatagcctaccaggttccactgtccatgggattttccaggcaagaatactgg

SEQ ID NO: 115 - DNA, 600 bp, Bovine  MMBT00742
agaaacaaaaatcaataaagctgttttctttaaaagtgtttcataaccatcacaacagcaccagaaggactatatgtgagtatcattcatttttactattagaatttagatagagtgaaatgaaaaaacttcagaataattgatttataatttaaaatacatgtatgaggattttcatcccaccatttgtatcaaatgaacaagagaagtggtttccagtgtctagagaaataaaatggtttgtttttctcctatttgcmtatttttmttatactcggttttgcttgtttgttctaaaaygtgtgttttaacaattctgagaaagaggggacagaaaagatgacagtagtataaaattagaatattttcttaagttctttccctcagaaaataagtaaatgcaaaaaagagcgacagagaccctcctacatatctttcttttctggtttatatagcatttgcaaaatctgatccatagtcaaaggcacacttttcctttcagaaaattttcaaacgatacttcttgcttcaaacaatttaacaaacacatttctactaaaaatttgtttttaataytaaatacccatcatgaacccttta

SEQ ID NO: 116 - DNA, 600 bp, Bovine  MMBT01200
tagcaaggtacttcgtgttttaccatatgtaaaagtaaaatttatgacaatagcacaaaagatgggaaggataaattgagaatatattattacaaggtacttacatataaaatgccatcaaatcttgctgactaaatttttaagtagtttaataacccctacaatttttatgggacaaattaggcaataaatatcaaaactcttgtttaaaagtaagtaaataaaagtatatatttaaatgtagggcaataattctaagcctacttaaaactgtttgaaccaatgcatagataataagaycagaggctggggataaamatggaatattgaatgatactcaattaattcaaagaaggaagaaaaaattttaaacacaaaaatagaaaagagctacaaagatggtatattttaatacaacagtattatcaattacattaaatataattggtctaaatataccacttgcaagattgtcagagaaataaacaaatccacaattataaatgaagacttcaacattcactttgtattcaatttgcagtaattgatagagtaagtacagagaaaatcagtaaggatatggaaaatttgaaaaccact

SEQ ID NO: 117 - DNA, 560 bp, Bovine  MMBT01216
cattttcacatacaactaaatataaacaagtttgagattcacactactttttccccattttgtgtttagatctaattttattatttatttatttataggtaaaataaggaattcatgatggggcatgagaatcacactttcagcaatgacttcattcttttgacttcactctttacttcttctcaagcaagtctggtatttttctcttttatattcaccatttttgttttgactgtaacagaaaatacagtcatgattctcattatccacagggaattacgacatcatactccaatgtayttcttgcttagccatctctcttttatggatatcttgcatatttccaacattsttctcaaaatggttactgatttcccrtcaggcagcaaaactatttcatttgcagcttgtggmgtccagatatttctatcccttaccctcttgggtggtgagtgtcttctcctggcagcaatgtcctacaatcgctatgtagccatctgtcacccactgtgctaccccattcttatgaatgactatgtcagcgttctcaaggctggagg

SEQ ID NO: 118 - DNA, 600 bp, Bovine  MMBT01222
tgaaggcaagttcatttaaggtaagtaattattaaatagagatttaagtggttcaactccaaccttttgtcttggataaagcaaaatcatcagacttatacctgagttaaaagacaggcatcctaaaatcaggtacttatgtctaacaactagtggtataaaagaaattgacagcggtgaagctgcctatgctgttatctaaactgtcttcttgacctgtgatgtttatgtaaactataaatgaaggtattttaaattggaaataaaagtgggagaataatataccaggaagaataagaygatgcaagggactcaagtttccgggaaggagtactgatcacagtgggcactcaaagatgctgtatacaattaattttcctttttctcaacagtttctgaaatcctttagatacctctttgtttcgaagactgtagatgagagggttsagcatcggggtgaggatggtataaaaggctgataccaccttgtcctggtccggtgtgtgattagaagctggtctcatatacataaacatggcagctccatagtagagtccaaccacagacagatgtgaggagcagatggtgaaggccttgcgg

SEQ ID NO: 119 - DNA, 600 bp, Bovine  MMBT01301
gcaccagaaatcaatgcttctttcatgaaagtaatattattttgatgtgattataattaagttacacagaagagggggaaaggatctggaccgatcctttctactggctttttctaaccactcaaattcatttatcactagcagtccttagatttgttccaaaatagaatttaattttaaatgtggtccagggaatacagtaaagggtcattctaaagtaaatgtataggtacccactaaggaaacaattatgacaaattaaggtgatttaaataataatgataacaaaaacaaatataygaactactaacctttatggaacacttatcacatcctaggcactatgctaacatattcaagttgaaccayatgaaaatgacaatttcataaggtagggcctaatatattttytcatctaatccttacaactaccccaagagaagagtagttttccataattgcagataaggaaactaaaatttagaggacttaactttatttcctaaagaactaggaaataaaatggggactgaagcctaggtgcacatccaaagcccagggtctcattacctactgcacaatgtcagtaacctccatgtc

SEQ ID NO: 120 - DNA, 600 bp, Bovine  MMBT00784
ctccaggggatctttccaacccagggcctgaacctgcgtctcttgtgtctcttgcactagcaggtggacgttttaccgctgagccacccgggaagcccagtaacgactaattttgacttttggccttttaaatttagaagtaatgagagtttaaattctcagaaaaggctataatttaacttactaataactcctatcttgtaaatgtactttggggtttaaaatgttcacatttacaaagttgcaaatacagtacaaagaactcatgtatatctttaactagatttgccagttttcaayatcttgccatatttgctttatattctatctatatatgaatttttctctgaactatttgcccctttaacccttaatgcttaagtgtattatgtttactaagaaggatattctcttgaataagtactattattaaattcatgaaatgtaacactgatactttaatctataggctcaatttccattcctcccgttgtcatcataatcttcctcatagtgatggtgccactcgttacacagggatcacagatgtctttttagcctccttcaatctggaatggctcttaaacctttcttcgatga

SEQ ID NO: 121 - DNA, 600 bp, Bovine  MMBT00559
tgcaaacgatgtgactgacaggagattagtctccaaaatttacaaacatctcatgatttttaacaacatcaaaacaacccaatcaaaaaatggaccaaagacctaaactattgtgtatgttttaaagtatttatccagtgattgcacttgactgtttctcttgttggtaaaggcaggcgtttgcagtcaccaccacacttctgaatttctggtgtggtttgcggtccttatcattattttaaatgtctagttataatgaaggggacagacttcaagtagaggcagttttgagaggttcayggaattaatttgccctaaaatcagatacatgtctggtttgtaagacatggcatataaacattaacttttgatctctttgtattttaggtggtggcaaaaaaataccgcaacttcgatattccaaaaggaatgactggcatctggagatacctaactaatgcctacagtagggatgagttcaccaacacctgccccagtgataaggaggttgaaatagcatacagtgatgtagccaagagacttaccaaataaaagagcacttatgagagaagcgtcttcacatcttcccctgactaagaa

SEQ ID NO: 122 - DNA, 600 bp, Bovine  MMBT01400
tatattttatgtgattccaactcaacttctacaagtataaaagcaatataaccaaaaacatgccttttggcaaagaataaaatataaggagatgcaattccgccagatggcaaaatcccagactaacaatttgtcgacttattgatggacataactaagcccctaacttactaaactataatggaaatatagaagaattctgccattttgtagatttagctgcatcattgaccaaattgcatccccacaacatgacatcagatagagaaattctgaaaaatcacctttacctcaccacaytggtctcctgkgcatgctaatggcattcttactgatttctctgctttccatttttttcttctccaattccmtgtacatttcaaccatgttatgtttctaaaatatacatgagaggattaccgttaccttttttaaaattttgcaatggctccctccaatggagacagtccaagctccgatgtaaataaagcttttcatggttaagacccaaacctgacccactagctttatgtctattatttcaagcatggccttggccctaggatgacaccatcccgttctttgtttggtccacaaaca

SEQ ID NO: 123 - DNA, 600 bp, Bovine  MMBT00522
ttgyactctttggagaaaattgatggaccctctgtcctggaaggagcacaggttggtggttaaggagaggcccattcatttccctccatgacaggaggccaaccacaatggtagctgcaaccatgcttgctcctrttgctatgaacatttgggacactaaaataaattgactgcacaaaaagattctttactttccccaccacatcatcttaatggggaattcataccactttgagctgcatttactgccggaatggaataatggcttctaaaattactttagcacataatgaattgtayctaagtttactgggttatcggacaacattttggttctagtgaaggccattttccagaaggccttggactctgaatcaattattcattcattgaattcagagatgtgaatctttcctttagcttgaaatctccatctcttctgcttgaaaagcttcatttcttaaactcacaaacatgttctcataacaaaaactaagactgaaaaatgttacagatctcagaagtgggcaattaattcaaataaaatacaaaagagaggataaaaggagtgaaggcaaatgattgcagggtaataagggt

SEQ ID NO: 124 - DNA, 600 bp, Bovine  MMBT01421
tatagttgcaccctttgagaacttcacaactatgatgaggcaggactttatttgcacctcgaaaatgttttactactgttataaaggcaaaggcaaaagaaggggaaatatgtttaattaacaataattgaattttcataatactgtttaatcttctagatatgcttatgaagagatgggtattattattttttttctactacagatgaggaaaccagcctgagagaggtcaagcaatttgcctaaacttgaaatgattttaagtggttgggctgattcaaacctaggttagtagcctcygggccatttcaacaataaatamcattagagagactgcattaacatcctgcgaagtaagacgaccactaaggsactgaggagtgatgaaagcatatagcaatgggtcatgaatcaggaaaggcttccagaatgaggkaacagaaaatggaggaaaagcggrggaatgcagcactgaaaaacagaggatccagtaartggagcacattaataaagaaaagaaaagacatttgccattaagtctgtagaaatatttccagttggtttccagtctcctcatattttctatccagccaaacagca

SEQ ID NO: 125 - DNA, 600 bp, Bovine  MMBT00896
tgctttaacaatctgtaccctttcttcctctagttacattctagcctctggaagctccttcctggttgtatatacttcctagctacctcatcctcagtaggaacacttactcttcccaaactttgaaaccatggattcttcaggagttttatagatagaaaaatccttctgtcccttttctttcataaagaagccagagtcctagcagtctttaatggcttatggatttatgggcttctctactgcctcttaccctcctaccacatagaattctgrtgaacagatagttctaagtgtttygaattggcctaaaygtcagggagacatcagctgactgaggtgtattttgcagttttgacttcttctacctacaagtaaagctaagctaccaagttcagctgcttctttctcctkyaagctgctcaaggctgttagtggctgaaatagcaaaactcaacccatttcagggctttatgtaaagccagaggcaagttgagtcaggtgcatactagcccagttcagatcctgccagccgtaggactggttccctcccctgttggttccacgacccagcaatctggggccttggctaagctattt

SEQ ID NO: 126 - DNA, 600 bp, Bovine  MMBT00495
tactcccgcagccatgttcatctcaccggtgtttttgatgccatgtccattctatgaagggctctgcaatcataagagtgagtctgtgattgtcagttaaggagaggttaaatactgtttgaaaaacctttttcatctaatttatgctgtgcctttgaagacgaagaagggagaggagagaccataacatcttagaccagcagaggatgggggagggctgtagaatatcaattccaaccaattctattccagcccataaaggagccagtactcacgaagaaaatcagcctttcataaaayttcttggaaatctggtcaagaaagcatgcgtgtctcctgcagataacactgctgtattataggcatttgactcgatcagtgggctatggaaaaataaaacacccattttaacacagtgtctggaaatgctgcctagccatggaaagcctgggggctggcaggcttcggaacgatcgggtgggtggctagcacgtgctgcatccttcagaacagccccaaagtccttgaaggacccagcattggctcacctggggtgccactcaagcatgcaggttccttggccccacttcagccctgctg

SEQ ID NO: 127 - DNA, 600 bp, Bovine  MMBT01495
cagtacacccagtgattgggaaatctttgtatgatatttggagatggggagaaatttagtataagttatatatcctgacccaatttagtgcaaactttttgaactaaattaggacatgagtttgagtgaactctgggagttggtgatggacagggaggcctggcgtgctgcagttcatggggttgcaaagagtcggacacgactgagtgtctgaactgaactgaactgaaggcactattatactcaatgttactactagagattgtagtgtgagaatagcctgtagtaagtttatggtgyttttcattgatatgattattgttactgtagtggtagttttgtttgtttwtttgtgtttattttttkataagagtggagagagggtgatgtttggaaccttgcaaagatgtcatatatccaaagtaatatatttctctagctctcaatgcatggtatctaagttaccagagagtagcaagtcagttagttttgtattagtacatggcaagacgactgttgttcacaggacaagaacacattatccacactcacaaaaatgtcaagtttagaaactaattaattctaataaatacctgtgat

SEQ ID NO: 128 - DNA, 600 bp, Bovine  MMBT02142
tggcaggaaagtcttctagtagagaatagccatccctttgctccactgattccccacctgagggctctctacttccccgcagtcttgaacacctgtgagaccaacggaaagaggatgggggctcagccacccccagacaaggtggagttggagagaaccacttggaaatgatccctgtgagtggatcagcttggacacagcatttctgttcaatatgaagaaactggagcaaagggagtcatcacagactggattttataaagatcactcttgactgcagctggtggaaggaggtagtgyactggtcagatgtgtcgctgcagacagaaggaaaataaaaggagtctaacgatttacagaagattaaaatttataatgtttagtgataaactcaatrtttgctccataacaacatcaactgaagttatacacctacaattataaaagaaaaagtattcaatatgtgcttcagtcaatctataaataagggtgctgccatggatccccaagttataaaatgtcagagtggcaaagcatttatgaattcatctagtctggtcatggcaagcaagtttcatctcacatgacaactctaattga

SEQ ID NO: 129 - DNA, 600 bp, Bovine  MMBT01728
tgagtctgagtgaactccgggagytggtgatggacagggaggcctggcgtgctgygattcatggggtcgcaaagagtcrgacacgactgagcgactgaactgaactgaactgaactaaaaaaataaataatacctgttyctccttcattaaactcatgttttagaaaaaaaaataggcataataagagagagaacatgatttagttatttgtcgataacttgctgtaaggaggaaggargaaaagcaaggtcatgaatgagctatttgaatctcattgaaagagatactgataaacttcygtagagctctcttcatcatagagttgttaggatagggatttattcacaagccactaggaagaggcttttaagtaaatgagactatcattctttccatagttagttagctagtgttagttgctcagtcgtctctctttgcgaccccatggactgcagcctgctaggcttctctgtccatggcatttttcaggcaaggatactgggagtggttgccatttccctctctaggggatcttcctgacccagggattgaacctgggtctgctgcagattctttaccgactgagctaccagggaagc

SEQ ID NO: 130 - DNA, 600 bp, Bovine  MMBT02109
atagattacctccccacaaagctacaataaacagacttttttgttactgctaaatatttatttcctgtataagagtggtcaggaacatcgcctgcatacaatcaaaggtatgaccacaatattgctctgaagggttgaacatggagaaaaatgtgtggtttatagtataatattcgtatttttagctgtattttctggaaacttatgctatattgtatgcaagaagaactgataagacctcttagtcttttacatggttctttattcctagaatttgtcttctatgaacatttttttccyaaggctgcaaacactgagaactaagcatattcccagcactgctctagtcattagaagagataaaaagatgaaattatatattatactcccctttaaggagtttagcaagccatggcactttcgtcacagaagtcctaggaggtaaatggctctctgaagaatgatgaataacgaaaggaagaactcatatgagaactatgtagaaacccagaaaaatctttatgatgagaaaagcagattaaggtggtatatatggtacaactgtcaagacacggatgcatgggatcacattctggaatg

SEQ ID NO: 131 - DNA, 600 bp, Bovine  MMBT01741
tctgttctccactgtgagcattaatagggcagggcatggttcccagatagatgaaagtgacttgtaatatcttaaagcaataaataataagctaatatttattaattatttagtgtactaagcactttatagccattattgtttttaatccctacaaaaccctttattttccttgtattttatagatgaggaaacagaaaagatccagtaatttatgcaaggtcaaacacctcagaataaagaaaggagttaaatctaaggtgtcagcacattcttacccactcttctgcttccaaactyaaaaatatcaagaaaactcttcagatgatgaaattttttaaatataatttcacattccttgtagtggtcttggaagaccaaggactgactttagatttgcagtgtcatagtatggcttagaatcacgggaagaagtctccactctaccacgtcagggtaactgaaccaccattcagcaggtgactgcttaaagggacatgttaagatccttcatacggcagcataattctgccatttctccttcccatcttattaccattcagtaaatattgtcatcctttggtatttcttatcaagata

SEQ ID NO: 132 - DNA, 600 bp, Bovine  MMBT02174
aatcatttaatatttttccttataggtctgacttctttcacttaccaagttttcaaggttcagccatgtcggagcatgtgtcagaatttcattcgtttttaaggctgaatagtattccgttgtaggcatataccaccttttcttacccactcaccattgatggacacctgagttgtttccacctgttggattttgaataatggtgctgtgaacattgatgtgcaattatctgagtccccgctttcagttctttggggtataaaatctagaagttagaattgttggattatatggtaattytgtgttcaagtttatgaggaatttccctcttttctcatttttgttactggaggattctaccaacctttatagttgagaaattcctagatcctgaaggcaaagtgtttggcagtgtctggcacttagttagtgctcagtatgtagtattacttaggcttycttgactgttctctgccccacagtataccaaatgtggaaataaaattatccagtgtactctctacttaggaaagcacctgtgaactggtctggccagcaagcagatttttcaagattaggtagtcattaagaaaaagggga

SEQ ID NO: 133 - DNA, 600 bp, Bovine  MMBT02025
tttgccaccacctgctgggaatttttcataataaaggcttcccttgtggctcagctggtaaagaatccrcctgcaatgcaggagacctgggttcaatccctgggttgggaagatcctctggagaaaggaaaggctacccactccagtattctggcctggagaattccatggactgtatagtccctggggtggcaaagagtcagacacaactgagcacctgttgggaatttwtcataataaaattacaagacaaagtgtacaaattcactgtcactcctcaggagagcccttgtgcagtgygcaacctgcccaaccatcctcagcaacctggtgtaccacatactctatgtaatgccacctccccacaccyggccctgccccaaataccccacatgttggcaaatctctctctcaggcatactggcagcccagaggggagagaagagaccacggcttacatgagctcttgtgttcccttctccgcggccgcctccgccccattgtggtccgggggctcatgggctgggatccacgaggcagagtgctggggttggtgcaagaaaaggtgtggttcacggtcggcgaggagaagggagatga

SEQ ID NO: 134 - DNA, 600 bp, Bovine  MMBT02086
agtatttagaaatatacaaccaataaaagaataaacaaattaagtattaaatgcaattgctcccaaagaacagaactgaaggacaagagggggggtgattttgaactttttaacatgattttgttgtcttaatgtgtacatatatagctgaccaggtagctgatcaggtagaaagcttctagagatagactcaaaaattcttgtaagagatgaaagaagtgtttattctgatcttttttctaatctcatctaaaccatattctcttgcattttgcccagaggtaagtatggctgtcatcyagcttgaattatatgcttgtttcttttccaagatgactctaatctgcctcctccctaactgggtggagaactggcttacctggttgtaattatgcagtagtcagagaagacaggaaaamacactctggtaaagattcttaagaacactgaaataacattagaatccctagatctacacgggtagatctaccctctaaaaacgaggcggtggaggaggtgagggtggttgagactgcttggatgcgtgtcgatgctacttacttttctagactgtctttccccagtctccatctacccctg

SEQ ID NO: 135 - DNA, 600 bp, Bovine  MMBT01826
gccaagtccatcccacagattggtttttgaacagcttgtaaaccaagaatgattttatatttttaaaggattgtaaaaaatacaagaagaaaaacatacaacagagaatatatttggcctgcagagcctacaatatttaccatgtatccccttaccaaaacagtttgtcaatcactgacacagtcatgttagtaatggagacaaattagctctgagctaaagactgctctggacccatcctagcaatccttaaaaggatcctacaaattcctggtaatttagctaatggtgaacaaaatytagcactattttatgaaatacaacaaaattcagtgcccccaaacacaaaattcatccaataagaattgctgaggttgtaagaaacaagaaaatattaccctgaattatatttctattgctgtataacaaactacccccaaaacttcgtggcttcaaaccatgatcatttatcctttcktatcatttctctgagccaggaattctgacagaggccatagagaatgcttctttcygcttcacagtgcttgaggcctaaactgcaagatttgaaatctggrggctggaattttctgaaatctc

SEQ ID NO: 136 - DNA, 600 bp, Bovine  MMBT01731
ggttctcagcctattccttattgctttctgagaaagttattatctctattatttaaaatagatttacaagctcactatttccttacttaaaaatataaacactatgaaacaatttatgaaacttcttgagaacttttaacttaccaatattgaattataagctctttgtggacaaaactgtcttcttcgcatttgtctgtttggtgttggaacttaagttctctaacctgtttcaaaaatccaggtatttgttggattaagtaggtttctaaacgtgtaagtatagttatttactcataytcagcatatctgtatataatgttactcaaactgtgatatagatactttctattaattttttataaaaagcactatttgaagagggataaataaatgaggacttggggaccaaactaattatcagatctctatagtagcagtaactcatttagatcattgcctcacagatatcatcagcattggttaaagaatctattggacaattgcagtaattccagaccactttttaatgtggatttcacttggagaggtgggaaaagagttgattttattttagttaaatgttaataattcaaagag

SEQ ID NO: 137 - DNA, 600 bp, Bovine  MMBT01644
taccaggctcacatcagtcccaaatttaaaattgtagactttatatactagaactttctaagccttctggcccctccttttggctggcatcgaagagaagctttcttcatttgcatttggtactgctctctggcagcctgactctggcctcagaaacttctgttccagaaaagggaaggttggactcactcccacaaggatataggaaaatgttagtgcatcttctttgcctaaatcaagtcaggacagctgaartgtgaccttggaattgaacagtgactcttccctggcagcagtgcyctgctcacagatctttttgtgttctgatctgatggtatctggtggttctgaagcagggctcagcttccgccagtgatggagtatctgtgagttgtggtattattgggaggttgggcttttgtgtgtgtgaacagaaagagagctctggggtgagaatgagagttcagagagtctcttatcaaccacttctaggcatggttatgtcaaaaccaacttgagcagatatatttatttcttcctttttgaaagcctctggaaaaaaattatagcttttctaagtaacctttcctgccaagaact

SEQ ID NO: 138 - DNA, 600 bp, Bovine  MMBT01209
cctctgaccagtctggaagtgatgggactggtttataagcatcaaatgattcttgccaaaaccatttaaaaatcatttcccactgttttgttggcctccatactgagttctaactcttgagattgtgatcctatcaaatatttctcaatcagtttggcctcctggaaggatgatttcattacctttctttgttgtacatgcgtggcacagattgtacaacatgcataatctcctctatctttcgcctctttttttcaaactatttctttgtctcttgtcctctattctaaatctaccagyattcatgtttttttctcatctttttatgttcttttgttttggttctttttgttattttacttgaggtgtgtatcatgtttgggaattattaatccttctctgtaatatcctatttatgcttgataatacatatccatggcttttggtttggttttgtttttttgccacactgcgctgcttgtgggacttcaattccccgtccaggaaatgaacccagaccatggcagtgaaagttcagaattctaaccactaggccaccagtgaatgccccatatctatgtattctaaaagcaaattctg

SEQ ID NO: 139 - DNA, 600 bp, Bovine  MMBT01475
aggctcctatgtcatgtgaaacatattaaacaaatttgaattcttttttcctgttactctgacagtttaattttcagacccagccagagaccataagagccaacgttgagaaatgttttcttcccccatactgtgaatacaagaaattaacctttatatcttttttatcctccaagactctcatagatatgggcacatacatttacataaaattttaattaagcacacaaaaaaagcaaccaatagacaagtcaacttcagatgcccatgtaacctttggaaaactctgtctgtaatagytgttactagtaatagaaactcaaattggtttgagaaaacagaaggaggttaggggtagggtctgtgcattgaacagctcatctacaaatatgtcaggatcacaaaactgttatcaggatcctatcattttcatttcatcttttaaatcttctttcttgcacactggctttgttctttggaaggacctcttcccatgctcggaaatacacctatggcagctctaagtgtaggtggcctaccagccagcaatcccagtaaataaaggcttatcactcagagtaaagccaccagggagggctc

SEQ ID NO: 140 - DNA, 600 bp, Bovine  MMBT00991
catgtcacctggccatagtggtaggcactgggcaccatttatattcatattttaatttgaattgatatgttatttctctccccaatagatgctagaagaaagtttttaagaaattgatttgttttgatattagtatttatgtcaaactgatacagtttctttgcattcatcagttcatttatcctctatccagatctgtatttgtcctcattgtaatccaattaggaagcataaaaaaatgcctcagatttactaaacaaaaatatcaacttattcttatagagggctgcataaaattcytaagttagagtatttttctatattattttggaattggtttttctaatattttctttagttgtataatcaaatttttacacatatctctggtataagtgcagaaatgttctcatttaataatgcattgtctgggcatttttatgtgtatcaattattttgtgtgtggttagtcgctcagtagtgtctgactctttgcgaccccatggactgtagcccgtcaggttcctctgtccatgggattctccaggcaggagtactggagtgggttgccatgccctcctcatcaattattttattcct

SEQ ID NO: 141 - DNA, 522 bp, Bovine  MMBT01435
agagcctggaggaaaccttaccaaatatctgtaaccccattcagggctatgactctgatgactaatgcgagctgtcaggaaagaaaaagcccaagggcaagtcagagctctagccatagcctgatagaaatatcctgtaagaacacctcggctcaccaatcagccttatttataatttagtctcttgagtaattcatccatcaggtgggaatgccccaagcaaatgagcaaagtctatgatgccagatatatttcatattgtaagtaaataaattaccatgccagttgatacatcagtcyctttttagtttggttattgtgaatgttgttactacaagaaaataaatggagataacataaaagatagacaggtttaattaatcagaaattttttgccctagcctgtgatatagtgaagtagggtgaaattttttaaaagttgcagacctacatgaatagcaccattccattttattagaaaaaaataggtgtggtatatgcatacacatgcatacaaatgca

SEQ ID NO: 142 - DNA, 600 bp, Bovine  MMBT02273
ctaagtgtatttaacatatattcattcatttaatccattgtaattgtgtgtctactattagttaggcactcttttaggctctaagagtgcagtgataattttccaaatgaatcacttagatttttacttaaaacattctaataaacgacttttaaatatttaaacttattcaaaaattttaaagtacatttgaaagacatgacataccatttcagccttatgaaggtatgattgatagataaaattatagtatgtgtaaagtgtacaatgtgagaatttcatttgtgtttacatttatcyatgtttactcccacaagcaagttttttttttttaacacaacttgcaatatatctttattgagtggttactatatcctaggttttggactagaaatttcagaaagtgatgatacttagtatatcccagaatcagaaaatccaacaggaagaataaagcagttaaccaatactcataatacaagggaaaatatgttttgcaatgaaaataacaattggtgctaggagatttgggggaggtcacatgagcctcaaagtcataacatggaaggcttcggacagtgaagacagaagggagagcct

SEQ ID NO: 143 - DNA, 600 bp, Bovine  MMBT00735
tactttaaaaacttactaggatgcactgtgtttcaaattatattttcttttccagggtgtttcacattgaagaaaataacaccattctcaagcctttaaactgtcctacattcacaaaaggggcgggggtggggggcgatattgcactgaaattaggatcttcaacaacttcttaaatgcctcctttttaattgagtgaaagtaatagacttgtaattgtttcaaatacmatgtggtaagctttgtgattaagacctcttatttctgactgacatgaacaattcaataggaaagagagtyagccatggcatgcatgggatgttatgtgctacaagtctgggtaccagcattcaaaaaatagagactgagccttcttgtaatatttctgagttggtgagcatgaagggagcaaacttagtccgagctgtgtgttacagattctataatcaggaaaagacaaaaagaaagtgaagaccagtacctcyaggctcctcccccagcagtaaacactggggcaccagactgtgagagccctgcctttctttaagtccatgacaycaatttctatttccttcaacatcagaatgtcaatgaagtaga

SEQ ID NO: 144 - DNA, 600 bp, Bovine  MMBT02033
agggtacggaatatacagaggaatgaaatttagagacttccaaatcccactggaatgtgcaaattaagagacatgaaatccatccccatcatgggtctcatgaatgtttttcattgaccttttcatcatgatagagtttttaaatccacaaggaaagttaagatgtcaagacactaatacattttcatgtgtattttgactttgaatgagacaatctaaccttgttttttattttctaaaaaagctgttgatctatttgaaggttattgtaacattcagcccccagaaatcattcccacygaggtaaaaatgagactaaagcaattattcattaaattagaacatttaaagaaaactcagtgctagattcagatgacgccaataccttggttgttcaaattatagtcaactttttccaaataagctggttaggaatctaagaatgaggccgtaacccattgccttgctgaaaaacgctagataacgtccctccagcagtaagacattcatgaagtccaaagcacagcattactcattcctcacttctgactcaaattttcacaaataatccttctttaaatgttgctgcaatgggagata

SEQ ID NO: 145 - DNA, 600 bp, Bovine  MMBT02071
caaatatggaaattttacacatatttgtcatttattacwtggttgattgaatttttaccatgttctaggagtaggagggaattatggaggttaacgagacgtggtctcagacctcattacagttatatttcatgcagtggttcttaatctagaatctaatataattatttgggaagcttttaaaaataccagttcctggatgttacccagcgtctctgatttgactggtctggagtggggccgagacatcaggtgtggttgttagttgcagccagaatcgacagcttctgttaccaaatyctatctgcatcctcttgcgttgccataataacgttctatagactgggtggcttaaacagtgcacgtttattttctcgcagtttggaaggctggcagcctgagatcaaggtgctggccgattcagctgctgttttttcctgttcttagcagggccacccatctgattagggctctacccatgtgarctctcctggtgactcggatgataaagaatctgccagtaatacaggagacccgggtttagtccctgggtcaggaagatccctgtggaggaggaaatggcaacccagtccagtattc

SEQ ID NO: 146 - DNA, 594 bp, Bovine  MMBT01867
taacacagtgagagatgttccttttatatatttgagataatttagctcaatgttcatttgaaaaaatgatggtgctaatagcggctcttcagcttcagaacaacagaccgtcctgagagagcacagaagccacggaaagtgattctcatatcaggctgtctggaagggattggataaaagctggaggaatttcccccagaccaacagctgcctgagattgtatggcaggatctgaaatactgtatgaacccatgaacttgaactgattggcttaaaaccaatagctcttaatggaggaayatgagatagagtggggggcgagggggttattatgaatttcctgattgtccaggtaaattgtaagtcattgcacataaatcagaatttctgtatgctcagctgtggtaacagtttgttcttcctgctggacctttctgtccaagctatgaaggaatagatacaaacaagggaggataaatgaatctgctgtgtgggttttgccttgggcttcctgagtattatgtaccaggggccattgttctcccccccaaggaatcctttactccaatcagaatccaatacagtaataaaaat

SEQ ID NO: 147 - DNA, 600 bp, Bovine  MMBT02018
ctctggggagatttgaaatatactggcactatgaatttcatcctgagagatgtttattttttttggtctaggtgaagcatggccataggccaggtgattctaatgtacagctaagtttaaaaacactgacttaaagattctttctcctaaaatacctttctccatagcttcacaggataaaatctcacctattagtatggaaggttcccaactctgccttgaaacctttcccagaataccgttaaactcatttttggattatctgagtattgcacagggcctggcatacggttgggactygataaatgtctgggggcatggtacatagtagagacacagtacatacttattggaagaatgatgtatagttggtcctcattatttgcagattctgtacttgcaaacttgcctattcactgacatctatttacccccaaatcggtctgtgcagtgctttacagccattccacagccatgtgcttgtgcagagaggcgaaaaatctgagttgccagaagcacacattccagctgaggctgaacaaatccctcatgttgaaacaagtgtcctaaaaaggactggttagctctatgattttcaca

SEQ ID NO: 148 - DNA, 600 bp, Bovine  MMBT01432
aatcatgcatggattctattgagaaatgctacatgtgcatcatgatgcttcacattaacataatttaaaaataattacctacaagtctggacccattccctctttgtttttcatgttcaaggtcttttatgctcatgaagaatatatatgctttttctatgcacatagctagaaagtaaattgcagctctggtttggaaatggttaaagatkatgaatgggtaagttaatttgtgtgacatgccttgcccactttccctacctcatctaatctggattgagattttggaggcatgggtcytctctctgactctgttactatttaygcattgtaagtaagccactcacatttcctcaaccctggttttctcatctgtaaatgtccagaggagaagrgatcatctttatacttctgagattctaaggctctcatttggagagccaggtgaatattttgatggcatacgagagataatgtcaatacataygccctggaacagctctaacctgttgataacatagtgaaatcttttgtatcactcattaaaatgaccctgctggagcttccaagtaacctcatgctccaaacccactcctttca

SEQ ID NO: 149 - DNA, 600 bp, Bovine  MMBT01382
ttaaccaccaaattcgtgtgactcacttcattgtgatatttgctttatagcagtgatctggaaccaaacctgcagtatatccaaggtatgactgtagagggaagtgaggtcggtctaggacctagaatcaccgttcttactggattgggagcaggaggaaatccagctggatgggtggcaagtcatagaccacgcccaggccagcttcagggaggtccaacaagagatgaaggataaaaagagaaggaacaggggagtaaggaatacttggaaacccaggaatatggctagaaaaatcayagttcatatctgtggtgagaaggggagggttagagagagttcagaggcagaactggcaacatcaaggcatggactcatttttagaaggcctgagatcctgggtgggccaggtatcagtggcaaggaaactcgttgctccaacacaacgaatatccagtcaatataagagggcactgaacaaaacaggacaggtggtaggaagggttgaaggtcacctgagggctcaactagagtttctttaatttctccaaaccaaagccaggttggtcctgcagagcttacaaggagaagccacttggt

SEQ ID NO: 150 - DNA, 600 bp, Bovine  MMBT02703
attcctggtgtgataatgctggggagggaaaaatccatgcatgcaaggcagccttggagcagttcgagcatttactgtttatttctaagctacacatctgcaatgagcactagaccatacttaaaccataatgtatggtttgaaggtcactgccggttattatctgaccggtaatgaccgcagaagtatacattattgctattaggagccatttttgtactattttcagttttcctttttattgagtagctgctgacacccccagagcttcacagaattgggttatggtcacggaaaatyctcagtcatttcacggggttttgtttggggggagaagctggtatgtagctgctgcttttgtttgtgtgccgtcaaggggattgaagtttatatgaaatgttccttttattttgagacggcacttgggacttcccatcctgtgaagccttattttctcctttaaattagggattaaggttggaggagttggattggtttattttcttgctctttctgaataattagttattatgtctctgaaataatcacagtgtcaatattatatattctggaatcataaagcattatattaggggcttt

SEQ ID NO: 151 - DNA, 600 bp, Bovine  MMBT02951
cagtttgggaagatgaaaagaattttggagattggtygcacaacaatgtaaatagtagttaagatggtatattttatgtgtagtttaccacagttaaaaaaaaataaagtatcaggtggtgataagggctattgaaaagacaaaacgagatgattgtgggagcacgagggaggttggggaggtgtgagctgttattggacatttggtggtcagagaagaccaccctaatgatgactatcaggcagaggtgtggaatatccgaaggaggggacacgcatctgggagaagagcattttaggyggatgttaaatgggaatggtcaaaggtagggctggtttgtgtttcggaaacagggagcttggcagtgtaactcaagcaaagtaggtgaggagagtggtagaatgaaatctcagaggggtgggggtgaacagatcatgtttcaggttatgacactgagtatgtataaatgcatccttgtatgaataaaatatgggtattatatttctctgtgattgcaggcatagcgttggtttttttgaaagcagatgattgtattgattgaaatcgtatatgtttcccccctctacacctctgcggtta

SEQ ID NO: 152 - DNA, 598 bp, Bovine  MMBT02672
  misc_feature (1)..(166): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctcttaagccgcctcttaaactccaccctttctgttggaattatcctgccctccacttgcaggtaaatgaaaggtcatggaatctctgtctcctagtaacgtcatgatcctgtgtggtttgtttgctctyctgattgtttctgtgtgtttccctttgggaagcttccactgttctgtaacacacaagtctcctctgcctggcttcagagacagtcagcaaagccacacttctccctagctctaagcctcactcagttacagctttggggcgacagtatgttccaaagctccagccatycgtttcttcttattgttttcaacttcctctcaaagatacaaagttttcaatgattttgtctactaagaaagaaaatcctgttgcttaagtaataatttcttcattgattcacttatagccaacaatatcc

SEQ ID NO: 153 - DNA, 600 bp, Bovine  MMBT01524
tggtcaggatcctaccagtgagacctgctggggaaaggagcacctctgggtgggggcggcgctgtagagtggggagggcggcccaggaccaaagcccacggtgggcactacggtgtataggccgggggcggctggaactggttgatgacctcgtactctgccgggtagggctcgttctcctccatctcygagagcagctccagcgcttgctcctcctcctccgtggggtagtggcgcaggaggttggccgctgtggccaggatggaggccccgccagcgccagccaccaggtagaagctracggcaaaggtgacgtaaacctgggacccgtggtacttcttatgctgctgctgctgggccaggatgagttcggaagcccagtaagagaagccgatgactgtggcacactgcaggactggggggacagagggaaaagggggttggcaggcaccccgcagcctgggtgcttgaaccagctgcagccttcccacccaaaccccattctcagagaagctgcctgcccccacacccagtgccggggagctcgtatggccagggttggggacagaggcctgaccctgccgaggccggtcagattct

SEQ ID NO: 154 - DNA, 600 bp, Bovine  MMBT02510
tttatccttttctggtacacttaaataattttcttatatcttctttacataaacaatcttactattatataaggccagctaactggtgttgtacttcaatcaggcattacaaggttgagaaaagaaagaaaataacattttttgttgttttaagtttcacacactataatacataaattacacctacatgttatagytttaccctaaagttctcaattatgaccaaataattcctatcacatcttatctcttctttgtccattttatattttatgttatgtagaggggagaaagataccygggaaaagtcattttagtggcattgctgagaataaaaggacatttcagcattttttctgatcattaaaaataatgcaaaatatcaggaataaaagaatataacaaaataatagtgactcattatgtcaccatccagaggttgaatatcttgaagcatttctgttttgtctttttgctgtacatttttctccacatgcatagatgtatgtatgtatgtatttyaatttgggagcctggatgctytcttaaaagacaatttaccattttttttgttcggatgtaacacaccaaggataagct

SEQ ID NO: 155 - DNA, 600 bp, Bovine  MMBT02870
tgtcatttaaatgcctaatttccaatgagtttctttaagcttgtcaagctaaccaagtcccctaaaccttataaaggtgataaatattgtaggaaagagttatttctgaaaaaagacaacagagagtagatayaaaactaggagaaaccaagcacagcagaaaactgataccccaggagatggggatcactataattgcagaaagattaggataaggaaacatgatcacagcatccttgccatgaggagaggaagaagactctaacttacaagagtggattaacataatttctcttccayacccttccccttttgttctctttgaaactacaattttgatttaaacagaatgactttacttctcccagacacaagcacctttcattattgcaagaatttcttttagcatttggaaaagtgccaaagatccatgattcctccagattttaaccacatttccaatactgtgcatccaataagatatgacacatggacataatgggttcctagaggtgttttttaaaaaaaataaaacttactttgttacagtagcaaacctttcttagactgacaagacggggtagaatcaaaatatctttt

SEQ ID NO: 156 - DNA, 600 bp, Bovine  MMBT02871
gtcaaaatattatgacaaggtaggagaaaatataaaatctctgaaactcacagttttatgtcatttggtacaactcacagaaagctcaacccatttcaaatttattttaaaatgaattatttcagtactactaactttatctgcaaatggaaaaagcaaaaagtgtgcttaaaaggaaaggttacaaaaataatggaagtaaaacaaaaaccaaaagtttgctagtttgcaatttattttttaggcctttgaagtttgggatcctggacgatatatctcatctgtaaagctctgacatgytcagagcaaagttttaaatactgaaaaacactcattgtttttaaagttctgcatcacacactattgggtgtactatttagcactgcaacattttgagtggccatgaaggtcaccttcttcatttcttaggtaaaaatcatcactttctcaaaagagtaaactacatagaaaatacagtacrtagtttcttatgtcttaaacagccacattcagtttcctttagcttaagtaccagtaatgtaagtaaatgaaacagtaagcaattggcagcacagtaatgttaaggttctagcaaacttc

SEQ ID NO: 157 - DNA, 600 bp, Bovine  MMBT02949
tagcagcagcagcagcattagaagtgaagggaaaggaagattactaatgcttgggtggatgcagcttaagatggagaattcaaaatgagatcatagatatgttgagtttgaaggtactagggatgctaagaaacaactgagtgaaggtgaccaatattcagatgaaaacaaggatctggagttaaagaggtctaaaattgaaatgtgtgtttggaatcatcagtgtgatgaggtcattgaaacatttgacatcgattaatgaaaatacagaacttgagaagacacctgagaatgaagacygcttaatatgtggtgccaaatactgagagtatcgcagaccttgtgaagcatttctggaagccagatttcagggttctggaccatacaggtagctaatatattcaaatacatcaaaagttaatgtgactgggagctgacagtgaatcggaaaggagaaggaattctgtggctttatagataaagaaggaggaagagaattttaaaataataattataatagaatgtaagtcagaagatctggtcactcccttactggcaggttgagctggggagagaagaaaccaatctttaaagaaacag

SEQ ID NO: 158 - DNA, 600 bp, Bovine  MMBT02762
tatctttgtctcttgctacataagcaaaatctctgtgcaaacaaagtttatcagtccattagaatgaggaacctttacaacacacattctagttatgttaactgagctaggagccagcgtgtcagaggtaaacagagtatgcagtggttaaaaagcataaataaatgtcaacagccacctcaaatagaggaacagttgtgtggatgtgaggaattcatttttgactaaaataactacaatgttccccagactctgtctgttgagcttctggaatcttaatgaacagcacataatgaaaaytgaactttatgggaacctkctatctagtaacaacaaatgtcayggttataaatattatgatcacaaaacagaacacaggcttgagaggagcatgaatytgtacgcgcgatactgygacacacaccatgatgtagcagaagcaaaacaggctctgacgtgtaaacacgtgcccagagactggatccgacccacggctgcagagcaggctgagaggcagtcacggggacacggaaggacgcyacagaccgaagtcccgtcagaggcactcgattctgctaatcacgcctctcactccagggc

SEQ ID NO: 159 - DNA, 600 bp, Bovine  MMBT04308
ggtatttatggtgtgcgtgtgtccatacygcatccatacacacgaggaggtcagaggtgaggccagccatgggagtacagcacagcaggtagcctcctccctacatcttgcagtgactccttcaacttcttcttttttgtccactcccaacctgttcttgtctcacattcagtattgtgccctgtataatatccatagtcccaagracagattgccagaggggctctgaccaatcagggtggctggggaagctctgccaggaagggaagaattcacagatcgggaacattcactctgagwtaaggcctgytctcaatcccagctggctatcagctaatttctgcaaaaagatgcctctttttccagaagcatttacatgtcaamtggaacttccagaggatttctasggttttaagataatcttttttttaattaaaaatcatttttaagaagtgatttatggcaatactggagaaggaaatggcaactcactccaatattcttgcctgagaaatcccatggacagaggaatctggcgggctacagtccatggggtcacaagagttggtcacgacttagtgactaagccaccaccaccac

SEQ ID NO: 160 - DNA, 600 bp, Bovine  MMBT03007
gtgaactgtggggtctcagtgtaggttgattcccatgatgtttattgaattgaactgggattggtagagaggaaggaagacgggagaggggaggagagacaagggaagaagggcggcaggagacaaagccaggtaacagcacagccacacgatgcgtctgrgaacctgccctgcggctcctctcctagcagccttttctggaacaggtcatagcctgtgggctgaagacattccaccctaaggctcctgttgaaagtggagaccaggtctctgcccccagtccaaggaccctgcctgtcwctgctggggtgtggggagggagctctcccattgtgttgggttttcatcacttaagtcttaattacaagcattatttaaatttttcacttaattattgtttaytgagcatgsttgtagctaagatgtatttatttgctatgtactttgtctgattttagtagattttttcccccttctctctttttatctgtattctttattctaataatgcatgttcaggttaaaaaaaattttttttttaaagcacagaggaaaataaagtccctggatatttcatcctttagagataaccactgttga

SEQ ID NO: 161 - DNA, 600 bp, Bovine  MMBT04010
tatgttactgcagttctttggatggctctctttatgaaagccagtggccagagatgtttgccctgtttttaccaaaaccrttttacagccctggacagatttgacagttcaggccggcttcttggtgtggtttagattgagagctgtaaaatcccactactgagaaagtaaaatcaagatgtacgaggatgctaaatccaggctgtggacaatcctttattgtttccgttttggaccgaattgtaaaatgtcctttggaacatgagctagaggtkcgatgccgaccaggaccaggaagywtaagtttctccaccgtagcttcctcgtaaagggtccagatgcaataactttcttttcagtttgccacccaaaagttaacgcagggaatactttgtgaaaagtatgtgtttccattctaacctgttactttgtgttttgggaaagaaaagagaggatgcaagagagagatggagaagaaagaagggcggaagggagagggagaaaaagagagagagaataaatataataagccagagaactaaggcatggtttgtcattacccagaagtgctaacactggctcccaatcctcaagctctga

SEQ ID NO: 162 - DNA, 600 bp, Bovine  MMBT04390
aaaaagttcctagaggcattagttctccatgctcaacatttcaaaatacttggtcttactttgacacatctaacagtacttggctacattatcatattcattttctagcctacaaaccttccactcatctcttatgtgaagtcagctttcctgaatggtcaacttatcaggtgtctacctcaggacttccagagaaaatacatggaatctgtatatcctaggaggaacagatcaatgtcacagtgggagtcatgggccctcggaaaatccagcagcccatccattccccaacatcacacwcccatgaaacttttttgcaaccagaaactcatttctatattcttaggggttttacttttccagagtttcttctctaaatgaaaaactcaaagactgttattaaataaaatgtatctgggaaaagctaggaaaaaggtgatagattctctagaaggaattcaaaggcagcatatacatattccttgaccaaggataaatgtcctcttaggctttcaaattccttgtcagtaagcttttccaactttctcagatgccaggtcagcctttcatttagatgtttaagctggttttagaaaaggc

SEQ ID NO: 163 - DNA, 600 bp, Bovine  MMBT03968
cacatttcacaggatccctcgcatgtgggtcccacgctcgcacgtgtgtccaccatccagatggatccgcaggtctgactcctcgcttcttaaacagtttgcttcatccttatacaaaattgcttacgcgtcagctctttggaccttgccctgtgtatggaaacggtctcagtagactgggagcttgggttacaggcagacacagagaattacacatactggaacaagccaccttggttccctttgaaatccccctaaatgaatgctgcctgggaatcggtttcctgggctactctgtcwtcggggctgtaagagcctgagctctttaggaacctgggcagatattgtggctgggaggacggctcactgttctcacattgttccctgcgctggggtggggagcactttcccaagcaaagcgagaggcaacgccaagtattttcaccccctgtcgctgccgacaatgggaaccgtcctggctgctcacagaagccgagggcgcttcctcgctagctcacagcataatgcatccgaaagacggcctcagggtaataaatgggcagtggctagagctcccggtgcagcccagggaagccctga

SEQ ID NO: 164 - DNA, 600 bp, Bovine  MMBT03694
attcttaatgttgcaaaaggaatgctgttttgaaaataaagaggaaaagatagtggtgaaatttcatctacacagatcttagaaaaaatgtcatattgtttgaatatttataggttwaaaaaaaaccacaagtatataatcttggtaaaaagtatctcttaaacaacagaaggtcaagatttaagatttagacttcttcttgatggcctcatattgttaccacaggctgacagaatagctggaaggcatttctacagcttttgaacagatgattacttactctgatatcccaatattatwattttacaccttaatggcagatcttattcttaaaagccaattccatttwaaaaaaaaaaagtgaatgtctgaacttttgacaaagacattttaaaaactcggtaaaataattattgctataaaatctagaagtcctctttcttacaatttttacaagcttgcttacttyctttgtatagaaaatcctttcatattatctagcttcttttaattttcattaatattagttgtaccagggcaatacagtaatatcttttctgataaaatatcaccagttgtgacaagtggggagtgaccaca

SEQ ID NO: 165 - DNA, 600 bp, Bovine  MMBT03351
aaatgtgtataaatgtatacatatgacatcagcaaagagaaatgtataggaaagacaatgtatagttctcattagcctcacactgatttttctctctactctttcgcaaatggattagtgattatttaatgttagtctgacttcctaattacgtattcctttctgatagccattaaagtggtttgttttatgtaaataaaggtacaagggttcacctttgattattttggaaaagcctgcatgagaaaacacattgtattgtttggactttgatatattttcaggaagctaagatttttwaaaaatgtaatattcccaagaatttattgttggcagaacattcaagttgaaaccaagtaaaggaattttgtataaatctgagggccagtcaaataaagaccaatgaacgtttatcaaatgctgagaatgtattggaaacttcttgaatcttggttcatttttgttctgctgaattatatacaaaactccatttaatattagtaagcatttacctatgaatgaaaggaaaagactaagagtcattacagacagcttctatactgcacatgactattcttgaattaaatcaagtttttacta

SEQ ID NO: 166 - DNA, 600 bp, Bovine  MMBT03473
atgaaggggcatatttaaagcaacactttttccattaagagaaaagaacaaataatgactgaagtataacacccacactgctggatagagaagtatcaccagttgaattttgcatgaattagtgtcagcagtcaatgaatttttagcaaaggagataaacagcaaaggcagccagttcaaagaacttggtatcatttaccaagtagaaaatactaatttttaggaattccttagatgactgaatttgttgaagagagtaccactaagtttcagtatgggaaaataccacataaaaattgwtcagagactgatgtttagaagatagtgaggtccagaaattaccattagtatctttggaagatagtaagttaaggtactatagaggccaaaatggccaatgaaatatagagcactgtaggatatataatacaaaaaatctgattttaactttgcatccaaaatcatggtctctctacaagccatattccaagaattttattcttttgttaattcataacagaatggaaaaaggcttggaaaaggaaattcataaaactttttttttctttatcattgcagtataaaaagattagaagtatc

SEQ ID NO: 167 - DNA, 598 bp, Bovine  MMBT03348
  misc_feature (1)..(137): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttctgcctgggctcctttgtgaaggcacttaatgcccaaatctttacaggcatctgcacagcttgccctcttctcaaagtcctacagtctccagggtgcttcataccaggtgggcacagatattggtggctctggaacagttcttgggaatccaagattwccctacttagctaatgtgctttttttatccaaagcaatcggcactccccatgatcagattccagtacactctttgaagtgtcatccagttgattatcttctatactcacctttaaaatacttggactattatatgtagtctgtgtaatgttttacctttagagaaaatttagcatcctttgaagtaaggtttcagaaggacctaatcctcyttttttaattccttgaatattcttaggcatgggtttttgtcattgagtttgtacaattttaagttttaaaagaatttagagctgcag

SEQ ID NO: 168 - DNA, 586 bp, Bovine  MMBT02984
tcttgtactattgcctccaataaactgaactctttttaaatcaccaacagttatttaaggaaaaatataaatgcaaatgtttcaaaacattaaataagtaccatgtgccagattcaacatcacaagtggcattaaagatccagtacttttctgcttaaaaaccaatcacttctctctaaaaaaggtcagaagactctagttcaaaatatctactcaaacatctaatacatcaattaaaacaaaaataaaaagccagattctaagcatgtctgcccttaacaacacaggatggtttctttwctcttctttggagggagacgttcatttgaacatccattcgagtttaattttaastgactagaaaaagcaaatatttgggctgcaggaaatacaacttaggacaaaggaagccacggctaactttctaacatttacttcatgtgattcattctaacaataaaacctaaacagtgaacattccctctaatcttcagagcaagttaactctacagcgaaaacgatgcatgccccatcaccagactctatgtttaaatgattacaatgtaaagcatgttcattctcacaa

SEQ ID NO: 169 - DNA, 600 bp, Bovine  MMBT05002
cttcctttattccaaagaaggtttggtttctgaaaaaaattttggccaccttagttccctgaccagggatattgaacccatgctccctggagtggaagcacagtcttaaccactgaattgtcaaggaaggaagtccccaaaagaaggtttccattgccataggttattcatagcaaccgattacaccacaaaagctattattgttaatatacttttagcaaagtcaaggcacacacgatacatcaaaaatgcatcctcaaggaacttgattccctttccactgcacctgttattctttgwtatgcaaaatgttatcagtgcacataggctactgtcaaaatatttacacaaggcaatgaaaacatgcttagaatgtaatagtctgcaagatcctaattgcctaatgacagttcagagtcctacaatacactgcttcaatctctggaccacccagatagaatgctgaggtatactcttttaaatgaataaaaatagttggagttataagcacaaagatcttaaaaacatcaagtcatcattgccaggttctctgacygggcttagaaacacatatgctttcctagtggccttaaataaaac

SEQ ID NO: 170 - DNA, 600 bp, Bovine  MMBT05289
tgaatcttccctcctaggagattataatacccatgactgttgaaagtcagtgggacccattccaataaaaagaaatgataataatcctgagaagaaatgatagcatagaattttacactgaaaagagatgcagtttgccatttcattccaaagggctttattcctcttttgagtgaaatagataaaggaagacatagtataaaggaggaacactgctgtttttatttttatgtgattcctactcagtttataatttgatgatgttacttttcaaaaacatccacaagtgacttaagaaawacagtttatgtctcagaagttcaaaagaaagacatccttccaattatcagtttcagcagaagaaataacaaattattttggcagtagaggagtaaaataagaacactggtaaagcagtttcataaaaggatacatcagagccattgaaatcatggaatttaatttcagaagataccttgagttcatgtataccagtataaggcacaagcttggggatacaccctggtgtatatacacactaaactacatcctattttttttaactttttattgaaatatagtagatttacaatattgtgc

SEQ ID NO: 171 - DNA, 600 bp, Bovine  MMBT04904
cttcatcagctctataaccctgcaagtttcattattagggtttcctgctacacttttaattttcagttacagattgactaggggctgccagtatgtctggcctactgatgtttgctggtagattatccttgtaaaagttactattgtcaggtttcattttgtaaaggtagtgaagactggcaattcacataaattcctcagcctcattgctcgtgatggtctaacaactaagaacaaaacagaaagataggctcattttaaacaaatcttcttgcttcaaataatatactaaacagacawacagcacccccaccccccggcaaaaaaggaaaacaaaaaaagaaaaaacaccttacagttgaatttactgagctgaagaggtcaaactttgccagartcagggactggtaactgacatccagttatccagttcagggattcattttcccttttttcaatagtgaatgaaattccctttttaaaggcttataatttattgtctaaaactggaactgggacaaattcaaagcaggatgaaaggaagtctccaaaacaatagcattgaaattctcccagggctgtttcaattgtgagaactta

SEQ ID NO: 172 - DNA, 600 bp, Bovine  MMBT03790
tgttaaatgcaatcaacattaatcacattctgtagaaggaaatttcatctgagcttggctcaattagaagggaaggacagagatgggggaaaatctagggcagagtgcagaaggtggggatgtgcattcacaagatgaaaaataacacatgttgacattttgacaaaataaatacatctcaaacatctgctggtttgggaatgttttgagtactccacagkcttgttgacacrgttctagaagtaaacaagaatccaataccaactgactccagctcctgcctttcaacaggggccagawaacagtacttttacttgcttgaaaattaaaccactttaaattccttagctgcaatgacactccaagttttttttttttctctccattatgattgtccagtctttactgcctacttggagaataattaatgaaccacaggaaatatcctttctcatgaatacatagcaagaaatttcatcaggcaataatctctcgttcttggtatctcactataatccaagtagcacagggtttgaaaacataacttctaggtttgamtccaatcaaatcttgtrgcataacactatctcctttccctct

SEQ ID NO: 173 - DNA, 600 bp, Bovine  MMBT05446
agcgtacacataaacttgaatatttcactgtgaactctcacttctagatgagttatacatcagtgcattgagaccatgggcagacagatatccaaagcttcaggccatggtactaaatatgtggccaggctctttctattgatgtgattccttgtttttgatatagaaatggcagaaataagggtggaaaaggcattaccaagatgaaaaagacattattttatagattcttctacatagttaaaatggtcaatattaatcatatttgtacaataaaccatgatgtctaagaatcagtcwttaggacttcctttgggaaaagctcaaagatatttattttaagaatgtagtttcccagtaaagactaattagaatatggaagaaaggacaatcacaatgctacaaaaagtagcattaagaaatacaaagatgtttgtgtcatcactcgtgatgattttaaaggttctactataggcctataaacattmattaagaatttagtaggtgaatatttatataataaagccactctcatttactaataaaatctacattccttatgttttcctcacacacacaaaattatacagctaaaataac

SEQ ID NO: 174 - DNA, 600 bp, Bovine  MMBT04399
gggaaaagttgtgaccaaggattttgagaggagtttatcctgaatgatctgggtgggccctaaatccaatgacaactgcccttacaagagtgaaggagaaggaaatgtgacagaagaggaggrggcagtgtgaccatggaggaagagactatagcaatgcagccacaagccaaggggcatcagaaaccaccagaaaytgggagaggcagaagaggaccctctactagaggctttggagggagcgcagccctgccagcatcttgatttgcgacttctgatctccagaactctatgagaatwaatttctcttgttttaagccacccagtttgtgatactttataactgcaaccccaggaaactaatacactagtttctgagaatagaatactgatcaaaacatacatggtccctaccctcctagaatatacagtctaggggagcaaacagacaatgaacgagtgatcaaaggtaagtaattaccgactatgatgaaacaacaaatatacttggatagagaagagtgcagaggagcgctttatttattggatttattggagtttagggtcagcatctttgaggaggtgatctttgagctaagt

SEQ ID NO: 175 - DNA, 600 bp, Bovine  MMBT04677
gttatgaaccactcctcccacttccagagaggttttctgtcttgtgtgagggggcgggagtgtcatgaaaactttgaagaaagctatagaaaacccctctctggaaaaatgaccactggggataaaaacccgtatacagtacaggagattcccagatccctttgcagccaatccatgaccttacaaactgattcacaccaaaatgcaaatgactaacaaggttcagtatatttccattttaatggggagtaaagcccttaagccacactggatttcactccaacggtgggtttagacacwtcctaaagcagatgggaagcatttcctagcttctgagttcttcccaaatccctgctgtaccaacatagaaaactgggtttggaggaggagaagtaacagagggaagaagggaaacagggaccattcttaggctaatttggaatcaaaaggccacctgagactggacccaatggggcttgttgggaacccacaccagatattcctggtcagcccagggcatctgatcttgttaatggccaataaaaattagggggacaaaggctaagccctggcagctcaaatgaatctcctctgcaagag

SEQ ID NO: 176 - DNA, 598 bp, Bovine  MMBT04198
  misc_feature (1)..(107): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgagcctagagtccaatcttggttaaaaaccagacaaaaacatcttaaagtcatcaaaaaagtggagcaccagagaagatgatgagatagtaagagtgaaaataaatcagtaacctgctcagttttcactaaagcagacagacaaaaggtcagatcagatatacctacatattcatacaattaaaattttwaaaatttttgtaatgtcagacttttaaaagtcagactttaactaacataatgtgttcctctctcttacaaattaattttaaagtatattaaaaattgtttgcaaacctgacatggtaccaactccaatcacaagacattctacaagagcatccagggtgaaggtgggacctaaaatcgccatcccacgagcaatgttctccctcacttcatcctgaaacagacaaacagagcaaatgaggagaaggcaggaaatcattttaagaacttttggagcatcccagggcttttactaaatca

SEQ ID NO: 177 - DNA, 600 bp, Bovine  MMBT11032
ggcacaggggtgcggtgttgtcagggctgggggcctgtggaggggcgctgtggtacacagcctgaggtctgaggtgggctggccccgggagaatgggaggctgctgtggagagttcggtttctatacacactttgttttcccacccggggaattcaggctgtgtcctgttctctgctcgagtatattgaagtgtttattctcttaacatgtaacgtggactgaacacctgacacgcccagcgttctaataccacagacaacccttctgaggatacaggcagcctgtccaggaacctaaawgtgtctcgagtgcacrgtgccacgtgcagcgcagtttcccggaagccagcgtcccccaagcggtcttgcgagctgcgctgcttcccgcaccggggtgggcggctgagggttgcggcccacggmttcgtcttgtcccctctgaggggtccccgccctcgcctcatgagccccagctgtgctctggttttgttggggagactgtattggtttttagacacagaagaaaattcactctggtttaaattggcagaatggcttgaaattattttctcattcccagaagatttttaaaacaatttt

SEQ ID NO: 178 - DNA, 600 bp, Bovine  MMBT07908
gggtggcctgattaatggactgaggaataagcccgctgggagccggaggcaagtgtgtggttaagagtcccacagcctggatgaaatcctgactgccaccactttttgtctgtgactatggacaagtcacttgatgcttctgagcctcaatctctccattcataaagtgaataatagtactttctgtttagggtagtttgaggatccgtgtctgacatggagtaagaactatgtagctagttattattatctttgcttggggagcaaaggattgcttcctttactgtgtccaggacaaawgcagaccatccccagggatgctttctggttcagtgctggactgtgctgtgtttgtgatcccttgcctagtttcatctagcagaggagaaagamcattggacttgggggtcagaaaacttgatttaggatgccttcttccactaatgagataagtacacttgggaaaaattccttattctgtccaagtctcagtttcctaatttgtccaggggcacactcacctggggctcactgatatatcgtgagactcaaattagatacccagtttatacgggtgtgctgtgtaggctggaaagcact

SEQ ID NO: 179 - DNA, 600 bp, Bovine  MMBT11253
cgagccactggtggctccaggtggaaggccacatatgcgctcagagagccaagaggggtcccagctgccccctctcctccaagacagcggtagggtgtgaaaagggctgagacacactgcggggacattgcttcatttcacgttcacgtgagtcttctgaggggagcactctctttagctccttttgcaggttggcatagtgaggctcaaagaaactctgctcccctcaaggagatgtaaccatgaagtggcagagacgggacttgaaccgaggtctgtgggtccaaagtctatgctttwaagcgctcttgtcatccaagctttagaagaagcccagaactttcgactgaactcctggggatgaatctagtgatgggctggtaaatatttaacaactagctctctggaattaaaaaaaaaaaaaagccttgatttgtcgtgtctgctggtttctgcggtgttaaaacttccacttctgctgacgtcaagctaccagcatgatatcactgaatgtggagttgggaagagatgaacccgatctgctcctgcacragagaagagccagcttcagcacaccactgcatgaacatcctgccctca

SEQ ID NO: 180 - DNA, 600 bp, Bovine  MMBT09527
aaatctaacagctgtaatgttggacggagatgcatcaggtatttggtagaaacatatatcgtggggaagtttaaggattcaaagtctgggcagcgtttggtgaaggtctttgggatattttaggtgtctggagccatagggctggaagctggagtgaggatgcggaatgaagggcagagccccgcactgaactgttgagggaggagagagaggctgtgaccaggagggaccaccaccaaggcctttgcaaagcttagacggcctgccctgcccagttagcctggatgtgtgttcgctggwgtatgagaaaaactctaagcaaataaggtaaagactgagaattccctggtggtccagaagtcaggactctgcacttcccctgccagggctgagttcaatttctggtcaaggaactaagatcccacaaaccagagggtgcagtcaaaaaaaaaaaagagagaaagagagaaagagagataaataaatacaaggtaaaggctgctgagagcagaagcagttgtgatctgcacatttctcgaacggtctctaaggttgagacccccagggaagaatgggctgggtaccactggcgttaggctg

SEQ ID NO: 181 - DNA, 600 bp, Bovine  MMBT07138
agtcaaatccatcgcattttataagatacaaagaaagacttacaggcacctggcccagaatggctcctttccgctgggtgacgaggccattccctctgtcygcctgtgctgaatcccgcagcatacactgttccactggggcygggaaacaggtgggctcacaccatgcagttgtttttcgtggaatgtccgtttcttcacgatacttgctgataaacccgcatggcctgcatcagctctggactgttgaccaggggtcttcccaaacggggtcttcattcagctgcatttaagtgagcwcagagctgcyggrttagggtgaaaattcaatgtgctgcagtttgaaactttccacagaatttcaatattcttcttaatccatcatcccaagcactygatttctgttgttgtgtttttgcaagttaagcaaaaatatgggattacgataaacaaaatttccacacagcacgctgtatgcacctgtgctcyaagtcctcctctccccataatgcctccaaactatgtgggtatttaactcatttgagttcatttttgtgtgtggtgtaagaaaatgttctaattatttacctgtatctgtcc

SEQ ID NO: 182 - DNA, 598 bp, Bovine  MMBT09774
  misc_feature (1)..(111): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcccccgcccacacacagcaggcttttccacaatcccatgccttgtcatttgcctttccactccgccaaatgtttcctgttttctctgccaggtgaactcttgcacattcttcaagatccagctcataggtcacctcctccaggaagttttccwtgccctccaggcagagtcagcccctttcccwtgctagctgtgtagaagtatacgctacttctcccagcctgtaattatctgcttgctggcctgggctccaccgtcctgttgttcacagatattccctcctcctctctggagaaggaaactacttccctgactcactggcctcactcaggcttgaccatgtgacttgccctgggctgtgaagtggaactcatgagtcagtgaggaayagaagcttccaaggctaagtatggttcaccatgctctcttttccctttgctgcaaaggatggcaatgccccatccagaaaccgcgctgccagc

SEQ ID NO: 183 - DNA, 598 bp, Bovine  MMBT09810
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnnatagcaatttatatctctggcagcccaaactaaaaatagtcaggctataacagagacagggatagactttaaaagcaaggaagctgagtggccatgtgtgtaacatgtttgtgcccacctggaatcactcaggttaaaaatgaactcagaagttgcagagaaaaakattccttccatgtgacttaargtagtttctctctaagggcagggtcaagattctggcaawaaggaaagggaacagcaagtatgtcaggcaccgtctggggccccatgggatggcacatggttctgccaggaaatttacattttccatttctctctgatacaatcatrcctcccattgcctcctgaagaaatcattatgaagaaattagtcacccaagacctacatgaaaagcagatgtaaaatgcaaataaaccccccaacactgaggctattctcttcgccccaaaagaatgaggaaggttctcaagagttatgggaaacagcacccacttaggccagacacctccacttaaagcaa

SEQ ID NO: 184 - DNA, 600 bp, Bovine  MMBT06699
cccgccaacctttaaaccaccaaagggaaggaaaaggacaggggtgtgtgtagtcactggtcaagttggggacaggcggatrcactctgccagctacagtaatcaggccgagatgccccgattgaatcactgctcatctatagggaaaaaagactctcagatgggaaaaaaaggaaagagtgaattgagtactggagcagggagaggagggtggggaaggtggtgacaggagcagacggctcctgcttgcctctctgctgcctgccacagggccagaagcaggcggaaccccacagcacwcacgcggatttccactctgctcctcagcgggggaaactacagtgacaggaccctcatcacagacaagaaccaaagggctctgatctcaacctttctaactgatgctctgaaccgcctgtcaagcctcagctggcagcaagcgctagtactgcatgacagaacacaggtgtgcaagtgtgtgtgcacacacgcctaggtgaattagattttttgccacccaaataagagataaaacccaaagacagacagatctatggcttcgagtatgcatgtgtgcatgctcagtagcttcagtcatat

SEQ ID NO: 185 - DNA, 600 bp, Bovine  MMBT06652
gacttgggaactcatggccaggatgggggtgtttccactttgcggttcatgggcttggcagctggagctgtcatcttgtcrcccttgaaacatggatgatatcctgtagaaccgcattccagacccttgatagcttctgtatgtaattcccacttttgaagaatgtctttcacaagctctgtggactacatttcttgggaaaacaagacccaacaacaatgcaaacagcagcacaccctacatggtcaccgctcctgagttttgttcctggtgggggcatgactccagcccctcatgacwcgagggctcagagcagtgtctgggtcacttacctgtatctcttcagaagcccctttatcctttcgggatgggtatggggagaagatgtggaaaacggaggaaatgagggacaggacgggagaggtgtggctggtgatggagggtaggggcagccctacttcctagctgtcccagcagtgggctctggataattgcttcaatgtagaagtctcagttctgcaactttgaaatgccaacattttacagttaacgtgggccaggaatcagatgatggctaccaaaagcttagcgcggtaactg

SEQ ID NO: 186 - DNA, 600 bp, Bovine  MMBT05949
ttaattgaaacagtccgtattaaatagaatttgttgtatatttatatggtcttttaaagggagaagggatgataaaacatagagacagcgtgagttttattcccaaattcctataaatgtagcaccttagaacgtgtgtctactatagctctgtgtacttaaaccaaccatgtctgtatatgagagagttagacttacagagatttaatacatgttttgccccctctaaaagaaattcccagcataaaatgaatatatctgagtttttaatgagagatatagtcaggtaaagtaattttwaaatgcttcagtaaggtaagatagaagcacctaaaaatgttaatatgactgaatttttaaattatttattttaaacaatgatatattagaagtttcttgaaggactagaccaggtagaactattttacatgtttttagcatatrgtaaactaaatgttcattaaatgtttgttaaaagaaggaataatttgaaacctggttttggtttggcttaaacaattaatttagaagacagaaaaacttatttatgatgctattagcccagtcacagtatttgatctttgcctttttttttttttt

SEQ ID NO: 187 - DNA, 600 bp, Bovine  MMBT11359
gcaaaatgcaagaaatattcaagaagagtaatcatgaggaaggaaaaacaaagtgctgaagcataaaatgtcataaagacaaatttttcctactactctttttctaggatcagtcctggcacccacataaaactctctctctagattcctttccattgtaccctgaacaataatcttatgtcatctctggcatataagcagaggttactgatttgttctatctccctcttgccaaacaacaggaagagtagagagactagaattgcaatgtcttaagtctaccgtctaccaatgggatcwcttggaaaggcagttttcctgtgcaacctgtcttctctgactgaaacctactcagtaagcctgttcattcctgacctcctgcccccttgacactgatctgtcctaaaggggatgccaatatatcgtctgtcaaatttatattagaaagccagagcctaaggtccctatttctatattgcacacaatgctctatgtcaaactttgataaacatgaaatcacattttcaaaggttaaaaaacaagtgtcagtcagtcaaaaatatttgatcactgtgagtgtctcactggttgaccttgaac

SEQ ID NO: 188 - DNA, 600 bp, Bovine  MMBT06749
gaaaaacatacttgttggcacaaaaaccaatcatgtttcatgtagcttttccttcctttattgaaagagaaaatatagaaattttaggatggtttgcctccatcttcataaaaggcattgaatgaataaaattggaaaatcaagtttatctatagctctcttgatatttagccattcttgcacacgtacacatgttcgtgatcatggaccactgatagtttgccaatagtaggggatgctgattttattcacttatcctaagaaccagagcaagtactagacacagactatgacatattwtagaatagcaaataataaataccttggatttatagcttaatttgtggcttattttcacatacacttaaaatttacctctaatccatttcttacttcttgagatagttatgttctaaggcctgtgctgaaccttatcagagaactagaaacctgtggcagagattgctagttgcttacataatatccaatgtatttytttttattatggattcctgaaattttattattttattttattttgcaagatgtcagttctccaaccaggaatcgaacctgggcctggaagtgaaagtgcagagt

SEQ ID NO: 189 - DNA, 600 bp, Bovine  MMBT06761
gtttatgcctctgaagtttcttcttggaagctattgatgtgatggtaaaagtaaaaacttgctttaagcactcatcatacaaattaaatttcaagtaaaagcaattgatattgctgctgagtaagttcttccagtagattgctcagacactctgcaaaattgcctgctgacctactgcatgggccagagatgccagtggcctgatagccaatagtatctatcataggtgacatttatagtggagagctctaagcagttgtgccaaaagtacacagcaactgcaaacaggctatttgagawgagatgatatattaaattatatcctgcactttcaattgagaaatgagcatcctggagaaataaaacattcctgaaaccaagctggaaaaaaatgaaaatgtgaaagtagctaggtatttttactttgataactggatatgtaaagagttggcataggcacacttatgaaatgtagagtacatccatcactttaatgctttaggtttcgtattgtgacatatacagaattatctccattttacagatgagaaaattgaggctcaactagattgattttatctgagtttaaatgggcttccc

SEQ ID NO: 190 - DNA, 600 bp, Bovine  MMBT06770
gatgaatattccttttctctcctcttcaattgattctgcccatttttctgggtgaactgaatgttctcaaaagtcacaacagaaatgtcacaaaaactgtggagaaaatgtgggtttccataaaccaccaaagtgtgttcttgattcagaaatctcagggggcctgtgtcttcaaagtagatttgttctccacatataactcttatttgtaygtatttgattgtgatttcattctctataaaagagaatgtttcattggttctgatttccttctgatgtttttgtcccattttgttaacwttcttggttcctgcttcatagccttcagggatattcaaactagaaaaatgctttgcttgcacttcatggatgggaatgagaatgaaattgctttctggttctgaaaacctgaattttaagaaaggaaatacaaatttcccaaaaagttagttgaatatattgccaagcttggcttgtactttgggtttaatgaacagaactgtacataattatattgaaggatactcttataaagtcatgcaaatgaaaacagctttgccaaatttatcataggctactacaggctgagacacttggcac

SEQ ID NO: 191 - DNA, 600 bp, Bovine  MMBT07334
aactgatcaaaaaaagccttggaaggtgtagatgggcaaaaagaaacatacatggaccgttgagtccacacccgacttctgcacttcctgaggctatgcagctactaagcccacagacgccgactgaaggagatcaaagtctctggtccattgccctctcagagctcaagaccacacccgccctcaacaaatgccagcgcggcgtccacgtcacagacctcatctacctctagacaaagcagggggaaagcagccatcagtctacatttcccaaagtcagagaaaccttaactatgaacwccccgatggcccgataaagcaaacatgctctgtctttgctccaatgatctcatkctccgtaagggaaaygcaacctgaaaccaaacacaggtccagggcaggactatcagtataaagactggcttggcagactcacacttctcttgcactygtagaactaaagcgcttgcttcttttttccctctctttcctgcctcatgcattttctgaacatcagcaaaaaactagttctgtcatcaaaaaactgctctggcctggcttttaaacttcgctgctggcacctctcagagaatcgatcag

SEQ ID NO: 192 - DNA, 600 bp, Bovine  MMBT06143
actgatgtatacatgatccccctaatccttactaaattcttaataatcccaaactaatatttttgaatgtattagatgcacaatgcattgggtactgcatcacaaaataagcctgtgttaaagctggtcctctgctgccatctagtgtaatcataaaatgccaaaattaaaccaaaagtgactggaaaaaaagtacttcggtggcgcatctaaataataaatcattaaaataaactagttcaaaatatggtccttaaatcactggagataatgctataaaacatttaataatttattttwaaaaatgtaaatctcttaccacaaatgcattctggaggatataaatagttcattataatgaggatatcttaaattataaaaagattgctacttctatcttaaatatcttggaatttcttgggtcacttgatctgggggaagctggctgcmatgtagtaaggatgttcaggcaactatttaaggacacacagaactccagagttagtatgaagattactttaaactgaagacatttgagattcaagagatgctgaaagaagccttcccacaaaagcagaaacttctggaaatgaggtttcc

SEQ ID NO: 193 - DNA, 601 bp, Bovine  MMBT08496
  misc_feature (1)..(1): n is any nucleotide
ncaccagggaagccctaacaagatattattaagcagaattcagcaatacatgaaaaggtagagttgaggtcagaacaatgaacacattgcatcccactatcccataacaaascctgacagatatcacwaattgatcactctttttttctggctgaatcattctcagcctmtctctctccaggcagccattatcaatcagttaaagttggcatgtgagaagaaatctatttgacatcattgaacaaaatggatcttaacaataaaaagttgagatgctataattctatcttcctattaaaawtttgagatcattttacaggcaagcatttcctgcaatgtggggtcatttactccagaccagacatgggagagcaggagttccttattgtgagcaattcacacaaaaggaagaagccataaaatactaaatttctataaagactgtaaccttgtttgtcctcatttactgctgtagcatcagcccctaagaacaaagtctggtacatagtatcatccaggactgttgaatgaatgaatgagtaaattcttagggaagcagaaaaacagctctgtctttgtagagttgttacagttactgcaa

SEQ ID NO: 194 - DNA, 600 bp, Bovine  MMBT08172
aggcaggaggcacagacagccaaggaggatcgaaggctgattctgacttccctccagacagactgtgagatgctgggagtcaccccacccttccttctggactgcacttgccacttgtaactggggaggatggtagattccacacagggggttgagcttcagaaagttgaacagaggacaagctcagctacaagtgctgtggccaagtgggagtcgtggttctccctgggtgatgggttttgtttgttttcattagttgatttacaaagttgtgttagtttctaggtgatagagtttttwaaagtatttacttatttattcggctgtgccaggttttacatgcagcatgtgggrtccagttccctcaccrgggatggaacccaggccccctgcagtgggagtgcagagtctcagccactggaccrccagggaagttccacaggatagmatttgaagtgctgtttcttcccgtttctaattcttactttctagtatttctgacagtgagcatgtagtaaagtaaaacccaaaagtttcttttaatgatgcaaatgctaattgtgataaaaactttaacatatgtagtatgtcctagaataa

SEQ ID NO: 195 - DNA, 600 bp, Bovine  MMBT05616
cccaggtcacttttagttatggcgttgggagaagttttctgttgagattttacccctgccacattagaggcagaattcaatattctgcagccccaaaggccagtgttcaccaattctagtctcattcaagcaaactgtataacactctaatgccaggtctgaaagcacataactatctgctgtaatcaaaggtttaaatgaccatttatttcatcttgtatctgcctgaggaaatcckttaccagcctattttctccccttagagtaagaacatttgcatgcttgcagacaaaggtaacwatttcaaatgatatatattcttcaatggtgaatatttgctttttaaatacaragagtagagatctagttattattatgggattttacatattgctcaaattaactgccaagaaaagcctctaagaaataaattgcctttatgtaatattacctttaatttcttctagcaaatgggataagaggtttaagtaggttaaaggaaatcaagtaaacatatttatggaatacaatttttcatggttaaaagcctaaaagcaaatatttcacagcttactaagaatgtaccagggaactaggaga

SEQ ID NO: 196 - DNA, 600 bp, Bovine  MMBT06834
ggcagagcaaacacctggattccagtgtgctttcttttaccatttaccaaaattacctggagcttttttttttctcccactctccattgtttccaagaatttaagccatttatgatctcttaatccatgacaagatatccatgtcctctgaaatattttttttccccacatatttccaagttgtcaggatttttagtttctcttctacttaacagaaaatttctcgtatctactgcctcattttcaaaacacatattaaaatgtgcaagaaaaaaattccaaaaacagacttttcagtawcagcttttacatcagacatgggcatacacataccacacatctgtaaaggactgagcagctcatcataatcagggaggcattttcaggtacttttagagttacattgctcagtagagctggaggaagagatagaagtatttatatcttttctaagtggttctttttaactattaagatgtcttttaattagaaattgtaggagttgtcattttagaattcattctgcctgcattctacacagtctttgggaaaacatattttccctaaaggaatttaagggaggtgatggcaactgttaaa

SEQ ID NO: 197 - DNA, 600 bp, Bovine  MMBT06816
aacaaggaagctgggattttaattttgcatggaaggaagtagctcctacttcatcttgcctccttttctaatagttaaagccttccagctccctaccacctccatcccttaccatatgaaattatcaaaatcatgaggatctgagcaacccagtcatttgygaatcttctttctgccccatctttactggctttactgttttcatctctgacacattkactggctggggccagatctatcaggtaatgacgtatgctttagtttcccataagttctggatattgggaaacaaacagtgawtaatttgtttcctcttgggaaagtggtttragtcccatgaaatcaatgaataaaatgatgtgctacagacacttaccttcagctggattcccaaacagcttctcactttccattcttacaaggatgtgtgctgctgatgctgtttatcgagcttctttagtgaaggagtccaccagttaaattgttatggagccttttgtataagaattctttatgaatgccaaacatgttgctttcatggaggacatatagtataattaagtgtttctcaaactttagcatcaaaataatccaaaatgt

SEQ ID NO: 198 - DNA, 600 bp, Bovine  MMBT06973
ctatgaaatataatacctatgattattgatctaatttaaagactatcaaygtctgattttacaaaagtagtcaaatgttgccattctacataagaaattacattaacagcattcttctatttaataataaagaaatagaatatcctgaatatttcatatagttataaaatttcttgagagactgggaagacaaggtctgtttcagtatttacatatattatcactgaacttctgatgtagaggatcataacaaacctattatctaattattatgaaaactctatgtgtagtagaaaaagwaaattgttcaaatatacactttaggtagttaaattggaaactgcagttgcatttcttgaaggaatgcaatcatcatcattttattggtaccacattactgctacaatagcaataggctgcttttttagagaaaacattctgtgctataaacaagcaataaagtataagaaagccatcaacaaagatataaaagccaacttttgttacggtatttcttattattttacaccacatgaagtaataatatttctacttctaataaaatatctgagtagtatcagaatgaaaaggctaggaaaa

SEQ ID NO: 199 - DNA, 600 bp, Bovine  MMBT06802
agtattttcctcattttacagatagaaaactgaggtccagtgcagtaaactggcttgcccagggtcatcccaccagtagaagacagggctgctggacttaacatctgggttccttccatgatccccacttataaacgactgtaaaaacaaagggataagcagagttctaagacaagctaactaaagcaattccaaaaataactattacagaccaagcaagaagtttcgtttagttctccaagttctcaaattgaatttcagcaaggcttcccttattggacctgagttgtaagatcagtwcattttctagagtgacatcttggrgaaggggrtgggaaagaaygcttgggacaattaataagaagaccctccccccaccatgccttgcccccattaccagcttacctttatcagaagatgagaattaaaagtgatgacacaccagaaagcttacaggatgggaaacctaactcaaagcatcagtttcgattctatgtgaaccatcggctctctctctttactctttccatctggctttctggtctttcatgattgggtctttcctgaaggaaataactcccaaaaggaagtagaaggctc

SEQ ID NO: 200 - DNA, 600 bp, Bovine  MMBT06271
tactcaattgtacacttcagtttattactgtgtgaacaaagactctattgctgatatgagagctggttggcaacccatttagacagaattacatggactgggcactatgaggtgcctgtgcccaggggttctctcctcccatctggctcatgacacgggctttcactaatttcagttatgtctacaaaaaagaatgatgtctgactgagctttcttatttcccagacaacctagaaaaaaaaaamaaaacatgtaagtatatttttaaagagcctaaaagtgcagatttttctcttattwgttttttctaggttaatttattctatattggaagttaatgaaagtcaatatattttgcttctaggcaagcatcygaatattttaagaatatttcatttgattatctgcttgctatttattgatcctactgcagtggtctctggacaaaattgtgtgcagtgaggagcacaaaatgggtctgcccttgtttggcagctggtgataaygaaatcaccccacttcttagcctgttttgaaatgtaagtaacagaagagagttacttctgttacttkcaacctagacagcatattaaaaagcag

SEQ ID NO: 201 - DNA, 600 bp, Bovine  MMBT08344
tcttggaagacacagttgttccaaggagcctccctgtggtcagatacgcagcaaaccttctggcctaaagtctgaggagaaggactcttcttatgtaatgtagccttccattctgagtcagaaaaacccatcctcccagttattcaactgtggcccagagagggtttttctaactttatctgaaaatcagttgagtggaatgctaggagagtggtcatttgtacatggctacagctggtgaggaccctaaattgtggacagggcagaatggtggaagttaatagcaaacattcatacagwgcttattatctttcagaccctgtccttaacactttgcacacataaatttatttaatcttcacactaggcctatgtgataggttacattatcttcctcattttagaaatgagggactgaggcatgaagaggttaagtaacctatgatcacaccactatttagtgaaagacccgatatttgaattcaggcagtccttggctccagagtcaatgctcttaaccccttaagtaaaccacctctccatagcttgctctgctctgggccttttaaattaagaagttcccgtgacatcatagcatag

SEQ ID NO: 202 - DNA, 600 bp, Bovine  MMBT06968
aaaattctttataacctatggttaacatttcatcccttctttgtgtgtctggaaatgattgaccgggcttcagactattttctctgatgtactgcagcctgaaatccaattgttatcttggttcaattaaactcaaacttattggtttgtaggacacaatagtaaagcccaagcttagcaaaaccttttcagaattcagtaagaaactctctgaatgcagtctggttaccagagctatgtatgcatacctctgttgttgtgtttatatttcctgaaggcttaggaataaatacatttttwaaaaatctgagatgacagttctgcatggatgtcatattaatagtgaatctttgtggcatatataatgtacaaaggtacaattcctaagatggtcatcatgcccttttctggattctctgcctrtatttcatagagataatcttatcaaggagcatttctagaatggtcacttagctcatatgtccttttaaaggtacatcacatcacaatttggctgtagcattaaaaacttaggtacagtcttagctattagaactagattaatggttataagcaacatctttttttggttgttgttat

SEQ ID NO: 203 - DNA, 600 bp, Bovine  MMBT09729
gaaaagcatggtgacatcagtgaagaacaaaccactagtataattcgcaacatctcctagaaattagagggaaaaaacaatgagacagtgtcattgccctccacctgagaaaagaacaaagaattttagaaggctggtgagggtgtgtggagactaacagtcactcacggctggtgggaattattatatgactatgtgctcctgaaaagcaactgtaccaatygttgaaagatactcacatccttttgtaattccctttctagaaatctaccctaagacacacgtaaaatgctttattgwcagagatagtcattgcagtatgatttataattttttaaaaaggaaataacctgaatactgtccmacaatagttagaatggtgattttcaatataactttcaatgggcattatggagccattaaaaacaaggtttatggagcctttataataaacacataggggaatggtttatgttgccatgttaaatgatacagtaggatataatactgtatatagaatactattttaactacataaaagttcacataaaccaggaagaaatgctctaaaactttacacagttccctgtagattggttg

SEQ ID NO: 204 - DNA, 600 bp, Bovine  MMBT09289
accatgcagtccatggaaagggtagaaaacctacctacctagcagaattaacatgaggagtgagtaagaaggctaaggcaaggctcagaagcaggtggaccacacacacagctgaagccgtcttcgttgcttgggtcggtgcatcttttgcctaatcttccaaactgccaagcatggtcagactttgttttgaactctcctaatgtttaaatattggcagcttagtcaactgactttaaaatactacaggttaccaaagaagacagagatgacaaataaggatgtgaaaaacgtgcagtwgtatatgacatcgtttatatgacattccggaaaagccaaaactatatacagtatggaggactgatcatagttgctaagagttgagggtttgaccttaagagtagatagcagtgagggaatttctgggggtgatggaaatgttctgccgtgattgtagcaatggacacaggcctctacttgtcaagcctcatggacagaaccagagaaagacagcaagctgtgtccttgggatagtcagtttgtaacctatttattacattcagaacccaatttccatatgatgaacagctcacacccatt

SEQ ID NO: 205 - DNA, 598 bp, Bovine  MMBT08750
  misc_feature (1)..(101): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttaatttggaaatatttcatttgtcaattcacacaaggtttatctcctcaaatgtgattttttaaaaatatatttttagtgctagtgtttatgtcaaattaagaatatgtagcaaaagttgacttaaagagcactcatcttaactattacaagttgtgagagttaattaatttcatatatttagctaaatcattwaatcactgtggcttggtaaagaattaatctaaaatcagtaagtggagtcatcatgtagaaataccaaggttttattgtaagtacaaaagaagatctctcatctaagcagtatgcatagaatacatttaaaagtgcatttaaaaatcaatattacattttatgtttaatacaggtcagtgacagcatatgtcagtggaaccaaaggacattttctgtgaaggtagcacagaaattctctatttcttaatgcacattacagttcactgaacctctctattatctaattctgaaatgcccc

SEQ ID NO: 206 - DNA, 600 bp, Bovine  MMBT05678
taaagctcctccccctgattctaatgtgcagccagggttgaggatgaccgccctggggtggaagagaggtctggtgaaagcgctgagtactcaggacaagtgagggtgccctggcgcagccggctggtgcttcagctactggaagagaaagaaaactgacagagagtcccagtgctttccaatagcttaggtacgaagaggctggggtatccagtgggataaaaagcagaagatggaggggaatatccatcccactagttaagatgtgaaattccatcacctgacattggaaaccagaawaaaagagggggagcacaagatattcaatggcactaaggcagcataagtgaacagggggtttggtgtgratctttcctcgttagagsctggttttcatgtcttactttggaaatatgtaactgagcagaatttattgactcgatcttataaaatatgaaaatcagctgccagcaatattgttcagcctgggagctccagacttacatgtcaggaattgatgacatgtgggttccttgatctcggttcacaatcggaagtcagcagcatcaaaccgtttctaccttgtccttccccagctag

SEQ ID NO: 207 - DNA, 600 bp, Bovine  MMBT10143
cactgagagtgtcgtgcaggggtttgtcctgatacccgccatgatgaggtcttgcgggttctctgaccccactgtcttacgtgtgtgtttttcagatttctgggtttctgaggaatcagatcagctctccccttacatactcttggctgtggctttacagagctattattcctccaatgcccctatttttcagcaatcagaaaaaattttagaccacagtgatttctttcttattttgtctatttggtaacttttttactcctttgttttagtgaccagcgggaatgaggtttgtgtgcwtaatccctcatcttgaagtgataatctctactaccacataaaagactttaaaagagttacagaaaaattcattgaatacgttttttttaatagccagttttggtctaacttaaaaagtcagtgaggcatatttgcgatattgttagattttcatgctcagaacaaagataatgctggtttattttttttttaaaaattgctgtacgaattagcatacttgtttaccatttttaatgaacgtcggtgtgtttcaggccacgctgtttcagactttacctctccagcagacggacacccagg

SEQ ID NO: 208 - DNA, 600 bp, Bovine  MMBT08653
tttgtgagtagcactttcagctgtgcgaatagaccattgttcgtgaggcttctcgttgaaaattctgctttagaactttttttttcccccactgacaccctaaattttttccttgtgtacctatcaatagcagaaaggagggttcaaaaacagaaaggaaatgcagagaatgagaggcacagagtggcaaagtcagggagagggggagaaagagagaggaaaaatgcaccgtgaagttcaaatgaacctggagctaatgacatctgcactttgccaactccagttcgttcatactctatwaaaatgccacatttaggagtgtaatgaaccttgattccttgtcagattagcaaaggtttcgctatctgactctcacgtttctaatgcttacatcttgaaggctcrgagttgagcaagacagggatygtagacgaaaggccccaggacacaaacccttctggattgcttttctggattctaagaccccaggtggaagtgcggctgactgctacctgtgtttccaaatctcttctcccacctttagctgagcacttggctatccaggcaacgasttcattttctatcctttctagcggctac

SEQ ID NO: 209 - DNA, 600 bp, Bovine  MMBT04426
cacctctcaagagygcmtttcacttaagtactgcccccagtggctgcatcttcctgaagtcagctcagaatctaagaggagctgctggttggaatacaaagagttaatgtagaatccttattccagctcggctctgtttccatggcaacagctaagggtggtgaaatcttaaactgaaatccctaggagccagcaggctgccagctgtaaagctggactcactgctcccagcgccacctgctggctgaatgccaccagtgcagctgacctacattccaacctcatttatttgccctgggkacgtggtccagggcagggtcccctgtgctgactgatgatgtgtgcagccttcatcccacaaatcagctggactccacctttccytattacacyctaaacaataactaggcacaaactctagaggcttggggagaagsggggaaaggtgaaggatatacctcacgtgggcttgtttattattagagcaaagtttgtggcttacatacaactggagtaagggcaggggaactgcttcccaaaaaaatataaagaaaaaatagaaatgcagggtgcttcaggtccctaatcataccacaacag

SEQ ID NO: 210 - DNA, 600 bp, Bovine  MMBT04544
aggggcccccaggttgccctcacgtctaaccaagtcagggattcacactacccccttagttgttacaatttgctggaatggctcagagaactcaggaaaatattatatttctgattacaaaaggatataattcagagcaaatcaaggggagagatacaggggatgaggtctaggggccccaaatgttaaacttccgtggtctctccccatattgtcaagaatgctttaccctcccagcacgacaacatgcaacagcacagagtatcgccagccaggaagccccctagagtttcagtgtgmagagttcttattgaggtttcattgcataggcatgrctgaccracttgactgaatcatcggtcatgtgactgaactcagtgtccagcttccttctccttgtggggctcaaagttacaactttcctaatcccatggctggtctttctrgcaccatcagcctccrttttgagtcacctcattagcataaactatcaggtgtggtctaaggtgccgccatgaataacaaatacagtcctatccctccagaatttttgaggatatagaggttactgaggatagaggttatataggacatagaggt

SEQ ID NO: 211 - DNA, 600 bp, Bovine  MMBT03468
agagagctctgagcaggggccacattttccaacaccgggggttggggagtgtttctacggctcctatcaccctctccctcggtattcagtcagttcagtcagttgagggcaagggtttgagcccagctcctaacaaatgttgaaccatatctagggcagygctactggactgaatggtacctggttcttggagagttgatttatcttgaaataattataaaaatcatatgcaagaagcagtataagragcagatgtgaaatccccttatcacactgttcccagtgggcttcttatccccmcctcctcactgctgccgcttcttcttccaggaggcactggttagtttcctttttctcaccctcmtttgcttcacatttctgagagttgtctctggcatataaagggtggtaccgctcggccagcggggtagttcaggggaggaccaaatgcctgtggatggcttggagtgctgcttggtgaagggaggatattcagtcaggtgttatattcagcaacacagaccttgagtttctaacgtgaggatatacaagggtgagagtggcgggagtaaaagcccttctcattatctcttgctttga

SEQ ID NO: 212 - DNA, 598 bp, Bovine  MMBT03262
  misc_feature (1)..(18): n is any nucleotide
nnnnnnnnnnnnnnnnnncttttttgggtcagatgcctcacaatcaacaggatggctcctgccaattaaaaaaaaattcaccacttcgtatacaattacagacagacgattcaggatattccgaaagccacccaagaaaccttgggttaagcactcctggtttacaatacttggacccaacaaggtcatatggtcatctctacttctccccctctttttaaccttccaagaccaggaaatggggtggctaaccggattacactggatctgaacaaactagcttgttaggaaaaaggcttmtttcttaggtattttacaacagtttaaaaacgttaataacggcaacaatttcaattaactcaaatgttttaatgatgtcaactacaacaaagtctgaaggatcagttaggttagatataacgtaaaagttgaggaattatgaatttaagaattattaagtctttctatccactattgacagtggtgagacttcaaaaatttctacagtagttattaaatgtatttcaaatacaaaatattggacacaatatttgatctaaatactaaaaaacatatactgcacaaatgtcaaatgtaa

SEQ ID NO: 213 - DNA, 600 bp, Bovine  MMBT03728
caagaatagtagagatggttacctttgtttttattattgctgcattaaagggtacaggtaaaatctttgatagtaaaagaaacctccacccatttttagagaggatcttttaaatgtacctacatgtatagataagtagattctttgctatatcagacactgaagtttcagactaaggtggaggatttaatttcagatacctctcaagctttatactrttattataagtagaaaatgattccagccattatgaaccaagatccagaagagtccctgctggttttgtctaactctgacttmaccttttacaactygtgtttcaccttccaaaagacattctcccaccccccaagccccactgcctgcctacagagatacagcagggcatcgctttacagtcccacgtggctttagccttgtggagccagagccctatcagatgtgctgctccttcttttctgcagcacrgcagcagcactcaaacagttaaccrccttcyaagtgtcccagtaatacattcctgctgcaacactcctcagctctccagaatcgaatttctgcaaatgtctgtacatggagacactcactccccagctcaac

SEQ ID NO: 214 - DNA, 600 bp, Bovine  MMBT03887
tagatttatagatgaataaatcaggacaagtgcagctaactcttttatttatttattttaaatataattgatggtaagaagtgtagagaaaaaggaaagtaccaggaaaaagattcatagctcagagcaacagtagaacttctggaagactgaatataattctatgagtaaagaaaatttagactatttgaatgctgagagtgatactctagaagacaggaagaaggtcaggatttggagtaagtgaaagagttctatctagagcctaaaaggctcaagtaccagggatggtcattaagmaagaggatttttctatataaaatagaaggatagagaaaggaatgaatgaacatgcagaaaatctagcttatgtttgaaaaaaatagtagtttgatttgatggtttctatcttctctataacatgcaaaacagaagtagaagcatggaatgtgagatactcaaagttgtgagataagactatttgaaatagttgcttcaggatgtggctattgaattgattcaagaaatcataaatttcaaggctgagcattgagaccagtgagcattagtgaccaagattaaaggttcaatcattctgcc

SEQ ID NO: 215 - DNA, 600 bp, Bovine  MMBT04620
attgaaggactgttgaacatctgtcagacattcccaaccctttcattgaaagttgactggcctccagaagattgtatactttcaatattccaaggaaagaagtcattgtaacttttataaaagacaaaaagaggcagcaagagaattttgactttgcagtgttttttttcccgtctcttatcaaccagctagtcactgctgcttctttgatgttaaatagatgcttgtttccattgaattttctgggtgacttgtcaggttggttgtgctttactctgatggaacatgtgatgttaaaamcttttctccccctctctggaaattcttaaactggcagccataccacagttttttctgtagattttgttacagatttgcttcataaagcttaaaaatgcaaagtttaagaaacatggtattaatttaagtgatattttaagttcatactttctattaaatttgattttctattctgttytttaaatttcacttaattttcactagctattttggtgagaactttgagagamacatctgttacgttgctccttcttagagtttacattttgttagaatatactctgcatttactgagygctt

SEQ ID NO: 216 - DNA, 600 bp, Bovine  MMBT05414
agacctctgtaattcaaatgtcacactgcaatttcaaattggcagccttccttgagtttcattttacttgctaaggaaacaatgaagcacttattctgatgccagcagaattgtgggaagagacttaagagatttgtattttcctgaatctttaatctgcagaagagagcaactacactgaccaagtggcacattattattatttcaataattctttagwtgtacaactaattgaatcttggaaaatatggtgtattcacataaaaattgactcatatgattgcaaaaatgctgattatmacatagatctagaaattatagcaacagaattgayagtaaacaaaaagtaagaccaacaaaaatatcattgatggtgtttctacggrttaataataaaygtactctcaaacttataatttcctttgagggaaaayaatttttactcctttcctcattatggctatctggtggtttgtgacaacaatttcttcttgaaaagtgtctgcaataccagcactcaaaagtcttctcgtcagttttcccggcatctttaaactggacagctccagccctgattatacccaacccttcccacaaacc

SEQ ID NO: 217 - DNA, 600 bp, Bovine  MMBT04095
tccaggtttctttatatcttcatgtctatactatatgtcagatagtgagaaaggaaaaggaaggttccagtgtcatttactctgtgtttataggtggtgtttagtcactaagttgtgttccattcttgcaacttcatggggagtagcccacaagactcctctgtccatgggatttcccatgcaagaatagtggagtgggttgctctttccttctccaggagatcttccccacccagggatcaaccctttgtctctggcattgcaggcggattcttgccagactgagccatcagggatgamacatgacatgaaaggacatatgacatcgataaaactcactgttccaaacttagaatctctcttctctctctcagtcactcacacacacatacacacataacttgagtgctgaagaaaacaagtagataaatgttagatcatacaataaaggattaagtaatgccaagcaagtgatggtttgtttatcactgtaataagttagacttacagtctggttttatgtccccaatctttctctactcctgttaccatctccttcaacattgcatttccatcagaaatgcatctgaccccttcaag

SEQ ID NO: 218 - DNA, 600 bp, Bovine  MMBT04098
aactgacaaactgtattactttaatttagtcaaaattagtgctaaatatatatagagagagtggatagacattacacttttaacaacaaactgtatgtttctagattttactgtgtaagaaaatttatagctgtagaaataaaacctcatttctgcttcatttttaatggtctattttcattcccagatttcaaagaaagcttgcacatgtcacagacgcttaattacagagctgaaattaatgatgaacattcgaactgctatagttgtcaggactccttgcacttcatacaactcaamtaagacatgtcacaatgaattccaggtctgcatgtgaacaaagtgaacaatctgtgggcctccaaggaacgtttttctgtggggagctcttactttgttcccgttatttgagcaagacctacatctggtgtgaaagcagccacttgggttccaatgaacaaccaactctggttttggagaatttcaactaccagaattaattgtgccctaccaagacagaagggcttccctggtagctcagctggtaaagaatccgcctgcaakgcaggagacttcagttcaattcctgggctggaagat

SEQ ID NO: 219 - DNA, 600 bp, Bovine  MMBT04761
tgatgactttgactttggaaaatagggagaaggtacttggaggtatgagggatcaacgtgacaaagagaatattgtacaagggaaaatgcagtgaggattctgatcataatggcatcaytgaatcttgatttgcttcattatttgggcatccccagtatctctggttctgtttgcctgcagattataaggcttgaagataaaagtgcaagtgaaaagataaatgagttttagaaacccactcccaataagttctggatagcatcacactagtaaaacattccacagctgacttggaaagmaaaacttgtgcctcattcatcttgttgttaccctgcttcacccttcttgcctcagacttggttgcctgagaagagactcaggatgaaaagctgtgtgcagaatctttatcaggaagtactcttaaaagtgggcttcccagctggcacagtggtaaagaatctgcctgccaatgtaagagtcacaggagatgtgggttcaatccctgggctgggaagatgccctggaggaggaaatggtgacccactccagtattcttgtctagataatgcccatgggcagaggagcctactggcctacag

SEQ ID NO: 220 - DNA, 600 bp, Bovine  MMBT05140
ccccaggtatgtctaccctggcccaatgtcaggtatttaaaaatacaaggtgtgtataactaaggtttactggctctccattatccagctttgtgtatataaaaaacattctttaggaagaccctgagtttttttctattttaagcctgttagggacgcctgtaacaaacagaataatcatcctccaaacacccagtaccaggcactgtgccctgggtgctttgttcttatctgtgatcctctttcagaacactataaaaacaaggaaactgagtctccaagcagttaaataatttactmagggtcatccaactgaaaaagcgaagccagttctgagactccaaaacgtagattcttttcaccctttgcatgtcaccagaagagccaagcagtcattatctatgaaaagaaatactttaacagccatatttttctttcatctttgctgctctctccaatcatgtttcttcctttttttttttttaagtgaagaaaaaatgactgctgcccgcattaggaaatgccacaagtgtgggaccagcctcatcaaatctgaaggctgcaaccgcatgtcctgccgctgcggtgcccagatgtgct

SEQ ID NO: 221 - DNA, 600 bp, Bovine  MMBT03342
atgtcaggcaagtcaagaaaatatggatttaaagatacttgaaatttaattgttttaaacagcatgcaggccaaacaaaatygcatacaggtaacactttgtttaatgagtctatagatgtgagaaacatggaaccagagcagagggcctatggagacaaagtatgagataaatgtagatgaatccaaggaaattttgtaaccataactactgtagttgggtaatttggtttcatcattttttggtagtcattacaattgagttgggaactccatttgtaatgcatacatttttaaagamctttgtagggaattccctggcagacyagtggttaggacttggcattttcactgcagggggtccaagttcaatccctggttaggaatcctataagttgcacactgcagccaccaaaaaaaaaaaaaaatttgtagagatgaccctctgagttctatgttcttttcagtccgatatcatccttaaaaccttccacaatagtccgaatcttctatcctttaaatatgtctacagctttctactaaacccctcaatgaccaatttcatctgagaaaatagaaaatttctataatttagtagaaa

SEQ ID NO: 222 - DNA, 600 bp, Bovine  MMBT04902
ttactgttggagaaaggagttaaaagatggaggaagacaatgaatcatgtactgttgaattagaattggagataccagtgtgaacttaagagtttccagtgtcrgtagatagatatagcaaatctgggacccacttcttggcctctgaataccattctcagtagactaggrcctgttggagaaatggctaatttagggaacgtgtgagatgaacctgcatcatcttatcgtgcaagaaagttgttcaaagaatgatgagattgtgtcaaaatgattcagaagcagcttgaataggctctmgtggccaaatttggaataatttgaacatcaaaataaatattgatggcaaaatactgcaaataaaattgaagctcataagtctatagtgaaagaattaatgaataaatggaaactatgatgaagggtggtatatttttataatctcaaagcatctccttttagaatactaattataaagattaaaaaggaactttacagtggaaaagttkggcaatggtcccagcagacataccagtgtgccaggactgagaatatggcatcacttcttagatactgttgacaaagatacacaccctgaat

SEQ ID NO: 223 - DNA, 600 bp, Bovine  MMBT03267
ggaacaaaagggaaaactacaaaaggcaaatggaaaaattcaaaagctagaagtggagtcatggtggaatatagtttattttagtaaacaaccccacatctaagtggctccgtggaagcactattacagcccagcccaaataccgctcctttgttatgtgaaccagtcgttattgaaagacttaattacatttgcaagaaaatgtgttatgtgctttaggagtattgtcatcaaaatggtaatagatattttctatataaagagtttgttatctgtttatagtagtaatagcaagcattmagccctgcagtttacatgttgaattttatttaattctcccagcaacctgaggctaatgtaaataaaagcaactcttgaaatactgttttcctaatctgaaacccctaaygaatacctgttgtgtcttcctagatctgagttctataagcacattgtgctttctggagggtctactatgtaccctggtctgccatcccggttggaacgagagcttaaacagctttacttagaacgagtattgaagggtgatgtggaaaaactttctgtaagtatcagtcagtactccaactgttagcatcc

SEQ ID NO: 224 - DNA, 598 bp, Bovine  MMBT10415
  misc_feature (1)..(42): n is any nucleotide
nnnnnnnnnnnnnnnnnnnnnnnnnnnnnnnnnnnnnnnnnnaattcaaattccggaaatggacctgctctccatttatttgattatttttatgacaagtttgtttgtgacaaccttctcccggacactcccaagcagattctgaggaaatgagagaaggaaatgcccagattgttcaagtggagcagagttcagactccaaagcagctttaatcctatgtctggagctgggtcagaaagttcataattagaacaagggcgggggttcagcctgggtctgacctaggatgaaaagagctkagatttggtttggatgaatatcctaaccctcaactgtgattctgactactgtaaccttaaaaaaaaaaaaaaaaaaaaaaggactgggcaggatctccaggagggcttcactctctgttttttaaaaaattttatcatcatttacaaaaatgtattaaaggctaagaggagggggggggtgcaggaatgaaagtgggaattcatacatcaaagttttttgggggctccaagaaattctgttattgctggtcaagttagccagtgctaagattttctcaaggcctgaagtctactgcat

SEQ ID NO: 225 - DNA, 600 bp, Bovine  MMBT08244
aactctaggtagtaggactgtggatgatttttatctccttcattgtctttttaaacttgcaatctaaaaawtcagaaacatatgttatctttttmtgattaggaaaaaaaaaatctagyagagcagtttccattttgaggaacagaatccaaagaagaattacctgttctggttggtgtccgaatggctgccccgcttctttccaggggcccgtcggcagaagtcccctgggaatatggtctgccacagctgagaaataatggaacagctgtaagtaggtcctttattttcagaaaattktaggcacacaccaggtatgtatatattaggataaaaaacaatcacatattctggcactctacttattcctctgatggaaaaaaaatcattttgtcttttacatggacattgatatgtgggatactgttttggtcagtggtaaggaaagcatattaaaaagcagagacattactttgccaacaaaggtctgtctaatcaaggctatggtttttccagtagtcatgtatggatgtgagagttggactataaagaaagcttagtggcgaagaattgatgcttttgaactgtggcgttggagaa

SEQ ID NO: 226 - DNA, 600 bp, Bovine  MMBT08526
tggacagaggagcctggtggactacactccatggggtcacragagttggacacagcttagygactaagctactacctgctactactatgaactcttagttryagcctgtgggatcgaattccctgaccagggattgaaccctgggccccctgcactgggagtatggagtcttagccactggaccaccagggaagtcccttcagcatgatattcctaaccaatttcctaaaattgtatcccygcccaccaatcacactctttcttcctcttccttgctgtaccaacagcctcagaggtackgtacatttcactaatatatctgtttattttctgtcttccccactagaattcaagtcccatgagagaggggattttcatctgccttttttttttttttttcatgttttatacccaagcctcaggcactccttgacacacagcagctgctcaatgaagagttattgtcttcttaattaatgtagctgccaactccaggccaaacaatcctgcagtgaggtgagggaaggtgggttttgatggagccttattcctcctaagaaatccatccaccctcctagaaaaggctccctggtcaaccat

SEQ ID NO: 227 - DNA, 600 bp, Bovine  MMBT06762
cattattcattaaaaattagatacttgtaaagaaaatacaaatgaagcctaaaccaaagaattgtaaccagaataacttcagtgttgtgaataaccaagttttttgactgcctcacactgagaacatcttaatattcttttggggaaagattaaatcccctctgatttaatagttgataaattatagtgccagactaggatataacttagagaataatttgacttctgccttatatttgactgttcaagtttctttggctttcatgtttgtaattcattctctttagttcatacctaaakaatgtatttttttcctgtgtatacctttaaaagataatatattcttattaggaggaaatacaaaagctgaaaaaagaactggaaaattttgatccatcattttttgaagaaattgaagatctgaagtataactacaaagaagaagtgaagaaaaatattctcttagaagagaagttaaaaaaactttctgaacaatttggagttgaattaactagtcctgttgctgcttctgaacagtttgaagatgagcaggaaaatcctgttaatttccccatatactaaaaggccatctctaacaat

SEQ ID NO: 228 - DNA, 600 bp, Bovine  MMBT07993
tgggacttgctgggcagcaataatcatggcaaattttctgccatgaccacatttagatggtcattcagaagctgatcccaattggacactgttcattacacactaattactatttgccctgcagtgattgttatgtgtgacagcaagtataaatgcaaacctagatgcttaccactgcccttccaaaagggagacaaaggactgcatatacaagtgtccatatcaagttattttccattttcttagataatatttagaggcaaatatttctaaagttcatgtccatgcttagaagacatktaactctgtatacgtatttcagatggtggaaaataatgtgcttcrgtgagaaaacactgtgatatttgtcttatctgtatatggaggtatggggaaagacctcarttgaaatgtattataagagatgagattttaaaataagttccatttctgtagtttatttccatgtacatttggtcattttgagagttgtttgataaagattattgrgctcttatggttagcaaaattctgttccatgacctgaggtgacatagataattaagatatgatctctgttctcaaagtgttcagagttag

SEQ ID NO: 229 - DNA, 600 bp, Bovine  MMBT05543
acaaattacttttgtttattccctgatttctttacccgtctccctacctgctttcccctcccagtgggcagaggggctcagaggactgtggctataatctcagctctcttggctactttgggggatttacagggaaatcagtacttggcaacttgtatttttcactgcctggcccgaactccagacatgagcccctttctcttatttgaacaacattcatatgtaaggaatagatgtcctgggagagatctctgcatcctggtcctctcccatgttggggctgcttgggcagcagtgacmtctctgtgttagacgcagcagacwtcatggcttacaaaaaatgtcagccagggaagtgctgccctgccaaccctctgtccccacccgtgccctctctgttgctgaactcacaccacggccacacagagcaaggtttagaatccatacgagctaccgttaacacacagacttccctttcctatcattccaacctcaaagacactccaggccctaggaattcccagctaccctaagcaagtcaccgtgatcttgaaggagctgttacctggggctcggcagctggaacccaccccagtggtc

SEQ ID NO: 230 - DNA, 600 bp, Bovine  MMBT09779
catctcattctgctttgcaaaaccgtgctctcagaggcgagggagggctgagctcacaggcttggagcacagctccccgggaaaggctggccaaggggcctggagccccgggggtttggggacagcagaccttggaccttgggtgtggcacccagcctcttttgttccctcctctgtgtaacaagaacatcagaagcaagcacctgacatgcatgattgcatttaagcttaacaacaaaagcctcataacctagggtggttgtggggcttaagaatcttcatggacataaagtgctcacmtctctgaytgccattaaggaaggtacaggaaraggcgcagggctaacgcttcgtgaaggctgcccagctgttatctttgggggaaggggtagggggcagggcatacctgtgagcaaagacttccccaggccgttgggctgaaggcacacagcgtggccaaagtcgcagagggctgcgcggctcccatcgctggacaggagcacgttgtcggctgccaggccaccccggggaagaagaggaacaggtgagtcaccragggccccggcccaatatgaacctccggcggggcagttttctggc

SEQ ID NO: 231 - DNA, 600 bp, Bovine  MMBT06966
gatagaatacatatatcaaaagatattgtttatttttttttctcatctctggctcttccaactagagtgtaaatttcacaaacacagggacttgtcttaagcatctagaacagtactggtagatagtcacgcattcaacagttatttattgaaacaaacaatgaatgaatctcaattttgtgttcaacgccctgatcgggatcagcagttcctgaacctgggtatccttcagaattcttgacaggaacttaaaaatatatcagattccagggctctaccccagatctacttactcaaaamacagagggaggaagactattgaggaatctgccctgctggtgcctctcgtgtgcagtcaggcctgggaaccaatgatataggtgccccagtttcaggaacacagggggaaatatgagggagtgtggttagcaggtgaatgttgaaatcagcctatgtttgactcctagctttgtcatttccttattgttatagattactaaaatttctgagcctttcaactttctcatacttaaaatgggtatcataccagtatcataaaatgccaaaatcttcagtttcctgtggcatggtagaatcaga

SEQ ID NO: 232 - DNA, 600 bp, Bovine  MMBT06280
gtggcaccaggaacccacaaatcacagcctgaagcactcaggaccttggacgtttgcttttgtttatgaactgtgtagggtgcttattttctgcttttcatgatggctacaaccaatcttttcacactgtatttatggtgcttttctttctttcttttttattaaggttgttttatacttggcagtatctaaatgttgtatctggaatttaaataggagaaaccgtactttagttttatctaactgaaagaggccgagatcactgctggacagaaggtgattttcctttgaagagtgagmagggaggtcaccgagtggatgctgttatgacttggtgcctttcgcagctcatctcagcacakcctcacatcccagtgggctggggtctataaagcccagtttgcagctgagaacacagtaaggaatggagcaggcttaagttttggttggttggccgactgaattgaaaagcatgtatagaagacaaaagcccatggttggttggccgactgygttgaaaagcatgcacagaagacaatagcgcctagttgttctgagatcaaatatacagacaatgttgcacaaaggtctcaggtcaag

SEQ ID NO: 233 - DNA, 600 bp, Bovine  MMBT10155
cccagaaacagggagctaggcacgtccaccctgcagactgagtcccacggcttccccatcacattcttccaggatacgaactagcccctcccgtcaaactggggaccccatggaggggaatctgggttaccctcaggagaccgtaaggtctcacggaggagggagtcccaagggaagcatagcacacagcccatcccccaccagaccacaggttgctcgggcgtggccccaccccacaagccggcctgcccccacttacgcatgtcgaacagatccttcttgggrctgtcctcgggctgmagggactcagggccgtccagaccctgcgtgttgacatacagatggtcctcgtagtctcgggggccccgggcrtccgcctgcacatagccatccccgggctgggctgggaytggggagtcagaagggtgtgagttcagaggagcacaaggtcacgcggggaagctctggggagaggtccaagaggggcgccccgcccacrcctgtgtccctccaggaagcctgccctttarcgcagcaaggtcaggagtgaaaaaccccatgagagcccagctttggggctgtgagaggcgcagaggtcta

SEQ ID NO: 234 - DNA, 598 bp, Bovine  MMBT08176
  misc_feature (1)..(65): n is any nucleotide
nnnnnnnnnnnnnnnnnnnnnnnnnnnnnnnnnnnnnnnnnnnnnnnnnnnnnnnnnnnnnnnnnaactccccctgggtgcacggcggaagatgaagccactactgccacgggtcagctcatacctggtgcccatccagttccccgcgaacccrtcactggtgctgcagccctcrgtcaaggtgcccttgcccctggtggcctcrctctcagagcttgcccgccacagcaagcgagtctgcatcgcccccaaggtgctgctagcggatgagggggtggcctctctgcccacggcaggacmggtgacagaggagaagctactcctcrtggaaggactctctcctctgcttcctgtcccatccatcaaggaggaagacgtccagcctggggaggagacaccacatctagggaggcccatcaaagtcgagagcccacccctggaagcgtggccttcaccctgcccatcggtcaaggaagagtcatcccactcctgggaggactcgycctgytccccaacccccaggcccaagaagtcctccagcactgggtccaggtcccccacccgccgtgtctccgacctgctggtgatcaaacacagg

SEQ ID NO: 235 - DNA, 600 bp, Bovine  MMBT09426
tcccttcaccatctgtcttccagatgaagcccatgaacgtggaatatctcatgatggacgcctccatcctgctgcccccgacaggcacgccgctgactggcatcgactttgtgaagcgactgccatgtggtgacgtggaaaagacccggcgggtgagtgggcattggccttggcctctattctgggcagccgttcaccaggaagcacccctaggacaggagaggaagggtctctgaccacatccagacccaccttctagctcgctctcagagagccagagagcaacccccagccccacgmccccaccatccacaagggcctagctttcccacgagcactgccttttgtctgggcgtttgttttttaattttggctgtgccaggtctttgtagcactccgtgggcttctctctggttgtggctagaagattcagttgttgcggcacatgggctgagttgctgtacggcgggtgcgatcttagttccctgaccagggatcaaacccaggtcccctgcagtggaaggcagattcttaaccactggaccaccagggaagtccctgccgtttgttacagcagagactgaaagctgttggtggcag

SEQ ID NO: 236 - DNA, 598 bp, Bovine  MMBT08150
  misc_feature (1)..(14): n is any nucleotide
nnnnnnnnnnnnnntcttcatgaccttgtgggggctttcacactttgtctcttcttccccctgctgctttttcttttctttgccttctggaagttccaggccctctctgccgactgacaccaaagtcttctcagattccttcttctctcagacactgtactcatctgtgggctccagcacatgggtcacatctcagctgtgcttcctgagatgttcacatacacccaaggctgagccttttcccagttagtgcagccatcatggcacttctgtcctaagtacagccgctggtgtcccccmggaasaaggaaatcctcccacgtcaccaccatagttataacacccagaaactagcgccctgacatagcactgttagctggcatatggcctgatttcagattccttcaattctcccggtatttataggtttttaaaaaagtctaggatccagtcaaggaatatgctttgttttagtcattattttttttttaatttatttttaattggagaatagttgctttacaatgctaatctcttttaagtctagatagtctctcccagccttttaatttttgtttttttatggcattgcattttt

SEQ ID NO: 237 - DNA, 600 bp, Bovine  MMBT10010
agggaaggccctgttaaccgaaacgcccacatgctgcttgcaccacctgctctagagtctgtgaataaacctcacctcctgccgtttctaatggacttttgagatcactttcccatctctggttctctgtmagattctttcctgctgaggtatgtgaggcaagcctgccgttcccagtcagtcccaaccccacgtcccctggtcagccgccgtactcaccaggctggcttctccagagcagagaaaccacccagctggttttaggtgacaaaaatgtccaaaagatgcactttggccccmctaaaacttccatagggccctgcagtgaggtgtggagccagggaactaagggcacgcctggccccctgcccctcacaggttggccatgcctgtgatcttacaccgagggaacagttttatggggctgtaaacagtgtatagcattgsccccttagctgcrgtctcttaagcttagcgcagagttaaaatcttcatgaactttggtttagtggtgagagctggacaaccagctgcccccgctgcaggagcattattgcagccaaataaccacagaaggatcccaaatacagcagaaccggg

SEQ ID NO: 238 - DNA, 598 bp, Bovine  MMBT07698
  misc_feature (1)..(20): n is any nucleotide
nnnnnnnnnnnnnnnnnnnntataatgaggagggcaatgaaatggcattccgagagtcaatggaggagaaccctttagttctctcctcagggaatagctgaacaagtgattgttatcagagaacattctccagagttcccagccatgcaggattactcacttcccccctcatcaacacccactactcggtgcacatctctgaaagattttatacacgtgtcacatagacccttccccacatggcaggtacgccgcacgaacacggtcatacgcatctcactaaccagccacccaaacccmrccggctctgctgctaccccagtcagcacaggttagagatcccttcaacaaaaycacagtgagtgttggactcagatgtctctcatctcctccccttcaaaaaccatgttggaccccacttagtctctactctctgctcttgacacacaccagccttaaccctatgcatttacacctttctaaccatcctatttaaggacataattttaagatgtgtgtgcagaggtaattaccagggtgttcttcaagccttagtataatattgaaaacgcaaaacatcttaagtgcctagcattaa

SEQ ID NO: 239 - DNA, 600 bp, Bovine  MMBT06381
gagggcactgctccccacaagcaccaagctcttggtcagactggcagatcacatcagggccagcctggatgtgtgtggcctctgccctgtctccacgctgcctggaggctctgggttgcagctgctccacattcagggctcacagcaggctcgctcagggagctgctaagcgaggcatccaggctcccttcggaagccatgaaggcagccttccctcctctgccccttcagatctatgacttcatggacctgctggtggccgagcacccacagcttgtcagcaaactccagattggcagmagctatgaaggccgtcccatctacgtgctgaaggtaatgggtgcatgccagtrcatgtatgtgggcacttcctcaagaatggatgcccgcatctgtgcataagcccagggtgacagaaaacacggttatacagactccgtgtgtagcacaggtgtacacacacctgtacacacaatttaaacttttaggtgactcccctgttcccagtaaggtggcacattgtgcaaagtatcccagagttgggtagtccaaataaaatgttttgctcgtgaccttcgacagagctatgtgtgggcctgg

SEQ ID NO: 240 - DNA, 598 bp, Bovine  MMBT10805
  misc_feature (1)..(34): n is any nucleotide
nnnnnnnnnnnnnnnnnnnnnnnnnnnnnnnnnnaatactggagtgggttgccattccattctccagggactgtttgcattaaggtacagccaaactctagtttctccccagttcatcagagctcatcagagctgttcctggggtcctgtgctgtggaagcttgctgcattcttaaattggtcccaccccgccctggtggtgaacactgtcctgacttgcttccacagtgctccttgccttacctctgctacccactcctttctcttcctctccagggtcaaaagcggctggtgctttcmgagagctgttcccgggactccatgagcagccagcctagttgtactggactcaactattcctatggtgtcaatgcttggaagtgctgggtgcagtcgaaatatgccaatggagaaactagcaagggtgatgagctgcgctttggccgtaagtacccaggggaggaggggaaggggagagggagcagggctgtgattcagctgaaggtgtccatagggcatcctgtgcagatgtagaggagttacagaataaggggagatgccatctaggtttcaagactgaaggctctttgtgtgattg

SEQ ID NO: 241 - DNA, 600 bp, Bovine  MMBT06413
ataatcttcaattaaagattactggttatcttctttagtctgaggttgaaacccaagttggatctatatttcttctcaaaccctaaaagaatagtaccaatataatatgtttgtgattgggcacggcagcccactctagtattctttctgggaaaatcccatggacagaggagcctgacgggctatggtccatggggtcgcaaagagtcggatacagctgaggtgaccgagcgtgcataaacaggatagagattatgtcccttcagtttctggcaaattttgtaatccagtgggtgacamggatttattgtgccaatactagtaattacttctacttacacagcgacctaacttcagttcatgtgcagctcctgaaggctcctattcaaaggcccctttcccctatatcacctctcttggaagtaatggatctgctgttattttttattaatataaaaaagtatatagttccaatcagaaaatgtttttgtattgttgaatttaatctacttcaatggtatctacattttgtatcttgttcagtaaggctttcttcactaaggatatatatattttaacttccactttttttcctagtgt

SEQ ID NO: 242 - DNA, 600 bp, Bovine  MMBT06992
tgtatgtttggttttaaaaaatatgttttggagattatgaataattagcacccatttaacaaatacaacttgatattcagtatgtaataatacaacataaataaaagcaattattacttcaattatttaaaattatctcaactgccattaaaaatacaaataaaacagttacatactgatcacttgtcattttaatcataaaccatcattccttagataagctgaaaaaaaatatttattcaacacacaattactgaggacctactatgtgccaataagcaactcaggaggtacacaaamaaagcatggtcactgcrttcagctctcaggaagcttaaggactaaagaagattaggtaagtgtgaaataaatgttctagctctaaaatatctgtaacaacatattatggaagascagagaaaagagtaattattttcrcctttaaaaggctttaaaaggtgtcccaacagaacagyrttggaatttaacaaaaacagaaggaaaatacacagtttacrtttgactgtcaataaattacaaccagtattactgttcacaggcacttcacaagttctatttcacctaattatctcaacaacc

SEQ ID NO: 243 - DNA, 600 bp, Bovine  MMBT10295
gctgtatattctagatataaayaagatcactgaataaacaagggtcattggrtaaaatatggtacattagarggatcagtatttaatgacttatgactgggtcaaggcataaacaaatatttttcctcccctctgttgatcgaattgtatgcagcatagaaattctagagcacaaagtctttattccaactgccatttgaaattctgaaacagttggatgtgtcatcaatgacccaacccatatggccacaaggtatgctgagatcttctaaatggagcaaattatgcaggtgtgagtamagaggagtgaagaagyaaagatggtttgagtcggaaaagacatctattccctacaaaatgttctggaagatggcacttyctaacaagttgggatgcaggttgtaaaaccctttggttacaaagaacagaatcacaactgtgtcgaaagatggaagttastatcaagctactatagcaacaagttcagcataaactggtgtctcctttcaactaggacagtagttttcaattaggaaagatcttgcctagtgggagacccttgscaattttgtctggagagatttttgattgttacaacta

SEQ ID NO: 244 - DNA, 600 bp, Bovine  MMBT07448
gctacgaaggagaaaatggtcctttgtttctagggaagggatatttgaaaartgtggggtgctggtaaaagagctggctcctgagaaggagggcattcctggctgagtgggttgcaaggatgaatgcacaaaagcctggtgtggttcatgcgttgacaagactgggagctgtgggcgtggttgggctttgaggggtgagaccactaggaagacattggctgaagaggaggtggatccaggagtagcaggtgggagcctttcctctgtcagtgatggggagctacagaagaattgttagamagagaattccatgatatacatgccttttagaaaggttagtaaatggaaaaatcagaaaatacagagcagcaaaaacgacaggaaatcaactgcaatccatcctcactgttgaaatccgagtccatcactcaccagccgttttttcctacaggtacgtayacagacatgcttttttaagactcaaaatgatcaaaagttgtacacacttattttgaaccattttmgtttattttcacaagcatcagagtttcataagcattctaaagcttcattctgataagcacactgcaatatattata

SEQ ID NO: 245 - DNA, 602 bp, Bovine  MMBT06494
  misc_feature (1)..(2): n is any nucleotide
nngtcttaagggtcttcattaaacatctgccaaattaatgaaaagttggtgtctagtgctatcagggaaaaccgaaggcttccaactgagaggataaatgcctgtaaatgggtaagggttaaggagaaaaggaaccaatgcctccatgggcattcaaattattccaagtttctggagaaagtgactgctgaggggccataaatctcttcactgtgccactaattgctcctggggagagtgtgtctcacacaggctgggaaagcttgaggggataagatgattctctctggaattctccaaamgctgggttgttgatgaattctaaaggggtctgtgtaccagtaaacagacccctttgggccatctggtgctaaacatccataattaaaagtctgaatttgcaagacttccattcatcagatagcaccaatcaaagtgatactatggaactttaaactttcagatgacaggttagtgagaaagggaaattatgtttattacccactccgcatcaaggttcagggcctcttatttaaggcatcgatttccatggaaacagcctgtgaggtggagtatgcttattagaatgatttcttgtaaca

SEQ ID NO: 246 - DNA, 600 bp, Bovine  MMBT06496
ataagtgatgggaacaaaattgtctagggaatccacaaataactttttaaaaagtcataaatctggatttcatgcctcatagttttcaacaactgcaagaaataggtcaaagcctgggacacggtgggttcttttcctcccgtgtctgagggctggctctgcaggctccagtgggaaccacgtcagcgttccagccgcacttggtcctgaatcacttttcattgcttctagcactcactttctccgccccccgccccaaaatcgtgatcaaatacacatggaaataacttcttggctttmcagaactgttttatttgatcctttaaaaactgtcaggtagttggcaagaaatttgcaaaagtataaaaacactagagcaaatccatagtgtaatttaaagttgggggtccttggcaaaattttggaaagggctgaaaaaccaagccccaggcagggctctgtactcttgattgtctggagccagtcttcctcaggctgtgggtccacttcacctgggaagctttaaaataatgctgccaggacccacctcacggtgggcaggtcggagcctctgggggttggaggccttcgtgttaggag

SEQ ID NO: 247 - DNA, 600 bp, Bovine  MMBT07194
agtagtgattattaatagaaacttaaaggaaatagcaagtaggaaatttttttcacctcattaatgttaatgtgaattagtataaaaattatttataaatataatcagaaaaataccagagtataaaacagtcctttgaattgaaaggatgaaaatggttttatgtgttgaaaatatgtctacttgacacttaatataaattcaaatgttaagtatgcttttctttaatattatcaggagtttgcattttacttttagaaatgctttggaaatagagattactaatattttccttaaaamagtagaatatttgagtttttaaaacttggtttcaatttacttayggcttactgttcagaaaacaaggaggaaagccttctggaaaggcgaaggcagctatctcgtgatatcagtagactgaaagaaacagaagaagctctcttggccagatttcccaatcttcgatttgcctataggtaagagttaaatcttgaaattgaacatggtagtaactaggatatatttttgtgtraaagttaccgtaagctgcttttccttaattgttttttcttttttccttaaatctttattgaatgtttc

SEQ ID NO: 248 - DNA, 600 bp, Bovine  MMBT07414
tgtggtggggaggggctgaggtgcaggctggagggaagcccggagatcactgggtacacagctctgttctcaagccagcaggaggcacatccctccagagccttctccccatggccctgctttcctctgccggaccttcccagacaaatgaggactttccccacaacctgagccgggctggtggtgatgctgttcatttaatgtatcgctggacacagagcctgcatgggctgactgaacatattctaataacttaggggggaaaatccatattgcaaatcactgtactctggctttacmagaactatttattccacgaaccgcagagcgttcatcattctcattctccttggagcacatgaaacggcacacagataaattagggaatccctccctagccccttagctatgaaaaaaagaaaggagagaatgcaaacacacaagaatcctggaaaacagctgatccaggcagtggctttggtctctacatctgaatactcatcacagttggtaacattaagccgtggtccccctccctgggccagagaagagagtcatctgtcacccagatgcagaaggtctctgtgcagcctcaggggg

SEQ ID NO: 249 - DNA, 600 bp, Bovine  MMBT06701
tttggagtgaggtgggtattttcttttaacttgggtgagatcagggcaggctgcctggctatgtttggcttacatttgaacaacccagagcccttaattctcactcccagctagtgtagcctgggacatgctgtttataccagggagaagagcctctcatccggtctggtattgtgggaaggctggggtgaggggtgagaaggagatggagtctccctgcctcttctaagagagtaaccacgggggtgtggttcaggttcttctttctttcctctgcttgtatgtccacaaaaggttacmctgtaaaagtcggtttttcagccaggatcatccttgttccatgcagattttctaaggtggacttgtgttatactcctttgcactgtttcccatcactataattattttaatgatttgtaaagtggtctccttatttagcgatctgaggttagtgacccttaggaatagcaactgaccttgagcagacttccctgaatttacagaactgagatgataattgagtagccttgaccctcaagttcatttccattcagggaacgtcagttccacgcagatgtgttggtcgtttacatcaggcac

SEQ ID NO: 250 - DNA, 600 bp, Bovine  MMBT09199
gagatcatatgatctcaaataataataatcatagatcatattataggtgctttttggagctcaatgtaagcttagggagggcagttttctgtattatttccaaatacttggcagataatagtgagagaatcaataaagatatccccatatagggctaagacaggttcaccaatgacatcccaacatgaataagggattttatttttttaatgacttgaaaatatgacgaattgtttggaaaagtatatcaaattatctgaaactacagtgcaaaatagattaaaatgcttacatgttagmaagtagaaatgaaaaattggtgaaaaatttatagttttgaactaaattataccatttaattataacagtgtctctcatcttttaaattaataagatattgcttctgtttttaatgatgtcaatactgtagtcagcttggactcagttggtaagctagtttatcataacttgaaagtcatcctatatttatagtatattaaatgcatgaaccaataattctgaggctggaataatgcatcaatccataatgagaactgcttttaatttagccattgataagtaaaagataattcaatattc

SEQ ID NO: 251 - DNA, 598 bp, Bovine  MMBT10759
  misc_feature (1)..(173): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgacagataatgcggttccttcagcagctgtagcctggactgtcttcctcttgatttggtgtagttcctttagaacttcaggagttgaattaatctaaccccacaattgcatgtttaagagtcmatggggtcaacagggcataagatcttcacagaatcagcatcacatctccaaaattagaaggcacactaaccctcagcctctaaaacagatactcaaacacatttatgtctctgggacttagtacatagggtaatacagaggtaatacaatgtgcaacccacattgtagttgtcatcaaatatctaaggagagacttagtgacagcaaaaggaaagaaaatagacagagaatacatgggaaaagagagtatcttcctggtttcatcctcagcagtatgtggtctctctgtgccagtagt

SEQ ID NO: 252 - DNA, 598 bp, Bovine  MMBT11339
  misc_feature (1)..(63): n is any nucleotide
nnnnnnnnnnnnnnnnnnnnnnnnnnnnnnnnnnnnnnnnnnnnnnnnnnnnnnnnnnnnnnntatcagattcatttcctcccattctcttcctagggcttcctcccctcattcaggtcttatggtgaccctaaaagctcccatgctttcatattcctgcttagacatccagaagttccttggtcttcttgcctccaatccatttccaaagttcctgggtaagaaaaggtactggcccaatttgaaaggtgctcatctttgaaacaatcaacagggacaacagcattggctcaactttamtaaccatgtggatggttgggtataaagagtgatttctagaaaagragtgccaggcatcaaacccactgcagtccattacagcttctctaaatcctgcatttccccattcatatattcatcatacctaagtataactattgatttaacatktacctttcaggttatkctataagctyaaggaaggtggaatatgtgagtctttcttggtctctatctcttcaccaagagtagtttctggcacatagacatcctccaatatatttctgctaaataaattcaactattttaaaatgaaatt

SEQ ID NO: 253 - DNA, 598 bp, Bovine  MMBT06260
  misc_feature (1)..(27): n is any nucleotide
nnnnnnnnnnnnnnnnnnnnnnnnnnntaaccctgataaaggaggattttttggagtcgaggcaggattggaagctgaagccatatttcactagatatgtcagtgtaagaaagttacttaacctcttcatctgtgattcttctgtacgtgaatgggacgacaatagtattcccttacagagttcatgctttgcccacagaaagctctcaagaagataattattatcatcatcatagttaacactattcttggggagggtatccaagaccaggagtgactgaaggaacagaagctgtgacmagcaagtggtcatgccagagactgagaagaaaaatatgaaactctgaacccaatgagaagggagcaacaggcagccgggtatgagaacacaatcaggaggtgagccagcttctgaatctaaatgcccgttgtctcatcctctcaactcttaagggatccaagctgaacttggagccacctgtccagagggcagtgcccgtggcaaagagacagaccatactctagtcaagatgaagactcctttcttttctgttgatggctgagggacccatcccagttgtaaaagtttctttatgtc

SEQ ID NO: 254 - DNA, 600 bp, Bovine  MMBT09544
garataactaaaytttcccatgcctcatttcccccatctcctaaattaaattaatataatctgtcatatttctttctgtctgtgaccttggagagtttccagtagaaaagacctgtgaaaagttttttatattttatatattcagttactctttcagataggcaaatgaggtaaagaaatgctataccttatctgtaaagcttccatttaggtcttcttaaatcatgaatgattgttcagacagctttctatcagcatgattttgtcagggaaactgaggcagagttatttgtatgcttmyagtcactagagaatgaattgatacaagaaatatcatctccagagactattggtgaactccaagtatcactgtaatttgaagtgtgtccaaaamaatgaaaacaaatgtgataccaaactgatttgtcaaagaaatctttwaaaaatcctgttgcttatctggttttatgtcctttaagtagcagaattatgaccaacaaattactttatcaagatgataccctaccttgttgaaactgaatcttgaaatcactctccttttacttcaagactgaaacctcacattacaggtctctgtct

SEQ ID NO: 255 - DNA, 600 bp, Bovine  MMBT08970
ctgatgacccaaattcgaactgataaaattttcattcattctacaaacattttctgagcacctaccaagtgtccagcactgagcatcctggctctggaaacaccaaagcagacagggtccttctcttgtcctccatttgtgaagcctacattacagctcaatatctacacagttaggcatctactaggtgctgaaatacctgatcaaccaagatccctctcctgcttttcttgtggtttaaaacagattttgtcttcatgtctgaggatcttttgtacgaataatgctcaaaaaaaaaamaaacaaacccmaaacacagttcttttttaaaagaaataaaattacttgatgaacctattctgctactatacctactccccacgccctgaattaagcaamcacattaacaaagcctattgttgccttttaaattagaataaacaaagatgatgccacgatgacagcccaaaacaatgcactgtagtgttacccataccatatatgtcttctcaatagggaggtgcacaaaactggtataaaaattagatgagatattgtctcagaaatggttattaaatattagctataacagctgataac

SEQ ID NO: 256 - DNA, 600 bp, Bovine  MMBT06144
cccatctcccacctgggcataaggccttgaagacaactgtatgataaatgttgtctccttggtgtccaagaagtatgtctgatcatcattttttgtataatacctatttcttttattccagcayacacatrttttacaatttaacattggtgaagtcaggattcatcctataatcgttgactgctataatttaattagcagcattttttcctctcagtggtacataaactatggggacatcttagattcagtgaaatcaagcatcattcaagcatctctgataacagctatgtttactcmtctgtcctctctctatggtgaatcattctcttctcaacatttctttaattcctgttctccactcctatggttgtctcctctttacctcatttaaatttctacctttctcacrtagagtcacattattayaataagactgtgctaaatccgcaggtgtcattggctcatgataaaatgctgtttacaattctgtttgctatagaatgaatgccarttcacyacataagctagttaaaatacatctttatttttgttaagtgtgaacagcccaccatgctataggagcttccatttatgaag

SEQ ID NO: 257 - DNA, 600 bp, Bovine  MMBT06715
acagagagagaaacctggacctttggattgcctgataaaacattctaggataaaacattctaaaaccctttgcaggctgtgtgccataaatagccatttaaagatttgtaattcagacatcgctttcaagctttaactcttctgggttgcttttgccatgtttttggcatcatgtacattatcttggaaaatacagttttctgttttgtgggaaaggtgcactgtgaaaagtcctctggagtaaaaatggattggagaaaatttatttcaaaatttattccgtttgctggaattaagtamacaaatcaaactggctccatccctttgtgactgttgtattatttttgttgttagaaaatttatgtgtgccgggattttcaccctaattgcactacatgtccttatagccaaaaggagtggaagagccggtgttggagattttcccggggaaatcctgagagcattcattatgaagtgtaccgtgcgggagtggttcagggtaaccacagtgctcctcatggccccagcgattccagccatggtggttcctaatgccactttattggaaaaacttttggaaaagtacatggatgaggatgg

SEQ ID NO: 258 - DNA, 598 bp, Bovine  MMBT07486
  misc_feature (1)..(117): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcatagtctttatattgatgtaactgagtcagaccacgtaccgcagacattcgacctttcttgtatccttatttctcacaacactcttatgagcatggacttttagcttctctgtttccacataaaacactatcaatcatattgtcttgaaatatgctcaactattaatttttactccttmttactctttgccagtgattatttaagccactcaattaatcaccacatttattaacataaccaatatgtgtaccatattgttctaaatgaagccagtatacayactcacacttggtaatagactgctgtaaaaggagtttaagattgaggaaaatcctctaagatttatttctctcttaattgctcccttatttccaaaatttaacaaattgccattgtcatcttggtttcctgtagagaaggaagaaattttgtttaattacttctccctgtgtttctgctttgggaaagcaagtgac

SEQ ID NO: 259 - DNA, 600 bp, Bovine  MMBT08119
ggacctgcagttcatcaatttccaactactgtgaaccaacgaccagcagattaataggatgtgctgaggaagagccgcccgctcacccactaattgcttgtttacgtaactgatgagcatggcactcattacgggttgttagcacatcaaggcagtgtctgctgatactgggaaaggcctgaggtttgtggatcttagctggttgtcagcaggcacagtagctacttctggggtgctctacccccacagaactgccacggatcgagagtttagtttcaggcatatgacctcacgtaattmcatagcaagcctgcgaggaagggactrtcatccctgttttagaactgaggaaaccctgggtcagagacactaagtgattcacataaggtcacacagctcatccatggtaagctccacagcgttaaccgctctgctgaacagcccccacctccaacacctgccttcatactcagtgatgtcatgaatgcaagtgatgtcatgaatgcaagtgatgtctgcatctttcatgcaatttattggacactctatgctgtgtgctaagtcgcttcagtagtgtcagactctttgtgacaccatgga

SEQ ID NO: 260 - DNA, 600 bp, Bovine  MMBT06831
accaacaaggatctactgtggagctcatggaactctgctcagtgttatgtggcagcctgggtgggaggggagtttgggggagaatggatacacgtacatgtacggctgagtccctttgctgctcacctgaaactaccactacactgcttgttaatcagctatatctcaatacaaaattaaaattttaataataataaagcaataaagatttccaccactaaaggtttttaaaaataaaaaggtgtttatagaatataactaagaaaaacatgtatccagaggaagaatgacaagttatamataaactgaaaacaaaatgctaatattagggtataacaacctttgggtttttctcttaagattttcttccatgagttgaaatttctttaataaatacaataaaatactttaaaaagcatggaaaagggaaagtgacagaagtttaactgaaacacaaaggcttagcttaggacaactgagaaatgagaacccatgagtcaggaaaaagctcagaaggtaatttctgcttctggataaattagacctgaggttgacttagggaggaacatatccagacagagaaggattcagatgcctcaa

SEQ ID NO: 261 - DNA, 600 bp, Bovine  MMBT11119
aattaacatcccacatgcttggagtacagccaataagtaaataaatagccagaacattaaaaagaaagaaagaaagtgaaggcatttgtgtatctatctctcagggttcacaattcagaaggattattaccctagatctttatttaaaaaaatttttcttttcccagttttattgagatataattatattgatatataattcaccctaggtctttaaataaggaacttcaaactatgaaaggatcatgcttttttagtgtctcaattttttttttttttaaaataccagaaaactgttamatttcaggatggcaggatgaccaggatagctactgtcttcatcygcctcctaaatgggtacactttttagtttcttactttgaaatatytaaccttgtacatacttacctatgtgtggatgtttatcttgtctagacaagataacaagggctagaggcagtgacctcaccttcactatctcctgcagctctatgatatggagagacacgagccctgcgaactcccaataaatattaactgaatcaaaaaaattactatatgaaattccctctgggtatgagtggaaaaaattcttgcttc

SEQ ID NO: 262 - DNA, 600 bp, Bovine  MMBT09252
tgtcccatttcctgcaaggatttggcactctrtccctgaacatgtaatatgaagcaacaaagcagaagtcatcaaaattggcaagaaatgggtgatgccattaaattttcacccacttctgatacttgaggacaagatcaaataacctgtacattaccacagaaaaaaactggactatccttgagtacaatcctgccaatgacctgagaagacgagcctgggggagagcgggtagggaggtgccaggggacctagtgaatgaccccatttcagaagcaaacgcggggatgtattcaatamattcyagtagcaccaagtcacatgaatctggatgcacaaattaaccccaggctggttttaaatcatctctaagagactgttacacatttcagggagatctgagaatgttgtgcacatgatcctcgctktgtgcaagaagatgcctgcctcaytgaaggacaggtggctgcctttagcaactttgtaagtagattaaacacaccaaagaagcagtgcagagttctggataccaggatgagacctgcagcyagatggaacagcacaggagctgcgtaaccttaaccaagtgctgcacattcc

SEQ ID NO: 263 - DNA, 598 bp, Bovine  MMBT06769
  misc_feature (1)..(41): n is any nucleotide
nnnnnnnnnnnnnnnnnnnnnnnnnnnnnnnnnnnnnnnnnactggttgaaattatagtttcataaatgaatgtcagtggtatacaagtaataataactttttgttacaaagtaggattttgctctatatgtaatgagtaaaattattaaatgcaatcttatgtttcattactgacagcttgttataaaaaaggaattaagactgaaattttaattattttcataaagtagatcagctttttcactcatgtgtagtgaaacctactcgactgagactcttttgaaggaagccctcattamattacatcactaaatacaggactgacagttcatattccaaaytattccctccctaaactcttcaaytttaaaggaatctaggaaaatattaagttcaacataactataactattaagttaacataactatacaaaatgaaaacattgaatgcatatctttggcactatttggaatgcagtatttggaaagaattttatgagactatttcattggtagtaccaagtaccatcaacatagatgttacgatccaagttggtggtaactaaaaaggactaatttttgttgttgctttgragc

SEQ ID NO: 264 - DNA, 600 bp, Bovine  MMBT08679
tctgagctgtgctctgaccggtgggagcagttctcactgcggctcagcatccttcttcctgaatgatgttgtcaagcagcccttctacttgcagagttcaaccagagccacgaaatgagagcggtgttaaaagaggagtgtttccaagggaggcagaggagggacggtgagaacatcctaagggtttaatcaggtcacgctgcaatccatccctgagagatctgggctaggcagctgggagtaccacagaggcatggctccagaattgttttcattatgcactttcttgaaaccctctgmagacgctcacctttccacctcaaatggctatgtcatcacctttatttctggctttaatggatttttctgagcttttagctttgaagccgtatagaaagaacagcctcacctgagaaccatagctgttacccagatcaaatgtcaccgtccttggagacagctttaactgcagaatgatgttcaaatttgggggctttaaagcccagcaaatagattctatatatttttgatggtctctgaaagaagtttcagaaagaagacctctattttctctcaatttaacactatatctgttataaa

SEQ ID NO: 265 - DNA, 600 bp, Bovine  MMBT08666
gattctccaggcaagaacactggagtgggttgtcatttccttctccaatgcatgaaagtgaaaagtgaaagtgaagtcgctcagtcgtctccagctctcaacgaccccatggactgcagcctaccaggctccgccatccatgggattttccaggcaagagtactggagtggggtgccattgccttctccgagtaaatggtactaacaacattaaaatcacacttccttatccccaaacacctgcaagctttgttttcaaactaaacaccccacactatctattgcttgattacatttttmttaattaaatggtgtatataacttgcattttcagttaacacagcaaaagaagccggcattctcataagtcatttttatgagttgggcccctatcattttaatgtagcaattaattaagtgtttaataaaactgtgttttattatagcaaagcctggtttcaagagtctagttacagtcgtgtcagcattttttgtttaccaactcctttttaacttctcaataattgttctataaaaatttgctttgggtacaagctatgaaatgctgtaaattgcaataataagctattgtttagatat

SEQ ID NO: 266 - DNA, 600 bp, Bovine  MMBT06639
tggcagcttgtgttaagcttatttgaatatgtttataatgtttacagcatgcaactttttttttttcccacaaggtgttggaattatcagtcatgaatggcatctgaatgcatttatgttaattgcagcaaggctttaaggatctttgagggctattttgtgacttaaatcaggtggaagttaaaacctcttgcagggagaagtatgggtctcgcacgagttattggcattgcctcagagtttcagaagaaggggcttgtgctttatttttacaggtggtaaaaggacacatatgaatamtataatgcctgctagtacaagtacaatgacttcatattgatcacagtggaaaccagaagttattctgatgttctgtatgactgcagcaatttgcagagaaaaaaaaaaaamaaaacattttctagagaagatcagagttgccatagcattctttgtacttcagattccttgaaagactccataaggcagagagctcaaaaagccaggcaaaccagtaaaaatcaattaagtccatcaatggaaattttgtacattgacaaatcatggtttctgttcttcttataaaataacaaactctac

SEQ ID NO: 267 - DNA, 598 bp, Bovine  MMBT11086
  misc_feature (1)..(46): n is any nucleotide
nnnnnnnnnnnnnnnnnnnnnnnnnnnnnnnnnnnnnnnnnnnnnnccagtgtgaataagagaaatattagcctttaaagattttctttacagttcccttgaaagctggctggatgaagtcagccagagaattatataacagcaagcctcatttaaagcaacagtgcctttctataggactctggggtttcattgacgggtttttgctataaattataaagaaaaagatacaaattttatgaaaaacagatagagggaccctcccattcttactttctgttctttcaccgaagggatacmatttctagggtgttcatttaaaaagaaagatacaaaacctctttcaaggaagataagaaaaaaatcacgttcattaacctcacgcagtcatagcatgcttaatcttgtttgaattaagaagaaaaaaaagaatgaagagaaaatcttcctaaagcattcgttttaatttaagagattttgtgaaattttacaaatatccagctatttttttcctctttcaaatggaaccagaccctttgaggtagggaaggatwcaagcatcaaatagtctactgctgcagtgttttctgtggtgctt

SEQ ID NO: 268 - DNA, 600 bp, Bovine  MMBT06185
agcctggtaggctacagtccatggggtcacaatgcaaagaatccagtgcaactgagcacacacacacagatgaaagtcaattctaaatacaaatacatggaaaggcagagagtcataaacagaaaaacaaagaacaaggtctccattgtgagtacatccaggccagtgcactgtgttaagtcacaagtactttgagctttgctctgtatcatatttttgatatggtgatatgtacctaccatgtactttgaagtgtactgataatcaaagagagaaaataatcccgtaatagaagagagmacacactttcagctacttctgtgagttaataaataacctggagctttyggtcttttaacaataaagtttctaatgttttccttctagaaattagatacaaaagtcaaagttttgctgtccagtgaaaccagccttgttttaaaaaagagagagaaaaaaagaaaaaagaagctgtttctaggcaaagagcagaggacgtgggaataacatccttcattcagcttcatcccctcaaaagctcatttgtagaaccgggtaaacacacacgttctgcattctatttttgaaattacgttgagg

SEQ ID NO: 269 - DNA, 600 bp, Bovine  MMBT05501
gaaatatttatgtctgctgtcttacagattaggtgccggttgtagagtagctataggaacaatctgtctatcctttctgaagtttctttattctttcccgaatgatgaagcctcctagatcccacctcaatgaacaaagctcaattttttactactaaktgctttaagtaaggcttctgtgatctaatcactaattggatgcttgcatttaagaaakaaagatagctaattaacagaaaccagtattgccagtattaggggtcagacctttatatgtggtagcatggtgatgggagaccmayggtgaagtttagaaagtctttgggaacttaaataggtttttcactcagagagaagttgaaacaacacacccaaacctaagagggaggaggctttctgacagaggatgaatccgtgggccctgggaacctgtgccttctgtattttgtcagcagtcagaaatgctcaaagtttaaaatgtaattactagaaatatgaaatgaaggctcatgagccacttgtgaaattgccctagaatagccaaggtgattacaattgaaaagaaatagaaaattttactcgcacaggatasgccaaatt

SEQ ID NO: 270 - DNA, 598 bp, Bovine  MMBT08420
  misc_feature (1)..(58): n is any nucleotide
nnnnnnnnnnnnnnnnnnnnnnnnnnnnnnnnnnnnnnnnnnnnnnnnnnnnnnnnnncaagagaaagagaatttttctctcacttgttcccagtgcctggattagaataatgcctggcagagaagatgtaatcaatgtgtcaaatgattgtggggggaaaaaaaaaaaaatcccagtgttcccctttagggtggatatgagtcctggttgtagagaggggttcaaacagttcaaaactcctatcaaattccggaggagagaggagaatccaggagttctaattcacacaaatgccatgmagctttcacagggcctccctttcccttccgtctacaggaaagtgagtggtattcaataaccaagttctmaaaccacagctyagtggggaaataaatcagagtccatggaaacggagtcarggagaagtcatgtactctagatcagaacaaagagaagctctggatagaacaagatagggggaacaaaactgcagtaaatatccagacgtgctaaggcaacrctcccagataaaaacaaacaaaactaatcaacccttaagagaaaggaacctggcgtgcagaggaatgataaaacccc

SEQ ID NO: 271 - DNA, 600 bp, Bovine  MMBT06717
gtagtctatacttttctgggtggaaggaaattctgtgaatcattaagttaaaatcaaattgggaaaaaggtcgattgagggattcatttttcattaaatatatacctctcacccctttccttacattttacattttaaagaggttgttttggttgctacatttttgttttctttctacctagttctgcttttctgtcatggcttacaatatcatctttcaaagacaatgctgaaagttctctggggacttgtgttgctttattgagtaatctttgatcagattgtaatggaaatccctgmaggtgatataaaatgtgtacatatatttgaatacataaaatatgtattttttttatttcatccatctttgacatgtctaaatatggacttatttagcatsttggcctcmaaacaacaggctcatcttgggggcatatttcaaaagagtkatgattttaaaaattgatgatgaaaataattggatttataaattctttgaaaatcagggatcctgtctcaacagcartagtaaaaactgctactgaagtatacagaaactgagactaaagatgtataatgtccttgtcctattaaatatgt

SEQ ID NO: 272 - DNA, 600 bp, Bovine  MMBT09200
taggatcttccaaaaatttgggattaggtcactcacacatgtcagtgtctaataccacttgaacttggaagaaaaacaaatttataaccaatactggcactgcagtgcggtcagctttcattttgtgtacatcaaatcacacgctaaaagacagcagcctgaatactgaggcaaaagcaagagataattaggaagtgatacagaaagacacaacagatgaagaatatctgcctccatgccagatattcccatttcctggtatcagtcctggtgtgactagggcatactttcttgctcttmaaataaattccctttaatacataagtaagtttaaatggattactgttgctttttaccgaaagagcttttaatcaaatagacagagtcctgattaatagatggttttcagaataaatgcatttcctttagccttagctttcctgaagtcagctattttctaaaacccatttttccattttttcttgagctttcatttagctggcttgagacagattatattaactgattatagctatgtttggtggtatgaccaggactcttatgcccttatttccttaagtgtggaggttaagtatgagg

SEQ ID NO: 273 - DNA, 600 bp, Bovine  MMBT06357
taaaattaaaaacctagtacagtaaaatgtatatagatatacacacatgtctcataatatatatacacattatatatagtatatataataaagtcttcactccaaccttttaattcacttcttaaaatgtttaatatttaccatagtctatagtacataaaaatacacagtaactactgggtcaattagtttttagtagtgtatacttctttctttttttagtatcaatacatcagaaaagtttaatcttaaaatctaaagaaattaatggacctacttctgacatttcatacagaattmtttttaaattattccctaaagctgaacattacagtctaatatatgaatgtacacccatttgttcaagcaatactatgccttttagtatcttctttgcttcataaataatattagctagtcacccaatgcattagtaaaattaaatagtgaataatagcttatgatttattattgtctttaaaactctccaagaacttaattacagtagttayattagctacagtagtattcattacattagttcttatataattttaatcttgaattgactgcttttcataatctttaatgagatttatt

SEQ ID NO: 274 - DNA, 600 bp, Bovine  MMBT07994
aaaaaagggcctgagtagaacctacaatttccttattataccagatgaatgaggtatttctatgcttagattaattgagtcatccatcttttaaaaatgaatgtgccgtcattacaagaaagactcaaaggagccacagctcatgaatcatggtttcaactgtgtccttgttgtaggctgactcagtttctccaaagaaaaccctctgatgctgacttgctctaaatcactgacttttctttcttcaaatttgatttaaacaaaacggtaagaaatggaagaatatggtttctacccagmtagatggggtgctgaagcaartggttcgtctggtggaaaaagcaggtatttaccattcgcatttgcaagggtcaagaaactgcctgccgcaatcccttctcctctgagaaaaacaaacaaagctcaatcctataaaatctctcaccctaaaytacccttttgtcaaaacattaacatacaatgggatactcaaaagccagggttagagaaaaagtrgtttgggcatacaaagatgataacataagcaaagtagccaagtcttcaatttggagactattctcagttacaatgttgaagaag

SEQ ID NO: 275 - DNA, 600 bp, Bovine  MMBT09540
tatagtcagtgcaaaattatattccagcatgtgtagtcattcactgtcctaatagaattacctgttcaggggagtgcctgacattaacagaaaattgtatcaagtgcctagtataaggcaggcattgtgctgggttctaagggctataaagctgaaggaaaagacatgctgaggatgaatgggaaaaggaagaaaggattctaaatatggtgcttagcagaggcggggttatatctaggctataacctgaagggtaagaaatcagctctgtaaagattcatgtgtaaagtatttcatgcmtcaagaaaataccaaattcaaaagatctgtgtcgtaagaaaatttgtcacgttcaggtagcatgtgtggctggaccagagcaaatgaatgcatgtgcttgaatggatgtgtttatacatctatatatggttcttcatatatttttcagtccttttatttccaaccttaaatcctacactcttttttttttccttgtacctgagctgaatggctacttaaatagttggagtctcttgaagtcacattaactggtgttctttttcacagaaatggtgaacctgacagatagggagggtttcc

SEQ ID NO: 276 - DNA, 498 bp, Bovine  MMBT10843
ttctcgagctctcgtggatccatgttattttcacgtttacaacggcaaacccagggctgagttttctccccagacctgatctgctttctgagttcatcttcaggtgggaagcaagactcattttggtatggaaatttcatttctgtccagatcatggctcctgcccatgaccccattcctgccccagggaccatggacggacatgagactcttgactcagctgtctttttggctttagtcttaggcacagatttatcctcacttctgtttcttttaccatcccaggaacaagactttgcmtcgactccaccagcagcctccagcttgtccttgttgctgaccttatgtctagccccacgctcaaaactgacatctttctcacacttagatctgagtgcattactgttctcactgtcagcccaaaacaaggaccttaaactgatctcctcaatatcagggctagatgctctacttagctcatcctcatctacatctcca

SEQ ID NO: 277 - DNA, 600 bp, Bovine  MMBT06343
taacttcactcaatgttttcttattatatctcatatatgcatatttaaatgctaaaatkatacttatttttattgtatactgcaagtaaaacaatacgacagcatatattgtttcctctaaatccagtcttactgccagacctacctaatttcaagggccaatagagtatccatcttcaattctccccacattcctacatatagaaatgtacaaagtcagggttatttttagaaaattgaaaactgatgctaagcatattttacattttaattttcaacacatgctcctcttaaaaaatmattgaaatgtagataattcatttaatatttgtrtaaacattcatggtatggatatattaatatttactcaaaattttcccttattaatgagaatttactctttttgtttttktcattttttgtataaaaatgtggtttaaataataacccttaaattcatcttaaagyactgctacattagtatctaaagtgtacattctctaaatgagatcgttgtgtcaaaaattatgtgtatcttaaagtttctcatagttttacccagtgtgtacgtgctcagtcacttcagttgtgtctgactct

SEQ ID NO: 278 - DNA, 600 bp, Bovine  MMBT07422
cacaggcgcccccattccaaactctttcccttaatttctagactctccttggtgtgaacccctcagaggaccccctgtgccactgttaaccctgaggacagagccccaggcccctcctgctgggctggccaagtgtcctgtgcagtcccggctctgttctgcccctgggccagygctgaggcttagggcagacgtcctggctgcttttgctccatatctgtgcccaacaattggggaacaaagatcagggtggatacaaacatagaaaatgagaatttctcaggctttgccttggtcacmtgggaggaaaacccaaggtgcccctcacccaatgtcctacaagatcacccccctgcagtccccatmtgcagagaactaggacatcagaggccccaggagtcaggaaagtggctgaaaatgtccaagagtcagactggaaacttggactgaacttggcgttgctttccctgagcgctggagagctgatgaactgaactgatacccggtgagattccatttaacgagttgtttggcaagggctacttctgaaattaattatcaatcgtttctcattattcttagatggcatttcttaaatca

SEQ ID NO: 279 - DNA, 598 bp, Bovine  MMBT05741
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagggcaggaggacagggtgcgacagaggatgagatggttaaatagcattaccaattcagtggacatgaatttgaacgaactctggaagatagtggaggacagaggagcctggtgtgctactgtccatggaaccacaaagagtaagaaacaacttaatgactgaacaacagcagtgataacgattgagmggcatcagagaagtgggggaggaattccgtagctttggtggtggtgatgttctctatcagctctccatccacagagcagagcatggacccatcctcactgaatgcattattgtaactacacgtgactgyaactacatgtactgtattcttggtgcttcatctgcctgcctcctgccacaggagaggaccctggaggtcattcacaaatctgagtctccagcagttacctcactttgtctaagataggttagtctgattatttaaatgatagtcaacacactggtactgatcttcagtg

SEQ ID NO: 280 - DNA, 600 bp, Bovine  MMBT03175
aggaagcaaacaagagacctctcctgtggtctcaccatctctcctaccctgaaaggagaagcacatatccaccagcccatcatcagaagccagcagcatctctgttgttactgtaacctctgaactcttgaaacctcaggcttgagggtagggaaaaaatgcaggttttctcctcaaacctacagttgtgcaggaggacctgaaagggtaggacagcccagaaaaagagagggagggaaggaggagaaaaagaaaaagattggctggtaagaccctgcagtttgggatcaagaccccagsaagtcttcttcctacaagttyatgagcactatcctccatcatagcctttctaagggtttgagaaagagcccctagaaagagcccctgcatggggctctctggaagcccactccttctcaccccctgagccacacagcctggcctcagtctcacctgggacatatgcgtcctctcctccatgcccctctcctctctccaaggccccttggtacccacatagccttccccctcctgccttttgcttataggcccatatgctctttgcttctgttcacccagctatatcccagtcccatctat

SEQ ID NO: 281 - DNA, 600 bp, Bovine  MMBT05276
catgggaggagcatgactcagcctccaggcagagctggggtgggcagtgctgggggaggagggaccctcccgtgggctccctgttgaccgcctttcccctctgcaggtcacagaggaagttcaccggctgctgcggcggggttcctaccgcttcgtgtgccgaggcaaagtcagtgtcaagggcaagggtgagatgctgacatacttcctggaaggcaggaccgatggaaatggctcccaaaccaggtccctgaactcagagcggaaaatgtatcctttcggaagagctggcctccagascagactggctgcgggtcaccccccggtacctcctgcagccggcctcccagttggagctgggccaggggctctgcagggctcggggcttgccccaggccccccaggccaacacctgccccctggagcctctgggaaggaggcttagtggagcccatgccagccgctyggggcacagggcacaaatgcttgaggtattgggggtctttggggctcccccagggaccagcccagccagcagagcagggctgggagctggtgactgggctgggkaaggggcacagtccaggcatgacttgaagc

SEQ ID NO: 282 - DNA, 600 bp, Bovine  MMBT04574
caagaaaatgttaataatgtacattaagtttaaaaatgtatatttgcagccattaaatattgtcaaaagcacaaaaaattgaaatatttttccagtattcaaaaactattatccaattcagcaaagatgttgctcaagtcactgacaaataagtgaagttccaacatgtctctttgcttcactttcactttattaacgtatgtgaaaatgtcaaccagcaatcaaagctatacaggcatccctcattttattgccctttacttttttgcactttgcagatactgtgctttttaaaaactsaaggttggagtgagtctaccagcataaacttttttccaaccacatttgctcactttgtgtttctgtgtcacattttggtagttctcacaatgttttgtcattactattatttgttatagtgatctgtggtcagtgatctttcatgctactactgcaaaaagattacaactcacggaaggctcagatggtggttagcatttttaagcaacaaaatattttttaattaaggtatgtattattgttttttagatataatgctactgcacacttaagaaccaaaacattcatgacttgctttat

SEQ ID NO: 283 - DNA, 600 bp, Bovine  MMBT04537
taaatgtccttgtcaccagaacaaaatgactttccctacatttaaaaacaagtgctgacaactccaaaaacagattatttctaacaataatagttgagcttytccacatacgcactgtgtcctgggcactctgctacctacttaatcctcagtgttttcaatattcccattttatagatcagaaaactcagagcttgaatggcttgcctraggagttgcaattagtctcttgtggagcaaagattagtgcccacgtctgtcttcaactacagtgaaagcttttaactatctcgctaaacsaagtctaaaaataaatcaattaatccaaatgaaggggctggagaacattaagaagttttccctgttctcaaattctaagattacttgaaaaacatgttctgaaatattatgtaatatattctgaagtcaaagaaccatgcctttgtttaacagccactgttctggaagctccattccttagcaccccatctagccagccaaatactcaaggttgcccatacagattacatgctactgagacaaaaacaaaagtccaaaatctatggttataccaaaagactgtgtgtccccgccatcgaa

SEQ ID NO: 284 - DNA, 600 bp, Bovine  MMBT03731
agtatgcttttatttgcagtttgtctttggttagatcaaatttaaacttgtgtctcaccttacctgccttcttctgcatcaccactggaatagaccaggagctgcaatcagtgccacagtgatgggagtgttgggggtggagaccagggggcattgtgggagggtgaaaacaacttcctgggtggggtttcaaggcactgatgagtgtttttagttataaggaaaaagaaaagggagtcctcccctttcctctggttttccttggatcacctcttcagtgaagcctgtaagccgttgttsctgcaaattttgtttaaataggcactcaggtcaaaattgctctgtggtgcttgtgccttgatctagttgtgtcatgaagaggaatctgtattctgctgtcatatagcattgctagatatgaataagactatatggttcttcccttgaattgcatttataaactaaagggtactagagattacctagtccagtgattttctcacattttttttttaaatagcacaaaaaccttttcaaacttatttgtaagcctacaaacaaaacaaagaagaggtgctgctctgatgtagctcttaggct

SEQ ID NO: 285 - DNA, 600 bp, Bovine  MMBT05257
tcttcaacagtgttgggtggtktccactggaaggaagcactgcagcttgtgttctatagtgctatttgtgcctcacaggtaaagagctyttacagcaccctcaaacctcaggagtctgggtgctgtggactagctaggggaagctgactttctggatagttcattcataagaagagtcttactctttatcctgaacgtttcaaatgtagggccttcaaagagaatttttcctgttaaatgacctgttaattcacatagtgatttcttttaaatatagccccccaaaacttccaattcatsagagtgaagaaaacagttattcagataattaaataaaatcatgtctccctttcttcagtatgagctcactcaaccaaggagtagagcaagaagcagtgctgtgttatttctggtagggacattatactgtatatttaatttgacataagcagaaacttaggcagtaaattccaagtttgaagagatgcagcactttactatcattccttagaaaaatgtcaaaatgatgttaaatcatagcagattagataaccttgggaatcttttttttttwaacccatgtttaagagtttttaaaaa

SEQ ID NO: 286 - DNA, 600 bp, Bovine  MMBT03724
cacctccgcttgctccccctgctactgctcttattctctgggtggactccgggtggtgaacaagatgtcagcagccaygttggtgctgttgccccctccttacctgagtccccctcagagattccaatacatcttagatactattgagttttgtcttggtgttttggttcatttgcttgtttctttttaagaacatcacaacrttccactataataatatcctagaattcagcacaacggaggaatgaggttttttgttttgttttaaattctgggaaaatagattaaagcagttaaatsttactcttgatgtgattaaatcagtagagcaaatgtacattgcttatagcacagtcaaaataactgaaaaarccatttgtataaatcagtagagatgtgaaaatagtgaatgtaaaaactacagtggaggtctcttttaagctacccatgcagtgatattttcatacagaaaagagaaaatagaaaaaaaaaaatacattaaagggtattaaaatggtttagttatattcaaaatctatcttgtcaagcatagtaaggatttgaaaagaatgaggtaggaagcatggaaaaggataaatt

SEQ ID NO: 287 - DNA, 600 bp, Bovine  MMBT03388
acacatatgagttgataagttacttcaataaatctaatcatctttaacatctcattcctttaacccttcagataaaagactttcatactatgcattgaaccaaaagaacagaaataaatggtatcaactcaaatatatcagtaatagtatttgtccaaaatcacctttatcatgtgtacatatttcaaamttttttttttttgcaggccctttccatatttggattatttatcttcaatgagctgtttccttataacatatgatgtctgcctagtgattctcccactgttggacacttgsattttctccagtttgttataataaataaaagccagtgataaatgtcttcacacaaaatattctttggattcttttgaatgattccattgggatgtaatccaaaaagtggtgtgcctgggcagcaaagtctgatcattttatgacttcttctgctttgccaactagtcccccaggaaaaagtcctcactttgaagtgatactcagaagctctagatagattgatcagtcctgacaactctgctagctttatcctcttcaataactttagctaatacatgtgtaggggctacttcagtgctg

SEQ ID NO: 288 - DNA, 598 bp, Bovine  MMBT03260
  misc_feature (1)..(34): n is any nucleotide
nnnnnnnnnnnnnnnnnnnnnnnnnnnnnnnnnnacggcaaaaatcacacagcaaaaataccagtgaacttgaattttgaaaggtcatgtattccttctgcctttccagctaagagttattatgagtctgtgaaggtaattgcatttcatgtacctttattacttcatgtgtaaaataaaagcactgcatcagaattgctttccaattgcctgtttttaaaagtattcttgagatgccattccaaattagtaaaagatcaatgaggaagaaataacagtaacagaaatattaacacacastgtagtgatgattcactgtttaagtgacatacctggctaatcgaaggaaaacaaattttccttttgattggttttcttttgttgcatccactcagatattaagatagaaataatatgagtctatatttttcttttcctttcatttagttgacctttgatacatttcttttttcttaaatttcctaaagagaaagtcaacgaatgtataaattggcatgaggacatgtgcaattgaatgtgcttttccattttaagtgaccttaccttgtgaatgcattaaagtgctgacactcaggag

SEQ ID NO: 289 - DNA, 598 bp, Bovine  MMBT05294
  misc_feature (1)..(64): n is any nucleotide
nnnnnnnnnnnnnnnnnnnnnnnnnnnnnnnnnnnnnnnnnnnnnnnnnnnnnnnnnnnnnnnnctcagaggacaccacagaggactcaggtgtgatgagctccccctcggacatcgtgtccctggattcccagcacgacagcatgaaatccaaagacaggtggagcacagaccaggaggactgcagcgaccaggacctggctgggacgccagagccgggccccccgaagagccccttgtgggagaggagcagctctgagaaccggcatctgaggtgaggcatgggccggctgggaaggsgggtcccctccagcctcmaaggatggaggcctttgtcccagtgagccagccagggctccatagtgaggagcctgactggggatgtgttgcacgtggttctgtcttcatgctgtgtctagctattcaggtatttataaataatgcatagtgtcagcttgttcacatttacctttcatacaaacagcaccataacctgtttccgcaatatcacgtgtttacgatttgtccctggtgacgtgtgtgttcatgagttcactccctcatccagttctttatgacacttgagccgttctggttt

SEQ ID NO: 290 - DNA, 600 bp, Bovine  MMBT10747
gggagttccaggcaggtcccctgctgctaccagttcctgcccaggtgccccagccggctgccagggcggcctcactcctcgaacaccatgccatccagctttgccagcacacaggccgggaccgtgctggggacgaggactggggccaccggacatcccgcctccccgcgcaggtactgcttggtgcttggccccccctgatgaggccgctcctccctacagctcccatttcatctccctttagtcctctgccactcttttttccccactttgtccctttcttccattgtttcctctctstgtgcaactacctggttccctgcctgaaaggacgctggagccagagagtcctcacacaagtcagtatggcccctcagagcttcggtgtcctgctctgacacatgggtggtaatactgctctcctccgagggtgatgttccaccaaaggtcgtgcacgggcagccagagccatcaggatctcctccctttctccctgcttcctgttacctccttcctgcccctaattcgcttcctctttctctgtgtcgtcatcaccgattacagcctccagatctctgaccaactcttcccaccactggc

SEQ ID NO: 291 - DNA, 426 bp, Bovine  MMBT10968
  misc_feature (1)..(3): n is any nucleotide
nnnatgttctacacatcttgcagtgggaactgtcaaatgtcacagtcaacattgccacagtatcagcactgacatgaatccacaaacccactgcaggcccaggcctgtaacgaaatgcacagcctaggaaaatgtgcatctcatatttcctacatgaactgaaaaaaacaactgtggcctgaggctaacagcacagaagattctttgagcttttcctcaaatactccagtttagaaacaggttgcagagtgtgagtatggagagggggaagccctcttctagcccaagggatttcgtttscctccagggacatttccaggtctgacacttggtgagatcctaccagagcagacagcttctaccagggtggcagagctmgagatttccctagggggaaactgatgcggggggtggggtggggggggt

SEQ ID NO: 292 - DNA, 600 bp, Bovine  MMBT10863
tgaggaagaagggggtgagaagtgagaggaagggaagtggttccagcagctccttcctggcttaccccccctccccccacacacaaacacacacctcccttttagcctcactcccaggctaggctgggcctgggccagcctgaggtccctgactcatatctctcgtgtcccttatgtaacagagccaggttactgaggcatcaagcttctgcttgctcagtggcaggcttccctggggccaggcattcagaagcctgctgggggtctaagtagagctcactacacttccaaaggaaaagsctcccctgcctagtgtcaggccaagagtctgctcagaggcaagtgccaggtggtgaaggtgattcccccctgaggcccccacgctctgcagcacatgtaagcaggcaggtgagctgctatggacttaagcgtggtttggggtgttcttgagggttggcatctcctgctgtcacctgatggtacagtgctgaagtcagcctggtgcattggaggtgggggggtgcagaacaggtgtcacaagttcttcttccttttgtatctgcttgttgggtcaggtactgttctggggactttagggag

SEQ ID NO: 293 - DNA, 600 bp, Bovine  MMBT10221
cctaaagcaagcataaaagcagagacgatgtagtggtaccgtactgtactactgcacttttcaaggtactgtactgtaagattaaaaatgttttctttgcttttttgtgtttgttttttaggtgttatttgtgtgaaaagtattgtaagcttgttatagtacagtactacacagccgattgtattagttgggtacctgggctaattttgtcggacttacaaacaaatcagacttgatgaatgtgctcccggaacggaacttattcgtatatagaggacttttctgtactcagtatcttcscacacagagacccactgctccagggcagccatggccgtggccaagccccgaacattctgacttcccaaaggcatgcgtttggtgcagaggcaggtgaggaagaggccctcctctcatcagctgatgacaatgtttggggtatcctctctcctccctggcacccctcataggcaggatcaacttttgcaaattgccttccagacccctgactatcggatatagcatggaaacatctagttcaggcctggctcaataaatgtttaattaattaatcaatcaagccaaatcaaagattaggtt

SEQ ID NO: 294 - DNA, 600 bp, Bovine  MMBT09135
aatatgaataaataactaaataaatgcacatctatgattctaggcattgtcttaatgacttcctttggagtctgtcagtttatctccatgagaagcatttattgtagccatgagatcatgcctcataaacctcaaagtataggaagtatcactgactaggctactagtcaatgctactttgctctgaaatctattttttctcttctccaaccaatgactgagtgcagcagaggtactaatacaaacccattgctggaagacacgggattcccttgatggcctgtgttggctcaggattcsctgagcscttgctgaccatttcttagcctgcacatcatgccagaaagcttccactcaaccttccttttgtctctctttcactctaggtcacacttgcttcatggccarcagctctttcagccttactcagattcctctccaatttctctcataggcatttccctaataaaatccctcttgtgtttagtcctcctttggtatctgcttcttggaggacctagaccaatacaccatataatatttgtactatagttatccccatgctatagattggggaatctaagataggaataggttaag

SEQ ID NO: 295 - DNA, 598 bp, Bovine  MMBT07843
  misc_feature (1)..(94): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggagaagtgtccaagggcacagggaggcacagagccagcctacaagcctggagtctcgatgccgaggcccaccttcctttcatggcattggatagacctcgctggcccagccgcatatcagcggcatcatctggcttatcctcaatcaacacgtgcgttccagaggaggcagaaattgacgaagaggcagccagttcctggsgctgatggcctaacraaaggggaagcttgagctccagactccttccttgttcgagtatccctcgctggccgaccccatctttcaccttccggctcccagggacctggacagacccttggcctggagggggcagcctgtcccagtgccagctcagcgggcttggcccttgtaacaatagctggaagggccttttggagcaagtacttcctgaagtgcccagaacagccgctgccgtcctggggcrcaggaacaatcacagtgcacgccagctcccgccctcctgggagcctcagggact

SEQ ID NO: 296 - DNA, 600 bp, Bovine  MMBT06883
acatcatcacttcggtgactcatctgtggtacaatctatcttgcaaaaggagaggaacctgaacgcagcacgagttatgctgagcagggcagaagaggccgtggggaggggttgcctgagaaaacctgggcatctaccttctccaggtcccactggaggacccgcaggccatcaggaaatgagcaccttcatgagatctcagggttttaacactcgaaacgcagcacttcaatttcacaggtacagaaactcggtcataagggcaccagctgaccccaaaccacagtctgagtcagaaasagggccagaattcagaagctggtctgcaacatcacaccatgtcctagcccactctactaaactgaaagacacacttgagaggataaactgatgaatcataatcacactgtggaataaagaaagaattaaataaaaaccagttgcaacctcaaacatgtccataaactctaagttggaaaggtagtcttaaaatacastttccaactctttggaactaaaatcaaatttaggacgctgtagcaaggcagttcaaacaaaagctaattttgtttaatgaactaaccaggaaggcattgtgaa

SEQ ID NO: 297 - DNA, 600 bp, Bovine  MMBT08705
gtacatagatgcacatcgatggcagagaagacaccatgaatgatatgatgtgacgctaaaatctagaagggstrstgcctgagagagagtgaccaaagcyactctctgggaaccaaagaayagtgagtgaagcatgagaactggaagctgtggtgcacattctgggagtctgaggaccagcaggcaggcattattcactcctgagcatcctggcctcagatgccaatcaggctgagaataagaggaaagactccctgggcaaagagactggtaagaagaagtgtgtgtgtgtgttggggstcgggggcggtggacgacmayttctgagactgtgagctgawgcaggaagtgctctaagaggctgaatgaagagatgagacttaggattaaggtacacctccacttcaagccaatacacgaataagtgaaaaagctgccaggtgtacaaaagacattcggggaagaaggcagggtaaatccaggtgtcctggggcctgaagtttatataacatggaagccttcttgaaagaatgctgagctgtgctcagttgcttcagttgtatccaactgtctgccaacccatggactgtagcctgccag

SEQ ID NO: 298 - DNA, 600 bp, Bovine  MMBT09620
tttctggctctgcgatgtctctctcctgcacgtttcactcaatggcgtcgtayggcacrcagccttttgtgtccggctgcgggttttcaaggtttatcatccgtgtggtagtgcagatcagcactttgttccttttgagagtcaaataatattccattgtctagatggaccaagtttttgtttatccactcgccggtggagggacgtttgtttccgctttttgtttattgtgcctgctgctgtcacgagcatttgtgacaagtgtgtgctgtggctgtgtgttttcaatttgtgtgggastgggcctgcagggctgtgcagtgcctcggtgtccaattgtctgaggagcccccactgccgccccagcagtgacccatctcacactcccgccagccgtgttcgagggttccgatttccccacatccccaccgacatctgttattgtccgtctgtgattctagccgtgctagtggggtgaggtgccgtctcacggtggtggagttttcatgcaaaaaagagatcgggggacacaggcagttcacagaaaattctcctgggctcaggacagattcggggtgaaggcattactggacatggaag

SEQ ID NO: 299 - DNA, 598 bp, Bovine  MMBT08573
  misc_feature (1)..(97): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatggggtcgaacagagctggacacgcctgaagtgactaagcggcagcagcggctctaattgaaagtgtcagacttccttagtggtacagtggataggaatccacctgccaatccaggtggcatgagttcgatccctggtccaggaaaatcccacattcagcggagcagctaagcccatgtgtcacaactactgagccagsactccagagcccatgagctgcaaccactgaaacccaagagcctagagcctgtgctccacaacaagagaagccatcagggtgaagccaggaaaccacagtgaagagtagcccctggtcagcacaactagaggaaagtccttgcagcagcaaggatccagtgcagccaaaaacaacaacaaaamaaagtcaccttatactgggggagtgaagaaagaagaaaacaagagtggcgggggggaagaaaaagaaaaacagcacagaaaacatccagtgctataacccaagggaagccctgagg

SEQ ID NO: 300 - DNA, 600 bp, Bovine  MMBT09235
cttcctgacccagggattgaacctggattctcctgcactgcaggcagattctttaccatctgagccaccagggaagtcctgttgatccggaccctgttcccaaacagtaaactcagcagttatgctgttgaccacccttaagtccataaataaaaaatttaaggacactgcttaaaatctctggcacgtggtgagatatagaggcccagaagaacccttccaggattcctagggcattgctgcccttgctgatggggcaggattgcagacaggacctgtgtttctggcatccttcccccsaccccactctgttctttctgacttgtgaagccttttgttagatgattcaagttcttttcttagcacagttacaagagggttaatgagctgaattgcccaaacctttgtaagataatttttctcttaattgaattcttggctcctacaaatggattctaaattattttgaggtctttggtgtgggccttgaattggctgattatgaaaagggggaaatgaaggggaaaatgttttgaaatgtcatgccatctttagggaaagaggggaattacacagtgtaaattttttatgttctctggc

SEQ ID NO: 301 - DNA, 600 bp, Bovine  MMBT07435
atatctcctgcattggcaggcgggttctttaccactagcgccacccaggaagccctagaccatttwaagcttttgtatttagatttctaaaggcatttccgaaagctcatccctttacagagcttctccactttcttatgcacaataagacccaattgtctacaaagagcttctgatctgtttctctgcatttcttaatgaagttsstaagacctggaaaggttttgtttgagaagagaactttgccaagtggggtctgcattagtttttagatttaggccagcggtctgaatgggacasggacacttggggaagggtagaactgctttgggtcagcaaagcacaactgagtaactgctgagaaattcaggacagcctgtataaaaatgagtcctgtgatgggttgaaaagtagttcccccaaatatctacgccttagtccctggaacctgtgaatgttaccttctatggcaaaaaaaatagtctttgcagttgtggttaatttagggatattgagatggagagattattctggattgcccagtgtgccttagatgtagtcatgtttccttgtaagagggaggcagagggagggtctaca

SEQ ID NO: 302 - DNA, 600 bp, Bovine  MMBT08179
ttgccatttctttctccagggaatcttcccgacccagggatcaaacccaggtctcttgcattgcaggcgtattcattaccatctgagccacagggaattcaggaatccccagattaaattaggaattagagtaggacctctccttcttcccaagaaaccatattgttttaacaaatctagrtctgtgcaaggatttgtctggtgggtcgtctgatgaatgtttcactagagctggacaggacttagcaactcaacaaaaacaagtagggtcggattttggatttggaggggcacaggcasggcctctgtctcyctcttggctcccacataacctcttccactttaacaagggcttgtccagtctttaaactgtcatgggaacagcaaactgacctctgtcttctatttccagacagttccaatagttagaaaattcgttctcagattaagccaaaccctggccctttttaactcccacacatgcatccccgttctgccttttagagcaatgcagaatgaactaacctttttttttttttttaatggcttctccttaaatatgggatggtttaggccttctcagcctccaacggtatcagt

SEQ ID NO: 303 - DNA, 600 bp, Bovine  MMBT05487
actccagctgcacggactgaaagggcagcacagctggctgtgaacatctgtgaatacatctgagaaccagagatggaaggggcttgggtcaagtcacacagggagtctcctggcaaktctcccctccctggcctcagctgctggcacgtcccgcagttgaaagctctcctagagccacttcagatgtctgctctgctctctcccgctccctcctgctccaggcttctctgcccccgacggcccgctgggacactaggcatcctctggacagggaaatttgagggcagaatgctgagggcsgaatgttcccctcacctggccactgagagatctgtgctaggattctggaaacttctcagaggatgaaagactctagtctgctccatcaagaraaaggacctcaggaagtgaggccaggagactgtgatttcaactagcatccttcccccgccccctgctgctgtcctcctgttcctctctagcacccctctgggtcttccagccttttccttcctccccttcaagggggcccttgggcaggaataaacagtctctctgaaatagagaaccatggaaatrsacaaagttggcaagccagcc

SEQ ID NO: 304 - DNA, 600 bp, Bovine  MMBT08841
tttgagtgagctccgggagatggtgatrgacagggaggcctgatgtgctgcgattcatggsatcgcaaagagttggacacgactgagygactgaactgaactacaatgactaaatataaaatacactcaaatgatttcagtatgacttttactacctaaaaaacaatggaacttggaatttaggtaattccatggcagttcttcccaagccagtaacaataaatcacaaaatytaagagttagaaaaggctgtaaggataatttaattcaaccccttatatcacagacatagaaacaaasgccccaaaagtttaaacttaaacttgtacaactaatatatgggggaaaaaataactagaaccttgatgttctgcctcctcaaccagtatgatttcaagtcttgcctctaatatgatgtaaagttactgaaagtatccttcaaatttctttattggttctatattatactgtgataatagtcagaaatgaccactatttaataaakaaaaacaaggaataaatcattaaaagtattttaattactataatcttgagatcaacaacatattggcaagttttctgcagtagaagtacattcct

SEQ ID NO: 305 - DNA, 600 bp, Bovine  MMBT08218
catctcattctagtcatttagtctcagacagttttttattgttatatcctttgttgatattttgattcagcttttcttttaccatatccatttgttgttttgccagtagaaatgaagtttataaattatggaaacagtaagtaggtttcagtaacttttttaaatgcaaagatttgcctgtaaaaaatggaattgtgtatttggaatggtcagatgatcagtgagaactcttcaatgctggaacaaatgaagtttgacctacacatttaaagggtacaatgtttgcttatctttattatstatcttgccctatgatttcaacctatagtttttaaccattttttcttttaactttaatacaatgacgttatttaatttttcaaaaaaatattgtcaccatcacactgtccaaggataacctttgggaacatttggatgtatcttctccaatttaaaagtttgaactgagaaatgggtgggataaaaattggattttaggtggcttaatttgaccaaagcatattagaaagatctgagcaaagggaccatagaacaagagagaccatattgagctatagtgacaagtcagacataagtcaa

SEQ ID NO: 306 - DNA, 600 bp, Bovine  MMBT08756
caaccaagggtctcagtttaccgataattgggtgcaagacttcaatacttgtattagattagattttctctgtattcataaaagtcactgcacacttcctgacttcaaatgaaaaaaatttattatctcataattctgtaagtcaagcgttaaggttagtatatttggtcctctgctcttgatttcatgaagccagaatcaaggaatcagctgagtatggtcctatgagacgcactgaagagaacctgttcataagttcatttaagttgttgaccagactgttgctgatgttgcagttasggaactgaggtttccatttccagctgatgtttgcttcaaaaggctgcgtgtttttcttgtcatactttcacatgatctgcttaccaactgctacttctccttctgtgtcatctttcctgacctctatacataccccttgagctaactcttctgccttctgtcctgctttttaaaggcacctgtgattgcaaaaggtccccctagattatcaaaaataatctccctattgtgttgtcagctaataaccttaatatagtattcatctatgcccacttttccaggtggcactagtggtaaaga

SEQ ID NO: 307 - DNA, 600 bp, Bovine  MMBT11275
tgtgctttgggcaggattctttttcttacaaatgacagacatctagctcaaacaagcttaagtgaaaagaggaatccagtggcctatttagctgagcaattcatgggcaccttcaggcaaagctggatccaggtactcaaatgccattctctctctcctccttccccatccatatctcagtttggggatagtcagagaaactggacaatgacagcttcatgtatagttctcatgacttaccagtcttcataaaataaaaaatgagaccttctccaccacccctgccaaactctagcaaasacactgattggctggattggggcacattccatttcctgaaataattcattcggcctgggaagtggtagggagggcagcactagaactgaccagcctgtcagtggacaaatgaccacccctccatactggggccagtcaccataactgacagccccctgaggatcagatggagtgggaaaagaaggttttctccaaaggatcttgggcagtcaagtaacatctattcacctcacctatgaaatgaaatattcatgaatgcttttaataagtggtttacaaacctgaccacttacccagggt

SEQ ID NO: 308 - DNA, 600 bp, Bovine  MMBT06944
aaagcaggttttttttttttttttttaaagtaggcatttgaattgtttttcctatgtggcttctgaattgagttgtttctggacaggttttaaagtttgttcatgtctcaccctgcgctgtatacttctgaccttagaatggcttctcatgcattcaaaatgaatttggttacaaactgggtaaacagatttataaccatagggaccacactgataaattgaaattgtgccaaagcaacttgagaagtgggaggacaaaatggaatagaaaatccaagtaaataactttctggcaagagstcaccatagaaatgtacacattcattttcaaattatattttatttgcaaatgagtatgatgggtttgtcactatgtaaacacaaacatcacaaatgaatccttcaaacagacttgacagtggtgagtgcttggggctgrtgaaatactcaaagtattttgtgctgccaggaattctatttatgatttatactaatctttgttttttactttatccctatttataagatgtataatgacttaatctatgttctagtgattgcttgttcaaccattttggtatctggccaatgtgattagta

SEQ ID NO: 309 - DNA, 600 bp, Bovine  MMBT08667
tcctggtggctcagactgtaaagcgtctgcctacaatgcaggagacccaggttcaatcccttggtcaggaagatctcctggagaaggaaatggcaacccactccagtattcttacctggaaaatcccatggatgaaggagcctggcatgttgcagtccctggggtcacaaagaatcaaacatgactgagcgacttcactaaaagcatacttgaaaatcttccagttaaatttcttcatctttatataggtctttttatttcctaaaaagatgacattcatcaaatatttagggaagtagstacaggtcaacatagctcttttcttttcctctttttacaaaacatgctatttaaataaaagagaatcgtcacttcattgagatagatctcaaaagttgaaaattacctgtaatctgttgataattataataataagcgggattttttttctaataaacaccatcaggcagagactactatagttcagacaattttaagtctcaaaacttctgcattgtgcttttaaaaagttaaattaccatttcctctggcagaatcaaatgggatgggaatggaaatgtctttttcttgcaagacaat

SEQ ID NO: 310 - DNA, 600 bp, Bovine  MMBT09081
tcaactcaaacacggaagcagggagacaacaaactatagcccacaggccaaatcacacctgcctgtttttgtagataaagttttaatggaacaaagccaggctcattcgtttacataagaggacagcagagttgagtagctgcaagtgagactacacggcatacaaagtcagatattcactatctaaatgttacaatgaaggtctgacaacctctttaactagagcatcactaaaatactgattaaatcacagaaattaaaccatgtcagtattgcttattaagccagtgttcagtctastgagtagaatttaatatatttcactgactttaatataaaatatatttaatatagttacctttgtagcctcttggttttgtttatccaattcttctaactcagctattagtatttccttttcagtaatgctctgattgagttcttgttcctttgcctccaaatttcgtcttaaatcacataattctgaatccaaatccacgtcccttgcagctgtacttttaactacttcatactcattgttcagttttgaaagtgacatgtgaagttcttccttaaatgataaaagaagataaaacacca

SEQ ID NO: 311 - DNA, 600 bp, Bovine  MMBT08398
ccaatgtgctctttttgtctagagcatattcttattttcaaaagtttacagattaaaagggaattggcatctttatgaattctgaaagctgatttgagattttaatgatccccatcagctttaggggcattcagtggagacacttacattgttctgtggtccttccccaaagcatcattctagaacctgaaactggacatttctttttaattatatggctctggtgatttgaacagtatttctccatgaagcaatacatcgtttccttaattttaaactaatggaagtacaacctcatcsactctcagaggccttgccatttttcatactgatgttcattcagccatcctctgcaacactctttgtttgttttgccttatacacaacactgtcgtgaaagaatacagctcctgtgcatcmcaggcatcccatttacagttttagtgttgaaaatataaacctcattaacaggcaatagctaatttgactcacttagatagttccatagttactaagagtatattatgtgttgcacattacaaattattttgtgagttttagggtctagtgtaccctaagttaagaattttttcaaatact

SEQ ID NO: 312 - DNA, 600 bp, Bovine  MMBT07426
gtgacaaaatcaaaagttctcrataaggctctgcaatcataataatgtgtcagaaacattaaaatgtgtttccatatataaaaatgagtatggaagtgagggttgaggacattttaggacatttcttgaatccacaatcttaagttattaaattttgacaagttcaaatacaagtcaaaaccttaaaatttattgtgatttatttccartcattttcacagagcaccatttgaattattatgtttgaagcttattaaagacaaatgaatggcacatttatagtctatataaatgcacagsctctttcgggaaacagaaaatccacagtaattctttgtcacagacttcgtttctgagctgaaggtgagagctggccaggatgattgatcaaagtgaccaaagatgctggtgaagttcagggcaggtagacaagtgtctcctgttgtctagaaacacctgcaaatgtctaaactgtgctggtcctggttctcagatgctgtttcttcctctttctgcattaggaattcctatgacctggttaagcaaatactcagtggaaggacagtccaatatttcatgatgaaatgcaggggaaaataa

SEQ ID NO: 313 - DNA, 600 bp, Bovine  MMBT05989
atggcaccaccagtttactttaagtaactttaagtgtaagtaatatgactgataggttgaaaatgatattgtaattctgaagcaacataaagtgtttaaatcaacagccctagcatttgacactgtcgtgatttatgattgtccaaagaaattctatttaatgtaaatgtaatgcaaaccacatgtgtgtaatttaaaatttttagtaactacattaaaaaacacaaaaagaaatgggtaagttaattttaataatatggtttcatggtgactgtagttgacaacactgcattgtataastgaaatttcttagaactgaaatattctcatcagaacaaaacaaaaagtaaatatgtgtagtgatagatgtgctgattaacactgggggacgggagagggtgtgaatcttttcaaatgtatatatatcaaatcaccacatagtgtactttaaatattttacaactttgtgaattataccacaagaattaacccagtacatcaaaaatattctgatttattttaattggaggctaattaaaaaaaaattctcatttaaaaactttacagtataaaattattaatgatatgtattacattcta

SEQ ID NO: 314 - DNA, 600 bp, Bovine  MMBT06515
ttttaaattacctaaatattaaaagaaatgtattaataggtacttcatgtgctagagaaatgtagacaatgttaccttcagtaggccaggaaatggcatgtcagggaacatggctcaattgagggaaattaataaatgagagcattgctgtcattccaggcccagctgaaaccttttacaagcggcactcaccctaggcactgacatttcacccaagctcttaggagatgaggaggatgtactcagtgagacttctgagcaaactacttcttgccatccagttgaatatgggttaaagastaggaccagagcccagagaatccactgacagacaggcctgaaaccagagaaaaggttgcttttgaagctgttaaggccattcatcatcaaggccctscaaccttctaccattaatttttcctcctgcagacactgcctggattctccaggctggctttcctttgcaggaagctcttgaggctttgcatctagttggcagaaatgcagacctaccttttcttgtttcgcgagccaagaatgttatattcccacatgaccatgaaaaattgggccagacaatccgccattcccttaaaaaag

SEQ ID NO: 315 - DNA, 601 bp, Bovine  MMBT06514
  misc_feature (1)..(1): n is any nucleotide
ngaaatgtgtttgtataatcggacagctgtaccccagataccttcattattgctaacagtggaaaaagactataatttcttcgtataattcttacaatgaaacaagtaaatactattaactagaaaaaataatcagtctacagttagcccacacacatccaaatttaagccctttcaacaagaaaggaaagctagaaaacctttgccaaaatcagaacgttcccattgagattacataagtttctgttgaagtatatttagataacatttaatccattgatcttttggtattacctttcasatgtttcataactttgtctttttagtattcaagaatattatgtaaagatcttttctgctttggttctttatacttaaaatgatcccactcagctatgctctttgttttatttttaatgaatttttacactgacttgccactctccccacaaaaaagaccaacagaacagtataatttwtaatttgaaatggttagaaagtaaataaaagtcacagggaagagaacattttatttaaaatacttggagaaaaaaagttttatttttaatactaaaaaatgtttggctatgctagatcttat

SEQ ID NO: 316 - DNA, 600 bp, Bovine  MMBT06336
ggaaatgttttaatttatttaagatttaaaaacatgttcctaagttcattacacaactgccaacattatctgaattatatttattttaagcactgtaggttctggttatcttcacaaacatgtacacacatgactgcaagtatatgttgaatataaaaaacatacatgaatgaggaaactcatttgaactgtgtctttagttacaatggtattgtgccttatggtgccctgttttaaatggcacatcttctaatttacctgtattaaattctgatgtggccttatctccctcctgccttsatattttcaaggctctgatttggctgtatttattttataaagtgaggtagtctgctgaccgcaactggagatttaatttgcaggttccatatatcagaaaactagaataccatggggtaaatcacttagcttttctttgtttccattttcctcctcacttgatctttattttctttttgaagatttttttttccccaaaaaattcactaaataatgtataagatttgaaggtggtgtttcttagggggattaaggcaaatctttcctttgagaggagaaaatggcccattgttgaagcaa

SEQ ID NO: 317 - DNA, 600 bp, Bovine  MMBT09940
catattttaactgttagaattatatccagagtcattgtgatataatctaattttgtaagaaacatgacactgggtgtttttttttaatcatgataaatgtgcacataacataaaacttaccattggtgacatttagcgcattcagagtgttatgactgtcaccaggatctaatgccagaacactttcctcacctcaaaagggaaacctcattcccattaagcagtcattcctcactccctcctctccccagcccctagtacccactaatctgctttctgtctccatggacttgctgactskggatatttcacataaacggaatcataggatatgtggtctttggtgaccggcttctctcactgagcgtacataatgttttcaaagtctgtccctgtcgtagcctgtgtcagcatttcattcctgttcatgcrtttctgttttaaattgtactctttggctcagaaatcttgcatggctctgcattgcctgtccaggagaagtccaagctcttccacatggcatttgctcttctgcagaatcccgctgcccatcttacctgcaccaacccactctgctttcttagttctacacctctgcct

SEQ ID NO: 318 - DNA, 600 bp, Bovine  MMBT07847
taggaaagcctcttgtatccatctttagcacagggaaatatcagctttgctttcaggatttgtctggccagatttattggcttggactccctcttcccataataccacttagattagcattaaacatattttcatctctaactttcctttttctatgaagtcatgtgaaccaatttctcctttctgaatgctatgtaattccttcagatctgttaacatatcttattagtctatgctatctacctggaagccatcctgcttttcaatatatatttgctcaatactattcttatctattasatattgacttagagtttaattctcaagggcttattttcatgttcttaggggagaacctcagaaactctcgattcacagaytacagytggatgatgattttacattaacaatatggagatttactactactaactcaaagcgttgttcattgtattttacaaggcattcttagcaagacacaagaacagcagaaatttgcttgacattttattacctctgcccaacaaactcaatctccaaacatgagaagatagttgacctttactattagtcaccggcctttaaaggatttttattatt

SEQ ID NO: 319 - DNA, 600 bp, Bovine  MMBT07328
cctgttttcagctcacactgttgttgccacagaggagaatgactgcagtttggtagaaatgatgtgtataaacacatacttttcaccgtgttctcacgcactccaatcaagctagacagcttgcccctgcccacgtttttctctctcttgactgcttctctctctctgtttctctctctcctctctcattctttcttctcactactttctctttcctttccttctatgactgtggggtataattccaacttcgggacccagttcaggtgtcacctattgcatatagcctctttggaattsacttactttcatccagaataccgggagagtgaaggtacactgtgaagttcctcactatattgaaaatactcactgataaaatatattttttcatgtaaatatcttacgtagtaatttgaacttttattaggctggttccaaattgagaaaggattacatcaaggctgtgtattgtcaccctgcttatttaacttatatgcagcatccctcatgcaaaatgctggcctgcatgaagcaaaagctggaatcaagatttcctggagaagtatcaatatcctcagatacgcagatgacaccacc

SEQ ID NO: 320 - DNA, 600 bp, Bovine  MMBT05655
aagtataaaaatgattaaaaccatacagccacatcactgtagaatgtgcttgagaaaacatacactgtgacttcaatttcacaatgaagggggtggtggttaaaaaaaaacaggtcaaacaagttgatttgtgtaactccttccccttactaaataactcaaagttacagcattaacagtaagagatatttgttatttacagtctaagatgttagaatttcttttttaagacaaaaagtctagagttctgagttaaggactcacatgtactgaaacacaggcagcagagaagattgtagsaacaggctacaaaccatccaaaaacttaaaaagcaagctctttatctccattaaagaggcgtgcttcctctgtgtctgctagcctcttctgtcaggtaccacgttggatatcacacgactacctggagctattgcctcattagcaggggaatcctcagcctctggctcccaacccgtaagtgagacgtaacgcaacacagaccccaacaatgggccacaaaaaagagaccacaaggggaacaagtacataaacaagagcagctgcctcttctgctcctaaatgacccaccttaccaatgc

SEQ ID NO: 321 - DNA, 600 bp, Bovine  MMBT06354
ggaaaccagcacatagccaggctgcgctgggtacccaggatgggatgccgttctaaaaaccaaagctgcctttaaagacttttgtctcatcaacaataccttaatgcataggatgaaataaaaactatgaaaagtctgagttacatgcaacttttaatattataaacattctagtaaaataattatgacaataatattcacagtgatcaaggataagacagagacagatagatagaagcactgatctgtattccaaagatctcacttcagtcatcagttctagctctcctctcctaaacscttaaatcactgaacactgtctcccctttttgctttttcagagaggtgcgaataaataatgcattacctggaattccttgagcagaaaaatcagtaagaacaagtgctctgaagtcaacaaatcaagactagaataatcaaatcatgagacagagatgatcgctagatatactttttaatatggataaggaataaaacttgtccacattactcaactgctagtttccaactagcatgtgaatagttttatagatagatgaaatgatatttccctttctcacctaatctaccacaaaaaaa

SEQ ID NO: 322 - DNA, 598 bp, Bovine  MMBT06369
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacatatgttttatgctaccaaattatgcatcattattttgaatagctaaccaaagtgtgttataggtactaaagcttcatttaaattttagtctatttgcagctttttcaaattctcaaggcagggtagggggtgggggtggggcgtggctcttctaaggagatgaactctaaaaatttgtttctsgaagatactgcaaaaatctgtggtcacagattccagactgttccaaacacagctctctgagctcctgtttgctaatttatgatgtatctgcttttacccactaggtttgtgctttatcaccagcctcagggagcccwtcaggacttacgaaggaaaggaagtctgagagacatwaaaaaaaaaaagaaattgacaccaagccagggagccttttatatgacatgcagcatagggtgaacccttggttctgaagggcatgggttcagttgccatctttacattcttcatgttatttaaa

SEQ ID NO: 323 - DNA, 603 bp, Bovine  MMBT09206
  misc_feature (1)..(3): n is any nucleotide
nnnactcctcttcagtaaggtattttcttatcacagagctatggttttataatcatttatatcgaagtcatggagaaggaaatggcaacccactccagtattcttgcctggagaatcccagggacgggggagcctggggggctgtcctctgtggggtcgcacagagtcggacacgactgaagcgacttagcagcagcagcagcagcagcatatcgaagtaaagtcactttaaggctgtcaacatgaaaaataatttgcttagaagaaacagggatatggttgtttatcctttggcagtatatstaacttcaaactcaatgagttaaaaatctgttcttttcagaatataaattaactgttgggaatctgtgtaccaaatgattatgtgctgcatatttctctcttaattcatgcacaccatgtattgtataacattacctcatatgccgtaatcatcacgtgtcacatgcaagatacataaaatacatcatgaatgtcccaccagatatcaaagccatccaagttctaattaacttattcacagactgtttctagttcttgccccagaacatataaacatcagaaataagaagtcagtctaaa

SEQ ID NO: 324 - DNA, 600 bp, Bovine  MMBT06324
atcagtttactttcaaatgggcttttatgtttgatacaatgccttccttatcattcctaccacaggtgaaggtctctttggttctgacctttgatgctgtgctcatattctctacaccaagagctccaactcagaccccggcgtagtcctctacgcagggctcaggcagctttagacagccccctaraaggtagagagacattgcaggaaccaccaggagaacagacccaacagaaactgtgtcaaagaaaacaaccacagaacagaaagaaaggttcctgacttcagaaaaaaattctsaattaaacaaaggcttattttcccaaagcaagaaacccacttaaccatatctttgggacaaactgttattttgtgaaatgaaagagacaagaatctttaacgcctttagactcatacggaatattgatcacatgcaagttacagctattcttaaactgtttgcttttctrttttttcaaatctgaggcagcatcrttattctactattatttgagctcaaggtctttctcagaagtaggaaaaatctaataattgtctacaagcacattatgctgagaggtagcaagacaattttcattg

SEQ ID NO: 325 - DNA, 600 bp, Bovine  MMBT08441
gaaactaacttttgtagcaacaacctataccttttttcgccatcatattatgcttacctggtatgctttcccaagctcagctgatagggtaatcaattttaatatagtcatttctttttttcatttatttatcagctttttaagcatccataatatacacaatccttgctatttactgtggaaaaattaaaaaagaaaacttcacaaacccacttcacttcatcctgaaggatcttacagtcaaactgaataagacagayataatacagatakaattgtattggtgatggacaggggagsctgatgcrgtgcagtccatggggtcacaaagagtcggacatgactgagtsactgaaatgaactgaactgaatacagataaatataaaaccttaaagtatgtaataagttctataaaatgattaaagcagacaackcaaacacttttaagtagtaagtgatatttcacctagagacatcatgaaatgcttcatgaagttatggcataaaagtccatgtattaatggtgataacattatccattctagtttctaaatgtatatttttaagatgtcagcttacctgcagtgttatacgaattt

SEQ ID NO: 326 - DNA, 601 bp, Bovine  MMBT08000
  misc_feature (1)..(1): n is any nucleotide
ntgccagtggtcgggggcaagggtggtgagaagggagaatggggagttagtgtttaatggggacagagtttcagctcaggaagctgaaaaatttgggagatggattatggtgagaattctacaataatgtacaattgtggtacattaagtggtgcttagtgccactgaacggtacagytaaacatggttaaaataatatgttttatattatgtgacttttatcacaataaaaaaaaaaactgaatgcaacacaaagaaggaagagctatgaaattagggtttggagagagagattaaatascaagaatgagcattacgatagttattttggtacctggcttcagttatatctgaagtcagtcyacctctayactcttcagttttgtgattcaataaaatactttttttccccttaaaaaaaaaaagtcagagccaggcagacacccatggaggccacactcaactcccatggcagcgaagaaagttctggttcatctggttcatctactctgctttgagtagagcctcaacctgaagttacagttgtagaatgacttagtgccagcgggaacttggcarcaacctagcagagagaacacag

SEQ ID NO: 327 - DNA, 600 bp, Bovine  MMBT06338
agaattcctctagcagtatttgctttttttaatatcttggtcaggtggtacttcagacgtcaaaccgagtttgtatataattaatcatactgttgtgtttaggtgtgtagaattattaattgcatatgatgctaatattaatcatgctgctgatggaggacagacacctctatacctggcctgtaaaaatggaaataaagaatgtattaaactcttgttggaagctggaactgaccgaagtgtaaaaaccagagtgagtacctgtattttgtattttgtcctctaattacaatatgtctscaaactctgcagttcaaaaaataaaataagttaaaatacaggttgctttgttttgtttaaagttttgttttgctttgaatatgttggatcctcatggtctgacctctgtttatctgattattcaaagcttgttagttagcctttctttttagaggtagtcggtgtagtaccagggacttgtaagccatcgacaaaggtcagctgtcattcattgagttgtcgtcatcatccacagtagtgctcacttgtaatgtgtataaacaggaagcagatttgtggcaggacagtgcccattggcag

SEQ ID NO: 328 - DNA, 600 bp, Bovine  MMBT08004
tggatgagcaactgaggcatccaggtaaacagtggggcatctctgactccaatgttcacactcctgctgctgcaccacccagcttcacaacaggcgagtgtgcctgaccctgctttggtgtgtgtgtacttccaatccatacagcacacacagtctgaaggctaactttatgcaggccactgggccacacagaaatgaaacacagagtgtatgcacaacctagttgagaagacagactcatacttactattccaagtgtaaagcagactgtgatgagtgctataaatgagggtacgaacsaagtctttgaaaggaatatttcttgtacacactattcccttgtaggtatttgtgccttgaaagtgaaagtattagtcactcagtcatgtctgtctctttgcacccccrtgaactgtagcctgccaggatcctctgcccatggaattctccaggcaagaatagtggagtgtgttgccattaccttctccaggggatcttcttgacccagggatcgaacccaggtctcctgcattttaggcagagtctttaccatctgagacaccttggtacatgttatttggcccccttgccctctacgtg

SEQ ID NO: 329 - DNA, 600 bp, Bovine  MMBT11160
cctgcattttcagtatgcttccttcagctctgcacattgcagttttgaacatagttaatgcttgctaaagattaaacaaatttggggaccaggttcagagaaaaagaaatatgaattccaggtatccttacttcttgtacagtttggctttgatacttattaagggctaataatctgatttttttatacctcatttctcatctgcaaactggagttaaaatggtgatatactatgtgtgtcttataggattactttatgtatcaaaaaacatgagattattttgaaaactgagcagtctsctacaaacacttggcgatgttactaatctgtatcttctacactgtggataaggctggtgtggtatrtagagyacataagcattgtgtaagcctgcttttgcaaacacagggtggcgggaggaaattggaaccctgggtaaaatacatagtaagttccaaatgaacatgagataataaaaaggcttgtaatatgtatttatcagtcggcttatggaaataagcaagaatgaccatctatgaatgtgaccttaaaaactgttaccaataagtgaatatctctgtgaatatagttaaatatca

SEQ ID NO: 330 - DNA, 600 bp, Bovine  MMBT08291
ggtggcccacactgaatgcagctgccacagtggccactggagaaccagctgaagaaccacccaggcgagcccagtagagactgcaggattgtcacaaataaaatgcttgttgtttgaaatcacatagttttgttacacagcagtatataatgaagcactccccatcacccttttagaagcaataataataatgagtatcattactgtaagaggaaaatggaaaagatctggaataaaaaagacaaacgtcattctaacaaaccgaggatactggacaccaagtctggcatctggccctgsagtgaacagagttctttctatcctcttactgtgytgcattgtgtatcatgtgtactcacattatcaagaggtttggcaagtctttacttacagtgcatgaccaccaaggactaaagtcctttmtactggcagcgtgtcactcacagtgtgaaacaactcagttcacaccgtgagtttctgagaaaatatttctcaggtcttataggagctgatcagcttacagagtcaactgatatcaacaagcacccagttgactcccaaccaatttgcgcaaaaattaagattctcaagtgggttagt

SEQ ID NO: 331 - DNA, 600 bp, Bovine  MMBT05667
tttatacctctacactctgcttttagtgcaggacaagaagagcccatcaagaaactgacctgaggctcaggtctctggatgaccctcaccaagtccaaccaggatgctcaccatgccaagcaccctggggtatgccttcttttgtcttaatgcacagacctgtttccctttcagcctcccaaaaggggctgcctttttctaacttgtacaagttgctctacaagctagctgaagtaccatgaagtcaacttgttatttattcacagacatttgctatactgaacatagattttttccccscaattctgttctgtgcttatatccatgcatacactacattatctcttttatttatttatgtttttaaaaaggacttaatctttcttttagcagaaacagcatcaccgtcatagtttattttctgtaaaatttcaaggttcagaggaaggatgcaaagcaagtttatgctatgtctcagatgaattaggatccagataagtgacttagccaggcttcctgccttccctttcttactggtttcacaagcgcctcagaggctcagcatatgaaaatctagaaggaacaatgattgccctattt

SEQ ID NO: 332 - DNA, 600 bp, Bovine  MMBT07720
gtatacctgccaaactctaccttgctcccccgtctgtactctgcaggtgcctctcttccgtatagtaggacaacgacacgtgatgctcaaaagagcccaggaagtgcttcctgcgctgtgtccctgctcccctgaccctgtccttccccaattctctcctcatatgttctcagcttatcacttggcatttccacacacactccccccgccctgttctctttctcccagtgacatgtctctccacttttccagatgtccagagcaatttggctgacctggcagttcccttctcttgggctsctcctgggaatatcttaaaacattagaaaacagtgactgaaagagcttccaagactggatcccaaacctgyaccaccgtatcctcctaggcggtgcttgggctcagttacttctcaaaggtcctcttctatatctcagatcgtgtgtcaccttgagggaaagccatttgataaatgtctgcaattggatttcaccctggggcaggaatgtggcttcctgtaagagaaygttactgaaccaggctctaaaaatctaacaactaccctggttcaaatctcagcttccctacttcctagctct

SEQ ID NO: 333 - DNA, 600 bp, Bovine  MMBT04992
cttctctgtactcagttcaggttttattctgcaaataatcctttccaaagtgtatttgatttgccctccctgtgtccctaaccagaagggaaccacagaagaaaacattgctgaagacatccatttccatcgcttgcgtagacctgattcactaagaaaataggaaaaggttaaatgaaaaacattctagggaagttacaaaccatataaggggatgggtgagccacacgtgggcgtcattttttttcttctcttctttctttcaacagggagacacatcgcctcttcctcccactgtcycagactgtctgcgggctgatgtcagggtggctccttctgagagccagaattgttccttctctttagcagacaagaatatcacccacggcttcctctatcctcctggtttgtataactcttttttagagcagcagcttagaaagccctcatcagctggatgtgggcatgtgccttaaacatatgctccccaccaaaactacctgcttgggctaaactagctgcccaggaggcttccagtggttgtgggtcagcctggagctataataaaaactaataaattttgcagtgggaaccacacat

SEQ ID NO: 334 - DNA, 598 bp, Bovine  MMBT03176
  misc_feature (1)..(107): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacctagttgcctgaaccgctggccacatggggccagagcttcaaggctactagactcacaaagcacatcctgtggcctgaaacctacaccagctgctgccgtcctgcgctccctaaggaagggtgggcccagcagagaggagagaagccggaaggaggaaagggcagggctgagggctggtccccggggragataagcctctaatggcggcagcatctgatccgcctctccttcctgctaatcctaaatcacaacactgtgaaatctgagcaagtgtgaacgccttgggctccagctgtttttygtgtcaggcctccatcccagcctgtcacakcaagaagcctgaggatgcagtggtgaratggtgtggggcgggggcccaatacctgcagaggggaggggggacactccaggctgrggtgcactgtggggacccccgcctgatctctgctgcccggctgtccccgaggctctgggtcagccccctg

SEQ ID NO: 335 - DNA, 600 bp, Bovine  MMBT04699
ttcgaattctataaaaagagagtatatctgtgaacaggaatatagcaacacaacacccagaacactggtaccttataaaatcagcttctgtctagaaaaacaaaaaacaaagcaaaacatgttggaacaacaacaacaacaaaaaaacaaaatagaaaaacactaaaaaaccattccacaccctctgcatggaatgctgccaaatggaaagggcactctggaaattctttcttccgatttcattttctgatccataaatctgctgagcacgcgtatcctttcctgcacagcctttttccygttacaaatctgtcgtggcgattcactaacctgccatatggcagagtaaatccattcaggaagacacgaggctactctgtaccttaccacactgatttaacctaggcagactagcttctctagaggaaagacatatctgaggcatgaaatggaaatcactcaaaagtgacacaaaagccaatacacaatagagaataaagagaacacaatcatgggtatactcagttcaagaaattttgattgtattttctttgtatattataaacatttacttaatttgttgcagtttgaagtaaaaaa

SEQ ID NO: 336 - DNA, 600 bp, Bovine  MMBT04613
agttctgtctgttctgaggtcccttcccrtctctacagagtgtgagagtgcagagacctttaggttgaccagatgcccaatggggacatggcagaggatttattgtattaagtatgagatgggacaacaygctgagatgctgctcacttctaaagctgctctgattttaagagagacctgtggaagatggtcataggaagtcaacaataaccattgaggattgccacgtgtaccagtcaccaagcttcagtaggctgtgttgctcggactgtctggtgcccgtctgcccttaactttttycccygagtagggaagtcgagctttttctcactatagccrggagagggagtgggagttggtagtccttgcatctttctggagctgatttttccctgactcttttctctgctgcttctttttgtccccactttggggtacaggggctggagcagattttgttatgctgggaggaatgttttcgggccatactgagtgtgccggagaggtgatcgagaggaacggacagaagctcaagctcttctatgggatgagctcagagacggcgatgaagaaacactccggaggggtcgcggagtatag

SEQ ID NO: 337 - DNA, 598 bp, Bovine  MMBT03137
  misc_feature (1)..(79): n is any nucleotide
nnnnnnnnnnnnnnnnnnnnnnnnnnnnnnnnnnnnnnnnnnnnnnnnnnnnnnnnnnnnnnnnnnnnnnnnnnnnnnnataatctgaaacaggtatcttgcttcttaagcacataagcatagtgaataggaacagctgtactatccactgaaataaactaggatgacccaacttggagctctttgacagctccctatcttagaataaaagctaaagtccttacgagggcctttgcccaattcatcttcctactcttccttccctactttacttcattctgactactggcctccctgccrttacctgaacaaggcaggcacactcccacctcaggacctttgtactggcttttccacctgcccaaaacatccttccctaagccactgacacgacacttcacccaaatgttcccctcttggtatggcattctctaaccatcctactttaaaatgcatctgttcctgacaacacttccacatcccctatgtctcctttactaatttctctccattgatcttatcacgccccaaaatgcaatttacttgtctatcatcatattcatgtgagctattatcccaccccactagaatattagtt

SEQ ID NO: 338 - DNA, 600 bp, Bovine  MMBT04453
atcatggatgaggtgaatgctggcctgcagagacctgggcaggcttctggtaccaactgcaactgagctgcagtgaattcatccaaggccctgggagtgaccccacccagaggccagcactgtagagtaacagagggaccgaggcctcagcaataagacctgagttcacagctctgcttggccacttactggctctgaggtttcagacaggtttgaacaggactgagcgcggttctcaggggatgagggaaatagcccagtaaccttttccctttggcagcggacagggtggggctctcyaggccatttgtactcgacacgcatgcacagacatgctcacagtcccacgctcctgcctcatgcctgcccctgagtccttaccctcccctccacccggctcttccacactcgggatgaccatgccctggggtgttgcacgttttagcctgctatcatgtcccactcagcagatggagggcccagggcccagaagaggtgacagagctcgtctgagttaagcggcagcgcccgggctggactccgtgtggatgcgttcttgctgttgtcatgatcgccgcagtagttttgtggtttgctgta

SEQ ID NO: 339 - DNA, 600 bp, Bovine  MMBT05221
agacataaacatcatcactggagcccttaaactgtatttcagagacttacccattcctgtcatcacctatgatacctattccaaatttatagaagcagcaagtaagtattgagtactaattgtttaatggcaccaaatttttaagtgtgatgcttttgacttcaagaaaatgaaaactcagaacctgattaaattatggcatgaggacttgctttgccaagtgagggcacaacagtacaattagtagaaacccagacacagtacactagctgagtggaaccagtgctaagccagttctaytcgactgatgctggggaccaggcagttctgtctctccccactgtttcttctatgctggaaaccaacacagacttactctgttatatgttgaaagtgaaatgcttttctagtaagcaatcagatagtcttcagtgagggctgtatagattaactactttcatctattaagcagaatccccttgctaattgattaaagtcatatcccaagttagggcaccttgatgctgttcaaaattagtaacaggccgagaagatactgtatcaaatactatcctaggaactctcaccaatatctccttt

SEQ ID NO: 340 - DNA, 600 bp, Bovine  MMBT05061
caagctaaattgcaaaggaagcagagcattaaggtcttactagaaggagctgagtgcctggctttcactgagtgtgaaggttatattctcccacttaaagagtaacatctgctctaccaaaataagtaagagcagatgcttcgccatctagatgaagatgaattttgcattctggattgaatttatcagtactgttgctgccaattttaaagactaaacaaattgttgctgccagtgccccctcctgcagtcatgcttagctccttggtccaacagcccattatctgactgcttccagtygtaagaactggagactagattacacttagtccttgggatccatgagatcagacagggcattcctggaaccagcagtttcttgatcactagagaagggcacagctagaggggctttcctggtggcctagatggtaaagaaactgcctgcaatgcgggagacctgggtttgatccctgggttgggaagatcccctggaggagggcatggcaacccmctctgtattcttacttggagaatctccatagacagargagcctggcaggctacagtccatggagttgcaaagagtcggacacaact

SEQ ID NO: 341 - DNA, 600 bp, Bovine  MMBT04698
aagctaaggtttgaacctaagttgatctggctccaaggctttactaccaggagttgaggagatcctgcagagggagggcccttgcaacctgccctcagccacagttggcctgtgaggcctcaagggtagaaactctggctcatccttttctgtatctgtgctgctggcctggggctctgggctgaacagtgcccggtccacctgtgagctgatgaatgagtgttgcccttgtgtgttgtgcagaatgacgacagctactgcatcctgggggtggagrtcacctacgtaccctcccagaayggccagcccctgtggatccttggggacgtctttctcaggtcatactattccgtctatgacctgggcaacaacagggtgggctttgccacggccgtctagactcagtgcctggactcccgggcttccttctccctctggacactccaccctacagggggttctctctgcacttcctctctgcatttagcctcccttctctggactctggactctctctaataataaacagctcttctccacgttggccatcctgttgtttttagagggcggtcgcagcctgtgaggctcagggaacgggac

SEQ ID NO: 342 - DNA, 600 bp, Bovine  MMBT04909
acccaagcaggaatgcccgactctctgaggtggagaatctgactgatcaagaagaagctgacgtmaagttaccagtgaggcacgagcaggttattaagggggctcccacatgtccatgcccagtgacatcttggggattgggtcaccacggagaggctcccagcactgagcatcttcttcaggactccaaatgcaagagcagtcactgaattcagttcaatgaaagaggaatagctaaatggtgcccagagtcagcaaactggaacaccaagaaagcagcatgcctccagtgtagggaaytgaggactgctgtggcatcaagggcggaccatgcaaaagggctcctagggggtcggcagcaccactcaaagtgaggcaagggtgacgctcttcacttttaatagaatgtttatcttcatcatcatcatccttaaataaccaggtatagctagtgacaaggaatggataagctgtctaccacacagagccagtaaacaaatattacaaggccctggggacatagggaacaagccagtctctgccctcatggcttttatcctttgggtcatccttacactgctgacagtgtatggcaaggat

SEQ ID NO: 343 - DNA, 600 bp, Bovine  MMBT05271
acgaggcccacgctgaccccagaacctggtcctgggaggactcacttggcgcagtagaggaagtggtccctccagtccacctgggcggtctgccctgacagcgtctggttggctgtgagcagcagctgagtgcggttgttctggaagtactgcaggaggctgttgacgcagcagtcrgacagactggcgttatgtgggttgaggggggcgtagcaggtgtcccgcagggagacgttccgctgctcctctggcgaccacacctgcagatgccgcagcctctcctgcaattccagcacctcyagcagcagatccgaggacargatcccgctgaagttcttgggccccagcagcagggagtcatacctatagctgggccggtgaggtgctgtcatgaacacctggctggttcggaagaaggggccgaaatacttgtcgtggaacgccttctcacgtcgggctaggctgttgggggctgaccacaactccacggggtccgtggtcagttctataaaagccaggccccctgccagggccaccaccacaatcacagataccgccaggatggtcagtggccatgaggccacccaagtgccccagcac

SEQ ID NO: 344 - DNA, 600 bp, Bovine  MMBT04556
acaggcctgtgctttccagccatgcagcctacatgggaacgtatgcagcatcatccatgttgttctgggagcccctaggctgtccaagacacctggctaaacagatgttcagcaggttgactaaacaccaaaacctaagcttcttgggacataaacactacagatatcttcaaatccatcaagactcaattttcctgtgctctcctccctgctggctagcagctcagccaaaaccagtgcctcacactctgaagtgggaaactttctaccccaaaacctagcctcatttcatggaggacycacgactggaggtccctttctgaggccccaggacatcatgcatcatcatttgcagccagagctgctgggcacgtgttagaacagggactgccttatgagagctcttcaagttccctgtatcttgtgttcagttttcagaaccactgggcagaccctttcccccaaaagcctgtgggtctgggggcttctatggcctttctcagccccatatatcccatcatactgttgaccgggagtttgtccaagtctgcatgctcacaaacactgctgcctttctgtgggtaccaagcaggtcccttg

SEQ ID NO: 345 - DNA, 600 bp, Bovine  MMBT05149
cagtagcagcagcagcagtaatatatctacctcataggactcccatgagatttgaaatcttttaaaagtacaagacaccttctacagccaaactttggataaatacctagaaaatacataacacctattattccgctcagtatgagtctatttgaacttttccatggatttcagtgtgtatcagtgacctgcaacacaatgcagagggactggcattgcctaaacccagctttgggaattaatggaagtggggcaggagtttgatatcagacctaaaggactgatgtcagtatcaggctygtttctctgcccacctacctccccgaccatacacatcgtctttgctcccaagaacagagcttctcaggagtattttttaaaacatctttcaggttattcttaagtctcaaatattgaaatatctatgaagtccttggaaccctagacagagttttgactttttacactgtattgaatattggattccatcagattgaagacactattaagttgtaccattattttaaagtgatgctaagaaaaaagatgctgccaattacattatgacatgccattaatttcacatttgatgcaatttta

SEQ ID NO: 346 - DNA, 600 bp, Bovine  MMBT04417
taaggggctcaaagatagacctctcttacaccaaaagccctttctcaaggccatggggaaaaagttaagtatacacgaatcaggaacttaatgcttctttttttcctttgaattataaataagggaacataaattaaggggaaaaactgctaagggaaagtaaagtgggcagagtttcagccaactctgaagctttgaaagcatcttgggaatcatgttgtgattccttctactaggcccagcaagagatgctggtgagcagacggacaatgagaacgatgtgggacaagcagaaaggcyttggatatcagggggaaggaggtatattaaggcagtgctagtgctrttgctgtgggagaaggcaatagcaycccactccagtactgttgcccggaaaatcccatggatggaggagcctggtaggctgcagtccatggcattgctaagagttggacacgactgagcgacttcactttcactttccactttcatgcattggagaaggaaatggcaacccactccagtactcttgcctggagaatcccctggacagagaagcctggtaggctacagtccatggggtcgcacagagtgggacat

SEQ ID NO: 347 - DNA, 600 bp, Bovine  MMBT04756
agagtcggatatgactgaaccaactgaaatgctgaactgaacctgattctgatttcactacaatttttataagaagaacaaacagatgtcttaataaaatgaccaggtggcttataaacaaagaagcatcatcaagttttgtgtacagattaaaaactatacaaaacagctatagaccagcaatgggttttactattttttccattttgtgtacattcttgtttaatacacataattaaatgatcgttttgttactaaaatcttctgactcactcattaaaatcactttattttcaaaaytgttgaactcacatttcttaatatgtaaytcacatttagtaatctgttgtttatctcagctttcaaaatataattaatctgtactgatctacttgacacacaaaatgacttttggggaactgtcatcattaggctggcattgccttcttcccactaaaactctactttggatttaatttttttaaaaaagcttacaracaaaaagagcatatctcttgaaaaataaagaaatattaattctaataataaagaatrtacaaggctccccaaatcttggctcattttgacattggaaaaaat

SEQ ID NO: 348 - DNA, 600 bp, Bovine  MMBT04503
aatgaagaggggctgcttccttgtaaatagttagagaaacagaataattgttataaaattgctgttaacagtgtaggaaatgcatagcatgcactgcttagatatatgattccatttcaaaattagttcaaattatgtactttctacctgatactactcttaacctttgataatgttcataactgatagagatcattggcattttgtagaatgtagtaaactgattcattttaaagaagcagtgaaaaaccaagaaattactacatgaatataaggaacacaaacccacaacaaaacatyggggctcaggtttgcatttgggggaatgtattttatttttatggcttttagatgagcatttcccatactttaatgtttctgaaaacaaracagaagcagagttgataatcacctcagggggttagattttctatctctacccacattcatattctcagagttggaattcaacttgttcacagcagtaaattctcatcaacaataactgaaaagtttaataatttagcattcaggtcattcttattatatactttaataggtgaactataattttattaaattaattttaaagctcactat

SEQ ID NO: 349 - DNA, 600 bp, Bovine  MMBT04748
tcttgccagcattgccctgtgtactgtagtcttgaccagtgtaggaatgactaaaaaaaaaaaaaagaataaaatatcaaaatcgaatttataaaacatactttgatcacctcaaaggaaattttcaaaattctgacaaaaagtcacgagaaaacatttcatacgtaaaccttaggagaaacatagccaagtgttttaaaggtatttcatagaatatgtttaagtaactttccccataaataatacagaaatatagtgctcatctgtgtctcccgattcctaatctagagtactgtttcyttaagagcaatatgcaaactgttgttaaagttcacactcctctactactgaccccttataacatcacagcacagtggtggtggtggtttagtcactaagtcatgtccaactcttgtgaccccatggactgtagcccaccaggctcctctgtccgtgggattctccaagcaagaatactggagtgggttaccacttccttctccaacagcacagcacaaagctagggataaacagagcttatgtctgaagtcattgctcagcaggccctagagtgagtcaccaagactctccacactctgg

SEQ ID NO: 350 - DNA, 600 bp, Bovine  MMBT04519
ccagggatccaacccaggcttcctgcattgggagtgcagtcttagcctctggatcaccagggaagccatatgaagaccttagaatctcatgcttawtttaccccaaggcaacctaatattaagccaaaccaggcctgtaggagatgagatttctaagaagaggttgggggtaggcagtgactacaactgagaaaccatatagaacattttaattactgtgatcattatgctaatttatgttgaatagggacagtcctatttatactttgagaagaccactctggctgctgtgtgaagaayaggttgagaatgataagactgaaagcacgggactggttgggaggctgctgcagttttgttaaaagatgatggaagttcacagtaaggcagtggaaggagagatgtaaggacataatctctagattatgaatctcgtaattagacaaattttgaaagcagcagggagagggcatgtagatttactggacatgggaggtaagagcaacagggagatctgcgtgactccaggtttctgatatggacttctgggtgaaatgtgggtctacctaccaagatgggagaggtggaagaaggatttca

SEQ ID NO: 351 - DNA, 600 bp, Bovine  MMBT04838
ctcatctaaggatatggtcataccatgaaaatgaaaattacttgcagactttaaatataaaatatgagmaattcacaaagttgctataagaattttctccccacagtttcaatgccttaggtttctcagaaagttcccaataccttttttctaaatcatgcatcctgttggttctgtagagaatgaaaaagagaaagtgagtaagacttatagtatattttagggccagacttgatatttctgactcaaattcctaaaataaacactaaacaattgtgtcacaaaataatacaaacttgyaaatatctggaaagtataaactttataagggaaaaaaattaaaatcagtcataatcctattgttcaaggaaacccactgaattttctgaattttttagtcttcagaaagactagattgtagctgtatcaactacatagatgtaactgtatgtatccacattaattaggaccatagtgtatattctaatttatattcttttctcatttaatactatatcttgagcattttccattgatattagaatttttacaaaagcagaattcagtgaatatatgacatttcaacttgtagaggtgtca

SEQ ID NO: 352 - DNA, 600 bp, Bovine  MMBT04568
ggggaagagcctgcgcgggggaaggatgaaggtggtccctgccaccgtggcggcgcaccctcctgggtccgctcctggccgacctccccctgactctggggagggcgggagaggcagcctgtgtcctcgcgggcagggccttcctgtgacccgccagggaccccgcggccctttcccacagccctcccctcgagccctgctgcagctctccgtttattttttcaggtgagtaaactccgtatcaaatgctggtttctcakttgcttttaattaggcttctgggctccactctttcatctyggtgaagtctgcgccacttttccccagctatttttggtcctaaagcccggggtttgctttcattcagctaattgaaggcacacaggaaagragagaggggataatcctgatcagtcgaygtttctgaaggctgtgataaaccacacgtttgttcagcagcagaaaatcactttcaaaatgttagctctgcagccccttccctgaggggccgggatgcgacccaccaaggtgaaggtcacaggtcaggtggggtcccaggagccctgaactcctggggaggctggcaggcgggtgagatgc

SEQ ID NO: 353 - DNA, 600 bp, Bovine  MMBT04463
actaactgtgtggacactgctccagcatcttcacattatctcacttaatcttttcaacaactctatgaagtaggtactattataatctccatattgggggatgagggaaactgagacagataaatcatgctgaggaaatatgtataatatcataaataatatgctgaaaaagaggcagagcttgaacttgaactcaggtggtctagctctagagtgttaggctaaaatgaggatatttcatccccatgtcaactatcaactatcagtaaccatctgtgatgctatatggagaactgtttytgactgtattcaaacccgacaaggagtgctacagtcaatgggggaagtgtactacccayaggaagatgggagagatgtgcatagtgagtatttacaacacagacctgagatccaaagactgaacaaccaccaaccacaamcgcaaccttgcccaaatatgacagataatagtaaaataatcaaagataaggtcacaggtttagcaatgttgctatgggtttgaacactggtgaggacctcttagcacaatgctggatggctcaaatagcttaatatactaagatcttagatcattatcct

SEQ ID NO: 354 - DNA, 601 bp, Bovine  MMBT04428
  misc_feature (1)..(1): n is any nucleotide
ngaataacattattgaatggtcaaaggttacgatcatttttaatggtttttaatgagcttaacaagttgtataaaagttaattttccatttcaccttctagagaaattaatggacttacgaaatgagtacctgcaagcagatgaggccaataaaagatttttggaacagaggtatggtaagagggtgattcagaaggcactggaagagatggaaagtaaggagtggctagaaaagaactcaaagagctgcccatgttgtggaactcccattgaggtaaagtttggggacagacttggaggyctccctacttgcaagcatgttatgatttcctcaagaagccttttaattttgaactaattaagaaaacatatattggtatttattaaaccttcttggaagattcaaatttactactaattattgttattggtattaaatatatgtagatgtcccttttcatacagtgcttccatacagtgatggtttttctcagcttgtatctacctcaaaattgaatgagttatgaggaggccatgttagaactatagtcaactcaactcatctatattatttttttttttaaaaaaggctgacttctca

SEQ ID NO: 355 - DNA, 602 bp, Bovine  MMBT04423
  misc_feature (1)..(2): n is any nucleotide
nnggcaatgttacataactggtcaggaaatgcctttttgaggaggtgatattgaagttcagatcttcaagattacctgaattgtaacttgaagagccagctactgaagtctggcagaagtgcagtctaggattggggaacaaatgtaaaagctcaaccgtgttatgcatcttagctgaataacgttaggcatgttccatacaattgttcgttcattgttctaatctctaaaagatgagaaaaaggaatccacccctcatatacttaaggttcaagagatttggacaggaaagcactcaacayaggcaaaaccaatacaatattgtaaagtaattagcccccaattaaataaatttatattaaaaaacaacaacaacacaggrcctagcagtaaatggtcaacacagcattattttagggtttactattgcgattcccatatgccacctggacccgcactgaccatagataatttaaaaggacctacgttggggggctggaccagcatctcttctcccctaactgaagcctgttctgaaccacaaaaacgattcctatgcagggcagggcccgcctccacatgttacttggatacaaacactc

SEQ ID NO: 356 - DNA, 600 bp, Bovine  MMBT04408
cacgtgggctgtctgccggatctaactgtctaactcagggtctctcccgttcaggctcctggggaggaagggaacttcctcaacctgtggcagatayargcctgatggaaaagcagycccattaggtgacatattgacaaacacaaatccaaacagttaagagacatgcagggcacagggaaggttacactgtggttctggtgtaaatgccccagctctgtcccaggcagctcagaaagagaatgtctacaatacttttcgttgtttcctagtccaggtcttggacttcttgattgtctygccaagtttacatttgtcaattttcgtttgtcttgttcacatctctaacccatcctggactgtgttgatcctagagtcaatagcaatagcttgctgaattgaaaaaggcttacagttatgtcaaagggctgaggaggcagtacaccaaaataaaaatgaaactctctctgtagagttggacttgtcatctcagtaggtgggcccttgtcaagcccctgagaacacttagaactaccaggtcagcccaagggatggagacccatctccaaagttcattattcaatactggtcctgcacttt

SEQ ID NO: 357 - DNA, 600 bp, Bovine  MMBT04407
ttttgataccctggactgggaacagtgggttaacccctgttcctgggcaataaaawtcccagggcagttcttcagtctgttcattcttatttacatcctagaaatcagaagcttcaccagggtgtagatgtcttgtgctcagatggctctactgtttacgcacctttcaccggaaagatcatgggccaggagaaaccttataaaaacaaaaatgccatcaataatggtgttcggatctctggaggaggtaagaagtggtgtatgtacctggggcatatagtggagatctctgatgcttayttcatgtgtattctatacagagaagttgcattcttctttcaaaggaacaaaacctaggaactaaaggacaagggtactgtactaaaagagcccacacattttccaagatgtttcaccactttccctacagtcatcttttttatacatacactccccacctagctctatacctgactggggcactttcctcctgaggtccacatggctttgcttaatattctccaagcaaaatcactttcagcaatattagctataatgaatggatgctttcatttaccagttccacaactggaaaatgtt

SEQ ID NO: 358 - DNA, 601 bp, Bovine  MMBT04942
  misc_feature (1)..(1): n is any nucleotide
nttatctttcttttaaatatgtgtgtacttatctctgaacttctctagtaaagtgagtattacaaaatatttcttataacaatgggatgtggaggtatgggttcatagggctgagagccactggtacaagtgtgtayaacacagaccctttrctgstaggaggtctagcaagcttgctattgtattgataagactgtgaacctttaaatcaagccaggctggattcgatcctgattcctcatttactaaccrtgagacctcaggcaagtaacttaaattctttgaatatcagttttttcayctgtaaaaaactcatgttttcctctatctcataggatcagtgaggataaaaccatgtaacaaagtacttaacacagtggtcaccacattcgtgtttggtatgcatgtttgtgtgtgctaagttgcttcattgggtccgactcttcgagactctatgcactgtagccccccagcatcctcagtccatgggattctctaggcaaggatactggagtgggttgccgtgtcctcttccagggaatcttcccgacccagggattgaatccagctttcctgagtcttctgcgtctcaggcrgattc

SEQ ID NO: 359 - DNA, 600 bp, Bovine  MMBT04392
ggacagtacccatgaactttccaaacctcatttttctgttctgtaaaatgagttcactctcttgccaccttgtatcattgtgattatatttgtaaaggcacttttgagtgctgtaagtactaactgttgtaactttgcataaattttggttaaactgtgttttctttccaatggccagcttaaccataacttttctggctgttcttttaagtttctggctatgggccaaattgctaaaatatgattgttttggatttattattttctgttttctgtgtaacattgttcagatgttagtayatatcaaataagtgtatcaagaagaaagaagaaaattgaaaactagwgtgttagtaatagagtatttttaaatgtaagcaaatttgtatttattaaatcgatttgtatgtgtatgatgtttatatttttaaactccagtgaaaaactcagtggtagatctgataactttctgttgtggtagctgttaacaattattaaaacaatttaagataatttaaaaattttttactttttaaaaaatacattagattgatgtctgcaagagcacgctatgagagatacagtggcaatcaagttctt

SEQ ID NO: 360 - DNA, 600 bp, Bovine  MMBT04385
cagtcagcccctacacagatgatatgatcttaccacataaaagtatgaataaaataaaatattgaaataatgttgccataaaaattatccttgagatgtgtatgttttcatattaaattttggaacttaaaaaattccaattagtctcttgatctattcatggttccatataatccacctaaagaaatccctaaatgatttcttatatatagtatctaggagactggcatcccgagtgatttaacagattaatactgtttctgtctccttcaattatacactgtgcacttagatccaaaygggaaaacgatggcaatggtattggtgttttcccacatgataaaaatcagatgacttcaagagctggagagacaaatttcatttgttttatttattaagcacattttcagttgtgattcctctttacttctcattttaaaagaagagaaaataatacaagtcacccctcaagctattagtcaagtgacctactttcaggcatccttctcctggattaggccagcgctgatttttcccagatgaccatattctcttttattcccatacaggcattcttagagttttaaaaggaaattgtgg

SEQ ID NO: 361 - DNA, 600 bp, Bovine  MMBT04985
gtttattgattaaatgagtcactcaaaaatatttttcactasggacttcccttgtggggccagygcttaaaactctatgctctcaattcagggagcatgggtttgatcccatgtcaggraattaagatcctrcatgcacatagtatagaaaaagtctcactcaaaatcatatgctaataaaagtaaaatttctccagaataaaactatagcaatgagcactttccttamtagcaaaacatagtcttaggaatattgtctaaaataaaaaagttaagttgcctctatctaccatatgataytactattccccttgctactgagaaaagacagggagggaaagagaacagaggatgcagtcactttccccycaaggcatctcatgaacagctgaagacccctaataataggaccatggctacacttcccaaatgagttcggggatcatactgtggagagtatggccaagctttcttgcaaaacacaacagtgagatcaggatggtgtgagggagttgtacccaatagacarcaccrcacctctcatgggcatccagactctctttgattgttagtttagaaggaagaggcccaggtaccagc

SEQ ID NO: 362 - DNA, 600 bp, Bovine  MMBT05008
atgaacagattaacaagatgtggtgtgtcaatacatgtgtgtatatgcattcttaaaaagaatggaaatcttgtcacatgctacaatacggaaggacagacttaatatgctaagtgcgagtagtcagtcacaaaagacaaatgcagtatggtttcattcatgtgaggtatctagtgtgatcaaattcataggaacagaaagtaaaatggtgcttgccaggagctgagggataaggaaatggaaagttattgcttagtgggtacagtttcagttttgcaagatttaaaaagttctggagaytggttgcataacaatgcaaatatacttaacayttttgaactgtgcacttaaaaatggctgagaaggtaaattttgtttttttgtcacaattgaaaaatgtttaaaagataaatttcaaatttgatctgtcagtctcagttacattttcaagtgcttggtttcaattctgcagtgcagctctggaatataaattatgtgagtcgttttctgacagtaagtatttgcctacatatttaattgtaaagaaatgaaaaggtagccaatagatcaaacacagaaagaaagaggcacggaaaagat

SEQ ID NO: 363 - DNA, 600 bp, Bovine  MMBT04344
ttcatatttactgtcaggaacaagacatcaatccccattgtgtccccactgtagtttaccctttctagaagatcatgatggaacttgacaagatacagaaataagaaatataaaacttatacaggagtataaaaaatgttcactttctctcagataatttgactgcaatactagaaatttccctcataaaatcaactgaaaaactattcaaaacataagaatttagtaactggcatggtgataacattagtagtagtttttcaattgcctcattctctaaagtattgtattagttaccaytgagtgatcttttcttttctttttttattttattcatggcatgaactttaactggccatgatatactgacatattatacttcygcatcatttaattcaatttgctaatacaggcatttctttatctgaatgaattctgaaaagtcattgaatattaaattttgaataacaggagtctttgttctattattttaaatgtgaaaaatattttgttycaaatctatttcaaaatctcaaccaattttccccaaatactacttatatatcctaagtacttccataataacttactgagaattcc

SEQ ID NO: 364 - DNA, 600 bp, Bovine  MMBT05383
agtccatagggtgggaaagagtcagacatgactgagtacacatacaccatacaacattatatatgtagcagtacatctttttaaattttaaatttgtttatatttttaattcaaggataatagctttacaaaactatgttggtttctgccaaacatcaacatgaatcagccataggtatacatctgttccatccctcttgaatctccctcccacattcctccccatcccataacagtacatttttatctagcatttaaatggatattctgtaatattatattcagttgaggaattcacaygatgaaagctctgttctttatgtcatataaagaactttagaggagatagcagatttatatgtaaaaaataatatttaggtatgtaatgagtgtaaatatttattttcaatgaataaaatgaggcatttgmcttcctctagttaacttcaaataaatctagggaacaataatctaacattttaaacatatttcagctcaatacagagattcttttatgaaaatagcagaatctaacatataaatgagttgccctggaaaatagtatgtttccattcataggaatactttaggctatggctg

SEQ ID NO: 365 - DNA, 600 bp, Bovine  MMBT05062
ccaacatgaagaaacatatagttatagttacgtaaaaacacagacacagtactgtcagtcaacgtaaatgcaaggttgcacctgccactttcttttcttccaagaagaaaaaagaaaagaagggaaggagggaatgaaggaaggaaggaggcaaaaaataagggagcagggcaatagagagagtgaaagagacgcaaagagaggatagggggaaccctgtacagtgtgttactgagctattctatagatattttagcaatgacttgcagtagccctttggcttcactaaccttttacaaygaattgctgcagacaaaagtgacgcccacatatccttcacactcgccagctgctgctgaatggcagggatgccttccggggaggtgttctgaaggacagattctcctctggtcactatcatcttcatctggatctctttttcctgtttcactgataacagagcctgtaaaagcccatacagaagtcctttgtcatctgtatgtttaacatcgctagctttaaatatttcagagtccctgtggatagcagatgacctgccgtcgtgttgagccctggatctcttgggctgatcaggaggcc

SEQ ID NO: 366 - DNA, 600 bp, Bovine  MMBT05073
gtattcttgcctgggaaatcccacagacagaggaacctaatgggctatagtctatggagtcgaaagagagtcggacatgacttagtgaccgaacaacaacaactgccctgaccccactctattattaaacattaagaattcatagatggtgtttccagaaatccctcaagtctgagaagaggtgaaaattatgttgcatgggattttttagagakttgaggattaaaataagattttgatgactttctggytaatcctgacgatacatgaaaatcaattttagtggcactattataactyttcttayattatacagtttgttgtatcctacaaacaacttaggcaaataaaatgagctaacattgtggagatatataaggcttatggagatggtgggtgttatttgaatctaaatakatattccctaaaaattgatgttcctagttacagccatacctttaaaacattcataacaccagttaccagatgcattcatatctgttgaccaagcactggaatattgactctgtcaactcaagataaagaagcagagataagarttatctgtctccaattattgtaactattgcatctttattt

SEQ ID NO: 367 - DNA, 600 bp, Bovine  MMBT05360
cacttgtgctgcttcctctatgttttgaggactatgttcttctcttatgttgcaggcacttgttgtaataaaactggaaaaaatattctctacttgtgttaaaatttaattttttaatagtctatttggtttgtgttactttatacatgtttgaaaccacaaacataccccactcatcttccttattgattctttctagaataaccaaatatcaggaaacacctcttatgtttctaatcataaatatttcacaatatcaattttagtttcaaccatttatttctcctcagtgacacttcyttttcaggtactcttgactaagcgtcttcactgaaaattccttcttcttacattgttgcttgctgctgctgctgctgctaagtcgctkcwgctgctamgactctgtgcgaccccatagacggcagccaaccaggctcccctatccctggggttctccaggcaagaacactggagtgggttgcttgctaggagtccttaattttgttatcataaaccttagaggaaaatcttttttgactaatttttagaagttcacatcttctctcttttgctaaaattatatacttccacttaaagaag

SEQ ID NO: 368 - DNA, 600 bp, Bovine  MMBT03295
taacctctgctgatccacaatgatttatacttccttgtactttcaggtgatatcatagtattttacattgagatctttttgttttcacttaaaaatcgtgtttcaccctttccaagtcattaaatatgccttctacacactgttttcaatggcttgtttgtgtatactatgatttatttaccaagacctcttgtttgaaaatcaagttgattayaattttgcaccattataaaccttcacttgatatatatttagtctttattgagcgcttggaaatttaggygcaagttccctaagggraaactgtgcttgtcttgattagttatctgcctacagcacagtgactggctgcatgamtttaactattaaagatccaaattggcaacaaaaatgcaatttgaagtgaaattaaacctcaaaaaagattcatctaagtgaaatgaaacatcagaaaagattagttttctgatgtctcatataggttgctttttggaaaactggaagacattctttcatctatgactacaaatcctgttaaagacacaccgaagatttattttcttgcataaaaagaattgtgggggtttacatcagggggca

SEQ ID NO: 369 - DNA, 601 bp, Bovine  MMBT05245
  misc_feature (1)..(1): n is any nucleotide
nacatggcttaggaagaaggaaggccccttccctggggggtagaggggtggaaggggtgcagatgaagcccccagagtttcctgaacaaagggatttcagacagcagtttacataagactctagctgggggataaattaaaaacccgggcttttttttttttaattaaacagtgcttttagaagtattgcagttcctgtgatgcttttcacagacaaaaggaaaaacaactgggtagaaaaagtcaggaactggcatttatcaacaaagagagaaagggagacaggtatcccctgcttttycaacgttcacttctcgccaccttgattcgatgaaagacctacgttagtatctattgtcatgaactgaaagaaatccaaagaggagttttcactttcataaaaacagaaaaaaaaaagcgaaaagcaaaaatagtgttcatcatctgttgtccaggagccagagtggagccaatgagtaacctcgagtactgagagaggccccgcccagctccttccccagaaaccacactgaacacttaggtatcagggagaaatagctttgaaccatgtctgtgagcttctgtgcttgatctccactta

SEQ ID NO: 370 - DNA, 598 bp, Bovine  MMBT05120
  misc_feature (1)..(197): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtgtccctgtgctagaattttttcctgctttgaataatgtcacatgacttgtgttttgctttaattatttattttctttccttttctgaagtcaacagytctttatactaccttcgatgaagtaagtaaacttctaagatatcttgagataaacagaacgttgcatttgtttaaaataaaaattaaaatataaaattaaaaatcaaattaatttgattttaattaaaattaaatcaatcaaattaaaaaccataaatcatatgctcgcaggaaaatattgaggacataatatgcttatgcttactcacataagcagaaaaaaagaaaaagctgatgatagtgttgagtatagctttccggctaattagtaattatggaaaggccacaaaatacatgt

SEQ ID NO: 371 - DNA, 600 bp, Bovine  MMBT05121
acttgtttacacagaaaactgaacctggggctggcttggagtctggagcctattctgggcattgttcaccgcaatctgcccagaccctcctcccccagcctcaacctccaccacacgtgttctgcaggaacagaacctttctttgggcaaaggggatggaaacaggattgggtgaccacagtgtcagctcacacactgctgacagtggcatatttaatttgataaaatgatggtcataagctttcattcccatgaggcctagtaaagcggtgggtaaaataatcagggtctccaacaaayagagatctcagttgcagttgttgtagccgcggttctgattatacaactgagcctaccctggtcactggggtcattcaggctacaagctatgcctgccggcaaaaagaaaacaccaacaccagggggcaaatccctctctccactcctgtgtctgatatattgggtgccttctaagccctaatgagcctcactttgtacagtaaatttgctgagacatcaaaaagtatttaaaagaaagttttctgctttttcctaatgagctaggtgaggatttatggagtgtgggggaggagggaatct

SEQ ID NO: 372 - DNA, 600 bp, Bovine  MMBT05217
ttgtacggccctcgttcaaatgaaggccagcccaggagaagctagaggccatgagagccggaaacatcagataataactctgctaaatcaactctcagctcttatcagtatgcaaaaatctcccaggcagaaatggaggagaagaggtcaaaacatatgtctccactgacaatcatacatctggaaataaaaccaccttacaaaatgacactgattttctactagcccacacaaagctcctgaccacttcacaacagccttgtaaattaaagaaggtatgatttttccaatttagacatygggaaactgaggcagygagcagttacccaagtgttcaaagactcacagcygatgacaggttgagttgggtgaaaaaagccagggggcccaggtgataattccagcattcattcaatccctctgctttcagagggagtacaacacacggtctctactcttaaggtgcatatgacttaattagaaaaataagacrattacacactaaatcaaacagtgcagttgaagaaaaatcaccaatgctaagcatataccctttgcaccctttccaactcaaaaccatactccttttctgaatttacg

SEQ ID NO: 373 - DNA, 598 bp, Bovine  MMBT05343
  misc_feature (1)..(60): n is any nucleotide
nnnnnnnnnnnnnnnnnnnnnnnnnnnnnnnnnnnnnnnnnnnnnnnnnnnnnnnnnnnnactgttgccataagacctaatgttaactttatcccaggacactggagccaatgtttctgctaaaatgtaatgagacaagcgtacaaattcacgaagttcactcttgtccctacccctttaaagagtaaacttatatccaaaaccaaaggtgagcacaaccaaagcagctgatgcgatcacaaagtagaagggaccctctccaaaacctagttcccagcttaaagcagaacaggcacacaygaagattaatggctgtatttataattatttactctttaatagagatgaaaatcctgctctattcccaagcagactaaaaggcattttcaatgctatataagatctgtcctataatatagttacattacaacagaaaaataaattctaaaccttaaagcaaacaaatatattcttataaaaaaaaaaaatcaagtctgcttttaaagcaatgagcttacatatccaagaaatcagagtcacacaaaacgctctcaatagtgaataactaactcactgctgtcactgtatcaaatatttc

SEQ ID NO: 374 - DNA, 598 bp, Bovine  MMBT05456
  misc_feature (1)..(1): n is any nucleotide
ncacaccagcacatccacacccacattgcaagcagcatgatagaaaatggaagaaagatgggcctrttcttacattaagacacattccagagttgaacataccctcccatcatatgcaattrgccagctcttagtaacatgaccatgcttaatggtacaggaggttgaacaatgccatctttatactgaactttatattggacatcccatgtaatgtccaccaatcaagggttccatcactataagagaaggggagaaaagatactggaggacaaccagtattgaagcaatctctctctygacaaatagcaggttgaaattttagtgaataagattaggtaagaatataatagaattttctgtgaaggttgctgaacacagttaatttaaaatgtgagaaatgcttccaaatgtctaaaaatgggatagtgtttcatttgtaaatgagatgggttgagaaaagggatagttcatgctcagtctcagacttaatgtttatattcagaaatgacaaaggttaaaagactggactaaatgaaagtttaagggtctttcttgaggcagattgctatagtcaggattgtatgcttggcagaat

SEQ ID NO: 375 - DNA, 600 bp, Bovine  MMBT04892
agactttagagctagaagataattgagagattatttaaatcaattcccttcattttgaagaaaagtaaagtccagataagttaaatgcatatacagtgccaggaatagattcagatattccaaatgaaagtggcagccagacttacagaggagccagagtctatacagtcttacagctaaagaaaacatgcatacacacacacacacacaaacatacatgaggtccactttcaagtgttctttgttcttatttttatttaatgcacaaaagcactacgttttattgattcataaatatgyattgagaacataccatataccaggctttctattaaatgttaacaatacagtgtctgcccaagtatttgtcttctaaaacaaataaacctacatgacctgctttgaaataaaggttatattaaatcagattttatctatgccatgaagctatgactcctaattctcactaaaattataattctaaaggcatagatattgcttgaaatagtattttcagaaaattgcagtggatgacataaataaatagcatgccatgctaaagtttcctataagaaagagcagatcaagttatgattgcca

SEQ ID NO: 376 - DNA, 600 bp, Bovine  MMBT04522
caggatcctcaataatcacttgtttctctgtgctgggtgttgtatttggattatctgggttttgccacaaatttatgatgttggtagtgtgatttattatacccattttacagatggggaagtggagtctcaggcagacttgatggctcacccaaggggaggaggtggagccaagggaactagtgactgactggagtctggggaaggggagggagtcaaaagccacatgtatttctagaaacaatagcaggaaatgtacaaaaaggatgagttttgggaaatgaaacggttacagagtcygtttgttttggggagagaagcgtctagctcgttgatggaaatgaaagtgaggaactcaggagagagggtaggagctagaattctcataaataaatgatttttcttgctgcttaggaagaaaataaatgtagcatcccagcaggccaaaaatattagcatttaaatacagccttacacaggtggggaaaaagggcaatttccttagaattaaatcagactttttctttcctccgaggctcagaaaggtccattctgctcaagtgtggtcttcagagtgttgctccacgttctcagtgggac

SEQ ID NO: 377 - DNA, 600 bp, Bovine  MMBT04926
tgtgtgtttttttgtgtgtgtgtgttttttttttttttttttttgaagctcctcagtgattcwtaatgggtagccaagattcagaggtatacatttagcctagtcaacatagctcatagagcaaaaggaamcaaagaaggccaaccccaattaaagactcaattttactattgctattcattatcctaacagctatatttatgtaattactaaatgcaatattcttgcccatctgccttttcaaagaattctctggcacagcacagatgatacgaaacttttactgacctctccacaggygtaacacatagcagctaaactgaacaatttcaacaaagctcccattctgacatgctacacagaagcaatacaacacygtaactagtgccagcagtgataggaaatatcctaacacaacaatcaacattttcactgtggcacaacagggcttgttcttggccccttttctaatttgttttttattcatttatagaccaccatgatttttttaacaaccaaattgtatggttttattttctcaattgcgagtyaacctgaacagactattggccctaattatggacagaattaagaactgga

SEQ ID NO: 378 - DNA, 598 bp, Bovine  MMBT05447
  misc_feature (1)..(19): n is any nucleotide
nnnnnnnnnnnnnnnnnnntttattgagcacttatatgccagacactgaaccaagtcttcatatagatcataacctttgactctcaaaaccaccataaaatgtaggtcttgtcattatcttcttttatgaagctggtaacttgctcaatgttaggcaatgaagaggtgtagaaccacacaatttagttcaaatgtttgtgatttcaaactgtacttaaaaaaactatgctacaaagtacatgtagaatcagaaaaattcccccaaatattctggaataaaatgaaacagtgaaagaatgytgaccaaactttttttttctcagattaataagattttaaaacttacctctttatggaaagaagtagagtaaaaaattggcaaatgggaatttttctaatgataacccttttccctcaagcaagcagtgacttttcaagccaatatttactaatattgattgaaatctaaacatacagtaagttcagctgaaaaaggaagttttgccatatcaaagaactttaacacagataaagaagaaaatgattaatcctgggggaaattagaactttgatcccatgtttacctgcagatgacact

SEQ ID NO: 379 - DNA, 579 bp, Bovine  MMBT05176
tgttccatgtccagttctaactgttgcttcctgacctgcatacagatttctcaaraaatcctgggtaatttcatactaaataggggcatgtgatcgcttccttcttttgagctaatcatcccagagagggaatcactcctactttgtatcattccccagaggtgaacttcaacttctccaggaaaagtgagcacattttattaacctgcaccacatgaagtttgggaggttttttggttaatrgaccaacaagctgtcattgtagagaacaacttctagcctgtgggcctggataaaatyatagaaatggagctatcagggaaaatctaaaaagtgtggctccacgtaagaattgtacgtatggttctctctctctctttttaacatcatatgtgtttatactttcactaaatttccaaatgtgttaattcaaattagtctcctaagtattcccttctgtcggtagcatttggctgtacagtaaaatgagcagctgccacaaagcattcgctaatgctcccttcctcagagggagattagtacaaatttaaggtttgtggtaatccccacctgcagcac

SEQ ID NO: 380 - DNA, 600 bp, Bovine  MMBT04347
tcaccaacttccaagggacatgcaagagaagctatttaactttcagtcactaattcaataaagaatttcaataacccaacaaatttaattaaatgggaagtacagatgaaccatttgaacttaataccatcaatcttaaayttgttaaataagaaaatcaaactcattttcatacagaagaataaagggattacgatttagtatttgatcttcaaaaatgtttagttaatgttacagttgatggaaactgaggaaataagagattgtgaacacatatatccaaagtgctctaagacagayacaggtaataagtatctatgttacatattttatacaaggtgccgattttagtcattttctgttttatacrttccccctccccattgtctatatttagggcttattggttttttatttgttttagagtatgtamtcttgttgaagaaagacaygcaatgatttggcatgggaaagagatgttataatagtaaatagatttatgactagtaaatagtaactagatttattacaatttaaaaataaatgtgaagaggtgtaatatggatggttgtatattgacctgagaagcaatttccatac

SEQ ID NO: 381 - DNA, 600 bp, Bovine  MMBT05468
aacatcaacagcagcaaggagaaaataggtttgactctggtatgcttaatttattttatttttagcaattttctgagaagcactctgcctttgaagcaaatttctattagacggagattattttccaggtatcaattcagctaaactattagttccttaatggttctttttaaaaaactaaataattaaatttaaaggacttttttgaatgttccctcaaaatgtatccttattcatggtgacctttgtacatctgccaaattactagcataaaacacattggtctttcattgcattgaytcattttccttccttaaagatttaggggaactcagtgtataaatattttaaaattatttcctagaagtttccttggccttctagtgataayagattgcccttctgggtcaatctcattccacccataggtcctagataacattaaaaaaatacaatactctcagattgttaaaaaaaacaaagtcaccatcctatgtccaacacagcataagcactttctccttaaaccacacccattactggtagaataccatagtttgacaaagaaacaaataaatttaaatgcaccttatctccatc

SEQ ID NO: 382 - DNA, 598 bp, Bovine  MMBT05377
  misc_feature (1)..(99): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgtggatatatagtaaaagctgaacatcaaacgaaaggggcaaaatccatttaagcaccctcaaagtgcattaatcttgccagcatacaactgcaatgtaaacactatgaagggtaaatagagttggaaagattctctcatctgaatagcttataaatggtatgcctttggggaagaaactttgcctttacaggtaytrtgctacctttgcaatgcccctgagcttgggatagaagctgaacaaatagtcacatttagtaatcttgggccaatgctatcatgtgaagcatggagtctttaatcatgataatagcaataaatgctgagtaaatacacttctcttctcttttcccctttatctcctttagcaccccttgacattcttccacacctcatcccacacatggcatttcttgcaaacttcacgtttgggcaccacctgccacttataacagtaccactctgtcaaaatatttttagcagctgcaaattaaa

SEQ ID NO: 383 - DNA, 598 bp, Bovine  MMBT05332
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctacttaaatccacagggccccgggctgaggctgtaaccactgccatatgagttgtattcacaacccctcctcacatcagaattctgcatctgacaatcagttgcatcaagaaagaatttaaaagaagacataactgtcttccctcatatgaaaattaaaatatcatytgccgcaagctcaagagactacaagaaaagcaactcccacctgtgtgttgactcttaaacttgaatgtgcatcagaaacttggaagggcttattcagacacagattgctggcttcctcccacccccactctcactcccaggaaatcaagacgggaccttgcaaatctgtgtttcagacaagctcccaggtgaagctgacggaacccagagatgctacaactcaagacatgagaaatgtgatgacaaaatctccacagttcttaacaacaacccaggtctgtcaccatccatgtaactg

SEQ ID NO: 384 - DNA, 598 bp, Bovine  MMBT05115
  misc_feature (1)..(13): n is any nucleotide
nnnnnnnnnnnnnatttggtaaattattaatggaaaacagacccttttatagattattctcccgccagtgttattaccttcagtacatcaagcccacttatgagtaataaaataacacaaacaaaccttctggaaagggatctgtgaagaatgatctgctttttctttgcaatcatatacatacaaacccagaaacgctcgcttctctcagccaacgaaaacatttggtcatttctgctgttgaccacagtcctcgcggccactcctaaaaattacgagtcccgaattgccataacctaygctggttcagaaccagatcttccatttgtttaagctttcttgaaaacagaggtctcataatattttgggctttgtccagtgacgcaaatgtatcccgatattccccataatcccacctaaactgacttcctttgcggttacgagcagacattaataagacagtcggcaagcggccagcagcctcagccgcgggttcgccgcacaggccgacagacctaccggggcagcggggcgtcttgtgggccacggcggtgccgccgatgggtctcccgttgggcgtcacgcaccagcagtagcc

SEQ ID NO: 385 - DNA, 600 bp, Bovine  MMBT04625
gcctttttgttcctgggaaactacagggaatgtaccccccaaaatgttgtttttagaatataataataacaatgacatgtttattaaataaatttttctaatttttactccagtggagactcacaaaaacccaggatgatgtaaagggacagtgtcaccatcatcaccactaccatcatcatatttcaggtgagaaaaatgagattatgaaaggtcagcttggatgataagtacatggcaatgatgggaaatgagttccgttcatctgacttcccattcagaatataccaaagtgccctytgaagtacaggggagctggaagttttacacgtgtaataaaagctaatttaagggtatagttttacttcccatagctccatattctaaatttgcagctttcttactcttaaataagaaataataagagtagtaataataacacatcaattatctgagtttttattagacacccaaataaatgctgtccttataccagcttacagaatcctaaacattatgaagagtcaaaagctcagaaagtaaataacacgctgctgctgctgctgctaagtcgcttcagttgtgtccgactctgtgtga

SEQ ID NO: 386 - DNA, 600 bp, Bovine  MMBT05071
gttgtggtggtgaaatactgtgaaagtaggcaaaagcagagaggtcacatgtgaaaacttagttctaaatagcgctctcgtgcttccaaaatctgcatatagaacagaacctataatgttaaattcatgagctatttcccaaagaaattctgaactggatttcatgaaaatgtaaagtcagttttccagacaagatttatttatatcaaatctagcatttaaaaacagctttacaacttataattcaaaccaagttatacacgaaggtctatatttagatccccaagcattatggaagcycctcattttccataccttttgtcagcagccttcagtatcttaactctcttctgtcagtcgccttcagttgaaccccaacaaggtctgatgaggagacaccacattcatgaggctcagttcacagcttctgaatattaatgataaaactccaccaagttaacttgcagatagcaacgagcaacacagaaatctggagaggtgaaaactgctgatggtgctagaagataaataccaggttctccatctcattttttgagctgtgggagaattaagacaagagaggcggggaagggagggagt

SEQ ID NO: 387 - DNA, 600 bp, Bovine  MMBT05453
acagatgagcagcagctgttaaagatgaaccagatgtcaagggagcaggtctacaggcagggaagtcacagaaacggcagctgggccccaggaatgtgcactggatactgaggtggaggttgcctgaatgtgtgctccttgcatgccagaggcccgcccctggggtgcggagaatacaagatgctgggctctggcccccaagtccatgggctccacaggtgtgttctgaggcccagatatgcacactttttgaaagttcccttagtgactctaatcatcagctgggtttaagaatacctygtatgtttctcagagaggcarccaagctcagaccaagyaggcccactgggtacccctagaacccagaacaatggcaggtgggagctggggcagggctgatgatgactgtaggagaggttcctgtgcccactgaggaatgaggtagacatgggagagaatgcacttcaacagggtccctamaccctaaagacatccttagaaggcctttgaggttgtcagtagaaaacatgcaatcagyaggttcatcctgcctaaggagaagtgacagctttgggaaagaccagatgacaaactagaaaa

SEQ ID NO: 388 - DNA, 600 bp, Bovine  MMBT04333
aaaaaaaatactrtcccaaagagccttgggaaggcgcttaaatgttcccagtggtggagyttagccatgccaacagcagcaacagcaagcacagcgaaacatgmtgctgcctcctctcagtttatggggaagtggtaatgtttctacacttcagccacgcccttcactttgcccacctgtcatcttacttttagctcttygtcartaagaaattctgccctggttcttccttttgagttctggctattctctcttatttccctgtctgaaaactactgttgctgtaatgcactggggaaygaaaacttcaaagccctgatcttaaagaatctcttcctgcagatctaggtatgacacgcatggtgctagagtgagttggaaaggcacacttagtcactttctgtgatatctttgtagaatatattaatacccagagagtataattacagcatattttagatgtagaattaacttaggcattatagtgtgtttttgaatacacctcaaacaaagcagaagtatataaagaaatctgaaagtccatattcagcaatatggcagagaagatttgatatcctgataactttttaccaaacacct

SEQ ID NO: 389 - DNA, 600 bp, Bovine  MMBT04592
akaatgcgggctgcggcagctgctggtgacggcgatagaatcagataggttctgccctgcagtttgtaagtgctgcctgcctttcaaaggcagagcctccaaacagtacaggagtgaacaagtttgcaaaggaaacgcacttgcagtctgaaaaccagagcagctggatatccaactgtgtgaagaaattcagagggctcttcctctcccttaaattgatattactcacccccgttttatagagtgaaagcatatgcttaattcctcaacaactcagaccaatttccacatcacagccayatacatggaatactcgattccacctaggtggtgactatgtgacttttttgcttgggtattccttaaggaggattataaaccaatggctctggaggtgacattttttaaataaaatgaaatgtgttgtaaatacaattgtgtatgacactatgtatgacattccaggtggcaggagtggtaaagaaaccgcctgccagtgcagatgtaagagacgtgggttcgatccctgggttcgaagatcccctggaggaaggcatggcaacccactccagtattcttgcctggagaaccccatggaca

SEQ ID NO: 390 - DNA, 600 bp, Bovine  MMBT04883
gtgtcccccggaagggggcgcgatgttttcgaggttaacaaagctgcggggtcagctaaggtctccgctctctctccatccagaccagtcatttcaccaacgtccggtctccctggaggcggagcccttggaggcgctcggtgagacacaagctgggagtattgtggaagttcgggctagactctggtggccctaaaatacggctcagggtgcaccgagcaacccgccagttggttcatttgaccctggggcccctccgtagtctgaaaagtagtgccgcgaactcaacctttatggaayccaacacacatccccttgaaataggatcacgctgctaaagtaaaaattttgagcgcactctgtccaggatacttaaagtcttggttttctgttcactgtgaagataaaaatgggtcaggcatggcgctggatacttcaaacggtaaagtacaagaacgtccagatatttgcattgtgttctttacaaagtcgaggtggttttgcccataacaaaaatggcgtcgcaacttgttaacctggtacagtcatgtgcccaaagacctggatgggggacagtatggcttcaggtgactaacggat

SEQ ID NO: 391 - DNA, 600 bp, Bovine  MMBT05472
gctctttataaatacaaatgctagactggcaatataaaatgtaagtaagaaagaagaaatattagctcaaaaaatctctagtcaatgaactttacattttaaatcctagattaggttaaaacatatgaaatggttagtatgttgcaatttttaacccacaaaaatgccagttttacatagttctacctaatatattaaacaaaaggcaccaagtcctcaaaagtagatacaccagaggaatgtgtattatggaaattttggcaacacacacttcttcaaattttaccaaaagcagaaaayttgaaaggctaatcaggaggtctttcagagtcccccacgctggtgacctgctctccaggagcagaggaaacaaactgaaagtcgtgacaagggkagattaaaccagtcaggtggttcaggaaaatgcactcgggtacagtttctgcaacatgtcagtgctgtgtggatggggtatcctggaacttttgggaagatcacacaatcagcagagagaaaccaatccagacaaatccccctcattctcatccattgtcagatgcaactgcagccttctgccaggatggtgtggaaaaacagaaa

SEQ ID NO: 392 - DNA, 600 bp, Bovine  MMBT04681
aactatagaacattttcacaacccacaaactgtctgcctccactagaatgtcacgctccgcacgaatgtggccaacctggaggtacatgcattggattaatgacaagccttgctctgctttatcagactgcatatttgcttaaacaatttaaatactgttgagtattaaattgtgatgatgcaaaagatacagcttatgcttaggcaaacctacgaattcaaaattgacaacatttgacttgaaggtattcggtgatgaaaacctgagtgatgaaaggcttgaaaatggcaaaaatcaayggctttaatgcaaatggaaactttaacagtgctataaagtgaacctcttgattagttaaaattaccattcttttcatatctttttgttctaataattcttttttgatcaaagtaagtccccaagatgagactctaagcaaatcctgtctcaggtcttcagagacatctgtgaagacggcaccttgacagtcccagatgctgtgatgccacagtacctggtcacagctgtgcacacaggaggcactcagttctgactgaactgaaacatgacaacagctaagaagagttgtagattcattt

SEQ ID NO: 393 - DNA, 600 bp, Bovine  MMBT04670
agggaattgccgcgaggtcacccctaccctgctcccttacccttctgcagctgttgatatttctccacttctccctgcagcttcttctggattagctcagccatggcggggacgaaagcctgcgggtagcaggagaggggcgctgggtctcgctctggaaggtacccgggctcccctttctggcctgcggaggtgacagccctcttgagaggcagcccctcggggcacccactgcagtctctcctcgtccgggatatcgactcacccccggcctcagggartggcagaaccccgaactcytcaaccgaaccgctccccgwctcacgctctcacttcagtattgatgaacccggaagtaaatagagaatgctggggaaagacggcaccggaagctgtcatctgacgcacgccgggaaatgtagttctaacatggtcratgtgtggtgttctgctaaaaagaccagacgcggaaggatttaaggcaagatggagaaaccgagatgggaaaagaaactgcacggttgcttgggtcttgacctcggagtgcccgtctttcatcacttgggcataagttgcctcactggggtccttggtcccgcc

SEQ ID NO: 394 - DNA, 600 bp, Bovine  MMBT05226
tgtaagctagggagggaacaggatgggggagggaagcgggggtgggggggaaggaatgaggatcaagatgcttaactctagctgctgctgggagatgggrgaaagaagctgccacagaaactgtgcgtccctggggagtgacaaagctcaggaggaaatcgggcttgtttattgacatccagcttgctcattagcttgggaacacgacatccgcaaataaaggggagagcaggaacagcttcaaggctaagctctttccacaaacaagtatttgaatcaatcaactcagcctggatcccrgagatggagacagaaggtgtagccttkcggggaggggattgatcagggacccagctcccctgagggatgcaggcaatcacccctgactgcccctccctgactcagtctttttatctgaaagaatgtcagactcatgctctgccttcagggctggagggagagasctatggggttatgggaatggaagcaatttgccaaggcactgctcagtttggaagcatggagtgtgctgctggggtaggagtcacttccatcattgggtttcyctcgctgtcccacagccatgcacaccactccaca

SEQ ID NO: 395 - DNA, 600 bp, Bovine  MMBT03650
gtggtgtccagctcagggcaagtaagaggtgatgggggacagtgccaccaagtctgagctcaccctgcttgctgtgtgcacgcctgcrtgctcagtggcttcagttgtgtccaactctttgggaccatatggactgaagcccaccaggctcctctgtccatgggattctctaggcaagaatactggagtgggtttccatgccatcctccagggkatcttccccacccagggatgtaacccaagtctcctgcactgcaggggaattcttggcagtttctttaccttttggccagttaactragagacaaggggttgaggcaaggaatacgaccttattcggagagccggcagaccragaagaggtcagactaatgtctcaaaataaccatcttgtcatcactctctggatgccactttcttttatagaacagagagggagagaaggggagggagtaaagtaaaaaggccattagtcttacaaatatctcctgaaatggccaacatcagggaaggggtgtgtttatctcttccttcctgtagccactcacaggtggacagggtcttgaacaaaggcagtttggttttaacattcaggcagtt

SEQ ID NO: 396 - DNA, 500 bp, Bovine  MMBT04605
  misc_feature (1)..(1): n is any nucleotide
naagactcagtagcaaagyrctagaaggctgagctgatccctgtctcttttttgctaacaygtaagtagaagtgaacatgttacttccagcatayaggaaaaccaccgagtcaatatctggatggraaacagaccacagacatatgcccagtggctctgttcacaccatgggcgccgatcacagagactgtaatagaaaacaaaggctaagtgacctaacttgacacgtggcaagaggtgtctgacttctcggcgcgccagtctcgcttaagaggacggtgccagacagtctaggaattcrtggcagacacactggcagaagccatacaccatcaggatgacgaggctggaggggaccaggctgacgaagacgacccccagtgtgaccttcttggagaccagtaagtagatgcccaagggcagggagctgaagtacagcaagcccagcaaccacaccagcacccggatggatgtctaaagaccaaggacgtgcagttcca

SEQ ID NO: 397 - DNA, 600 bp, Bovine  MMBT04206
gctgagatggttagatagcatcaccaactcaatacacatgaatttgagctcaaactccagaagatagtggaggacagaggaaactggcacgctacagtccatgaggtcacagaatcagatatgacttagccactgaacatgaacaaataatgtatagaccttgtttggacctgattcaarcgaactaattctaraaaagacatttttcagacaggcaaatgtgattatagattagaagataaaaaaataacttaaaggacttccctagtagtccagtggctaagactctgtgtttccaaygcagargacccaggtttgatccctgaacagggaactagatcccacattctgcaacgaacagttctcatgttgcaactaaagagctgcatgccgcaacaaagactgaagatcctgagtgctgcactaagactcagcacagccaaacaaatatttgtttctaaaaattgcttaaaaccgcttatccatttatatttttagagatgtrtatttaaatatgtgcaatgtgtgaagtgtgctttaatatactaaacagaaaaattatggaaagaataataaatgaagcaaatggaataaaaaatc

SEQ ID NO: 398 - DNA, 598 bp, Bovine  MMBT03436
  misc_feature (1)..(152): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaaattagagatcggagcatgtcaagggtgatataagacatttactcaagatgtttccttcgtaaaacattcacccctacccacattctgctgtagccacctccacccttccaacttcttttaaaagatttgtctctgcttcaygtctcttcatcctcatctcatattcaactctcaacccactgcaatctggcttcagcccacattattctactgaaactattcttgacaatttggtatgacctccttttttgttacatgtactgggtgtattccagccttcatctttactttctttctcaacacttttgaccctgttgacaattccttctcttatgtgcattctctttacatataatttgtgatattttatgctttaattttccttccacgcatgtggttactttttcatagtcgtctttctgggttccttcgcctctgt

SEQ ID NO: 399 - DNA, 600 bp, Bovine  MMBT03292
cacccagagcgagtccccgtcctgggctgtagccaagtccccccactgcttggccctctgtgaacagggtgtgctggaaccctgtttccagcctgcactgtaaggagttggtgagaactgatgttaacatggatggtggaagcagctgattacgtgaatgtctccacacggggagccccgagtcaaagctctcatgcacattctcttagggccctagcaagctaggaaagcagtattaccgtcacccacatttcagagagaagacagaaggggctcagaagttaagggacttgccagagycacctggctcctgcaccatggaacctggatccgagcccaggtctgccccatgacacctgcactcacgccccaggtcatgtagtctcctgggagatggagtggaaggttctttaaaggattgagcacctccttgcccacctctcctgagtatttgccctgagtatttgtaggtctagctcatgctgagcagaccactcagatgggcagggggactctagactagggaggacaggcccagacacaggttttagacaacagttttgttaatttcaggctgaactcaagacmgstgaggctctc

SEQ ID NO: 400 - DNA, 600 bp, Bovine  MMBT03486
agtaagggaaagctgatttgctatatgatggttacatggttgtaaatttctctggatttaaggctcttgagtcctaaatgctgtagaaatcctgccactcaatcccagtctttttgtgtgagagaggtcagatgtagctggactgaagtgtgtctgtactgacttgggatgtgcatgtgtctgtcaagtccctttaaggtcaaggtccttcccacatacgatgccagcaaagtgaccgccagtggccctggcctcagtacctacggtgtgcctgccagcctgcctgtggagtttgccatygatgccagagatgctggggaaggcctgcttgctgttcagataacggtaattttgagtgatttttctggagccagactgcrttagtaagatctcatttctcagtcagggataagaatcagattttaacaaccaattcccgatctcacgaaaatgtttgtcagatttccccactggagagtcagtaattgtgcagggaacaaacatgctcgcctgagraatctaaggggkttaactccaggcaccactttttgctccctagtattttgtatttgtatttgtattttgctccctagtataact

SEQ ID NO: 401 - DNA, 600 bp, Bovine  MMBT03663
agccagatggctttgtcatcttcattgataaattgtttccctaaatatatgcatctgagaaacttatttgcaggagaaccaggaggctttcagaggctacagcgtcccatctgctcagaagccagtcaaccgggggaatctgtcctcctgctcactctctcaagacagaactttctggaaaacatgcccttgagttatcaacaaaaccagaacactgagtcaaaggcaatctgcatcattacattactaccctgggtcaccatcggcatgtcagaaattgaacaagctgtggctgtgggygctgatggagagggtctctgatacacatagtcatgtatgagtgtttgactcatctttcctaggctagtgaggaaaatctcctcttctgattcctcttggcacaaatcctctactctggcatgcttccctacctctcccttattaaaatcttcttcttgacccacagaggtagggactaccatattacgctgtgcaggtgcaataaaatcacacagttargagcctgatggttgagatgcttcataaagaatgacaactattatagtacctggaggagatgcaccatccatcatgagctga

SEQ ID NO: 402 - DNA, 600 bp, Bovine  MMBT03272
tgaccccatggactgcagcacgccaggcctccctgtccatcaccaactcctggaatttactcaaactcatgtccattgagtcagtgatgccatccaaccatctcatcctctgcyatccccttctcctcctgccttcaatctttcccagaatcagggtcttttcaaatgagtcagttctttgcatcaggtggccaaaggtggtgtctcttcaggcccccactatggctgctataggaggacctctccagtgtttatccccaacccgagaaacacaagggtctgtatgcacaacaagggctygaatggcagcgatgctcagctcarggatttaccttcatctggatttggctctgcaggcagaccctccactgagactcactgggcaggacttccggatcctccactagcttcctggtctctgtcacaaatctatcttggtctccaaccaagtttgtctgaactttccccaaggaccctctcaaacctctgtgaccctgctcttcaccttaacacccttcttctgcttctgcctgatgaagctccatgcccccctcaccccaggggaaaggcttcccttcctttaataaccctgtttagaag

SEQ ID NO: 403 - DNA, 422 bp, Bovine  MMBT03492
ggctttatgagtaatttggartattttaggagagcagaggcctgcccatttgaggaaccaccctccccctaaatgggggtatgttctgactcaaaggaaaattaactcctgttaactgtgggtctttaaaatttcctcttaacgcctcagcccatcaactcctgctccctgagcagwacacacagctcggcgggaggggaggacttggctttgggtggagcagtaragtttcattcattcaaaacaccaagtcatttcttagttttgccaagtatttctcatgtatgtsgggtatttaaygcttctaagtctctgtttccggatccttttttttttttttttttttgagtaataatagtctactttgtagagttaaaaaatgaaagaacaagaacagtgtgtttcctagtacataatctgta

SEQ ID NO: 404 - DNA, 600 bp, Bovine  MMBT03257
gagggaaactaagtaccgcctcatggaatcagatgttctgattgtgggcatgcaggtgtttgagggagggaatatcaggactcttcatacatacacttgtgtgaataagctattttactgaggcaaatacacttacagaaaagtgcacatatcattgttgtacagcttgatgaattatcacagagggaacacaccccatggaactaccacccaggtcaagaaagagaacattaccatctttacaaaaattgtctactcatggtttttaacatgcttagtttcttaaatgaatttgtatcyttttatgtatatatttaaagtcaaatgtggtcagttaaaatgtttcacatatcaaatgagaaaaaagggcttgtactaaaaatgagttcaggaaaacactttttttagatccataaaattccctaaatgtgagatattaaaatctgaataaaatcccgatttcaaaatcataattaagtcctgaaataagggaaawgtttttgtgcccccmaaactcattggaggtttagttgctaagttgtgtctgactcttgtgaccccatggactgtagcctgccaggatcctctgtctatgggact

SEQ ID NO: 405 - DNA, 600 bp, Bovine  MMBT03460
tacattttctttctttcttgtctaattgctgtgtgtcaactttcaatactattttgagcagaaatgatgtgaatgggcatccttgttctagatttagaaagaaggcaaagtgcttttcactgttaagtgyyayattggctgtgggtttgtcataaatagcttttagtatgctgagatatgttctctctgtagtcacttttgtaacagtttttatcaggaatggatgttgaattttattacacggtttttctgcgtctactgagctggtcatgtcactcttgtcttgtttgttgttgatgyggtgtatcacattgattgatttgcatgcactgaaacatctttatgagcctgagataaactcagcatggtcatggtgtatgacctcttctatgtgttgttgtatttggkttgccaacaactggttaagaatttttgcatctatattcatcaaaggtattggcctgtaattttctctactggtgacacctttttttggtggtggtatctttatctgattttggttatcagagtgatggtggctacatagcatgtcttggggaggtgtttcccttttcttcagtcttttggagaagcatcaga

SEQ ID NO: 406 - DNA, 600 bp, Bovine  MMBT03099
atactgggaacggtcaccttggcttggagacagatgtgaactggtggccctccaaccacctagggtgggcataaaattgctgttaccacatagcacaggcttggaggaagaatcgtggctttgaaatagctgggatcatcacagggtggtcagtaagcagtgctggaagctggggaggatgagctggacccagtggcgcgtcttaccttgatgggcagaatgacctctttgttgccaacagaaacattgcccccttgtgtgtcgaatcgcacttcaaatgtttccgtttcacagtaaggyagattcttcacacgatctagctcaatactaaagcctggaccaagacaaacaaaacttctttgtgggaaggaaaagtagcaatcaagagctgctctagagagagcccatctgaggcaggacaatccctcaaagaactgactaatagcccaacacttctttcagttgatcccagaagaaacataaccacctctccaggacagtacagctgggcaccttgtcagaaatgacagcatacaataggaagggtctccagcctggtcacctgtgtcatgaaggacacgcttctctgcatggaaggac

SEQ ID NO: 407 - DNA, 600 bp, Bovine  MMBT03171
gcagcttctgccttggacacttgggcccctgagcctcaggtraaaaatcctgactcttcttctgggaagaccacatgggtacatcctgaaactacttagagaggagtaggggctcagtcatcccattccagctccaagcttagaagcaaattcatcatagatcgtccagttcagcccagctcccacctgagcaccatcaagcgacccaggtcagagccacatggagcagaagaacagcccagtcaagtcctgtccaagtttctgactcctaaaaatcgataaaaaattggtatctgaggycataaaatttgggggagtcagttaaacagtgactaaccgaaaaagttataaaggtacaaatcttattatcctagaggtgataaagtttgaaatgagcagtaaacagagccacagacagaaaaaagaaacttatgattaccgaagggaaaagggagggggataggcgtaaattaagagtttgaggatctactgtataccacagggaagtatactcaatattttgtaataatctataagggaagagaactcgacaaagaatatatatacatatatatgtgtgtgtatatatatatatatata

SEQ ID NO: 408 - DNA, 600 bp, Bovine  MMBT03662
agagatctctagctgttggagttgctgattggaaaagtgggtttaaaatacttaatacatgcttgtcacatttattgttatataattttttttaagaagcttttctttatcttgatttgttttctttatgttccttttggatttgatagatgactcagaaagatatcacatttgttgctgaatttcttactgaacatttcaatgaggtaggaaattggcatttctatagtgctttttcaacaataattacaataaatctggacaatggtaagaagtaatcaaatttaatccagtttaagygaccttatagcaattatgtatgctttttcaactactgaactaattaatggcagtacttatttattaaatgtaaagcatataaattgaactttgtttttgtgtcttaccatccacagaagaaaagagtaactgctactaacagctttcttaaaaaatagagtttttggttaaaatgtaagatgatttttttctttaattaaactttatttattctttctaggctccagatctttataatcgaaaaggaaaatactttaacgttgaaaaagttggtcaggtatgggctctggattgaatgta

SEQ ID NO: 409 - DNA, 600 bp, Bovine  MMBT04249
ctgaaaacagtagcaaatgattccttatacttttaaaacttcattaagcagttataaaaggtaaagacccttttgacccaggtataagacagctactcccagaaatcagggacaaaattatgttcctggtctaaatgactcaaataaatgtcttcgcagtatgatgtacttttaaattagatatgtactttactaacagttacatttggttaagtatgtatgttccatagtctagagactaatttttaaaagggtgaagtataccctacactatcattttttttcaataaaagtggatayttattagttcacttaatcttacttagttaaatctttaaaatgagctttaatttcatttttaaactcaaacagataaaagcatgtgatataatcatgaaagtraaaaaaattcagtacttctgaggtaaaatgtcaaatcatttattatataacttcaagcagctttcttttgaaaaattaaataaacccgtctaaaatgcctcttacaattataggcacatgtggtattactatataagacttcctttttgattcttatccaattctaagtcttttagaaagaggaaaagggtatgcatt

SEQ ID NO: 410 - DNA, 600 bp, Bovine  MMBT04231
agattttacatgcattttaaagtatctgctgtctttgatacctgaaaataaattgttacaaaagttgtcaagatctatgtttcttatcactaagcaaaatcataaatacctttcagtcagtcatcatgcagtcttattatcttggtactaatcaatatgcatgcattcacaggccatgaatttacatttwtttttgtagaaacataactacagtgattgtcaggaggagctacattacttgactattagcaaagagttatattacttgactactctgttctagcaatcattgttcacatytaatgaatttacttatrtaagaccatattacattattgtcatttgaatgtatgtcaatattttctactctgattaaaaccagtaaagattaagaatcctttgtttgactcaaatgaacacatcatgcccagtggatcacttattgctactattttaaatagagaatttacttgaaaaatacctagaattctaaaaattgtttccactatggggtgtataggccacaaagttcttcagatattcattgagttatgagaaataatgtaggatgagctggtcatatcatgagaagtgctttta

SEQ ID NO: 411 - DNA, 600 bp, Bovine  MMBT04203
gatattcttctcgctgattggaagcataattgtacagggtgaaaataactgtatccataaatttagttgacttgttctgtggcatctggaaaatcagcttagccaggtatgaaggattggtctaaagagagaagacgaaacgccccccacaagactgtatgttaatatactattaaagcagagaggacccccagttctttattctttaatgaattcttatgtatgaggcacacagaagagtatctggctcatattaagacaggtagcagctaacaacactactatgctataggaagttayaatagaaagttatggtaggatttaaattttatatactctatcatgtcatattttatggactataattacattatgaatattttatactgttcaccatttgaaggcacatattaatatttatcgtagagacaaagaagagaggggggtggctgagctatctgaagagactggcaagaatggatcaagggttgagctatagagattgtcttagaaggactgatgaatgaatcaacacagtctatattctgagactagaaagcaaaagcaaagggtatgagacagacaatgggatggccgtaa

SEQ ID NO: 412 - DNA, 600 bp, Bovine  MMBT03896
catatgcctcccaggtttctgccacatcgggaaattaacagtaaaaaccatcatttctcaggatgtgtttggacttactttgttacagaggaaaagtaattctaatttggatttgctataaacaatctattgtctctttttcttcccaaactatcaacttcacatcctaacatttttaacaatgccgacctgagttaatttccagacttttacaccacctttggctggacacgtccctttcactttggtgccaacacacaatttggccttccataaaggtagcatattttcttttgaagytggagttagccggctatgtcagaaagcatgtgtatccattcttccaaatgagagacttgtatcctcagtgaagagggtcccagagtgagccagtcaagttgttactttgtgtgtgccgatggtgatggtattagtgtcagtatggaagatgacttacctttttccaggtatgtatcaataaattggattggggatggcygagtccctttgttgttcagactgaaactgtcacaacattgttaattggctatacccccaatacaaaataaaagttaaaaaaaataaaaataaaaggttaat

SEQ ID NO: 413 - DNA, 600 bp, Bovine  MMBT03998
tttaaaaaataatctgacaagaacttcctcatgaaaaagaagaattatatgatttttatcctagtttagatcctggttttgactgattcttgtatctgttattctatgtaaagtatttaaacatttataattttgattttagttcatttgtcttgaccttattctaaagcaggaggatctttttcttctccattcaaatttctatattgttttgtggtcagttactactgttgaatagtaaatcactctcaaatttagtatcttcaaaccatagaaagttattattttatgcacatctayattaatttgatggtttcactaactggcctgggcttgtcatgcatctgtggtcagatttctgggagctggctgctctggaaggccaggctggattgcaggcagattctttaccactgggccactggggaaacccaaaggtcaccatacatgtagcaaaaaatgttttggtctgccttctaatctgcctggaagatctggcagattctggacctgctcggagttgtatggtctcctgtgggcttcccagatggagctagtggtcaagaacccgcctgtcagtgcaagtagagacagacatgt

SEQ ID NO: 414 - DNA, 600 bp, Bovine  MMBT03886
tctttaagtggcagggttaccactgagccaccagggaaacccaaaacagtttagcgagagatattaaatctacccagcagattgtaaactattgggttagatttgtttgctggtggtttctctttaagaggttttagagattaaatgaaaaaaaggaaaactggtattttcacacttctgttgtagaagaaatgatggcattatagactatgaagaatgattttcatatggatgatttttatgatgatacttgataaaatccaagagcttaatgctgagttataacacagtaaattccayggaaaatgcattgaattgtaagggagactgtaaatggaccgtattcagctagcaaggcaatcaacatatccacattattttcatacggtgcatattccatcatgatttggaatccacatttgaaatgcaragcagaaatgagatataatatttggaaatggtacaaaaatcttcatatgatttagtcattagatttcttttactatttaaaggatcatgactatattctataacatgaattattacttctggtagaatttatagtaaatatatgcacctgttttgaactgaaatatcaat

SEQ ID NO: 415 - DNA, 600 bp, Bovine  MMBT03846
cttaatctgtgcccaacattgcgcttaaratgctttacacacataacacagtctttataacaatcccaggaggaaagcagtatttccacttaacacaaagaaattaagactctaaaattaagaacctcctcaaaataaaaaagtgacagtggtctaagagaaaagccatgtctgctgactaactccacagccacattcttagccattcctgggtttatcttccaatgtccggcacataataggtgctcaatagtcaataaatgagctgagaaagtatcttcatggaagttaagtgatctygtgttataagctaaatgaatggtttgagaggaagaactgagatccaaatattcagatgtaagaacatcaacagactcacctccaaacagctatcgactgcgccctgccaatcagacatcttcagtttgcaggcgccaatattcagcacgcagctcaaagcgacaggctgcagctttgctccatctgcgtcctcagcagcagccctggaaccttccacatacctagagaacacccccgtacaagcagcaagcaacaccccattaagacactctgcctgtgactcactcataactcgtcagt

SEQ ID NO: 416 - DNA, 600 bp, Bovine  MMBT03686
agctgaactcatgcagagaaccatatgtcaaaactaggcctttgtgaataatgcagtctgtccacagtaaagcctttgtcgtggacaaatattttaaagataattccagggttcaaaaggcatcttaactcttactggacatgaacaaaaggtagacaagaataaattttgagagtccaaaaatattgtttcatccaactgtcatgcaaactataattggaaacttcaggtttccacaaaataacatgacaaattttcctacatgacaggattgctttactgttcttcctactccactcyactccaagtgatatgtattttgatattaagaaagattcttaggataataaagggaccttacttttctctggagtccttgctaaatgttagcttatgcctagggtagaaaaaaataaacaagttgaaaaatttgttccaatgagatggaaacatttattgtaagagacttgaggctttaaaaatgtacttgaaagatgtttgaaaagctctagcaaccattaagacttttgtctgatttcaggggaaatattgtagattttcattcctgttttaaaataaacatacttcatttaactgatg

SEQ ID NO: 417 - DNA, 600 bp, Bovine  MMBT03568
aatgtcttagtatctatccatcagcaaagtctaaactaaattagacaaacacaatcttcaactggaccctagggcagggacagcacctgttcagaggtcatgaagcctggccctgcagcgctctgttctttttttcctggctgtggctggctgcaaccctgctgatgggagccactgccctcccagagacaggcagtcttgtgtgagactcatctagtgtcatgttacatgaccgtgtagccacacaggcgggtactcacttcctccaccagaggttctaagatgagaaaactcacaggytggtgactctttggggagacagtataaatggtgtccaagactgagattgttctcttaatagctgctttttggaaaaaaccatgagcycttgcttagaatacaaggcctgggagtggattccttccctctagagtctttcatattgaagaagattaacctgacccaccaggactggccttaaaccctcctacatctgccttcaggagggaccctgggtccttcctcagtgaaagagacttgagaagggacccctatccctcacttgcccctagaaaagccaactgggatatttcatttatt

SEQ ID NO: 418 - DNA, 600 bp, Bovine  MMBT03301
tgattttgaacaaataagtcacttgatgatcaattcctcagagaaactcaaagaaaactcagatgaaggcagagaaaatgataacattcctcgtggagtctggagtaasaaaagtgattyggagacaatacctccagctggcaatcacttgctggtccattctcaccataaacattcagtgagtattaccatgagtcaggctgtgtcttgggagagacaaagcccttgtccttactaagcatacattctctaagaagacagacaaggagactaaacaaataaacagggtaatgacagacyctgaccagtgcaacgaaggaagtccacacgaatatgtgccatgcctgagagtcgataaaggagtgaggaggacccagaagaatgcccaggaaagacctctgtgcagaagtgttagctgacacgcgtcacgggaggaagggcacatggaacgacattgtaggcagacagagacgaggtgcaaaggccctgaggcagggcgaaggggggggtgtttctaagaaaacaaaagacaatccgtgtgactggcgcataattagcagggtggaaagagtgggtggagctgggattggaaagtagagt

SEQ ID NO: 419 - DNA, 600 bp, Bovine  MMBT03534
tggtaaagaatctgcctgcaatgtgggagaccagggttcaattcttggtcaggaagatccctggagaatggaatggcaacccactccagtattcttgtctggagaatcccatggaccgaggagcctggcaggctatagtccgtggagtcacaaagagttggacacgactgagcgactaacactttcactcgcaaagttttctttttatgttcttctccttatggtgtcattatcttaaagagtgctgcttgctcagtgcaacctttgctgagatctcattacctttgtaattaagctccytctgtgtttgtagctctcctcactcctgaaagttgaaagaatacaagacatcctacagtctgtcagcagcttctcactgttttgacatcccctttccaaggtctctttacccagtgtactcttttctaaatatattactttaactcattttatctctactagctagccataaatacctttctgtcctctgaaagattcccgctctgagtcataccgcccactcaacatgtctttgttgagtttttatatgtctctctaaaacatgtatctcccaataaatattatccaatttgtgattta

SEQ ID NO: 420 - DNA, 594 bp, Bovine  MMBT03203
ttgaatcctaaacatgttaacagtgtttgttatttaaagaatctggttaatttatttttaaagaaatatatactttttaaaaatgaggaaaattgatattcattataattttttgcaaatttaaatttatttcactaagtagaaatagatttttaaaacaatcttggatgcctttcttttgattatttccttacatttttacaatagttattttaatcctcwtatttaaattataataagctatgtaagaactctggtatctggtatctacagacatacaaaggcttcatgtttgccacygtggaattctgcatttctaagcctcattacctccaagtggactctggctaaactkgaatctggggctttgaaagagtccgtagaagtgcaatgcagccctttttcttattcaggaaggagtcatctttactgttgtcagtcttattctcctcctcctcctcatcattcatcatcacttgctggaaaatcttgacagtcaaggagagaccacttgcttattatgccgcattctctatgtatacactgtcctttccaaaaaatgttgacttacaacggtcagatgagtaaacaagc

SEQ ID NO: 421 - DNA, 600 bp, Bovine  MMBT03266
gactagagacagacacaaacaattttcctgaaatgctgttctgggccatgtgagtaatagctgaaccaccaagggaagcatttttagaacatcacagaggggatagtcataggcccaagcctttaaaggactgcattttttagaaggtcaactgctttttccctggagggggtccttctaataagggagtgtagaaatggataattaataattgtgatactctgaaagtgacctaaaaaaggaaagagtttacacagaatgagcctcttatccaagctatggctcttgcctctctgcttygctctgatctagggaagaagtgatgcttagctcaagtttccagaccccagtttttacagtccttaccaacctacagttgcatttcattatcaatctaatttatagagctgagaatcacattttatcaggataccactacatgagtggaaatgtatcacaaattccttttcctccattttgtattttcaatattctgtattaattaccaaaatcttttcatcaggacaaacatgtgatgtatttgtgcatgtgccaatatcaagcacatacctggtgtgtaccagcttaattagaacaaaa

SEQ ID NO: 422 - DNA, 600 bp, Bovine  MMBT03459
cgcagcctaggcgcagacccacgtccactgtagacgcacccacacagaaaacctcattgccagggacaaagccccagactctgctgcctgatctaagagtctcactctgtttcctgatgtatgtactttgcaaagtagccccaagaaatacatttaaaaaagagagactctctggaaaacaacaacaacaacaacaacaacgaaagaaaagcttcatacattagcgagcacacaatggttctgagaagtcctgcagttaaaatcaaaaatctgtttggcgtgtaacccaggccttcccaygttcattcaccataggaccrtttctccaaaatatctataaatatactgaaaaaagaatattccagggaaggtatctttggaatgctccggtttaactcattcagatcctactcaggtagctgtttgtttggttgtgctgattgtcatcagaggaactttgtaaaggtagagcattttcctaagtccattgtgatcaattacatcatgtgctgaactgacaaccaaaattctgttttgccctttaacagagaaagcaacccagatgagaggcaacagtgtctctttaccctccaaaaagcc

SEQ ID NO: 423 - DNA, 600 bp, Bovine  MMBT04132
tattggcgagctctcagcgttggagagctgtgactttagcatcctagacgcaggtctgcataatggcttttcggtgagaggaaacttcctccgcttttaatccagtaccgtctcccctgcctcaaacctgaccatttaggtgcttgtagtcttgccgaagttttataaattctgttacctgttttttgaggaaaagtcttgctcatgaaacatctttattgtttaccaggacatttcctatatagccccacagtgaattttagaaattccgtttaggaaagggaaacacgattttggaayactatttttataaaaacacaagtgatcctttcagatgyccagacatattcataattacattaattatattcagatttattggcaatgaaaagtttaccttggtaaatatgttatattttaaaatgtatttaaatttatactcagtgtttgtggagctttgttaaatttcatttatgtttcagtgaggggagaggaaaatgttgtcagaagtgatttttaaaattctaatatattggatattatcctattattgccacatactgtactgtcagagttatatataaagttcccatttttcct

SEQ ID NO: 424 - DNA, 600 bp, Bovine  MMBT04152
gatgatattttgcactgcctcattgcttctagcaaaagaatgagaaacatctaaatcacaaagaagaatgaggaatgatacttctccactacaatgtcttcaaggaaaaaacacaaaggttacaggaagaactcttattcaggtgttagggttaacatcaacttttctgacattgagaaataaggtgattagaccaggtataatggcttgaagagggctgccttgggagacagttttggtaacattaacttctcaatgcaaattattaaacatttccattacccttacccttaggaaaaytcatttatccaacaagaatcttaagcttataactccaatgcctcattcttcacttcatacaaaaacaaaacctgtccatgcctttgaaatagttcaaggtaccctatcatattaaatagcatccacatttttaactcagtctcctttccaaaaagtttaatctgagtaagcactaaccctgggatacaaaaataatttgacaactgagttattctgtaagaaatgatatgaatatttatgtttgtttgtttgttttttacttaaaatggataaacaagcaaacatatctcctcagttgaa

SEQ ID NO: 425 - DNA, 600 bp, Bovine  MMBT03653
gaacccaaatcatcctctgtggagattggtgctattcaccaaaccttaacaagcgcgttatgtcctctgagagcctggcaccgtcagcccatcaggagggagagctctgtgtttgtcataactgcttctcgtattcagtatctcaccagacacagtcttcaatggcctcagcagcagtgggatgtcaatagaaggctttgtggatgatccaggagaatcaggaagacccttgtcctggagacaaagctcagcctaatacttctagaattgctctcctggctgccattttcaacatatcgyttcaatggttatagctccccagtggctcccctgtttcttcctacattcaatggggacctctgaacactgcygcagatttgatcctatcctcccgatcgtcagattataccctgtggccagccttgcagtctctccttctgcatatcccagccaaggggcctcacaagccaaggaaaaactatttcttcttctccctaagacaacactgatctctttctataaacctgtcctgagaaactaaaattaatccagtctgtgtaatctcatctgccatctcacaactgacttttaatagtgtga

SEQ ID NO: 426 - DNA, 598 bp, Bovine  MMBT08540
  misc_feature (1)..(13): n is any nucleotide
nnnnnnnnnnnnntccaatggttctgtagggagaggcctcacagaagggcacctgctggctcaaaacattaacccgagctgggaacatgggctgagcatttgccccagggctgctattaaagcactcttggccactctcagctcctcctcggaaaacaaatcgccgagggcactgcatctgagcttaatgaacagcagtgctcctcacttgactgagcgcttctcagctgaacaaaaacatcacacagctccccagtggtcggcttccaaaggctggaggctctagtcggcagtcccgcrcttttggcttagtaggttaatcttgtatgtacatacttttcttttaagaagtttaaaacatttgacaaaccttgctttgcttctagctcctcctgggtaagttgaggccgcttctcctcaacaactacacagggtggggcaactgccgggttagtgtttgtagcactactagaactttcttggccttctttgctttcttcatcatcatcactgtcatcatctagcttaacacgatttttttccaggggaagtagatcattttctttggccttgattgcaaagcttattggagcaaatg

SEQ ID NO: 427 - DNA, 600 bp, Bovine  MMBT08534
taaagcaagcagaggtgagaagacagggatgcagggttgatggacacctccatggaccacagtggatcctgttactcctggattcagtcaggatccctgagtgtgtgccccacaaaaccacactaggggttacaatgcctgatttgcctaaagagggtgctgttacccagcccctgccaaaagttattctaaaatgatgaaggtrcaaagtagcagaatattggatttttttcaagaaaaggaggaagtcaaaacatttactttacatttcctggttttttaagtatggcagtttaaatrattcaaacactgtrtaartcaamcacatatctgaggacaaatttggtccacatgccaccagcagataacctccacccaacatccatcatcttgatttaggacatttgtgtcctggaatgtctttctgctgcagctgaagtttttttgtttgtttgtttattttttgatatcgcattttgttttactatttcamgttctgattgacttctatatgtttcctactggttttactttaaagcaaaaatattttacatatggctaacatttrtgcttttaaaaaacattaaagacttccctggt

SEQ ID NO: 428 - DNA, 600 bp, Bovine  MMBT09539
tgtgagggcaatgaggtgttcacccctgtgctggtaaaggcaggaagagtttttggtgttagaatctcagtaggcaagagtgtttcatggctgagtaatattccatsatatatattactcagccrtaaaaaggaacacgattgggtaattcgtagagatgtggatggacctgagtctgtcatataaagtgaagtaagtcagaaagagaaaaacaaatattatatattgatgcctatttgtggaatccagaaaagtggtacagatgaacccatttgcagggcaagaatagagctatgcacrtgtagagaataaacttgtgaacacagtagggggaagaaaagtaagactgatatgtaaaccttaccatgagtaacatagctagctagtgagaacctgctgtacagcacagagagctcagcccggtgctctgtgatgacctagatgggtgggataggaggtgcggggagggagtttaagagggagggaaaatatgcatgcatatgactgagtcamttcattgtacagcagaaactaacatattataaagtaattatacttcagttttgttttgtttttttaataaggaaaaaaaaatttttt

SEQ ID NO: 429 - DNA, 600 bp, Bovine  MMBT07927
gctgtggtggctgaaactgtgaaattactaagagataaatctcttttgctctaagccactggaattctaagcttatttgttactgtaacataatcaatgtacccagactaacacagaatagcctctgttttccaggaccacatcaacttaaaatcagcaaatcttgagatcctagatagcttttctctgacctctagaaccttactaaacacatatgtatttgctgaattcatagttggagaatcctgtttcctcagcataatacccagactcctctgtctggactcagaaccctccacratcaatctttgcagctttatctcccactacccccagaacagctaaatttgctcactcatccccacatgcttttcattttttggacattcattcttccacagcggcacccactctttcctggggattgtgcaggtgcagaaatgtccaccagtcctggtctccctgccctggtggttcccagagtcccagactttggtcacaccacttctctctgcccaaagcatcatttccaccccctactgcttatttcagtgactaactatccttgcagacacaactcagaccctacttccttctgct

SEQ ID NO: 430 - DNA, 499 bp, Bovine  MMBT11117
  misc_feature (1)..(1): n is any nucleotide
nacatatgtccccttcctcttgaaactccccttctcatctccctcctcatcccacccctctaggttgatacagagcccctgtttgagttccctgagactaatacttttttttcccaacatcattgtgaggtaattctaacgtgtgtcatcttggcattgaagtctgtaaattttgttctcctatttattggggttctagaggttcattgtaatgctgaataactttgtattgaattctggacattcttaatattgtgttataagactctgggtcttatttacattttgtgtaaaatattgrtattttaacttatcaatccagagagttcaggttgcaagttctgaccaactcttctggtgttttgtggtttcaatgtcaatttcattttcaaagcctttgcattgctatcttggtctgttcccatgtgtttgcaaccaagtggccagtctgagatctaggtggtggtctataatttagctcggttctcaaatctttgtt

SEQ ID NO: 431 - DNA, 598 bp, Bovine  MMBT08467
  misc_feature (1)..(37): n is any nucleotide
nnnnnnnnnnnnnnnnnnnnnnnnnnnnnnnnnnnnnttgccagattatccgtttgaggaggagttaacctggaaagactcattttatggagcatcttcctatagtctgggcacatatgagaacctgttgaagaagttgggatttgctttaaaatagatccgagttcaattcttagccctgcccttagaggctgggtaatttcgggcaggtgtgtaccagcacccagcacctgcacccctagttaggtgagattgatggcctcatgcttactgagcggacaagaagcgcctggcacggcrggcactgggtcccgggctaagaagcatgggtgttgctggcccgcgcgggtgacggtttcttcccctctgtgcttgtaacgcagggccatccaggagagcctcctcagcagctccgaaggtctgggactctggcacctccagtgagaccagccgactttgacagcgacctgcagctggccatggagctctccgccaaagagctggaggagcgcgagctgcggctgcgcgaggaggaggcggagctgcagcaagtcctccagttgtcacttaccgagaaataggcccacctgcctcccgc

SEQ ID NO: 432 - DNA, 600 bp, Bovine  MMBT08009
gtgttgtttttgctttggctccatctcttcattctttctggagttatttcaagagactgacccagacttgcccatgagtgtccaggagtctccggcggaggcgtgggtcggcggtggcctgctgcagggtctggggcactgactgcagcagtgcctgcatgggaccttttgaaggaggaggtcattatcttcattacctctaccatagtttggcctcaggtccaacaaaagggagggaacacggcccagtcccctgagtaatatagcagcaacgtttaatccagaaaattggattaaagrtatrctgagcatggtctggagcatcaaaacaagacccagttccccctcagtcagtctctcccatcaggaagcttccataagcctcttatctttatccttcagagggcagacagaatgaaagccacagtcacagaaaactaaccaatctgatcacatggaccacagccttgtctaactcaatgaaactatgatccatgccatgtagggccacctaagacagatgggtcatggtggagagtccaccctctgtctgactcgtcccataaacaggaggtggaaataacaggaggtcaggcaatt

SEQ ID NO: 433 - DNA, 600 bp, Bovine  MMBT05547
aaatgagacatatacaaattattaagagagtcattggattacctatccaatatgctggctagtgaagtaaaaacaatatgaaaaactctgataaaattttggaaaatgaaagaaaaaccctaaagatgatgttttggtttttaatgcaatgacatggaggattacttaccaataacaatgccaccaatggctccagcattctgtatgttgcgtgccttttctgcaaacatgcactgccctctttgtatcaaagcaatttttcccatcactgcttcagggttagtaagttctgaacaaccrttgtatggtttactgcttgcaacaaatcctcttgtctgtcagaaataaaaagttacttgaataacttttatcttctcaaatcactaccatgtcattaaaattcaaaatctagagctttaaggagatctcatttcttttctaacaataacacatccaatacacatttagcataaatttttgctttcaacattttgcatatcatagtccccaaccaatatttctactgtactttgcagtttataaaagcatttttacataaatcactaaacctgatctttataatgactctgagttaaatac

SEQ ID NO: 434 - DNA, 600 bp, Bovine  MMBT09812
ttatgatgaaaaaaactttttttttttttttttggtgttagttctagaaggtcttatgggtcttcatagagccattcaacttccgcttcttcagcattagtgattggggcatgagctagcacatacactggtgctttgatctccagtgggaaccatttttgtacagtgcaacagccctggtctgacaaaggtacaaccaggagtttagtcatctcagggtgaagatctggttaccctaccaatcaaacaacctagactagcttagcagaagttctggttcaagataagagtaatctagarcaggtggtatttagataaacatgaygaatatyatcattaarcaggtttrcatgraatgctgccagtgtctaatccataattctttgcctttatcactttggtgtatggtagtagttacctgtattccytttcttaaagtttctttctttctttttttaatttaaattaccaaagcttggtttgctgtctctagtgtaactcataagtgctagggaattactgtcccttggaagaagtcttcaaccaatgactgatcctagtcagagtataaacaacacaactgtctcaaacagtaagtgg

SEQ ID NO: 435 - DNA, 600 bp, Bovine  MMBT06311
gaaccgcatcctgtggtcttttgagtttctttcaagtttggagactggctttgaagttagaagcaaaattcttttttatttaaggataccggaccagttgattcaaagagagtgtattatttggctcacgatactgttttccatgcctcatcacacttttctacatggcaatggagaaaggaaatgtagcgggaaacgatttgggccaaaactcctgggggcagcagcgggagggcctcagcacccagcgtgattggccgtctgacagaagcgggcaggcgtccccaggctgagtctgaygagggtctgtgagaatgggaccttgctgatctggaagtaatgggctactggtgccccgagaccatcttgttctctccgctcgctcacattctgaggggtggctgccttccgctcctccagcagccctckcagtggtcccgagctgcagagagtgccagagtgtttgctcagctgccgcgggtccacttgcccaagagatctagcccaacagagaaaccatgtctcagttttatccactgaaagacctcggccctccaaggcagtaaatgaacttgtgttctatcagtgtgaatagaataa

SEQ ID NO: 436 - DNA, 600 bp, Bovine  MMBT10862
tatgatttcttacctcatctacatttccagtgagaaaggactagtgcataaatgtcaaggagctacaggccttggagtttttccacactatttagtaaaattattagcttagcaattaattacctaataatgatttactaagaaaacactaaagcacacctttgccagactaatcttaaaggatttctccacccatgtcacgaagctggtcagaaacttccatggacttctaagattgctccaatgtataggaatcaaatacaaattcatcgacctggcatttgagaccctctccaatayggacacgactgaagcagcagcagcagcagccaatacagccatgtcctacgtttctaattgttccccactgctcattactccttcatgagatctactcttttcagacaatataaaccacatgatacacgggagactctytgctcatttatgtcctacttgcacttaattcctacctcaaatacaaatggcttcccaggtggctcagtggtaaagaatccacctaccaatgcaggaaatgcagaagacacaggttcgattcctggttcaggaagatcccccagagaagacacccactccaat

SEQ ID NO: 437 - DNA, 600 bp, Bovine  MMBT10894
aagaggagtccaaatgagagatcttcgctttataggacctgtgcaggtcattgtctcaaaaaacagcaaatcacctctacactgagctgctttcgggttttccttgccttcccttgcttccttgtcaagccctcatcttggatttgatccttaaaacttggattttgcatttcttttgattgacaagggttcctgatctaggtcagtcccagtcctacttttgctctgtaagtgaaaggctttggagacccacttacacccaacctgctatctgactttagccagtacagtattgttgtygttgtcttctcttcaccaggaaactgacagttggaagggactctaccctgctaaatagcttgagttaaggcaaggtcactggaatgcatcaatctgtagcatatatgcaaaatcacacttaaaactgaattacatagaaagactataatcctccaaatgtcacttggtaaggtaactttaaaaggactttgaacaaaccaaaatattatggcaagttgttttgcacctgtgagcctctgttttagtgagtgaaggggatggtctataatgtgccttccaacacaaaaattctatgatttt

SEQ ID NO: 438 - DNA, 600 bp, Bovine  MMBT07818
agcctcgaaggttaattttagttgaagtcacgctcctgctgtggtcagattttcttacacaggccacctcctgaatagtggccacttgtgttaccccaaagctctgggcggcccgctggccctcagccccatcctgcggccattttccccgcctccagttcccccatggcatgcactttgccctccaaagtaatcagactgtgtttctattttcatgacacactcgaggaaaagagatcacagttccttttgctgtcccagacacacgaacctggggactcgctcccctctcactcaggyctggcaaaggctgagggttgaacagacttcacttgaaccgggcggcacaagggaagaagcctgatgcttcagcttttgcagaggggttttgaaaacctttctctaaaccattagttgtgtggtaccctcgggtgtgttttcttcttcctgacattgtttttgtcaaagaaggcacaagcatgcctgcctttctatctcttctaaaaggctgatggacagaaatctgcatgtttctacccagagatcttgctcctgcaaaggaaaagtgtgagccttcattcaaatttgcagaggttttga

SEQ ID NO: 439 - DNA, 600 bp, Bovine  MMBT08335
ccctgcaggaagggacactcaccaatctgggactgcgcccacgagggtggaagtgcggtcacagagcggagaaaagggcaggcccagctcggcctccttgtcaccctggggagcagacagggtggggacttatttcagtctacccggttggggtgcagctgcgggtagaggggctgccgggggagaagagggagctctgtgcctttgacctggaaatgagcagcatgcaaatgccactgccagcaatgactgttaagcttttcggagatgacattctatcccatgggtctgggatcaggytggcagctgcagacagctaaacaaggagctggaggaggaacagggaacttggaaaacatggaggagagaaggccccgtgggcaagggcagacaaagatgccccctacctggcggaagaattcctccatgagggccttggtccagcggctgtgaaccgaccactgcttggtggggtggctgatgtcagcagcatgaagcagcagagagagggccttggacttgtcaatcctgtcggggcaggtggcaagggamgggagactgatygtttaggaaaaggaagcctggaccattcctaacttc

SEQ ID NO: 440 - DNA, 600 bp, Bovine  MMBT10614
tggcatgagactgccacctccctggggggcagtctgtccggggctggggagagtcgcctgcagaatcgaaccctttgcagccgctcctgccgctgatgaggacaaattacccagttttgaatgcaagtggcctgattctccagataattgtttgtgttccaaaccactttgtactkcactccattggacaaatgcttcttgcctctgccagtttgggtgaagggcttaattccctgaaaaatcagcttggcgggctggtgtatgtcaatgcccytcccagggaaagcagtcctggctccygttactcaagagctgctctgtctctcagcaccagaatatcatcctaattaaaaacctctctgctccaaatagctccctttacttaaggctgtttctttccctaatcacagcaaagctgttccaaagtcactttttttacataagacccatatgtctgcactctagcccattaatgggaccgacccaagaacaaaacagagagaaaacatttaatggcatgtaactgcaagttctcagagtgaagcaaaacaccatcaaagtctgtttaccaatatgtttatcagtgggtcaggtgcatta

SEQ ID NO: 441 - DNA, 600 bp, Bovine  MMBT10054
acgtgcagccacgtgcagtctacacctgtactgcagccgctctggaacacaggtgcgcccctctactctaggaccgtgggaacgtatctgcgactgaaaagttcagagaccaccaacagttatcttttttgtttcatcaaaattttattaagaaaaccagagttcggggaggcacgggagagcagactccacagtcccacccaggcacagagaacggagagacgtgaaattccgaggccctctggtaagggcagacaggcagtcagacggtggacggatgggcacagggactcggggacygtcggagaaacatgaatggcagaccagacaracaggggtccagggccaggcccgcccgcagcgcagggagatagacgtgtgggccrccagggctcagcgctcggcgtttgaccgcaggtcggtggtgagcgggtcatgctggatggtttggtgcagcatcagggccagtaagcccgcccggttggtcatggctgtgcgaacgttgcgctcctgctcaaacagctcgtccagcttgtaccactgcgtgggcagcagaagccttaagaagcggctctggagccccgctccaccctaccccgg

SEQ ID NO: 442 - DNA, 600 bp, Bovine  MMBT07858
ggtccctggcattcgccccctgcccgatcttcaggtttcccgcccggagggcggcctctggcgaggcaaagccatgcccggctcgtgaagaatgttcgcttgcttcgcggcttcggaaccaagagtctcccacccggtgctgtgacacctctgaactgcagcgttccaccgcctagcagaggagcggggctggcgtgctggtcagggcggaggagagcttttctttggaggaggaaagtctccgccaacacctgcgtcactttgcagagcctgaaacggctctccctctctctgcaggcyctgggaaagtgggttcccagcctcgtggagctgacgaaacgggtccaacgagcaccaaacgcaaaggcgaccatcctgccgcccagccaggggcgccttctcccctcgggcctctctcttttctccagcaacctgcgggtttccagctcactcggcagcctcgccgagcccagagcgccgggaagcggaggagagcagaagccggacgggtggcgcctccgggctgtggccacgctaggctggggaaagcccgcggtgccctcgcccttcctcgcctcctgccaaatggcaagtgtgtct

SEQ ID NO: 443 - DNA, 600 bp, Bovine  MMBT05604
ttaataatggtcagctccaggatataggaaggtagtcaagcgtggtaattgtattttgaactccagcagattatttcctagggagtaggaagacaaccactatgtgggatacagtttctctaaatacaatagagataattgcttccctagaggtgaggggacaagccaagggctcccttaataatttgtgtgatcaactttataaagaaacatagaggtcaaggttttgcaagatgaggctaatactgggaagaaagtctgaccattgctgaatgtcctcaatagttaattatctcattyccttgttcagattaacagttgagttttatgtgttgggggtagggggatcactaaataaatctggaggcaccagtgaggtcagatcattgactgattagtaaatttaacccagcttatattcatccataaaggccaaccataaatcttttactgtttaatgtaaattaaatgttcacaatatattaaaagctgtaaacaccacagaataactaaataggacaacattattatcttttttttttaatccctgtcaaagaatgaaggattttaaaatatcatttgggaaattatcataaaaat

SEQ ID NO: 444 - DNA, 584 bp, Bovine  MMBT06824
ggcattagtaccttttaagaatcacaagagagcttgcttcccctctctgccctcaatcaaggatacaagaactcagcagtctgcagctcaagagagagccttcaccagaactcatcagggctggcactctgatctcagacttccaacctctggaactctgagaagtttctgttgcttataagccacccagtcaatggtactttgttacagcagcctcaactgagtaacgtgcccagatttcacggactaaatggcagagtcgaaattgtaagtaatagagggcctgtaagaaagactgtyggcttggtcattttcttcccatttcattgtctcatgtgcaaatcaagggcaataattcaggctctttaatgaagtgtatctaaagtcagctgaaccaaccaagatcactcactgatgagttctggtgaaggctccacaaacaaaggattaatccctcatcaatgattgtcagcagaaatatttatggaaaactttttattcagatatagaaaaatattcatagtttttaaaaacagaagtttgaaatttctgttgactacataatccattcagttgattcaaag

SEQ ID NO: 445 - DNA, 600 bp, Bovine  MMBT06365
aatatcaggagaaaatatatgtaaaataattttcacagtgctgggaacataggaagttctaaaaactgctgtttattattatgaatatatttgatattatgttatacaatgattagaaatatcaatagaaaaatactcaattatgtatattggcaaacttggtgcccttgatggttaaaatatattttacattacacatttttatactgttcaggtaaaaacaatttatatgtctatgtgtgtatatagagataaatgtatctacccatcttctatgtctcacgttttctttagaaacayttttgattctmtttactttccaccaaaagagtgattatagatatattatttttcacatctctgtggtcctctggtgaggctaatttatgattattttactgccccaaaggtccaactctaacatctaagagttttattccatggggctttccttctcaacttcccaggcagcctgattctcatttgctccacagctatggggtagtacttttattaagaacatagacctacagctatcaaaatcagcaatatacccaaggaaattttaaagctctcatagactcccttagtgttttcccc

SEQ ID NO: 446 - DNA, 600 bp, Bovine  MMBT08544
ataaaaacttttcacttgggtgtcaaaatcaaagactctttgacatgtgaaacttaaatccaaagtcagtaatatcttagaggtatgtgcatatccagttaccgggtatgcactgtactacatgagaatgttcttacccaataaaactagattgctatagttctccaacatcacgtctctgtacaaggtcttctgagtaggattaagcagctgccactcctccaatgtgaaattcacagccacatcttcaaacgatatctaaaaaagtataatccctgttaaatctgaagtcattctctytgctgaatgtaggcttccttttctacagcaacaagtggcctgaaagctggacccatgatctccaactcctggaaatgtgcttttgtttaaccctcactgccccacgtcctgaatatgggctggatttatcaagtcacttccactgaatggaatagggtagaagtaagggatmtcccttccaagaccaggttataagaggacatgacttctaccttgggaaccctctcctgctctctttgggggaagtccaagggccacatggtgaggcagctctgtgtacaagcctacgtggcaaggacc

SEQ ID NO: 447 - DNA, 600 bp, Bovine  MMBT09019
ccaaaatgtctgtctgcatttaatgtcaaattaaaaactaaagcagttctgtgttaatcctgggagaataagtaatgctttttaaagattgctaaaggaatcatgaagatttcttgggtttttaatatgaaaatttcaggtgaccaagggcacagccatacacattggggtcaaagtatagtagaatggtcagcatctcaatttagacttacttattactttctactctgaatacactcgtagaagctacttgtggtgtaactccttatgtatttaatatttatctaactcttggttttygtggttgagttttgaaatgggtgaagaatctacttattctttgccctttacggaatgtgatatcttggtttttattccatttatcctccttaccctttacttaattttaccttattgttttgctttgtgtttctaaaataatggctttggcttgttttttcttgaatgtttctgcagtttgatttgagtatctggctttgggcacccctcctgaaccttggactccatctgtacttgtgacttatggaaggcagaagtcagtgttttctatggaatatgacctttttttttttaatatta

SEQ ID NO: 448 - DNA, 600 bp, Bovine  MMBT10797
gaggaaaatatgagtacttggtgggaatctttctggtttttatgaaacaactgtaccattaattataccccatcaaggtgctgtgaatttgaatatgcttattatttagaagtttaagtgaatcatcaatgttgtacagggaaaagaattggaggtaaatgaattaattttcctcattgacttgaattaaaaagtgtaaagatatctttccagtgggtaaaatatcattctgaagatcaaaataaaattttaaagaaaatcagattaagatagtagtcttaaatctatgctgcaatgagyaatgtcatgccagaacgttgtttcaacatgttcaaaactaaccaagatttcccccaccaactttgtagattactttcacttcttcagatcaagaaaaaactctcccatacacttgtgacttggaaatactttaaatcataacttcagattttgtaaaaagaataagtagccaagttacatttacttaagtactccacttactttgtacttatttaaaataatgactggaacccatattaagtaataaaatgttgataaagattggacaaatggctcaatatcactggccctgagtttctt

SEQ ID NO: 449 - DNA, 600 bp, Bovine  MMBT08282
atatgttctctatttggaatcctttttcttgtatgtctgtaagttgcctacaaatccatctacaaaatatctgagaatgcaggatctgctactgatattattttgtgtccacctagctctgaatactaccacatataagaaaagatttaaggctaaaactgtaaaacccttgatgatgccaatctattcacagttgggtcttctcttatgcataattaacaacaagtgatctattttaacatgtacagaattctctgaggaaaaaaaatgacagaacagagaatgcaaatggaaaaatgygacaacacaatgaacactacagcatgtgttttaaataatttacacaaatctgttccaatttgtgagccagaataaaaatagtaccatttggtaaataaaagttaaaactttgtgggaaattataagcctgatttatatatcatattgttagacttgccattattaagcataccataatggcagtagtctaagcataaacatgccctctttcacagctgcacgattgtcttaattgttaccaatttccttccaattgcagtattgtttgttttccttggtgtggaaaagcagagtgagttt

SEQ ID NO: 450 - DNA, 600 bp, Bovine  MMBT07096
caggcataattgacattccaactccctcccgactctccccctctttttcctgtgcctgtctgtccctctgtccttcattccaatctatcaggcttcattttcttgtcccacagcttggcctagcagagactacttcctttcaaagggttccctttcaagaacacatgcaggaatatgcatgagcatctggtgtgagccttttgttcaaattcagccccctagtgaaatacggagacagatagagaccctaaacaaaagagaaagaggcaagattaatgagaacaaacatcagagaaatgycttcatgtctagaaaatgttcagagcctgctttggccacatttgaacagttgtgtgtctggatttcagcctcttattttctggtgtacctggaayrgatygaacttccaagaggcttggtggcaggatgtatgggggtatagtgaaaaggagctgctggcttctgactctcagggaaaggagagaagtcagagcttctagtgagcatacgaacaccaacaatagtcatattggttgttaaaatatgggaatgctactctactaattggtaaacagcctctgcacacatcttccacctatt

SEQ ID NO: 451 - DNA, 598 bp, Bovine  MMBT09286
  misc_feature (1)..(72): n is any nucleotide
nnnnnnnnnnnnnnnnnnnnnnnnnnnnnnnnnnnnnnnnnnnnnnnnnnnnnnnnnnnnnnnnnnnnnnnntcttattggccgaactgggctgggaaatataacatttcagttttatttggttttagcaaagtttctttgctctgtcacatctttccctgcctccttctgttctcagtcccaggaaatgatctctaatgtacaaaggaggctcagctcatacatgtaccctgataagaaaggacaaatcaggtcctgctgatttgaagattccagctgatgatgaagattctagaaaayggatccaaaccccagaagtttcagacttgactttcagagtacaagctctgcttccatctgacccacttggctttctgtagttttatggctcctttgggagactcctagtccccagaacacacagagagggcaggaactgaccacagccatctgggagcaaattctgggtcagttaggatgctttcagctacaagtaacagaaaacctcaactcaaagtatctctgagagagtttatcatctcacattaccaggaaacccagagatgggaagaaagaattccatacaggatacttcagc

SEQ ID NO: 452 - DNA, 600 bp, Bovine  MMBT10755
gatttctagggagattactgcttaaaagtttcctagtccatctaagaaacagttttagatttagagggaaatccaaacacagaagcaagcggtctcttcaattaggtaatagtttctaggattcaggaggcaaggaagaggagtataaaatctcaagttgctgtcttcaccccaaaccttctagatcctcagaagacggactagtggtcaaaacatactgatatttggcatcagaactgtttttataaagtgagacactcataaataggggaagaagacttaaagtacaatgctgaaggyaaggaatagaatctacagattgggtagagcacttgggttgagcactttcagatttaacartatttgtttactataaatccttttctaatttcttgggcaaacctgatctatctgtacctttgctgtcacctgcatgtacaggactgggcaatcataccctcatactccttgtacaagatactcccatttgcctcaatcagaaggatgctaatgggaacatacttataagggacacaggaaggctgagggacactctgatccaccagctcattgacaaggttctggatgatggcatgattg

SEQ ID NO: 453 - DNA, 600 bp, Bovine  MMBT10040
ttagaccaaatagtaaaatattagttcatgtttgtggtttttcttttcaaaaaagaaaagaaagctgtatcatttatggagttctcgtcagagttcaaaatgattattatggaatcaagataatgtgggatgtccaaatatttggttgcagaagatatgaaggtcaagtacaatattgactatttgaccaaatattctattttttaaagggctttattaagtgttttgtgtttgggaaaaaataagagacttatttaaaaatttgtatcataaataccattcacaacctcttgccctcaygttcccccaccccacaacccacaaccaccaaattgaggcaacaggtcaacagtcaagtcaaaattgtacccactcctacatgtaaactcatgcaaaaagtataagtgcagatgtacatgcagagtaacatcacctacccatggaaataacttgtctgaaagtcttcatcagtaggayatacaagcataaacttgttatctggcttcattcttgtatcttccatatttccaaacagcacaccttatagcttagctcaaatttagtattcatcataaacaaagacagyaatattttcacatt

SEQ ID NO: 454 - DNA, 598 bp, Bovine  MMBT05639
  misc_feature (1)..(181): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaattagatatagcagcttaaactgccttagtaaagtacctgactctggacatgaaacaaagagggtcagtcattcctgcatttaaaacagaaagcagctctatcacttacttggyttggaattccgtagagcatgcggtgggggttgctgtgtcactgaattaccaaaatgatcaggtggtatggcactgtggcaaagcatggcaaaagaaggatcaaggaaagaagaacaagagcagagcaagggtagatggagggggaagggagagaggacgtatcagacatcacaagagccaggtaggagaacattctctctgtgcttttgacaagctattcagagcccacacaaaggaaagcaatgccataaatagataattatttaggtagtatctatttaatcagtccaaaatggta

SEQ ID NO: 455 - DNA, 600 bp, Bovine  MMBT07014
gggatgtacagtatattacacaagtttaccctggcaggccacaggccctgatctgcaatcctgtgtcagcacttttcagtcctactaatatggatacagatgggtgtgtgagctgctccaggcttctcacggggccaaggaaaacatggaaaacaaaggcctttatgagctccatgctgaccacagtccctgcagtattgctaaaatcacatttttctctggacttgccatatacagaatacttctcacctgagagaaatcaaatttcattcacarcctaggacctaagtttgttgttcyagtaagagtaagtaattgctccctttggaaaagagaaaataaggcctttttcagcctttctctacaaacttgcaaaacagctcagtagctctgaacacacagaatgcaaaccatggacaactagttagactagagcaaaggcacacggttgggctgacactacatatatttagaaaaatgaaaaaaaatgaaaccattatctgcgaccattcaagcgagagaaagacgtgcttgcacagctcctccgtcacctccargagccccaccctagccaccaccaaggtcgtcatctcctgtcct

SEQ ID NO: 456 - DNA, 600 bp, Bovine  MMBT10692
aatatttagaccacttctaggtttccacaaacaaggaaagttgctaccaaacgagccatttgaaactcaagggtataacatactaaaatcaagagtcaaacacttttgttttccctgttacttttaaagactatacatgctattggtgataggaaatgttcatataaccctcccaaatccatgcacaggtgcactgaggtttcatttagatgatgcatggcatataaactagtgtcttttgcttttggtagatattctgattaaagacagaagctcaatactaaaatcttaccaaattaygtttaagatatcccaacatctttctttcaacaagataatcaagtttctagatgtttgaaatttcagttgcaatcctaaaagtttgagctcaaaacttttatcatcattccccaaaaatgtttgttcaacaagcttcaggaggtaatactgtactttttcttcaaagatgtttgctttatctttttacattaagatccacaaaaactctgcatttttagatatgaatgaatcaggttgccatttatagaaatgaaagtttcttgtattctgaatctgttttctcccattttatttattcta

SEQ ID NO: 457 - DNA, 598 bp, Bovine  MMBT06237
  misc_feature (1)..(61): n is any nucleotide
nnnnnnnnnnnnnnnnnnnnnnnnnnnnnnnnnnnnnnnnnnnnnnnnnnnnnnnnnnnnnataaaggctgtcttcctttctggagatttcctataaaaacatcatgaattcacagacaaataaggctgccaaagccactttcaattggcatcctatttgcaagctcattaaagcctgcaatgagataggacctagtcaccactgatctgtcagttgatatgtccaaagtaaagatgacacgtgaatgctttctcatccaataaaactcaaagcagcttaaggcttgtctcagcattagyaaagtgcttttagaaccacaagactccaaatgtaacmttaggctgtagagaaaatgatgatggaaaagaaatacagttgtatgggttttcttttgtttgcttcagtcrctgataaaagtcattgaattaaaaaaattgggcagatgtcaagcacagrtcaataaaccacatggcattttaaatcaagttaagggggctgattgaaacagacatttcttatcgtaattgtttggctttatttttcatttgtttaagtgagtattcattcaaaaatatacccatttctgcatattatttt

SEQ ID NO: 458 - DNA, 598 bp, Bovine  MMBT06897
  misc_feature (1)..(6): n is any nucleotide
nnnnnntggactggtttgatgtccacgctgcccaagggactctcgagtcttttccaactccacaattcagaagcatcaattctttggtgctcaccctccttgatggtccaactcacatctgtacatgacaattgaaaaaagcatagctttatgaaaaggcaaaaagagtaacattagaaaagagcacaaatcttaaaagtatacagctttgatgaattttcaaaaataaacactctctagcatctagtacccaaatcaagaaacagctaatgaccaaacctccagatgaccccctcatgytctttttccttcactacctccctgcgaggggaaccaccaccttgatttctaattgtgtttgttttgaactttatataaatggaatcatagaacacatactcttttgtctggtttattttgctcaacattctgttcatgagaattagttgtgtgtagccatggtctgtccttcctcgtcactgtatatgtattatttcattatatgaatataaaaattcttctgaggatattttttcccttgtttgcaattatgaatatgtcatgctacagacattcttgttcaccttctttaggatat

SEQ ID NO: 459 - DNA, 600 bp, Bovine  MMBT09854
agtgggttgccatttccttctccaatgtatgaaagtgaaaagtgaaagagaagtcgctcttgggtgtaccaatgggtctaaatttacaaaacagaaacaattcaaggtttcaaacagattcaaaggattgaaccgtaggtttttgtttttgagtttatatggtaataggtaaatgatctttctctggactttctttgaatcatgtgcaaatttctgcttagaattatgatgcttttctaaaagaaaaaaaattttctcctattgttgtcgttgtgtgtgtgtatgtgtgtgtgtgcttcytgctaggtcgtgggatgtgtgccctttatgtctggcctaatgagctcagtaggtgctcagtaaacttgtactgaatgagtaagatgcagtgaatgaatggtcagctaatgcagtttcatttaaataattactttcttcttttatttatatggcatgtacaacttgttgggtagtgttctacctgctttgcaaatattaagtgatactgtcctcctaacagctctgggaagccgaaattattcctgagcacagagaggctctgtaacttgctcaaggtcatgctgccagtgaatggtggag

SEQ ID NO: 460 - DNA, 600 bp, Bovine  MMBT08269
ctctttgtgcacgactgggccctgtgggtaacttctgtgcagtgtattcatgggacaaatacctgatattttcaattctcctcccttcctctgggaggttgctgcatactcaacacaaacccttgcttcttgtactttcaaggctggaaattttcctattaaggcagaagctgaaaaacaaagcacactctggtaaatagttgataacttggagcagttagtcattctctgagcttcttgctattgaaatgagagaatggcgtggcacaggaacctgaaatactcaaaactttgatttgyctcctgcctccagcagacttttttgcttagctctgctttttagtctatttatcctgaaactgaaagaacttttaaattctgttcaaggaatgtttctttagcacctgctgtgtgctaaggcagtgtactaatgtactatatcattgtatactgactaagacaaggttcctgtcctcaagaagttcacaaaatgattagtgaagtaacactggcaactttgaaggaatagtgcttctcttaaaggattgactcaggacacataataatataattcacagaagtaatattttcagcctttgg

SEQ ID NO: 461 - DNA, 600 bp, Bovine  MMBT07848
gggttgcaaagagtccgacatgactgagcgactgaactgaactgactgaaaaatatctttaaattgttctagtgcaaaatgttctaaatttattacctttatgtttaaaccttcatgaatattcttattttattatttaggatattcaggataaaattttataaatttttaagagctttgttacattttgacaaattgtgctccaaataatttttttaacattttatacccctggcaagtatgatgcctctttccctatgtctaacactagattttaaatatatgtacatattttgttcyttttaacaatttgtaagtttttatgttcacagatcttcattactcagattaaacatttatgtctatgtttttgagctaattaaagtttttaaaaattaattttgtccttgaacttttccattttctaatggaatttttattttattttttgatgtcagactgaattttactgattagttctttcttgttaatagaagaaaacacatttcaggtagagagcaagtataccaagcatccatatgtagggaataaaatttaaatttgctactaacagatgtattctaggtccatccttttccc

SEQ ID NO: 462 - DNA, 598 bp, Bovine  MMBT07849
  misc_feature (1)..(93): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaattctagtgttacacaagtcagtccataggatataactgtaaacttgtaaccagtctattacttccaagttcccatgataagatttcctgccatagttaatgggctgcttgcttggagcaatactctacaaaggaaggatttttaaagaccataatatacatttttctgaaatcagctgagagggatttggccagtagtttyagtatgaggcactcagtcatttttcgccatctttacaggttaacacaattggagaagatatgattcacacaggacaagtttcctgtcttgctgtgttcctataaagatctgactcaagtgtgaggatccartttaaaaccagcctcttgcctggatcaagattgaagagggggtggaagtggtggccgtgtttaagctttcttaaatataaattacttttatggaacaaattgtaccttctttgaatatagctaagtggaagtcttatttggattgaagcttaaaacacaggtgtcaa

SEQ ID NO: 463 - DNA, 600 bp, Bovine  MMBT05823
atgtctcctgcattggcaagtggattctttatccctgcaccacttcggaactccaatataatgaatatattataatatgtaataaaatatattaattattatrattmraaataataattctaaattattttcatctaaaatttcagctaataatttccatcatgctttagaaaaaggttcactaaaccatctatgatatatatggacacattctaagttcactgggttggctaaaggaatgatcmtttaacagcatactgttcacattatctgtgcctttgtctatgtgcagacaaacaytctggaaagtcatacattaatgcatgtgggtgtgggcaatagttccttcacaggacagctggatgcatcccataaagacgttcagccaaatgtttattctaaagccttctggtgtgaagcacmgggaggccygcagcacagttagttggaagcagcccctaatgcagaaaggagagctcagtgtactgataacaggttctcactcctgctcgttctttgagcaagagggtaaaaggctacatacgtcatgtcatttgccaatctaccaattatcccttggaaaagggaggcaaaagcaca

SEQ ID NO: 464 - DNA, 600 bp, Bovine  MMBT09790
ctccccatggcctccagagcagagcagatctggcctcccgcctgctgaaaaaacatccatggctcccactgccaggaaaaatgaaacccaactccttagcctggcacccaaagcccctcctccacaatcyagcccctgcctgcctttccagcctcctctcctaccacccacatgccagactctccastcacactgggccaaccacctccaggtactgaacagcttttgtgcagccstgctgtggaaccctctttacaagcagcccttgccttaccctctgcctggaatgtcctttctccyttctctgatggctaaatcctagacaagtttcaaggaactatctcagacagctcaccctccctggagccctcccagactctattccccagcaggatggctcactcagggccatctccttctgcaactgcgtgtggaacatggttgaaggcctggggtcactctktgcagtgacccagaagacctgttggggaccactcctctcagggcagagaccactgctgagagatgctccaccctgcagcccccttggaatacagcagggtggggctgcagaaacctccacggagccttggcatggat

SEQ ID NO: 465 - DNA, 598 bp, Bovine  MMBT06540
  misc_feature (1)..(141): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattgctagggtcatgtcacaaggattcagaggccagctttaaagggctcctagtggtcaaagatgggacaatctgagctcaaacatgaggataactacaatggattgaagctcataaaaatgtttacattgaaaagcttataatgattgtgtgtgygcatttgtgtatataccctttggaaaatgataaggaagcaactcattatcttgaaaattggtgaataaagagaakgagtccaacattaaaaaaagaagaagaaaatgcagtatataaacacaatggaatatccaaccattaaaaagaatgaaataatgccatttgcagcaacatgaatggacctagtgagtgtcatactgagtaaagtcagtcagaggaaaacaaatgctgtatgatatttcttatatgtgaaatctaaaaaacagtgatacaaatgaacttatttacaaaacagaca

SEQ ID NO: 466 - DNA, 600 bp, Bovine  MMBT10073
tcacaaatcagatcaatggtgggtgaaattgatttattaataatagacacacttattgtcatcttaaatcattaatcattaaccataaatagagatgatattacgcatttgctttggaattacatgttggctctcaaacttagcacgattttgttgtatgagtcagggacttactaaccctgagtctcagtttccccatctgtaaaacagagattataacatttattgtgaaatgtttaataagaaacaaaagagtaaatataccaagctggatggatgtgaaagaacacaccctataaytgcctcttcctcctgcctcaacacacataccatcctcctcaactcacagaaacagagaaattctaaagaccagctgcatagcacagtattttataatcagatcagagatcagtcgttcagtcatgtccgactctttgcgaccccatgaatcgcagcaagccaggcctccctgtccatcaccaactcctggagttcactcagactcgtgtccaacgagtcagtgatgccatccagccatctcatcttctgtcgtacccttctcctcttgcccccaatccctcccagcatcagagtcttttc

SEQ ID NO: 467 - DNA, 600 bp, Bovine  MMBT10074
tggtgtatctagctaggagccaaaaatgagtaaagaaatccttgaattatcttgatgattttcttagtttcacattaattattagaataagaaacctaacgacctaatcattcctcaagaagaaactggcatatcaatttccaatggaaggatgtagaacagaccatggttttgggaacatgtggctactggcccaggttacaaagctcagcaaatagtacggtggaggaaagaccttatctattacaaggttctcctggctatgctttgcagttcatttttgcattgagtgtccgatayctttagtgattcctctgaggtatcagctctctgtatcttcttttcctctgccacatcttctgaggagctcttcagctggccttctgtttgttatttctggcacttcccctaacatcgtgtgcttctctgaggataaactttgtctaaagcaggttagcccaagtgaccatattggttttctcaccttgaggatggtccttgttatctcagtggtggaagacaggtctatcctctgtggctagggctctcctaggactagaatgtgctcccgtggtcatggccaggcccgtgtcgtttctg

SEQ ID NO: 468 - DNA, 600 bp, Bovine  MMBT10092
ccagtggccaaaaatacagccctgaccctggagctgtcatttgcagccrtgtcctttgtgacaaaggagagctgagagcacgtctacataaaacatgcttatcaccactttaggaaaaagcagttcacttacggccatagragatattcaatagcattaacctcccaggtttatatgagctcatctgagtggtaaacattcttttttaawggagaatattttaataaaatgttgcaaaagttggcagtatttttttcctctctaaactttttattttgtattggggtatagccgattaayaaacaatgctgtgacagttttgggtgaacagagaaggagcacagccatacatgtatacgtacagtccacggaattctccaggcaagaatactggggtattcccgggtagccattcccttctccaggggattttctctacccagggactgaaaccaggccttctgcgttccaggcagattctttaccatctgagccaccaaggaaacccatatatgcatcttcttcccctagtctcccccgcatccaggctgccacacaacgttgagcagaattccctgtacagtaggggacacagaaggc

SEQ ID NO: 469 - DNA, 600 bp, Bovine  MMBT08253
aaagaacagtcagatgtttatgactctgctgggaaaaaaaaagaggtcattttcattttcccatctctgtatatccccacttgccctgtaatcaaagtaaatttcctgtgaaaagttgaattttagatactttgaacagggaaggacaagtcagtggaaacaatggggttataagaaagaagtcaggtaggacgtacgggcaaaatagggatggagagaaggttggaattcagaaaattagcactaagtccttgaaagcaatctatggcattgcaaatgttttgttgttaaactaaaaaytatatttatatcgcatttatataatttcactgtttcatgattcatgctactaaagattcttacagagtcaatcttaattcctaaatcatctctctttagtatttctattcaacttctagttttagaacatatctggaaaatattaggraaaaaaaaattgggagtcaagtttgcttacagtgttgcaataaatctgtgaactatgccctcctctgtttctttcagattcctgttagtaaaatggatctacagtgctgcctttctcccaaagcttgtatttattcaagaacaaacacaatt

SEQ ID NO: 470 - DNA, 600 bp, Bovine  MMBT10873
ctttgtttttagagaggggccatttttaccattaactgcatggtcatcctatggtcattctcttgccagtgtctagcaggcatctctaacatggggttgcagtacagacagcatttacagccaactggagtggcaaccacaattgtttgattatccttcatataactatatgcttaagtgaacaccatatttactcatgtatcttgtaatttatttaaaaacccttctttcctgcctgctccagtagatagctgtgaaaccaaaggtccagcttcaacagtttggaagcttggtcagagyagctaaagatctgtgaacagtgttttttttaactttttcacttttagtcacaaaacatcattagatctcctttagatgctctgtgcaaattctcagaagagtttctgtttcagcacacaagcaataaatcctaattggagttgaaaactatagtgggagaaatggtgttttcttctcaaaattggggaaggggagggaaatgtgagcagataggcaaacaaacgaagtaagtttgatctgaccgtcagtgacatttaatacttataagcaattaactagttatgaaatcttggacagatg

SEQ ID NO: 471 - DNA, 546 bp, Bovine  MMBT07881
gcttggagggattgggggcaagaggagaaggggcgacagaggatgagatggctggatggcatcactgactcgatggacgtgagtctcagtgaactccgggagttggtgatagacagggaggcctggtgtgctgggattcatggggtcgcaaagagtcggacacaactgagcgactgatctgacctgatctgatctgatctgatcttaagaagccactttataaattcagtttacacaccaggaaaaaaaaaaaaagtgattctttcaaaaagtaaaaggcaaatctataatggtttcttygaactgcagcatctaaatacattttttatcttccctacctctcttgcccaaaactctaggccaagttatacaattatcctgcaagtcattcccaccacaagtatctgtctttgggtagcatttaatgttaatcacattctcttactttccattagagtaattgtttgtctctctccctcctgtggaagattattatgtctacaatctatctacataagtgttatgggttgtaaatgtatgtcttct

SEQ ID NO: 472 - DNA, 600 bp, Bovine  MMBT08303
ccactccatgtggtggcttaattgttctctggaatcaatcttttttatgagactgcacagtttccagctcgacttttcagttttctcaacatttaaaattagatactgaaaaacacccgttgcagactcttacccagaaaaagacagcactggcacagagggttacacgtatacactttccccatgtggtaaagggaacacgctcttcttcctaattaaaaaagaaaaaaaagtcaatcaaggatttcaacaaaatcatttttctcctaattggtttgctgtatcctaggtttaattttytgtatgtaaatgttcacagaaatttattcataataacacaaactagaagaatcccaattgcccatcatcaatctattcaaaggataaacaaattgtagtatatgtatgtaatgataagttacttagtaaaaggagaactaagaatacaccaagcagtttgggtgaatytcacaaggaytgtgataattaaaagaaactagacacagaagactatatcctagtcattttcatttatataaaaattccacaaaaaaacaagactataggaaaaatcactttttcctatggctataggaaaaa

SEQ ID NO: 473 - DNA, 600 bp, Bovine  MMBT06416
aagtacacactgactgaataatgtctgctaattatttctatctttgccatttcttgatgaagttactaagatgaaatttttatgggaagtattaggaaatcataaatcttttaaaaccacacatgtgtatttcaggtatctgttgctttatacaagatgtatctattgctttatacaagaggtaaattaaaatcttgaacaaaaatggcaaaaataatttccaaattcaaaagatgattctcagagtgtcaatctctcatagtttgaaatgtttactatgcccaataattgatacaagaygcacagaagaataatatattaaaccttaaagcaaattttctaaaaactgctttttgatgaaactgacagactgacctattttggtagtgtagataaataacaaagtctatgatctctcactgcccccaaaatgaagctggcattcacagagcacattaaagttttgagaatagattgtaaacacccatgagaagtctatgttcttcagaaagaatatccaagggagctgagaagtgagtaccacttgattgatgaggtgcgactcagtgagctccgtcaggaccaatgaatgattcaatg

SEQ ID NO: 474 - DNA, 600 bp, Bovine  MMBT07508
aaccattgaaatacccaggcttcaatgctccttgggttcccatggcaaccaaacaaaagtaaaacaaacctatctgtcctaacaataaaaatrtgttttcattaaagtcaatttaacatattcttcctaatttaaaatattcaatgcattttgctcctggacaaaaatccccaacctgccactattgaagggaatgaagtcgctggcagaactatgcagataaaagcaattaggggaatgttggggacttcacagatgagacggaatacattcaagtatgaacaggattgcttttttctytcttctgcttagttatgctttttattatataaacattaactgtaatattacagtgggaagcaggtatttggcagccacatattattttagtaagtctgcacagagagaacagtttccagttttagcagctgtaacatgtttaaactcagtttgtaatgggatctgaagataactattccccatgggctgtgttgatcttcatggctggcccactgccagatgcagggctcgaaactattattcacgccttcttgcacataccttgtccgagcatgctcagtaaatgaattttctgtctac

SEQ ID NO: 475 - DNA, 600 bp, Bovine  MMBT07870
tctgcagaagcagatgcctgaggaawgctttagtgttagcctgggttcacagtctaactcctagcgaggttgtgcccatcagtcscagaatccaccagctatgtgaattcagcatctcccactgggcatcatgtggatgctgttgggttgggcactttctctgaatgagagcagcctcagctcaacccaagtggagcccagaccatcacagggagtacagtccttggcagggtcagaatggaaagctggcttcagagggagaggccccttctgccacttctgcatgtcytaaagctcacyrcacccagcttctttgttgtcgtttttcttaggaataaatgagtgtgataattcatttaataaatatttgctgagcacaccattctctgatgtcctagttcctccctggcacaaagataaatatgactgtctctgctctaagtcaacatctaagaaagaaggcatatgcaaattactcagagaaagatggcaaatatgggyactcctcagtatcgtgtccttgacaaacattgctaatcaagcatagaactcaccttgaatctgaattcagttcagaatccttctcaatacattattcta

SEQ ID NO: 476 - DNA, 598 bp, Bovine  MMBT10825
  misc_feature (1)..(58): n is any nucleotide
nnnnnnnnnnnnnnnnnnnnnnnnnnnnnnnnnnnnnnnnnnnnnnnnnnnnnnnnnncttggtgaaggaaacatcataaaatttaaatttatataaaattaaaggaataaatattccagagtaacagaacaattaacatctaccaaaagcataaaggttttaacatgagagcctatgtattaacagaaaatcactttagattacactactcttcaagtgtcattcaaaattaaactctagatcttattttggaattgctatattgagaggaatatcagtactaccagccataagttatygtttataataaatgaacacagtgggtggaaagcagatgtttcactgtaattttgctgcaatgaggtacaaatgcagactagaagtaacagtccacttggatgaaagttggattatgttaaaatataaactcttgagaacaagagggcggaggagtaggtggacgtggagtacatgtctctccatggatacatcaggaatacaccctcagacacagaagtgcatgcagaacaccagctgagagcggacaggagtacctgcccagtggaaaagaatatacagaaccatgcaaaactcggt

SEQ ID NO: 477 - DNA, 600 bp, Bovine  MMBT10861
ttttgtcaataggacaaatcacaggggccaacttgaagaggctcccacagacaaagatgaaataatttgagcttcaaaaagaataatgagtacaagtgattgaaaaacagaaattccatgtttctaatgataaattaaagaaaaccttctttgatcatcactcgaagttgccagtgtacaaactcattaccccactagaattcagctgataaatcagaattcaagttaatgaattagaattcaagctattcaatgaaggactgatagacttttaaaacttaacattttgcaactccaaaygaaaaaaataaaacaaaaaacaaaaacttggatctaaccaatgatcrtggatggatgctaaaccactatgtgaaagttgatagggaaattctggtggcagaatcaggctcatayatttgagaccattgaccaaatctagcatcaaaaaagtgggatagacagacgtttgtgccatgagatgtaattcaatagtaaatatacagcagtacctataaagtattgtttttcaattttctttcattttttaatcagtatagtttatatatagtaaaatgcacacatcttaaatgtacaggtttt

SEQ ID NO: 478 - DNA, 600 bp, Bovine  MMBT11278
acctgacagagtcagtcaataaggaaggcaaagaaatttgacacagatttagtaattattgctggaggtatcacctcacaattgcaggcgtccgatgtctttgtaaacaagcctcttaaagcttgctttaaaatcaatacaggaaatggttgtctgtggaagtcatgcacaaacaccaccaggacaaattaaacaacccaaacctgtcctgacacaatgcattactgtggcttgggatacaggtttctgtgaaagcaaaaatatagattcaaacgttaatgtatctcaaatgccttaaayggaaataaagataatgtggtgtggaaaacttaagatgattccccccaaaatggccctacagatgacaagaacactgatgtccgagatactggtgaagactttgaacaaaactgctccttaaaacatgagtggcaggacttccctggtggtccagtggttaagaatcggcctaccaatgcaggggatatgggtttgttccccacaggggagatctcacatgcctcagggcaactaagcctgtaagcttaatctactgaagcccatgtgctccagaccccatgctctgcaaccagagaaacc

SEQ ID NO: 479 - DNA, 600 bp, Bovine  MMBT10802
cccattaatctcgtagattctggatttaaatagcaaaaatgattaagcttgagaacctatattttgttattcccccattagagaggtataagataaaagaggattagaaactcatttctaaactacattaagaaactgagaacaaaagagatttttttttcactaatttcaaaagttaatgaaataagtttcaagcatgattatttctatcttctgaggaaatgtttcctgtaactgcctatgcagtgacacatgataattatttgaaaaccataataatgcggtttcattattctaacyatcttctttcttaaagggccagcactggcttgacagaagtgctcctaaagcctgtggtgccctcttctgacccttcactcaatagggtgagtcaaagcttttgtttctrtaaaaaatatgtaaaaattcgtatctgacacaggttctatgaaagaaatctgactacagctccatggtgtatacttaacaaattcttccaggtttcagttttgaaatttgagaattgttccagagaaaaaataatactgaaatttgaaatgtgatagcaatttcactcaagcaacatgcctgtgtaagaaa

SEQ ID NO: 480 - DNA, 600 bp, Bovine  MMBT08343
gggttctaaacaataaaaccagaaaagcaatccttccatgctgttcagttctcagtggttctgggagaacaaaggcgaggaaagaagggtgagcacctatctcccacccacccccagccttcacacattgcccattgcccaggttggggcattcattatttgttcacaaaacaccaaccaagtggcagacactatattccccaaaccagaccccattttggaaggttttctcagattggggctgagccaaatggctctcctgtgttccacatggtgcatccctaccctagactacatctygtggattaggttttgggttttttttcctgttcctcttaccaatgaacagcttgtgtgttgggattgtgtttttcatcttcatattctgcatgcctgactggcatacaaaactttcttataaaaaatgattcaagggaatggacaaagccattcactgagatgggaaggaatgagttaatcatagagcttgaatagtatcagttatctgttactcaaaagatctgagaattagagagtgactgtcaaagtagagtttaatggcagcttcccctgagacaaaaattttgaaacaggaggctg

SEQ ID NO: 481 - DNA, 598 bp, Bovine  MMBT06225
  misc_feature (1)..(158): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttctaaagtgaattaatctgtgaatgagagtttcttttttgaaaagggaaagatagagtttaggagatgagacgagttctgtacagtgattaaccgattattgtttcaacgccctcatacgagccttagacacatcatyagctctgacctaatcttcagaatgtccagcataatgagactctctgctgggcacgaagcttagattaggaaagaaacgactgctctctccttcctgcttttctcacctctctcattttaatgtctcctcttcaaacagcgtttgcagataggatatcatttcagctgatgctccttgaggctggcaaacccttgcttttaattctgaagcccacttaacactcttttgtcctctataatgctaatttaaccgcagccctcgtatacagttagcagttgaaagtgaattcctgagaata

SEQ ID NO: 482 - DNA, 600 bp, Bovine  MMBT08268
gccatccagccatctcatcctctgtcgtccccttccacgtttaaggtcgggaggggcggtggtgaggagatacccctcgtccaaggtaaggagcaaatcaactatacttcaatttwaaaaaaaaaagaaagttaaaaaaaggtcaacactgtgtttacagcataaaacctatttgatgtaggttttaaaggctctctcttgctgtaatattttttaatcatttctgacattattgcctagacctcatgtgactgcacattttgagaggagaaaagaaaaataacactttcaatatttgcytacttagcctcccattactggtcatcttcacactcatccaaagtgcttcctcagaaagctcctraagaaaaaaataaagacttcaataaagtataaaatgtatttaaataaactcttaattttaaaatagytttagatttacagaaawgttgcagacagtacagaggatttccttagattctgtgcctagttgccctgttgttgagatcttatatatgattcctttgtcacaactcatgaacagatgctttaaytggattttaagacatttttttaaaagaaatttttccactagaaata

SEQ ID NO: 483 - DNA, 600 bp, Bovine  MMBT06178
tcatgacttaggcagagatgacatgaaaactgtcattttgtaaaggagatgcaacagaagacagaactgagctgcctcagggcaatgaggggtgaacatcaagagcagtaaggacagcagagtggaactgcttgtttgaaagcttacctgagctgctttggttaggaaatcaagacgtgaaatctcaaggtaaaaaagctagcttgtgacaaagccagagtgtcttggctttagcgggaaagatcatagaagaagcttttcttgcaaacaacctggttctcttacacagtatgcaggtaygtgtaaaaaaagccaatggaacctctcaaagacgtcttaagtcttaaagarttaaaaaaaaaaaattacatggagggaagtgggttctagtgtttcacatgaaacyctttctagcagatccaagttatgccatgcaatactttaggacagaagtagagaaaaacaaaaaacaagcaacaacaacaaaagcaccccctccccaccaaaaaaaaaccctaaatgccaaatccagattttaagatatgagactaactggaatggaaattcttattgctatatttattaaatatgaaatttgag

SEQ ID NO: 484 - DNA, 600 bp, Bovine  MMBT10621
gttgtgaatcttgctcatagaaacgtttgaaccactttaagatgaccataaaaaggaacacaattgtgccatttgcagagacgtggttgaagctagagactgtgctacagagtgaagtcagttrgaaagagaaagtcaaatagcgtttattaatgcttatatgtggaatctagaaaaacggtacagatgaacctatttacagagcggaaatagacatagagggaaaawatatatagacataaagcmgaggaaggggtggtgggatgaactgggagactagaattgacatatataccctaytgatcctgtgcataaaccagatagctaataaaaatcctactgtatagcccagataactctactccatgctctatgatgacctaaatggaaagacagtccaaaaaagaggagatatatgtatacctatagctgattgactctgctgtacagcagaaaccaacayagyattataaagcaactgtattccaataaaaagtaattttaaaaatgatcattaggtgtgaaaagtcaagcttttacagactttctttaagataaaccatttaaatgaaaaaaactccagcacaatatgataaggtg

SEQ ID NO: 485 - DNA, 600 bp, Bovine  MMBT06342
ccccaaaatcagtcttcacaaaacagccagaacaatatttggcaaaactaatacaattatgtaaagtttaaaaataaaataaaattagagaaaaaaaaaaaaaaaaaaaaggcaaatgtaattttgttccttccatgcataagatccttctatgacttcctttagctattagaacaaaactcattcttcatctggcctttgcttcacttttcagctacatatactaacctcctccccatccatcctcaagctctccaaccacattggctctctttatctctcagacccaatattgctccytgtgcaatagggctttggatcttttgtctttaatttttaagtcacctgactcctcttcatccttctaatctaaattgtcatctcctgtcagaagttgttctacactttcctgcctgtatcaaattcttctattacatcaaattgggtatctcctctccttaccactggtaaagagttgaacttcttaatgtctaccactctttattatagcaaatattagagatattcacaagtagagagaataaaataatatagtctcatgtttccaatgtccaaatccagcaaatagttattcacggc

SEQ ID NO: 486 - DNA, 600 bp, Bovine  MMBT08365
ggatcctgggaaaaattaaagaggaaatcaaaaaattcctagagttgaatgaaaatgaaaataagctgattcaaaccctttgggatgcagtaaaagtagtttttttacatgctttaaaaattgcagtagagttgatttacagtgtttcagatgtatagcaaagtgattcagttttgtaactgcaaaagcagttataagggggcagtttatagcatcccygctggtcttgttgactgtgtctccaacctccataaatttcaattgataagaaagctcctggttccctttcttctgcatctywtctccccatggagggtggaggtgaagtcagacagaaattgttagatcttcttttgtcttgctgacttcttgcctcttgcagtggctttaaaggatgggagagggagagaggagctgaaatgtattctgtttgtgttttgtgcatgagaagccaagtccccatgtggtaaatgaaagagatcagcattgtctagctagagagaagcagagccacattctgtggtctctccatgcaggggtcctttcagaggtgcagcctgtggcttggcagattctccccagcctgaaatggcaacttgg

SEQ ID NO: 487 - DNA, 600 bp, Bovine  MMBT07102
atcaaatacctgtgtattttctttgttgtgcatgaaacagagtagcaakaaatgcagagtgaaatttttttattttactatttttaatttgaaaaatactttaagattayattgattgctaatttttttcctgtctttttttcatgcagatttgaaaccaaaatagattcatttcatgttactggcttaccagataactcaacaaaaccccgcctcctgtcttcattagatgatgctgcatcactcttgaaaattatgtttgagataaatcctttagatgaaactgttgctcagaggtgyatcatagaagctgaacctttagaaatgttatatgatgcagtaagcattttttgcaattcctaagttttaatatatttctatttgccttgagtttgtcctcatgttatttatacttattttaacagagaacagtgaatagtatagtagaattcttcagacctccaaaagaggtaaatctagcacagctgacttcagtaactttgacaaaacttgaagaatttcgtgataagacagcaacaggtaaatgccagtattattgttggtttatcatttayacagtttgagtcatgttatactgat

SEQ ID NO: 488 - DNA, 598 bp, Bovine  MMBT06847
  misc_feature (1)..(8): n is any nucleotide
nnnnnnnnaattggagctctgtgattaattccccttcattttgaagaggagaaatcagcctgaatcaccacatgaaatacaaacactaaaaggcaatgcattcagaagctgcaagtgctcagcaaaagatggagttaattaacttgaccagatactcaacgaagatagctaatgtgactaattcaggctctcaaaggaatatcaatttcttcagctagaaaactcactagctttcccatgagtgttgtagttatgccagaacgtaagagtatgtctacctccttattcttctcctttgcygttwctcactctcccatttgcttgccaacatttaaaactaatgtttataactgccttaattccccataaactaaaaatgcaataagatactgcaaaatatagttctttctttagtgatgtmttgggtggagcagggttagatattctcagtcagccgtttatagccaaaattatgcaagccctttttggcactggattgaaggcatgatgaatggggggcgatggacaagcaaaacagaaaagcacttgttcccatatgaaggctctgctgttttagtcataaatagcctaactaaaa

SEQ ID NO: 489 - DNA, 600 bp, Bovine  MMBT10875
aaaacctcagcctctcagagtaagataaatacccttcaattcttatttgagtttctcactgcctagagtgtaaggatagaaaatagaactgtctaagagaagcagagagcaagaccttttccattgtgtttggaaaatactgaaaaagggagcagaaagggggatgaggtgaccctgtttctgtccctcagcagtcagtcaacatttctggagtgctgtgacatttactgtcatttcatgtaatgtcattaaatagggcataaggtggttttagtacatgtgtcccctgtgtgcccagaygtttgctacctgttctggtgctccaaaagaaaaagatgatttgggctatgcccttgaggagctaatagggtttcttgggagcatagaacccatgtatgaaaaacacatgcagaagataaagacagccccaggaccaggccacaaaactggggacagggtgtttgggggctggagtagaagggatgtgacttgaggaagcaccaatgatggttatagagatgtgtgtgaaggatctttgtggaatggggttgggaaagaagttggaaatgcagttgcatagatgcagggagcgacttagca

SEQ ID NO: 490 - DNA, 600 bp, Bovine  MMBT06429
gatctgttggtaatttgagtattttaatagactttggtatggaatatttgttcagaactttttaatagttttgctttgtctacatgcaatttatttcctcaatgaattgacagtttggatttccctatgcacacttaaaaaaaaaacttgcttttatatctagaagtttgtgcaatataaaaaatgaaattcagtgccctagagtttccattgtttaattgaaatacttttagggatgagagattcataataatggtctttggttctctgacaaaataactattatgtataatgactggyttgtgttttggctaatatagattttatctgagctctagtatttttaaaaaacagatcctaaaccctagataacttgttaatgcatttcagtaaatcatttttctattgtaaattatattttatttcaatgtattttcatttagagtacaggtgttcaatccttttttgatctcataccatgttagctaaagaaaaaagcaaccaattcatgtttataaaataattgcaaatgattatcattgtgatatatatacacatttttttaagacaacagcaattaaaaagtgagataaagatgaa

SEQ ID NO: 491 - DNA, 600 bp, Bovine  MMBT06518
tggtagtgaacatcatttagggatcagcaagtgtcaggtactaagttcagaactttgtagaagagtttatttaaacctaaattggtactgatagatccactatgtgtgggggaaagcatggctaaaagatattaactaactwacttgtcacgtaccagtaagtggtgaagctagatgacacctagatgagagtctccataagcctgtatccttgagcattaaatggttgtattattatcacactggctactgatcatgtatgtgaattttatcctgcttcaagtcatttcttcttcccayctatatactatagtcctccagtgtgcccattttcctaagcaatttaaaagatgtttaaagactgagtcatttcaccctattctggatgagatgagaaaagtagcaaggcccatctgtcattcataccatttttctctaaaaccacttgtgattcacggtaataattcccagatggaagtcattaaagtttaatttgtatgcatatgtgacatcttgcttttcaaaatctttttgacttcactctttccattactgaaactaattgatatatatatatatatatatgagaaataactaatt

SEQ ID NO: 492 - DNA, 598 bp, Bovine  MMBT07660
  misc_feature (1)..(91): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcatcattttccctgagtgcagactggccagctctattcttctgagactatcttgataaatatactatttcataggccctgtgcatttacttttaaaatttcttctcagttattttacataggtattttagtaaatgacattttcccaatgtgtatgtatacatttttaacaaataactaaaatgaggtatgaaaaccattatcayataggaatcaccttaaagcattctcattgactctaatatttttcttaattgctttttgattcttgtgatacatacatatttcaaagtatttctycctttggaatctaagtgcctcacttttctatttttgtttgcttttttttctttttatgttgcagattgctccatacactgtatcgcatgtttcctagtgataacktatcagtttgagtagaggtttaggagctcctttaatttgcacaaagtcaaggtttttttcttcttcccctttagttatcttattgtccaaatttgtttt

SEQ ID NO: 493 - DNA, 591 bp, Bovine  MMBT05643
ctaagcaactaacactttccatttcaataggtgttcaacattaaaggattcagtgttctctcaaatcccacgacttagtgactgaacaacaacacaacaacattcgtatttacatttaattgtgattactgatacatctagtttaaatcatgctcaaacttctgtgttccctatttcagtcaactgaatgttttcattgaaagaaaatcttaaagcatattatctattctgaaaacccagcagaagaagtaatactcttgtaattaacataggcaaaacggtcattattaacatacctaygcactcactataggtatagaggcactcactatacctatgcaaaactcactatgcagtcaaaaattatatttgcttcaagcatctgccagttttgtcatttcacacttgaacagtattagaaaggaatctcactggttacctgccatatcaatattaatgaatgataagcaagaaaatcccttcttgtggaagttttaaaaatttacccatcattcttaactctcaacatcaactaattaacctttcttgtcaagccaagatattaaagtcagaggatttttgaggggggag

SEQ ID NO: 494 - DNA, 600 bp, Bovine  MMBT10672
aataaaaactgggttctaaaatgttttagatgagttacattcattttcatgcttgtcaagagtataagattgatgaaccgggagcaacgaggaatataaatatataaatggaaaacctgaatccaattctagaacctctgaatcaatggattagcctacccagtggttggcaagctgtggtccaaagggcagaaaccagcctgctacctgttttatatgagctaagaatgattattacctttgtaaggtattgaaaaaaaatgaaaaagaatagtatctcatagtatgtaaaaataatayacaattcaaattttggtgttcataaatgcagttttattgggacacagccacacrcatttgtgtacatgttgtccatgrctgctttcatgctataacccatgtggaggtaagtaggtaagtagttataagaggtaagtagttggaacaaagaggatatagcctgaaaaccgtaaaatatttactgcctggctctttaggaaaaaatgtattgatctcttagcctgtgattaattccatctttgttggggacacaggtgggaggtgatatgatgagatcctaataactgaagctcatcatta

SEQ ID NO: 495 - DNA, 604 bp, Bovine  MMBT11282
  misc_feature (1)..(4): n is any nucleotide
nnnntctagagtcgggagctgcaattactgaggcccccggcttcaactactgaagccctagcctgtgctctgcaccaagagaagccgcacaccaccactagaggagccccgcttgccgaaactagagaaaagccctcacagcagtgaagacccagcacagccaaaaataaataaataaaataaaatttaaaaacattttaagtaatagaggtaattttatttagagaaatggcagaaaaattaaatggttatgtcaggtgagggagtaagcaggagactgatgcctttctggacttgcaggaaytttttttttataataatttcattactttgatttttttaaaatgttatctattctttaccagttattgccatgagcattttgcagggacttttggtaatctcaacatctacaaactgaagctgtttctccaggtgaagaatcctcaagtggccagagtgaatatctccacatgaaatgtaacaccaccaggatattgccgtttatctattatctgccatttgtgagagttttacatgtgttatttctaatcttcacaacatcgctacaaggcaggtattgacattaccattttacagataa

SEQ ID NO: 496 - DNA, 600 bp, Bovine  MMBT10977
ttgtagccagttcagctaggcaaaagccatactttttgtagtaaaaaaaccaattctgattagagtcaggtttctcatttccattgtgatacgaacgcctaaggatggtaaattgctttgaaatatggtattaaatttcagaatggatgtaactgaatctgaaatttggaggatttacttcagccaaaataaagcagtaaaatcatgaaaattatgggaacaaaccaccttagacctacctgcagcatccactacaagtgacccaatcatcatctcttccttggtttagcgtgacctagyttgggtggagtaactaagttgccagctttgtggttgtagaagacaaataaaagatagtaaattgggctaacacaaagtttcatcaactgctatacttaattatgtttagaagattctgaaagcaagattatccagtggatagatgagagttgactggattctgtcagttcaagaaaaaaaggatagaaacaaaactctctaccattttcttgacttaaatacatcatatgtatatttttctcattctttgcatttttaggcaggtttaaaaatactcatcatagattcagcagaagtggc

SEQ ID NO: 497 - DNA, 598 bp, Bovine  MMBT08243
  misc_feature (1)..(62): n is any nucleotide
nnnnnnnnnnnnnnnnnnnnnnnnnnnnnnnnnnnnnnnnnnnnnnnnnnnnnnnnnnnnnntctccattttacttttgtgagaagaaaggtgatggagaaagcaaaactgccagccagcctaaaaacatcagaattattaataatattcatatttttgaatggttttctagacacagatacattatatgataagaaatgggggaaaaaatagtggaagtgagtaggaacattgagaagatggagaaataccttgagtatttgaagtcatgaagcataaatataagttccattctgatayaggggacatgacttttcagctttagtcttacttttaaaaaaattattgaagtatagttgattttcagtgttctgttagttttttctgtacagcacagtgaaccaggtatacgtaattcagtcttttctaaattatttccccttataggtcattatagagtgttcagtagacttcccctgtgctacacagtaggttctcattagatatatattttatatatagtagtttgtatgttaatcccaatctaccaatttttctctcactactctgctgctgttgctgctggtaagtcacttca

SEQ ID NO: 498 - DNA, 600 bp, Bovine  MMBT05544
aagggatttttttccccgctaaagcctaagtcagatatttaggaagggcttgaaataagctgttttatttgataaattcagaaatctgatgacagaattcttgcaaatagattctgagccttgttctttttgtttctttagcatctaataccagggtgtgttattaatgaataaatggctgtggaagtagcaatgaagaaatggataggatttatgcttgacatcaggagaggaggatggatgctggaggaaagatggatcagaactagcctttgcttagtgaagaactcctataaggcygcaccccaaacctagagactaagttgatcttattactgaacatagcctttcctgctaggagaagggtggttttactggtagaaacttttttggtcaaaggctttacagtcatgaggttctaaaattcttcatagaagaattcctagtttaggaaaatgatcatataagaaatagagtctggctttctattagataattaggagctgaggtcatgctctgggtcacttaaaaggtaattcccatttgttactagttgtaaactccactcaagtgagttatatttatgatcaccatctgggt

SEQ ID NO: 499 - DNA, 600 bp, Bovine  MMBT06318
atcatgtgtttatcttagaacacagttctcaattagctgagaacacagcagtctataaacagacatattttctatcttgtatttcctgtacaaacaagattttaaattcccctgttcattagcactttgctgaccaaacatgtggtccacattcatgcttaaaaaaattcatctgccctaacaatttacatatccctgttgtgttcactttccttcaaaataccagctaactataaaagcttacccaagcttgttagtgatttctaaagagtaaaatcaacttgtatttgaggaaggcaygttatagcagtactgtttatgagttacattggtgccactgtttctaatctttgggaaacaatttacaatactttatatatacacacacaaagattttagggggccagatcagagtattaacttcacttattcataagaatcttcacagtatacacacacatatacatatattgagacattctcatgcacaaatttaagtgaagataggtaggcacatttaatatatgctttagttttttgttagcacttggtcactctggttctgctttcagaactagttttatttagaaaagattctac

SEQ ID NO: 500 - DNA, 600 bp, Bovine  MMBT06094
gctaacatccctcaaaaaaaagacgtaaccagagaaccaaaatggtttctagaaaagtgaaaggggagatcagaccccttggagaagttcttctcttcccttaatatcttctaaatatatttgaactttgtttcctgcttggactcacttaatctcccctgatctattccacagatgtgagttatacttggaaacacagcgcaggactgcgtggttccgacccacgtgctgggctcgtgagcacctcggattcccacggcactgacgtcattcactgtcagcactgcccacctccctccyggcaaagagacacgtgactcagccaacagtgacccctgactcagtcactgtgggaggagagcgtcatccacgtctgtgtgagagaaagatcccaaaaggcctgtgcgggctgctgggacttgccaaacagctcctctaacaggttaattccctcatcctcccttattgtgcttaaacatggcataatttgtaatgtgtcaaaaaaaccccacactggctgacttatagttacctgggctcagcactccacattccaaatcacaaatctaagtagacgtgtttacaagagagyaaggcgtg

SEQ ID NO: 501 - DNA, 600 bp, Bovine  MMBT07693
ctcggtggtgcctcatgttcctgtggagattgggagtgaatgcttgctccctctttttttccccccgctttcctgcatagtctcatctgccctcctggttgcaatcacccacctgtattctgatacctgccaactggcccaggccttcctcccaagctccagatcctcatttctgatgcttatccctcagccttctctgcctcatccgtgccccaagcccaggcctgtgcgcttcctgtgtttcctatcagaaacactgtgtcagccctgagcctggactcagcctatttcctcctgttyctcccctctccattcaccacgtggatattccttaggatccgggattcttccttctgggtcaattttgagtcctcctcgttggtcccattcctgtatctcctctcttagcccaggccctagttatgttgcctggactatcacacatgcctcttgatggccatgctctctctgtcctccgcactgccgctgtggtcaccgtcatcacacacagatatgcccctataattgtctagttcaagaaacctgggtgactccttattgctggaggaggagggttacgtttcttataagcctttgata

SEQ ID NO: 502 - DNA, 600 bp, Bovine  MMBT05730
tccccacctggtgggtttgggattttcattttattgtgatcgcccccctcctatcatcttgctatgacttcttctttgtctttggatgtggggtatctttcttttggtgggttccagcatcctcctgttgatggctgttcaacagctagttgcaattttggtgctcttgcaggaggagatgagcacacagccttctactccaccatcttgaatcgaaaccagaggatatttcgaaagctgcagtggtggttcaggcagtccccgtgtaagaaaggcatgagcacatgtacataatgaagyatgccatgcatgtggcgaggtgacaggggcactgtttccaatggctgctctaacaaattaccacatgcttaagccacagaaattcattctgtcacagctctggagacccaaagtctgaattcagtgtcactgggctgaaacctagctgctggcaagggccaccctcccaatgtaggctctaagggaaaaactctttcytagtctctcacggttcccgtggctgctggtattcctcacccgagcagcagtactccagttacctgtgcccctactacatgccttcccactgccaccatgtct

SEQ ID NO: 503 - DNA, 598 bp, Bovine  MMBT10165
  misc_feature (1)..(45): n is any nucleotide
nnnnnnnnnnnnnnnnnnnnnnnnnnnnnnnnnnnnnnnnnnnnnctcaacccagcacagaggggctggatcagaactcacttctcatcgggttttccaccatggggttcccctcgcccggacgctcgatcttgaaaacttcatccacgaagacaatccgacagtcattgagagaatcacccctacaagagaacaggcctgttaggatgaccagcrggccagtctcaccgatgaccccaaaagacccggccacttggacatgttctcagagcccatgaacagctctgattctaattataysgtagaagaggttttcgyggggccctatgaactcgcctagctactaccctcgmaaattcaagtcctaccacatcaggaacgaggtgaaaacaaataagccagagtttcagtatgtgatgcattttcgagaataatttttaacctttggcaggtgaggcccactaagaggcaaggcccactaaacaaggctcaataggcaaaaactatgaagaagttctgatcaaaatatgaaaattttttaaaaattacaaaaactcctctaggttaaaacaaccccagggatcatctcactgcttcc

SEQ ID NO: 504 - DNA, 525 bp, Bovine  MMBT06111
ccttccaatgaatattcaggactgattccctttaggatggactggtttgatcgccttgcagtccaagggactctcaagagtcttctccaacaccacagttgaaaagcatcaattcttcggtgctcagctttcgttatggtctaactctcacatccatacatgaccactgggaaaaccatagctctgatattaggttcagccagtttcacaaaagggatttggatggagagggagctgggagtggaggagacagagaagactcttcttagcttttaagtcctgtgcttatccaaaaaaatygtccagtgcttctggacaggcaggtaagacctgactctcgtgagctcacaaccctcaacaacatgctcagggctctgagagcacagacaggcctggcatcgcgctcctgccccctggacgaccccacccccaccctgccctacgtgtggggtggaggctgaggccctgaagggagtgagggctcactgtggggcatcctggggggagctgggcctgaaccccact

SEQ ID NO: 505 - DNA, 582 bp, Bovine  MMBT08409
actttaggtctgtgaccgaaaactttaaaattacatcgtctcgtacatktcagttttgctttttgttcagtttgcaccttcattcttcgtgtgtacttcaataaatgaccaggtttcctacagaaatgaattcttcagctcccccaggatgcagaygtagctgtaattaatttttaaagcaaaaacatttcttcccacatcatcagaaaccattaytccttttaaactcctcattgttcatgttttatytagaaagatccgaaactgaaaacacgaacctcaggtcacacagaagtttcyggctcctccgctcttgactcccaggaactcggctaccttggcttgtggtctgctgcttgtctggggggagctgccagaagcgctgtstgtggcgtggcccaggagtattgggatccacatcccagtggacccaattctgtggtcttttctagggtcccatctgcctcagcctcaggtaactgtcctgctgaattgcaataaaataaaaataaagttcctcttagtttgagataaagttggaatttttcaaaaggtattttcagtaagaaactaagataatta

SEQ ID NO: 506 - DNA, 600 bp, Bovine  MMBT07941
ggcagagcccctcctggcaggagccatacacatccctcacttgccaagcactttacagtttgcaaaggactttgcgatagtaatggcgcagggcccctgggttcttgctctctgcagggtctgtgctgagctgtttacctggatcacccggtttcctccataacaaccgtgtcagggtgctgtcaccgtctctcctctcagagggaaactcaggttcagagaggttaaggaatttacccaaggtcacgcagcagggatccaggctcacccctcatcattgggctgtatttccacctccayatttagaccacaagagttctagacaggaatacagtagggactgggttcccattttacaaatgaggagagtgaggctctgaagtgaagtgacacctagctgatgagtgctcccagccccgcctgctgctgctggccacrcagaggccaggctggggcgcccctgacctgctctccccaccttccctctccagcaagtgctctcagaagaggagattgatgagaacttcaagtccctcttcagacaactggcaggggaggtaggctgggcctggtggcgggtgtctggggcactgaggggtt

SEQ ID NO: 507 - DNA, 600 bp, Bovine  MMBT08328
ggagttggaccagtcaacatctgtaagtaactttgaacagacattaacaatgatgacaatacagggtatttggtgtgactcagagtcccactgtttctagctaccggacatgcccatctcccaaatggttgtttaatatacttagtgagaagcaggtcgtacagggacaaaaacacaggttgagacaggaagcaacagggctcatgtcttacctcctaaagggtgggccctgtatcttacccatcttggactctgtcccccagccttgccctgacccccattcccttgggggacttacaycgtcccttgcctactgtgttcactggttttctattagggagcttcactaaatgacttagttcttctgggcttcatctgcagctgtctaaaaggggtgacgtacagtgctaacagtagcaggatcaaataaattagatgcataggaccaatctgccagactggtctcaccaagtttttccctcctttctctgcagctgtcgtcacaaacaccgtttcctcaggctacggtggtggcagtggctttggcggtggcctgggcggtggcctgggcggtggcctgggcggcggcctcggcggcgg

SEQ ID NO: 508 - DNA, 600 bp, Bovine  MMBT07225
aaaaaacaagtttttctgtatatatacactagatagacaggaagaaagagacacaagaaacagagagcaaatgtggctaactgatatcaattagtatttctaagtttattatactactttagcaacttttctatacctatgaaatattttaaaaccaaaaataaagaattttttaagaaatcagatcagcttgatattgaggacagactgtattagaggaagatgatgaagataaaagagaaaaagatgaggagagggacttccctggtggtccagtggttaagatttcgagctcccaaygcagagggcccaggttcgatccctggtcagggaactagatcccacatgccacagccaagagtttgctggattccagctggacctttgagtccttcccagcactttcattctgtcatcttagctccatgagatgtggcctggatgtctggatctcagcattctttccctgaaccacaattgggaaatctcgctgcaactaagaccgggcgcagccaagtaaataaattaaagaaagaaaaaaaagagagagagactaggagaagtgtggaaaagatcataaggagacagtaagctaaattt

SEQ ID NO: 509 - DNA, 561 bp, Bovine  MMBT10156
ggggctctgactgtccttaactttgtagacacaccactccctttctgcctccatcttcacatggcccttttccctgcttggtgtccctgtgtctccccttataaggacaccagctattggatttagggcccaccctraatctagtacaggttcttctcaataaattaatgtcagcaaaggcttgtttccaaacaaaatcactttctgagattctgggtagtagtgaattaggggggaacgatgttcaacccattcccactagtgtccatgagaaatgggccttagttgtttatagatgcygagcttcggggtatttgtcactgcagcaccactgtgcgaagcctcgctggtccacgctgtaatgtaattatttgtttatacactcgtcttccccagacgctgacctcccgccgaagagagacggcgtgtcgtttgttattgtatcatagaggatggttaggaaagaaattaattttaccggctggcaccagaactcattttagagatgcaactgggcttgtttaggaaaataccttaattagtactcggggacggagaccg

SEQ ID NO: 510 - DNA, 600 bp, Bovine  MMBT06453
ccttggggtcaagtcaacaaatgggaccagaacccaggagaccagagctgccataagactaaaacactgatcctagaaaatcgagttaacttctctggaccacctcttactcctggatgagagaagcaaccataatatcagggcttgcttcgcaagtttgagagtgagagaagacttaggcagaaaacacttttgaaaagttaggccgatcattgttaacatccccatgcaactggaatcctcgtgacaataatttttgcgtgtcgggcccagacgagggatccagaggaggcacagtcyggtggcatctgtgcgctcctggagggagacagaagaccgctctgcatcatggcaggaagggagtttcctatttccaggagaaacaataaaaaagagctatctcttccctaagagcttgtctctgaargacatgattctcatcaacattgtcattcaggcataagtgtatgtggtaccaaacagtagcctcagttcccctgctgggggaggacgtttccctgcccacagtaaacataaacccagataatttcacagccagtcggcgtgagtcagcaagcactctgagctgcccctgtgtgc

SEQ ID NO: 511 - DNA, 593 bp, Bovine  MMBT08504
gcccttgtctgaatggggcctgtgaatctgaattgctaagccactcccaggtgacgctggtactgctgacgtggggaccaccctctcagtagggaggtactctcgtgctcagtcgtgtccgactctttttgaccccatggactgtggcccaccaggctcctctgtccgtgcgattttccaggcaagaatattggaacgggttgccacttcctactccaggagatcttctggatccagagatcgaatcctcatcttctgcgtctctgcattggcaggtggattctttaccactgcgccacyaagaagacccagggaggtactaggacatgcttaaattagggacttgctgagtacatcagccctgactcgggcattcaactttgctgccagcctaaggaaggcaaacagacatgaggacaggcgacctcaagaccactgacttaaacaaccaaaaaaaaaccatccccaagaggcygagactttgcaccattttgctgtttatttcaagtttacagagaagcttaaacatttgtggaaaaacactgaaggcttattttttaaattcatgtacttttcaggataaatacacagta

SEQ ID NO: 512 - DNA, 600 bp, Bovine  MMBT09695
atcgtaagtatatatccttttgtatttgggattctttataaactactaatgtgtgtttttaaaggccagttctttcaacatcaactctttttttttagaaaatattcttactaagctaggaacaatagtttattgatgtgattgttaaaaatctgtctcaagtgaataaccagcaccgtacttgacagtacaaggcactcccttattgtgctaagtgccactgtattttgacatcgttctaaaaggtgtagctcttacactagtaacacatggaaagagaaggacatttggcccttgaayaacaactcttacacatgcagtgcttgggggagcctgtttcctgagtgagaggctaagagtatttaagaaagargatgtwctaggtacatacactagaatattatccaaaaattaaattttaaaatatatatttgtgtatatacatatatgtacgtgagcacacacacacgtatatatgtgcatcattctcagaagcacactgaatgggaaaaaaagttgcccaaaaagcccagaatatactgttcatattttaaacttagaaaacatcaccatatgtatatatgtatgtgtgtgtgtgta

SEQ ID NO: 513 - DNA, 600 bp, Bovine  MMBT06584
tctgcttcgtaaatgaggaaactcatgctcaggcggttaaagatgaagtcctgtatccggaaaaatggtgagatgggcttgtccgatgacagttagcaagggtctttcggattccggatgttggccttcccagattcttattccttgaacgggatcatctggggctcccgtggccacccgcaagcagccagacgcagtggtgttgcagaacgggctgggagctctgggtacgacgggtttatttttttttttttgcttggctggagttggtgaccacatgataccagaagmtttcccccygccgtggggctgcttggcgccacctgttttccttctgcagtcatctgccccttcgccaccccgccctctgtcctgcagcccaaaaccggtgtgaccctggcgtctcatggttcctcagccttgctggtatgtggcagcctgggagcgcctatatatagaaagacacacaagcacagaagccacttcctctgcctgcgtctcagtttcctcctcagccaaaataggcctgtgactccccgctcctgacctgctgagctcatcggcccaactccccctcactccgtcttccctgaccccctg

SEQ ID NO: 514 - DNA, 600 bp, Bovine  MMBT07951
atgaggaatggccatcgagaggatgagcttgctttcccttggggcccaaggccttgtctggcctcacagggcctctgggagcagacagtctgaccagagaggatctggtctcggggatcagaagggccatactcaggctcctgatttgtatcagtgtcccctctagaccccactgttttttccaccttctctggcttccagcctccaatatcctttctctaccaggtgctggactatttcctgcagctgcaaggctgtgactaaatacctacgttgtgcctytgtccatcttttcagggyctctaggactgcttggttccactttagctcatcctagaccaccaccagcctagctcccaaaagcaagcaggatcttggtcctggagcgaacgcttctatacagttgggcacttgggattttcctaatagaaatatttttggtgcttaaaggtcagagctgggctaagaggagagcccaatacaggtgggttggactaagggcctcggggctgatgtctcccctgtgrtctctcctaggaccgagaggagcggaagctgctgctggaccctagcagcccacccaccaaagccctcaatgga

SEQ ID NO: 515 - DNA, 600 bp, Bovine  MMBT07705
ttttggaaagccacatatgatacacattttttgtgtatatatattagtgtgaataaaacagtaacatcagtgcatttttctaaagcagaaaacttctgtaattttcttgtcttccttaaaagtattcctttgagttcagtgttcatttacttttcattgtgagcatctgctctatggttaatgtctaactatagcatttgctcctaataatagaattaggacagtagagtttttgaactgcagctgaccccagacggcatatgttccaaccaccttattctgcatccaaggacacgacaytaaatgcctttctcaggctgctggtggcagatctgggctggagtatggttccacccactcccttttggccttcatttctcgacaccagtgctattacttttcacttaatttcctccyaacttccccaactgatgaaataaaaataagagttatttatgtatattttaataaaatcctgttcgatttttcaacttacagctggttttgtctgtattattcaacctatgttttctgaacattgagcagaggagaaacccttgaaccagtgtccatagtagaaacatacaccagagcagtttt

SEQ ID NO: 516 - DNA, 585 bp, Bovine  MMBT05738
gagattcttgtcagcgtttgacactgttgacttgggagtgtttttctccttcaggagagaaagagatgcagctagagagtttatgtcctaatttacagagaagtcccagttgtagctttaaggatctgttttagcccacaggagtcttttctggttggttagattgggcagaggttgccatcctactggagtaatgtgctggggattagagaccacatttagagggtgggaatgagaaaatctggaagagaacaccaaggaccattctagcagatgagtcagaaacctgaagtgggggcygccaaactctttaggaatgaatgtctcttcagccctgggatgcatacaaagcaagactgctttgtgtaaatgctcccctcctcgcccagcgactgccaaaggcagaagggggtgacactcagggcacagatttaggtcttcattctttgaacttgctccagcctttcctggctggggtgacctttttgttaattggcctcttgtggggtagtttccctgcctccccctataggcctggggccaaagggacatgaacatccagtacttcctttgtagccaatgtgt

SEQ ID NO: 517 - DNA, 600 bp, Bovine  MMBT10142
ggtgtaattttgggctggtgacctcaccgtgcggcacggtttactaattttacattttgccgggagaaggcaaaacctctcttagcaggcgagggaactctgcacacagcctgacttgactacatcagctatttatgttcaggcagacagagctaaaccggtgcaaagactgtagcttcaagaaaaactcttcaagaacgaactttaaatgcttctcaaaccgacaggggaggctggaggcttgagacctggaagttctctttcagcgttcctccttagtcgtgttacactgagacggcycaggtccctcgtggctggggaggcatagagaatgggaaggggccctgggacaggctgtacaccctgcccaggccctccttcgaggagtaaaccggatcgttaacaggcgaggatggatcagcctttccatttattccccccaagtgagagtttatgtcacacaaataactagtttgggtggatctcttattaagtggacgtggatctgctcctcatcacacacaggggacactgccagccttaatcctggtgtctctaatttcaggtaaatgaatacacttctgcaaaagtggggagcag

SEQ ID NO: 518 - DNA, 600 bp, Bovine  MMBT09038
cttcaggccatgtggctaagatcacacacagtgtgctctgccttccagcgactgaacttccaggtgagaccagattagacagagaaggtcggaggaaatttaattcttatcatctactgtggaagrctggcaacagcaatccctgcacgaaagaagaggctcctaattatgattaaaaggataattcaggcaaggtgactctagatcagcttcagttagtccttatttttgaatttcatatttaaatccattcccttgacagcaacygaagaagtgaaacacaggaagaaaattgtctayaaaggatarcatcaaacactaatctccatgtaacrgagactctacagaatttcaaaggcatgttggtacttgagtgactgctatgyaccaggcaatgtagggggtgatgggacacaggatacaatgatgctctattcggaggcagttcctgtggtatatgactcctcagtaagccctgcagtgcaggcttgctcatatccatttcacgctatttacgcctgcygaaggcggtgtgcaacatggatgccagtcatccccaktcctagtagccatgcccttatgtcaccattggtgcctgct

SEQ ID NO: 519 - DNA, 600 bp, Bovine  MMBT09350
ctgaccttcactactgtattcagaattcaaacagtcagaagcaactgccctttgtctcctcaaatgtttgcttaagaactctaagtcaaaatgttaccacagtgttttgagatttctcagactctttggcataaatgtacatgacagaatctgcatatattcttggttgattaatgttagtataataaaattgttatgcatctacttcagttaagataagtatttataaatcaactgtattccaataaaaatgcttaacaggcaaatatctctaaaggtttctttcatttttaaagaggyatgatattgggaatcattttatcctgtcactggagcttccttctgaaacatatgttctgtccattaagttgaatatcaactaaaagatgtttgagaaaaaattactttgatttctaatttataaagatgtgcagcacatttgtggatgtgtatctgtttgcaatcttgaatttttgcaggtagttcttttgcatccatgatatggatgatattttcctttctttcacttaaacaggggggaatgcttagcctttaagctatgcaactctctctagtccattgacggtaagcatcttgctc

SEQ ID NO: 520 - DNA, 600 bp, Bovine  MMBT06980
tagtgttattagaatggtattcatggactttgaggatgataactaaatctaggttccatatgccaaatataacctggcaccagctggttacaaatctgttctcatctctctgaggaagtcattttaaaattcatgacttaaaataattccttgtacactgtgaatgtgtattcatatacagttgtacttaacccacagtgtttattctactaatctaaattatattattttaaaaagaaataaaaattatcaagataatatatatgcagcaaaggatatctctagtctttcatccctgayttgtcattacattgcttgaactcagactcagttcccagaaggattagacaggtggtctatagaataatatatggcatkttttttccataattagtcctctgctctgagtccaagatgactggtctaagcttatttgagcttagcttatttgagcttcttcttttagctgagttttctgctaggagatttattgcattatgaacaaaatatgaaggcagcatcataataaaataaaaccyttgttggatattgagacataagcaacactactttgaaaacttccctaaagaacataaccca

SEQ ID NO: 521 - DNA, 600 bp, Bovine  MMBT08602
agytgcacgacayktgttcatatgctgtatcaggagcataaattggtggacttaggtattattttcaaggccaacctaagtctaacaccaggtcacctaaatatttctgaaaataagtttattgaatcagggtaatatgtcaaataattattgacatgctagaaatataagaataatatttatttwaaaaactattagtatgtactatgtactacttggaataccttaartttttgaatataaaatagaaatgatagtttgttctttatgcaaattataatttgtgcttatgaagatttyaaactattatgtttccatatatacatacagatctacatatacatcatatataataggattgcttcatttgttaataaagtataaattataaaaataaaatatgaactaaaatgatctttggccactctaaatagagatgaatacattattaaataataaattagagaagagtaaaactgtttcttcacataaccactattacacccatatctaatggtgtgtaaactatgcttaaaaattactaaaggaattgcactgtaaaactgtatgtgcctttaagaataagttagaacaacctca

SEQ ID NO: 522 - DNA, 600 bp, Bovine  MMBT06036
tgtttttacctcttagagtagttggtacttaaggactaacaattgcattttggcacatgttcaaacagtggactaccatggtataacttatcattattgaagctaaaacagaagtatttctgaggaattttaataacttctaatttgtttttaaataataggttaactgaaagagccaaaaagagacgtacgtcttcacaatctattggacaagttatatctaacaggcatgaggatacaggttccactcaagtaaggcaagaacctcatcattaaattacgtcctttttcagcattatyctctcaccctgtgtccttgtctttgtctttagggctctaacatttttttttaatgtgcttttattttccccttttaccctggagtgaaaataggtcatcatttccttaatgctttcacagttttagttaatttcttataacttgatttgtgtattcaatgagtgacttgggggaaaaaaggtaagattttcctttaaaaatcacaagactctttgatttttcacttcaaaaaatgattttaatatcttactttatagattaagagcaattgccaaataaatacatcttacttttcccaag

SEQ ID NO: 523 - DNA, 600 bp, Bovine  MMBT06399
ggccccaggacagctgcctgagctcttgggtgctctcagctccctgtcttaatggtggttcagttttctcgctcgcctgagagtgatcctagtgttgagatgcacttttcaaacaggtggctaaacatgaagccacctactttatttgggttcagctaaataagagatctactctgacagtggaggaaaaaactagccattttttacttactaaaatggcacacgagtctttgtttcatgtgaattctaacataaaaggttgtatactgtgtacttcatgggtgacttaaaggaatttcygagacaactttaagcaaaatttgatgtataatcaagaataasaggcaactctacttgggtttttgtttctcagtttcatcagctataaaatgagctgrtatcaggtgatcatttacagcttttccacccatatagagttgtgatatgagaagagaagaatcagatttaatgtatttgcaaaagacagcactaccaagcagagctgttaggtcctgtccagcagcagagcgattctagaagacaaggagttgtgagtcacagctgatgctygttagtcacatctggaatgagcaggctgct

SEQ ID NO: 524 - DNA, 600 bp, Bovine  MMBT07571
cttttaaatatatttttattactttaaaattaactgatttatatcaatttaaaccatattattgatcgagcaaatactcattaaatgctcagtatgatacttgctcttgaaaagtgtaagtatagagagatctaaaataaataactttttatagtgtgataaatgttttaatataaagatattcaaaatccctgctaaaaatgttcaaatttctctaagctgggtaaagaaaatacattaagaaaatgaaatgatataaatgtctgataatgattttaaacagcaaaagaaatgtactgytacttttttttttccttctaactasaacacagattgttttagatacttgatatttgtttaatcaatgaattagtggatggacaggtcttcatgcaattgcatgctctatttcaaatatattaatagttcaaaattgaaggtcagatataaaagacaattgactgaagagcaccctaagtgcttatataatagttttttcaagttggtttttttgtttttaaatctaacttatttagctgagttcttttgccattttgaaacattttcctctagactacttaattatagcactctccatta

SEQ ID NO: 525 - DNA, 600 bp, Bovine  MMBT05833
ttgccctatatcctaaaatcaactggaagccaaaggagaattttgagcaagggattggaatagggctacaggtctagtgtgttttgatgaattcactctggctacatggtggagaacaagtagactggaaagggagtcagtgattcctagaagcacagttggaagactattacagtagcccaggtaaaaaacagtgatggtgataattggagaaaagtcatcaggctatgactatgctatttcaggaggaaatagcagtagaacttggagatatattagatataaaggtggaagaaaatyagaaaataaaatttctagttgggcctttatctgctgacctatgaagtgacacatgaagactgggtcttgctgggttgacttatgggtatttgaagtatgaggtgcctttaccatatccttaaagaaaagatgctgaataacttatgtgggtctgggatggagatacactcttgtgagtcatctttaactataggtgcgctaccccagaggaagcacagggaatgacgggggctaagatcacgcctgaaagagcattaatgcttaaaatctagacacagtgaacatagggctgtttttgaa

SEQ ID NO: 526 - DNA, 600 bp, Bovine  MMBT10104
aaaatctaaagaaaaataaaatattaagatatagtgaataatacagggtgctttaattctgtttctctttttctatgataataaataagaaagaaaatttaatagaaaatctaaaatctatcatttataaattaagaayaagaattgctgaaaattgtcttatttcataagcattagggaaagactagtcataataatatatattctttaggaccaaaaaaaaaaaaaaaaaaagaaagatcagttaattttaaagattcactcaacaattaggagaaaaatctggattgcggtccaagyttttccygtatgtatgtgaccttgggctgtttccacttttagatcacctcttaaatcatttttaattgcaaatgttactattctccaagggctcaatataaaaattctaacaattctatgttcacmtccattcattctgagtagcttattcactattctctaatcatgtaattgactttcatatgctcttaaatagacatgaaataatggtttactacagcgattggtcacacacatttgctctgtctggagtcgtaatctgcagaaactcctttttccccttgtctatttgttaaagtg

SEQ ID NO: 527 - DNA, 605 bp, Bovine  MMBT09312
  misc_feature (1)..(5): n is any nucleotide
nnnnnagtatagaatccatttatatgaaattctacacaaaccatgacagagagcagagatatcaggaaaccagcttgggaagagggctgactatcggggccaawaaggggctttgggacataatggaaatgttctgcatcatgattgtgataatggttacacgactgtatgtctttgtcaagctcakcaaacggtacttcttagattgataaattttattctatacaaattatctcaataaaactgagtttaaataatcctcttctctccaagagcaaagaatgggtatatcaggcctccaaaayagaggaccatttgtctgttttttatagaasgaaggagaaaacatctaatttctccaacaggtcattctgccttgcttataaaacatctacttttaccttaataagtttacattaatttctcacttgcaagagatctaactagggtatttcttgatggaaagaaaattatttcttaagtagctcaggaagtctaaactacacagaagtataaatcataaaatcttctaatatcatattcagatggctttatcccttctggaatgctcattttcagctttctgtcttgccaatactactcca

SEQ ID NO: 528 - DNA, 600 bp, Bovine  MMBT06395
ttagattttcaaagtctaagcattagaatcccccagtctgtctttaggcagccagctttgttctgtctgtgaggtcatgactcaaacagaaaggctccctgtgggtgaaaaggaatgtgtctctgatctcagtggcattgtcctgggaagaaattgagatggtgtgtcagaagacctgcatttgaattccaactctggtatttactgtcagtaagaagtaactttttctgagctctggctttttcacctgcaaagtgagcataacaaagcctggctcagaggggtctgggaaagactttyaagaggacaatatatgtgaattgctcattgtaactcaatagcattttaagaatattagttgttggaawgtattcttttaygttgaaaggagtttgggttttggacttgagtacttagtttagttaatctcttgagcctaaggatcttcatgtactaaacaataaaaagattgcaacgtacttttgctgcttcttgtaaggattaaagaggataaagtatgaactgcctctagcaaaaaccatggcaatgcatgtgcttcctgcaaaagcataactctttcttaaattaataaaccatcat

SEQ ID NO: 529 - DNA, 600 bp, Bovine  MMBT06397
aaaaacaatacaaatgaatctatatacaaaatagaaacagattcatagacatagaaaacaaatttatggttatcgcaggggaaaggaagggggagggataaattaagagtatgggattaacaacctactatacatgaaatagataaaaacaaggctttactgaataacacaggcaattacattatcttctaataacctataatggaaaataatgtgaaaaactatctatattatatatatataactgagtcacttttctgtatacctgaaactaacagaatactgtaaatctcctatacygcaattaaaaaaaatgctcaaactccaaaatactcttattaaaaatacatctctccttaccaataacagaataataattcctgtgttattcactctgacttttctagctttctctcatttttcatytacttaaggtcttatcagaaagagaagggagaatatatgaataatttcaaacctgttagaagtgcacactgatggatgtcttcatttacaaacttcataaagttatcctcatcctaaaacaagagaatttaaaaatrtttctattttaaaaacagcttttcaatccagaaatat

SEQ ID NO: 530 - DNA, 601 bp, Bovine  MMBT08298
  misc_feature (1)..(1): n is any nucleotide
nctgaaaacttgagtaaagaagtgttcagagcagaatgttaggaaagtcctctggcgctagtggttttttggtaacattggaggaaaactgaggaggaaaggagcaaagtcgaaggacagaagagcgaagaacagttaaggggttctatcacttgaactacggagaagtcagaaggctacatagagtgatagcattaggaatatgtgttccagttcttagaataactctgttaatataatcctacgataaagggtttttagtgcacatttgttgaattaaagatgtgtttttgaaataatycccccagtttttcagtattccagtataagtggttgtctgccatctgtcatttaaactttattttaaattaattttttgacatttttagcattttaaacatgttaataatttttaacattagtttaaacacaaactattttttaaatgtaagagttaactgaatccaaatgataaatgatttatcattcataggttgaaaaatattgaaaaagaagttgaaaagaaaagaatgaatgtgtttaacattcgttctgtagaggattcccttagacttggtcagctcaaaggaaatcactttga

SEQ ID NO: 531 - DNA, 600 bp, Bovine  MMBT06964
aaggcaaaaggatgagcagatatagtatgtgaaagttatttattgctataaaaattcctctctgaccgttaccctgtcttccagaaaacctcagcaatagttcttggaatgcaaaatggaccaaaactgaagtgatgagtgttgtttttaactctgctgtccctaggattttaccttccccctccatttagtcagatcagtccaaccccatgaggttttcccattttgatttaaaggatcactgctccagcttgtgtttattcactagtgaaggaagaacattcctgattttttatttcytgacaattgatgggttgtagtaggcaatcacatctgaggaaataagtgaaactaaaaccctgaaatttattattacacatatgkctgctgctgctgcttctgctgctggtaagttgcttcacttgtgtccgaccctgtgggaaccatagacggcagcccmccaggctcctctgtccctggtattctccaggcaagaatactggagtgggttgccatttccttctccartgcatgaatgyatactaagttgcttcagtcgtgtccaactccgtgcgaccccacggacagcagcccaccagg

SEQ ID NO: 532 - DNA, 600 bp, Bovine  MMBT10484
acaatttactatcctaaagtagttgaattaatccactcactgagttaatttcatattttcagggcatgtatttcaactcaatartttataaatgttcttttaaaaaatagaaatatccrtaacacatgcatatcaggtttgaccatcatttctgtcatccaccagaaaatgaggcagaaaaacccattagcattttgttaatgatggtgcctacaatgtraaaaaccacaattctagattctttctaacaacacttaaatctaaaactgttttccatcccagtttcccccttgattattyattacttggcacacaagaagcrtctcttctctttcaagaacatctttgaacacagaacacagtgtatcatacaaatatcacattgactacaatctaactgaaaaccgtgtggtcctgacatttgctgctgtcccttcgtctctctgctagcaccatatcctaaatttacaatctgctagagaatattcagcttggcttcaggggcattctggtggcaagaaacctccttgggggatataattctcaagttcgcacaaaagcaaatttctcatctttgggaagcttgtcggcactctggct

SEQ ID NO: 533 - DNA, 600 bp, Bovine  MMBT08302
gctgctttaatcctcataataggccaattttttctacaatgattattccacttgctaactttttttggtctgaagtatcaattaaaaaccctgtgatcttgtgataaagaaaaattttgcccccaattctgtgaccttgtgaaagagaaaactattgccccaaatattccttacactagtttttccctgaataagaactaatgagggcttatgggataaccagttacatgtatcttcataataaatcagattggggtgttatatctgagcccataggaaattggtctttcccttcatctygttgtgtgtctgaaagatggtgacagttaaacagtaacacaggtttacagattatgaatgaaatttagctgtctgtgcttcattcctaaaaattggcaagtctttaagtatttagagttaaaaaaaaaaaaggaacactccatagctatatgttgtcaagtggtgtatatagagtagtttaaaaactttaaaaatcagagcacattctccaagatttgagaggggcatgtttactgtgatcacaggtagtgagtagattcacctccagacattgtatgtgaaaaagagaagcttgaatgt

SEQ ID NO: 534 - DNA, 600 bp, Bovine  MMBT06457
cagggaatcagtggctgkctgtgaagttgttcatgttatttgwttggaaaacaataaaatgcagatgtaatcagtgggtataaggttagaccagttcttggtccaagtttttscatgagagtgcccatcatgccacagggatcccaccttgagggtctgatgtaagttgttaacttacttaaagtcttactctctgtcttagcacagtcacgaattttatattctattccaccaccatatatttggatttaataatcataaaatatttttctttgaggctattaagtactcaaggaagayatttctcttatgaatttgaatagctcaatttggaaactcagaattcatttagatcgcaaccaaccatttacatctcatttagagttgagctgaggttgtgtatgttagaggtcttacagaggaataaaggaaggctagcacacagatatccatatagcctcrtcctgctctatgggtagcttctttcccatamgacagctcagaagcagagtcccttgaaagcatccatttattcatcctttctcatgaagactgaaaatgtcacgtgccgatgatgcaatctggatattgctgactcac

SEQ ID NO: 535 - DNA, 600 bp, Bovine  MMBT08647
tgcaaagttcatgccttggtgtggtggcagtcagaaagaaaggaagaaaccacaagcatatgacacttttatgttatcataaactttagtcttgtctcaaaagataataaattaccattcttacctgtaatgcactgaaactgtccatcttctcttcttattgtaaatgcttcccctgggttaacttgtaccagaataaccttaaaatgaggggaagaagtattaattataagaacagcagatcaaatctgcatatcaagatattaaacgttgcaagagagtagatgtatgctatttaayaggggaaggaaaatggggactacacatttgctgaaaaaattaattacttcacttttctggagatcagacttaagccaaaagtaagggaataaaaaaagacactgcactgctgaccttccaattcctaaacccctttaaaaaaccagagttcggatctgacagttacactactctctgtcaaattaccgaataggttcccttctccactcagcttcttccatttcttacatccccgtatccatgctgccattcttgagacttcactcagttcgcaggacagatcagccgggcagttttctt

SEQ ID NO: 536 - DNA, 600 bp, Bovine  MMBT09813
aactgctattcttgttggcccagaggatattggcttacaatgcaaggtttatacataagtgaccttgttttctcctttgaaattaaagatagggttgaaattgacaccactgagtatataatatattttttgaatggaagctaaaacagagcatttgtatctggggcaagagatttttattttttgatggaagaacacaaaggtattttataaaaacaagtatttgatttatgtttgtgtgcctcttaactataacacagaccaatgggtttaataaaaattatataaacctgtactaaytgagagtcttccgtgtacaatcactggtgagcaatgagttcccctcatgaagaaaatcacacagaaccaagggtactatasaagaggcacctaaggctagtggtaaacatccttctaccactgagtttaaatgattctcttattgccccgtatttctcatcagtgaaaacaagggaaatgccaatgacaatagaaaagttatcactacattgcaaaatagcgtatcattagtaatgggcaaatgtattttttttaagtaagccaaatgaatcattccctggaattgtcaataaaaaatta

SEQ ID NO: 537 - DNA, 600 bp, Bovine  MMBT10220
cttttctccagcccagtaatgaggggaaagagaagaatgagcaggggggatggactgagtccctttgagataatgaagaatgagctgtcactgcacaccatcagagatggcttttgggaggagacttgtcacggagatgtgagcctaccaggcggtggacacctcaactgcgaggtctccatcaagagaatgtgccagagtgggcctagctcagacagcatctacctgtgaatgtcaaaattggcttgaaggctagtatttgtttctctggaccactccctcattatttccattctgtaygttctgacccagcaggagaaatgcaggaggtggatacagaccatcctgagtatcctctgttttgagtagtatctcaggccctgccaaggtacacagcacgcacactgggccaaagagggcacctgcgaaaagagcttctctcacaaacactgctgctacagacacacacacacacacacacacacacacacacactgctggagagcctcccgcacaaactaccacctcatgcacacaggaagtcctggatttaatggctgggcttatcttgtgcaacattcccaaggctccatttttcat

SEQ ID NO: 538 - DNA, 600 bp, Bovine  MMBT07926
ttcaatgcagtctcatcatttcaaggtgatgtgtcagatcctttcactaaatggtggagtcaattcctctgactccttaaatctgagttggccatgtgacttgctatggccaatgtcatatcagaaactgcagcagaatactcacgacttggatatgcttggcactcagtgtaattagtttatgcccaagcaagaaggacttattccttattgattgtagagcttcttttgcttcctcatttcataggcagtagataaggaggtttaacatggggtcataatgccacaagataaggatayttttccstattcttcagagttgayagatttaggctgtaartacatgagagagggagctgcaaagaatgatgagagcggtcaggagcaagatgcctgtggcagaggactttttctttccccatagcaaaggacaagctcaggatggtgaaagatatgtgtatatgagaaaacaagtaccaacacagctcaaaatgaagttaatatatagaatagattaacatttcactaagtgtatttttaatgagtcattgaaatgattatagatttacttgcagctgtaaggagtaatacagtgagatc

SEQ ID NO: 539 - DNA, 598 bp, Bovine  MMBT06597
  misc_feature (1)..(209): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcttatgtgcactgggtccttccttttgttcagccctgtgtacaggtgatttataaaggcaatgtagctaggttattactattattaytattgggatatcaatgtgttggaagaactactaaagtctgcatttctagaatactcacatagttaaatcctcgttacaaaggagggacccttatctctactcaccttcatcttaacttcatgaacataattagctagcaagcctaaagattttttttttcttcttttgctttttctggtgaaaccttttctaggctgacagtatatattattcctattatcttttactttcatcagtttcaaaaaaactatcccccaagccccatttctattgcattttcctccagatcttggagaag

SEQ ID NO: 540 - DNA, 600 bp, Bovine  MMBT06169
atcaaaagaaatgacaccagcagagatggacaaataatccatattaaaataccaacatgaactggagtttaggaattgtttataaccttgaaattcaacaggaattgcacatattagcacacatataagaatacacagatgatggaaactttactttgcactggtttaggaaaatggtaattcttaggtggaattgtgtatctctgtttaggaagattataataatttgcctggtcttggaaatagtatgaataaaaagagcacaattcataaatggagatcctctttttcccctttcaytttttcttaamatatattttttaaaaagtaactattttagaaagtaaaatggatacaatttgctgatggagtatgttgttagagaatctatatttttgagttaacagttcctatggaaagaaatgcaaaattctttcagctattgaaaagcattggagtgtgatggcaaagcttaaataatgtcctgggttttttggtcagggaggggcttcgagatgtctcttgtgtaccatggtaagaacaaatatatacaaatactttcatgacactggtctatctttctctaaatgtttttgttct

SEQ ID NO: 541 - DNA, 600 bp, Bovine  MMBT08702
attcaatgaagtcatgtctaacatttgcaactatatgcatataaacatttaagttcactgtagcacagcatatccaaccataaaacatcaaagtgtgaaaaggctcttcctgcccttccctaaattggtracacagaactttttcacttccaaatgtgaaatgtgatccacacccagaatgtgtcataattggcatggatatgctattaaaactagagcttcttttgcagacagctacataacatctcaggcatgttggtaagaaaggaatcataattgagactggtggtgacagtatcyggatcgttagagaaaattaatcctattttactaatggcaattcctattaacaatgcctgattttgccatcataatataaatagtctagagtctctactatgtgacacataactctgcacaaaacagccccacgcaaatgttttgggtacagagcataaccatgactacgccgtcatcaaacaaccatatacacccaagtctttgaaaacttttggattggggccggatggaaggaaaaatacataaagagaagaaaaaataaaaagcaaaaaatgaggattttggaatcctcccactgag

SEQ ID NO: 542 - DNA, 598 bp, Bovine  MMBT09256
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnncactggacagatcagaaaacatccaatatttaactaaaagataacttccaaaggaaccctataggttcaatatctaatcagctcaatgccyatgcttacgtgttttttactgcgtcatgaaaaacaacagtaatatttatgagtaccctcagaatcccataaaagtcaatatggaacaatgataaaggcattaccactttcaagtctttgaaaactgayaatctggacagagtatatagttctttactaaccatactgtagcctctaaatgtactagatgttttcatggttgctataataaatttcagtgataaagtaagaagtgtattaaagatgacattaagattagcaatgttttggctaatrttcaaatatatatcagaagttaacagtcatggataaactaacataaaaataaacatttccctcawccagttttagattttaaccagataatttggtctaaaaaaggaaaagtgtcattatacaacatcacagattttttaacaatacaaaa

SEQ ID NO: 543 - DNA, 600 bp, Bovine  MMBT07717
aaaatggagttaatgcaaaaaaaaagttgtgagttcatacactgtaatgtacccatctaacaatgatttatggagcacctactatgtgctgggcactgtgctagttgctggggttacagtgatggatagaattgtcaggatctttattgtaagggaaattacgtcctggcatcctttaaaatgttttattatgaaaaaattcagaccttcaggagagtgggcagaacagataatgagcttcatctacccatcactcagtctcaagcccaagaaagattttgctacgtttgctttgcctgyctcccgtgttttttactgaattattttaaagcaaatcatagacactgtgttccttgtccattgctatatgataaacagccacagattcagctgtttgaacaacacacatttgttatctcmcactttccaaggtttaggaatyggaacacaacttggctggatcttctgctctgtttcacaaagctgcaatccagatgtcagcctggcctgaggtggcctgggcctagtgtggttgttggcagaattcagttccttgtggttgtagggctgaggccctcagcaacgagaggcagtcccata

SEQ ID NO: 544 - DNA, 600 bp, Bovine  MMBT06974
tagatagtaaaggaactcagccatacatatacatgtatccattcttccccaaactcccctcccatccaggccaccacataccactaagcagagtttcctgttaaataaagaattttgaatattttactgcattgacactgaacattgaatttaaaaataatgacttctttggataaatggacaaactggcagatgagtatcaaaattttgtcataaaacaataacgtttaatgccatgcatgaacaagagtagatcttaactgttcctattacacatgaaaagtggtaactatgtgaggygatgtgtgtgttaattaacttgattgtggtaataattttgtaatgtgacacatgttaaatcatcatgctattattggttagtcactaagtcatgtctgactcatcctgtagaccttaaaaaatcttgttgtataacttaaatgtatactttaaaaataaacaacaaaaaaaagacacacataagaacaaagtatatcagtgaaagttgcattttaaaaaattgcatattatgtaaacaactactatggcaaactgatttcattgtagttrttttaataattttggctatgatgaactgca

SEQ ID NO: 545 - DNA, 600 bp, Bovine  MMBT06581
tgctgcagtccatggggttgcaaagagtcagacacaactgagcgactgaactgaactgtcacatctgttcacgctttattaaccatgtcatgtgttcaagyccaacacgaatattctattcttcccatgccaggagaagggagagagaatatttgctagacaagaatagagtctaccacagaggatgagatatgttttagagaatatttcctcttccaaaggagcccagtggaaataatctttcctaatatcagaagatcccagtgagtagctaaatgtccttcatgtaaattactctayaagcacaacagtaagttayacgtacctattggaaaaacataaagggcaagcacataacagtacataaatttcactttgtatagagggctgaataacatacagttcaacagagaattggaaatcagtttgaattaccaagaaaaaaaaaaaaaaaggcaacgagacagaatgaaacagatgaatttcacatagatctgggaaaatctgattaggtaacccataattcttcctctacctgtgttgccttaatggaaaaaagataattccagggaattggactgggtttatttgaggggccag

SEQ ID NO: 546 - DNA, 600 bp, Bovine  MMBT07204
ggaaactggctttgacgcacagaaagatggaaggaagagcttggtagattcatggcgccatgatgccttgttcctttgttgggtcgggacgccctgagaaactctccacaccgcaagtctgcccggggacatttagctagaccctccgaagtgaacttcaggccaaccggcaagagatttgcttccaccagggctgtaagatagttctcactccctgactcaatttcctcagctactctagcaataatttccaaagctgagaagaaaaaccagtgtcatggccaaagatgaaaatgtcaygygagatattaaatgtcatccgagagactgtacgcttaacggccccgaagtgctttcaggcttctgagaggatttcacttcctggccctggagaagctaagtgctgccttctattcctcctcggcattcraaaagtcataaatagttaactgtgtgagtcgttttttttaaacctccccagagcacctaaaaatagcctctgggggcttgatgcctatttcctcaggtgttcctcttaatctttcaatattggtggtgacgatttactgttactgtcatccacagactctcagagacaaa

SEQ ID NO: 547 - DNA, 600 bp, Bovine  MMBT10123
attgctattttggactgttttatgatgtccatttttctcagcctgacacttcggtgggtcctaacacacacacactcactggggaagtctaaacactagagaaatacagggctatcaatcaagcagaaaacaggtgctgagaacctaccaggggcaagttctctgccgggagagggtgatacagagagaagcaaaacatcgtccccagtataaaggagcctggggtcttgttaggaagccagaatacacatcatgtaaaccaaatcactagtaagcacaggaaaaacaccactacattcyaaagaaggatsagaggagaatattttaagatgaagttgatgcaaaaacttaaagttgcttaaatacacggtcagcacttttgacatatttcagcatttttcttcactccgtttgagataatgcaccatagctccagaatcacctaaggtcttttgttcaccaccaggaactgcaaacccgtcttytgaattcatttatctacatgggactggactttgagtttgcccatgagaagcatagtatgagtcttggaatgcttgggcatggggctattttctctagcaggagttgcagccagac

SEQ ID NO: 548 - DNA, 600 bp, Bovine  MMBT06053
gggaagcgggaatgtggaaaaagccagctaggctctccaggaggagcaggggaagctgtggcactgccacgtctctcagggcctgaaataggaaggactttctaaacccaaccaccaggttttcttaagatctcagcagcagaaatttctggatccctttattaagaagccttagcttttctccatgtagctctgtgtctgctcctctcattatctctgggactgcctttctatatatcaaggttgtataccaaagaaagagaatttgattgacctggtgaaccccaattggacacagayttcttgctaaaccatcaaccacagacaagtcaatggattagctgcccttgggtccaggctctgcttctgcctctaggcagtggatagtgtccagtgttagggagttaaatgtttttattttatttttaattggaggataattacttacaataatgtgttggtttctgcgatacatccacatgaatcaaccataggtatacatatgtcccctccctcctgaacytccctcccagcccttaccccataccacccctctaggctgtcatggagcacygagtttgggttccctgcatcctacag

SEQ ID NO: 549 - DNA, 600 bp, Bovine  MMBT09806
ggtttttcttaaaagaatgggggtttactttctgaataatgtctttttattgtgacctacagtcctctcttcaaccctactcactcttcyccatacatactgaaacccaactctattggtttcttgcccagataaactaaaatcacatggagatatttgctgctctagaratgtctccatgcctttgcaaaygaagtgggktttttgtttgcttttgctttgcttgaaaacccatcccctgctcctgccctagtgcctccaaccacaattccaacttttctgagtagattaaggcactcygctttctgctcgcctggacttttatatatgtactttcagcacagcacttaacggcagttatgggacactgtctgcattgccttgctcagtgcctatcacatagaagcactgaataaaatttttgcataatgattagaaagacagaatatattattcctaggatgcatttcaaattcttttagggtagcaatttaaataaaaaataaaaataaaaataaacaaaggcacaaagcaacacttgaaaaaaaaaaagaaagaaaagaaaagcctgtgatgtcagcaagctgttttttctcctaa

SEQ ID NO: 550 - DNA, 598 bp, Bovine  MMBT08293
  misc_feature (1)..(61): n is any nucleotide
nnnnnnnnnnnnnnnnnnnnnnnnnnnnnnnnnnnnnnnnnnnnnnnnnnnnnnnnnnnnntgctaagtttagcctgctgctaaacttaggacagtaagttcctgtttttcacttgcctcttctatgttgttgagctaacaatatgtaattgttcaaaatcctgggcaacagaactgataaaacttcctggcatataaataaatgagtcaaaccgtgaagagattaaatttccttttttttccccaataaaatcatccaccttcaccatctatcagtgattgtttagaaatatctaaggygtccttacttggttaactatggataaacaatctagtttggttttccactcttactcaaaggacactgtaaatttttggaaaaattccaaaactgcagttatttgatccatcacaaactctttaatctccctgttgagttccatatcaaaacacaccattcratgtactctacrccctctccttgcctgactcagcagctccactgctcataggattattctccatatccctcttccccttactcgaagcaaaaatgcctctcaaattccagttgagctatttcaaatcctaaaagatg

SEQ ID NO: 551 - DNA, 600 bp, Bovine  MMBT07701
tgctgtgattcatggggtcgcaaagagtyggacacgactgagcaattgatctgatctgatctaaatgtcctcatcacaaaaaagaaagggtaattatgtgacatggatggaggtgttaactaacactatagtggtaatcgttttgcaacatacaagtgtatcaaatcaactagatgtacaccttgaacttataagactatatgtcagttacatctcaatgaagctggaaaaaagattccatattaacagttatatttgggttgagaataaagcatattttcagtaatgatgttttctagyrgactaacatatactgctctatatttattagttattttataaaagctcaagattcaaattcagagaaattaaagtagaataaacatgttcccatatgccttcttggagaagtttctttgaggggccattcagcaaagggaaatttataagtctcaagatatgacccaattcagactcaccagcactgaatgggactctcttctgcttcatgaattgtaacagctcgttaactacagcatgagttcttacaacggccagatgagcatggaaaggaaatgtagcatttttcatggatattag

SEQ ID NO: 552 - DNA, 600 bp, Bovine  MMBT08292
tcctgggggattggacttgaacatttgaaatttaggaaagaatgattcaacccacaacagtatatatctttcaaataacacacattagtactgagtgtgaaatgctgatcaaaaatttagaawttctataaatatatgatctcatataaatgtatgatccatatatgaggaatgcattgagaatatcacatacaatatatggagataacctcaatgaatcccctatataagaagatttaatgaaaattaacttcagaatttattaggctgattacagaattttccaggtatctaacaggyaggctaatgatagctatatggtctgcctgcctaatcacagcccactggaaatttttaaacattgctcttacaggattagttggcaggtatatcatagatcaataaggcctaactgcccacccagctctactccctccctccaggkgtcacatcagcaggtgtgaatcarattagtaatttgtgatggaaactgaatgcaatcaattacacwattttgagctgttcacatttaattccattaaattatatcacaaaactagtccaatgaagtactgaaaataagatgggcgtaaacgtgca

SEQ ID NO: 553 - DNA, 600 bp, Bovine  MMBT07650
aaggagcccacaggacacttgggacgaaagagctctgcacaaataaccaaccacatgctctcaacctcctcttgagagaagcaggcctttaccatcaagagccatatttaatagcatgtaacttattatcctggccacaagtgatcagagcagggaaagatgcttgactcaagggcagctaatttctgggcgggttaagtggcttatgaggtggtatggtatgagatgattggagactaactaggccaatcagaaactgaatttgtggaattcctgtgtttgcatcatctgttcctggaygttctgccctggctctgtgtcatctaactcagaaagtgcccttcgaaggaccctgttcactgctgcacttttcaatgaattaaattttatttctgttctactgggggaaaaaaagaaaagagaatcagatttttggaggaagacttgtcagttgacagtgggcacaggagatgaagcacatggagggataaaagacagcatatcactgaaatggtagaaatctggaatcagcaaaagcctgagcattgcttttcagagagtaagaagtaggtggttttcagagagtaagaagtaagaagt

SEQ ID NO: 554 - DNA, 598 bp, Bovine  MMBT06023
  misc_feature (1)..(37): n is any nucleotide
nnnnnnnnnnnnnnnnnnnnnnnnnnnnnnnnnnnnncttcctgtgactcaccctgggccacatggtctattctgccagtggccggacagcaatgttagactctcacaccctcacccggttgggctgactctcagagtatgtgacgagaaggtggcytttctgaacaagttaagtgccttttcgtctcagggccaacacggacctactttctgaccttactttccattgatgtcttggtttttggtcaccagtggcaactgtctcaaaaacataggctttcacatgcctctggcagcagygttattcttctactttactccttcccttaagtgaaatatgcatactctatgtaagaattggattcctggggtgcgtttgatgaatcacccattttattcagccgtgggtgaatctgcctaccttttcctatatgtgaattcagcctttccctctttgagctttcggaaaattattagtcctcattaagatggatgtgaagtgagtggtatccctctccctttttaaatcactatgcatacatgctcaatcacttagttgtgcccaactctttgcaaccccatcgactatggcctacca

SEQ ID NO: 555 - DNA, 600 bp, Bovine  MMBT06170
cttctccatgcatgaaagtgaaaagtgaaagtgaagtcgctcagtcgtgtccgactcctagcctggaaactcctatggacggaggagcatggtacactacagtccatggggtcacaaagagtcggacacaactgagcaacttgactctcactttcactttctttcaagcactaaaggaaaaaaaaaatgataattactttggaagaagactgttttctcaatatcacaacagaagaatggtttatttttggcaactccaaacatgatttatttcctagactacatcccaaatattaggayattaagataggagtttcacttctaaaaactttatcagttggtgtatttttaaaattttgaatagtaatcaaaatatttactcccataacttctactttttatgagaatggaagaaataagtataggaacagtagacattaagtggattcatttcaaatttagtcaagaagaacacaaggtcgtagtccttagggctttatataatgatatttttttcagtactggatgatttgtatagaagcagtctactcctgttggtggttttttaatttttctttcatttaaccttaattaacctta

SEQ ID NO: 556 - DNA, 600 bp, Bovine  MMBT07983
tttcaaaaggagtttgaaatgcaggagaccttggagaagggaatggttggttacccaccctagtatgcttccctggagaattccatggataataatgtagtgtaagtgcatcagttaaccatgttcagaaaatgctgagtaacagatcactccaaaactcaggcttaagacaagaatcatttatcttcaaacatctgcagagtggctggtctcagcagctcgggcctgaacttttctgtagcaaatgccttccgaaagtctcttatcccccttctggaaggagcaggctagtataggcaygtctggtgatggtagaagcatatgcattagcaacttagttttaccagtgctttgcaccatatttctaatatcccattggtcgaagcaaatgcctctggtgagatattacatggcacacayagttgtaggcactgtaaaatcacttaccaaatggcagatatagagaaagatggagaatcagagtccaggaatgcaawttaccacaggaggggataaacacttttacatyaayagtccactgcaagaatgagtcaagaactcctggaaagcttgctaaaactacaaagtttgggctacctc

SEQ ID NO: 557 - DNA, 600 bp, Bovine  MMBT07208
agggaatgcatatggtttaatacatcatctcattttctgaaaactggttcatagattctaaggagcagcacatgatcagtgcataatcagtaatggtaataagagaggttgcatgagggagggaatctaaggtgaggcttctgggaatggagtcacatggtgggcttggaccagcgggtgaacactgctgggagggaagtttggggatataccagactgcctttggcaggcagaatccagactttgagtccctgcttgatttcgatggcatgggccaggctcctgcatgttacaggaacytttaattagtcggcattttccactaagactgtgttagtgcgtttagtaaaagtgtcttattactcctggacaggtgggtgagatggggtagtttgagaagtactgagtccatctactttccaacagcatcaactgagtaaattaaagaaattacatgagtaacaaagtatttcatttcttcataattacccatattttagcaccaatatgagtatggatatacaattataaagtataaaaacatttttattttgattttcattgtaatataggaaaaattwtagaaamattttaatatgt

SEQ ID NO: 558 - DNA, 600 bp, Bovine  MMBT10949
tatggaggagacagacacgtttcagataattacagcacaacatagcaattgctcagaaataaagcaagggacggcaagctaaaagatcccaggtcaaatctagcccaacacctacttttgtaaataaagttttattgaaacacagctatgcccatttacttgcctaacatttctgactactttaacactataatggcagaattgagaagatgcagtggagaccacatggccctcaaaacctaacatattcactacctggccctgataaaaaaaaatctgctaatccatgataaaagggcytatggggacagctctgctgaattggacttctgtttaacttacaataggcaatattcattcattctgtggcccttgacgggtatagcaagtctaggaggtgaaggtacatgcattcctgccctggaacccaggcatgtgtaggactttttaccacatacactacagaggtgtcaggcaatgtcttaccaaaaaagagattaattctggtcttttgtttgtttgtttgtttttggtatataactataaattatcaagaaggaaaagtttactaaatcacagaaattaaatataattataatt

SEQ ID NO: 559 - DNA, 600 bp, Bovine  MMBT09359
aaaaataataaagaggttgggaaaagcttttagaaggaatggatgtgtttatgacatagattttagtgatggtttcacaggtacatgtttacctccaaactcaacaagttgtttatattaaatacatccctaagaatactacacgtgttttcagttgccattagtaatcaattattttaaagataatttaacatcctggatttaacagaggaaatacaaagtaaaagaataatgaaatatagggctcctgatgcaagtatcacatctaagaatacagctgttatttctctggtctaacayaaaaaattaatatgtgatgaaatttttttccttgctaacaatttcctcctctaaaagagttttaccccatttcctagttctctttccatatacccttgtaattttccacttacaaatatgtgattgtttaaaaatttctatctcctttaagaaataaatttaattatatgaagttttatattagtgtatctgttcatatactggagaattagttcatctgtcaatcttctattagatcatctatacaaaaggaagaaaatgcatttctgggaatatattggattttccaagcagattttt

SEQ ID NO: 560 - DNA, 598 bp, Bovine  MMBT07977
  misc_feature (1)..(41): n is any nucleotide
nnnnnnnnnnnnnnnnnnnnnnnnnnnnnnnnnnnnnnnnntgtgactggttgaaaacttaatgtcagaatgtgcccagtctacagaggtagggaagagatgttcacaggcaggaaccagagaggaggatcaactataataatggatcaggataacaaaatagagaaaaggggctaatgacttggttattcctgggtaaggatttcctaggtccttagtgagaaggcattgtagtaatgccagagccacaatatatattatttatttgctctttgttatacatactttggtttctgcagytttaaaaataaactttatgcaattcatttcatatatgatggcaggaataatagctattatcgattgctgtcttgtttatacctgatgtgctactgggcactgcatagatccacatttccctgctcacatgacccctacctgggacaggtctctttcccacatccatccttcctagagtgggagacgggccctgctggtggatgctcctggggttggaggagtggtcatgggaatctyttcccatgaggtgtggctgagcttggacatgtgggtgaaggtgttcatatgcttgtgaact

SEQ ID NO: 561 - DNA, 598 bp, Bovine  MMBT10532
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagagagaagctgggggtgggagcacactctgccagcctcagggggcctggaagagagcttgggagccccaggcttgagtggtgagttggctgggtcaggccaccctccagacaagcctctccaccaggtgatggatatgcccgtgactccgcatccctggaccagggaacagctctccctgaayatggctaggaagccyatggggtctctgtgkatgcccgttgggaccactgatgggatgttccacagacatcacttctctctkgcctccccacaaacccactagggcacctcagggcatcctgggaaagagtctggatcaggatatgggaaatcgattctctaaaagtcaattaacaaaatgaccttaattgaccagttttctgaaagtcaattctttaaatgagccatttaccaaaatttcagacagatattttaaacccggtctgggcagcyrgccaccgctgcccgccagcaggggt

SEQ ID NO: 562 - DNA, 600 bp, Bovine  MMBT07737
cccagagcagggctgggcatgcttgaaaactcaactggccaagtttccttgttctagctctgcctccctgatgaaatgggcttaatgcaagacarttggaatggcctctcctcctggctccgacctgattgggttctgtaatgctaagtgtgagacctcatctttgcaaagatacggcaaagaccagaagtaaccacacaaacagcaaatatgatagacggccctgctctgtgtgtggacagcaagctcagaagtggctcggggagtccgtggctgccctaggggcgggttgtggacatygcctggcagtttttctgtgcaggtggcatcagtggttaacgacagcccagcctgtcccrtctcctctggagcgctgccctgcacctttctaccccagagtcgggctgtcccttcagatcagcaatggcccccgaagcctcatctcctccaggcaagccagccccctgctccatcgtttatttccgagtcgcctgcgttggatcttcggtcagttcccctgcgggcctcctccaccccygccagcctggcctcgtggctccgcgtgtgtgtgcacaccttgcccacccatctctcctcatt

SEQ ID NO: 563 - DNA, 600 bp, Bovine  MMBT09625
gcacaggcaggtgctctgcacacccacaccctcttttacaactggtgacagagagaatccagggtggtcattgccctcacctgagagctgccccccaacacccatcccaagaagagggcttctgcactcagctggcctcacccccaaagaggaccctgacttcccagactgcctcttcagtaataagagcaaagagtggctggcggttcttgtctctgttttaggagagaatcagggagcggcagtgacatagaggggacaggagggaacagcaaaaggaggtataggaattgattgaayaggtccagggatgcccttcttgtggttgataagtgagagttagaactttgggttacttgtgaatttgttctagttgctggactcagcttctctgatgaccgcctggcctgagactggaccatgtaggtgacggctttgtagacagcrtgcccgtgggtcaacacgtagcacgggctcacgtctaaatycagtggtttaggtgaaaccgcagtggtcagcagggccctccagggtcatttacctcccgctgraatggcaggacccaagcctttgggagctcaaaaatctcagcagtaactt

SEQ ID NO: 564 - DNA, 600 bp, Bovine  MMBT09947
ttgaagaacagatcaagtagaattagctctgaaatatactctatgtaaaataaaagccaaatacacgtttcttatataactctttcaggtggttttactcctaaaacttaaacttgcttatgatgagaaagtttgccactatcacatccattcgctgtttattcagaacatcttggatttacttttcatcatgtaggcatttcattatctagaaaaacacaacaaaaccaagcactaaatatcttccttcttggagatttcccagagatactggggcctggcgagtctctgctttgaatyggtagcygggtagatgacttctaggttttgtcctaatgttcagagtccatgaattagtcaataagggggatgcacacttcctgatcgctgagcaagacccacctctcccayctctgatggatgccaggggccccgggtgctgggaggcctccacggttaatgtgaagtttgtaaatgcacttgcatttatgagcaggatggcagaatgcattattaatgcctgcctgagaaggataacaagaggcttttgtggtttatgcagtaaactgtgtttccactttagaagtggacgatagtaaa

SEQ ID NO: 565 - DNA, 600 bp, Bovine  MMBT10393
tggtgacctggaaactcacaaattggggagcttctggagacagtgtattgtcatgtgggaacatggtcatgaggtttctagatcatcctgttgctcaagagaggccataagtctagattttgggggtgaaatctcctgatttttaaacaaaaacaaccaatttcaggttttcctttaacatacacaggccaagaaggacaygtgggactgagwtasagctgaaatcatgctgtcttgattccgcagctcttctgcgggtgacaaggaagcatcctaattgtgtgtgcctggtgcttctcyttccccttccaaggcatcaagacagaagacagcttgaaccattcccccggccagagtggcttcctcagctatggctccagcttcagcaccccagcctctggacagagcccgtacacctaccagatgcatggtgagtgcagtcctgcgcccytccctgccgtctcgaaggtactgcctgagtcgggtgtccagtcgttcgttcatttattcaacagctttattgagtacctactatgtgccaggacctatctcaagtagcggagttgcagtggtgggcagaggagataacgacttctgccc

SEQ ID NO: 566 - DNA, 600 bp, Bovine  MMBT08791
atctcactctagtattcttgcctgggaagtcccatgtacagaggagcctggtgggctgcaacccatggggtcgcaaaagagtgggacacgactgagtgactggaccacccaccaccacacctactgacgggcaggtcttgtccttgtaggttgagcatcccatcacagaatgcatcactggcctggacctggtccaagaaatgatacgtgttgccaagggttaccctctcaggcacaaacaagccgatattcccatcaacggctgggcggtcgaatgtcgagtttatgccgaggtaaagygaacactgggaggagggatgaygggaggaagggtggtgtttgtgtcccgagtcatgggaccacgtataactaaacaacaaggtaaagtcagcgtcctgtaacttggggtcaagtatttgattatgtaattcagagctgaaccagaaaaagaaaggttagatcattttgacataactcaaaatagttttaaaggattgagtttaattaattttcatgtgttgtttctggatggaagaatagcttctaatcagtttaaggagcgagaaagaattagtttaatattcttgtgcttgaatggac

SEQ ID NO: 567 - DNA, 600 bp, Bovine  MMBT09938
gaaaagctgtctgatagatgttgtttgtatgctataatattggaatttctggggtattttaatgggttacagagacaagcaaaatgttagaaactgggatggtttcagaaacactagagcatatggtacccatcctagtaaaattygctgccaaggcaggaaccaaaaacaagtggaatttttggaggaggtaaatttggaggcgctgccaaacaatagaytcttcctgcccctgcccraaggcctgtcgtatctggccaaatgctgtctgtggaggagaaacagggtgtcctgggaggygtgcagtgggcgccaccccgatgcacactgcaaacgcgacgagccacagatggtgctccttcttgcaaatgtcaacccgtcacttcaaaacctaaaaatgaaatagggtgcrttttaaacatttaaacacagatcaatcgaggacagggctccgagaatgtgatggtgacgctgtttcaccgcgtgtcttgcgtattctcctgatgctcttccacgttccaactcgcagtgcagtgggcactgactcaccgctccagctctcacacaagtgaacctgcaggygggcagcctcccccaagg

SEQ ID NO: 568 - DNA, 417 bp, Bovine  MMBT10707
gttatcatcttgtgaaaatattgaatgagtttagattcctaaaggaaattaaaagttaggtaaaattcacattcacctagaaatctcttgcaccaaaagctcctgattagtgcagatgaatatgagaacttcattcaaagagatcagtacaggtgacaagcttaaaaatgaccttaactcacaaattggaaaatactttccactgctctctactgctgtcagtttcatggaatgtgcaaggtcatgtgttatctggacccagcttactactcctgcttcttttctcaccactctccttayttcctacttctagccctttagccagagggtcctaggtgggaacccccaaacctcctgctctcatattattaggtctacattttcttgaaatgcctccccatgcaccctcttcttgat

SEQ ID NO: 569 - DNA, 605 bp, Bovine  MMBT11067
  misc_feature (1)..(5): n is any nucleotide
nnnnnttcttcctagtacattgattgcagactaaaaaacaatatatatatttttaaatgtgcttaatttcatgggactaatttgaaggaatagttcttacttgcaaggcagagttaagcctgggtaaaaccagaataatcacccttaccagagaaattgggggaaaaaaaaaaaaaaaaaaacaaactcctgctaagcatttcttctcagctagaaactggttgagctgaagcacaaatgttggattcttttgccttgttctaaccgagggacaagaggtacgtggctgaatatgggagatgagyagtaaagggaagatactgctacctgcagggaaagccaagcaagcagggctggatgtgttatctaatccagaagaattcttcacrtaaaaggagaaactaatcttcagtaaaaacgctaacatgtatcttgaagccattttttctgaccttcagattacattttacatcaagattaagaaaagaggaagttgtcttttcccaggagatttctgccccttaacctggtactgttagtcttaaacatgattaaccatttgacatgacttcccaaactacagactgtttgtattaaacacatat

SEQ ID NO: 570 - DNA, 600 bp, Bovine  MMBT06676
agctggaggagctggagctggtggaggggccagggcccgaggaggagctggccgacatcctgcagggccccagtctgcgctccacggacgaggaggatggggacgaactgattctttgacctgcatttcctcacgaagactgtccaggaacccaggacagtgcacacagggtgcacgtgtgggaaagtgtgcttcctaaagctggtgggcatcacatcaatacatggcctctcctgggagtttttaaaaatgtgatccttggaggaagaactggaatttgggcagggggtagccttggtyagtcatttgggccttgccctcccaaccccagataggcagtggatctgtgtgaagggcccctgatattccatgggcttcctgagtttgcccgtgtgtgggtggggaatacctgcctctcccgtgcatcccccacaacacaccctcccccgcccccagtgttcttgtcccagtgccttcccsgccttgcccatcctcccatcagttccccagggggtgggttaagggagacccaggatgactgtggtcctgcctgtggcatgctggaggaggagatgggaccacctcatggcctcgtggact

SEQ ID NO: 571 - DNA, 600 bp, Bovine  MMBT07344
gcagaaaagcacattttcttctgaaaagaaatcagtttaagaatcaaagaaacgagtacaaacacaaagccaacacactggggtccacgttgggcactcattcaaaatgtcatgtcattcgaacatgtctcccatttttaatggtgcttcacttgggtctaatcacattcagaccctgctgggttgcatgccattagatgctttaaaaatgtatagccaagacacaactaaaataaaaaacccacacaagccagcagctgaagcacagaaagaagaggcctctgggattttatttcatcyagagcaaccgacttacaaggtcatctccgacttcttacccacctgtgctctgttcccccattgttaaaataacagtgatcattagaaatgattgagggcctcagggtgtcatatttattttctttacatttaggagccagttttaggaaacgagaccaatagttcttattgtcttcttcccttttctgttacaacaygaacatcactgggaagatattcccaaacatamgcttgcgtgtctgctaagtgtcttcagttgtgtccaactctgagaccctggactatatagtccaccaggct

SEQ ID NO: 572 - DNA, 600 bp, Bovine  MMBT06610
ttacatccaaaagtgaggtgctgcctgtagggggcgcccagtctctggrttcacatggacaaaccacagaccagggtcacctccagcccttcagayggggcccaatcctctgaacggctgcttctgaagagattttcatgaatgagagaagcgttatggggttatgactttaatyctcrggacagtttcagccgctgcagggctgcgatgactcagctgggtgggcgaggcagacctctgacctttggtgtgtcccttaccattattctgttcctgaccttgccccacgagtaataaccyaggtagagttttccagatggaaccccatgacttcggggtggggggtggcggggggtgctgcatgactgacttggtgcaaatacatcatctcccctgggagggagacatttacagcctaaacttacaaacggtgtgaacatcgaacagcgtgggcagatggcgggctggccaggcccccaggagccgcttcagggtcccctctccctatggggacgcccacctccctctaccaggggatggccggggaatgggctggaatacaattctaacaccaccaggggtcaggcgctggattccaag

SEQ ID NO: 573 - DNA, 600 bp, Bovine  MMBT08314
aagggagcaagccaggaggacaggggttaacctcactcctgctttggggaggaaatgtgtctcgttcctctttgtagccccagcacccagaacagtgcttggcacagaggaggagcaggagaattctccctggacctttaccatgctggcaacggcggaggtgaacacaagcaggacagaaaagatgccaactgcggtgctatgtgccctcgagcggacgatactgcgagatacacgttgcagggcctcagggaacagctgtcaggaggcaggagacagagacagaccacgtcacccaayggttaaggccacctagggccagcccagtggcagaggcctcaccttctcctccctccccactcccagtctggcctccccgaccagccctggaaggtcccccacgtacagarccacaggagtacacggcacaagtcagcacggtgaccagtaacagcaggaagatactggcgtggatcccaagcatcagagctgagctgggcgggagagggccagggaagatgttactctgggagatctgggggtcctttcccactccctgggcaggcagggggcaggccccaggactgtgtgcttgcaaag

SEQ ID NO: 574 - DNA, 598 bp, Bovine  MMBT09623
  misc_feature (1)..(123): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattagcagaagtcactggactgtgaacatgaaatcagatcagtacacaggcttagcagaaacctgggatgcagtgaaggttccctgaaggtagctgtcgctattaattcttatctgagagacatggaaaccgaattagaaaactcgggagacttaactgaggtcccacggctccygccaggtcggggtctggccrtgaagagctacctctctggatgtctaccacacttcttagaactctgaagtaaatagtttatgcaaatacggccaagccaccccacctgagatgaggtcctcggtctggccaacaaaggaagccaggcccagcacccagaggtatttttaacagggtggagatgtgcgctttgcatattttgccttcttggcagcttgtggttcaaggtcccaaccaaaactaaatgtgtttacttgtttgtttagacaggtaagatctcacagtctcacaccccacag

SEQ ID NO: 575 - DNA, 600 bp, Bovine  MMBT11092
agagcaatatacacaatatttcggcaatgatagtaacagttaacctaaatatttagtatcagtagtatcagtgtaactgcattttaagagaaacctccctttgaatgtaaatgttgtagttttccttttttttaattacttggtagtcttatataagatgttatttctgtatacagatttacttgcacttaatagacattctaatttaacattagatataaattttccacttgggactttgctggcagtccagtgggtaagactctgagctcccaatgcagggagcaggggtttgatccytgtccagggaactaagattcctacaagctgcatgatcccctccccccaaaaatagaatttcctgtttacttatctgttgatataatttgtagaaatccagagttrtcacagaaacaaagttaaaggtttaagtaattttccctaacacccctaaaagagagcaataaacaacatataccgtccccaaaacacggctttaaaaaggcatttttgtcatttgaaattattattcatctcctggcaacccagaaaacctagtggaacccactaagaaacctatacatgcaagcacaggtaaac

SEQ ID NO: 576 - DNA, 600 bp, Bovine  MMBT10360
gctaattaggctcctaattagggacctcccaggtgcggcaatgcccggtgggcagggggtgagggcggctgggattaattgtggaagacttcatgctgctttaggggaatgaaggactcccagaagtgtggacaacactacatgccaaggagatgtgcctgtgagataggggatgaagggagaggccaggcatggacccagcaaacactgctggcttgagtgtggtgccagccctgctctttaaatgcaggtagaagagcctcccgagattctaaaccagcgcgtgcgagggtggtggaytctgcccttaaaagcaagttccccacaggactctggtggaagtatcggggactgaaagcctgaaaaaggccctttggatggtggacagacatctgggaacacctgagttctcagaagaggcagagaggcctggcaggtgtgtgtgatgctttacgttctgtgtcaaccaaactggccacggggcactcacgtggagtggctgggactcacacccatcagctcccctggttctcaggctgtcagacccagaatgagcttgactgccagcctcctgggcctccagcctgtggtgggtatagg

SEQ ID NO: 577 - DNA, 600 bp, Bovine  MMBT06994
aatttaacattttatgttcagttgatgcaaacttcctttccccaaatcaaagttgggagaaagaaaagggagttaaggagaggtttgacacataagaaaatgcgaagacagttgtgtacgaaatgaggtttgagttttcagaactgaaggtttgcagtccaggccggctcactaatgaaggacctgctcctctaacctggtgcacaacacaaaacattaatcaggacattgtttgcattaaagggctgtgttttccagagggtaatcatcagggaaatccagtcaagggcgaacaaggayggcagccctgattaattaaacatctgcactggggctaaaagcaagacttaccctgttggttgttataagagctattgctattaatgccacccgtggaattgggagatgttgtttgctraaatctactctgtacagagggctcggtgttcaaggcatatcaagttatgtcctgatgttattttggcttctccctgtggcactgggtggaagggactgtgggcagggtaayggtgtacatagcttcttttcaaggagaaagcgtttgagctagccatgaagcacaggccgtagttggaaatg

SEQ ID NO: 578 - DNA, 600 bp, Bovine  MMBT05917
cctgaaggctcctaaactggcctcattctatcattagtagaaatgcctgagtccctttcaacctctgcatgatgttctccaggtatcagacaatcacaggtgaaatccttctttctctaacaactgacagccctcttcttggctgagggaggggaccctgtgcttgccttctcccctctcagggccctctgggcaaagcgcactgcccagcggtgggcagaagccccatgcartttggggatgagcctctgctcygtgtgtaacgtgggcagacacctaaccagcaccaccacrygcatycctctgccctatattttgacctcttcctctcatcgctgctraagtcctgtctggggagcacatttcagtttgcaaagtgccctggaaaacaaatatttgcttgggattgtgatcctgctggatgtcaccatgatggggcctagaaactggggagagaggcgggaaacctgggggcggccaggttccacttaccggcacctccactgactgcatggccaggtcgcatggaggcttcagggcccgtggccgcgtggcgtaccagaaggtggtgagcgccgcgaacgcgccgaagcccatgag

SEQ ID NO: 579 - DNA, 600 bp, Bovine  MMBT06601
ctgatcctgcctgcctcccggctcatctggctggcccccaccsctttctccaagctttgctgcctcaggtcccagagacttttaacagtctgtctttcccctgcatctctgggtcacggaccagcctttgcggcaatcccscccagccagactttgagcctcgacgtcttcttaggccctcccctcagtcaaagctttgcaattaggactccgacctcatcaactgcaactgcatccgaatccccagaaatcgcagctccaggtcctccatcccggggtgaatccaccgcgtttctgggyttcgaatgwtaggcgcctgacaacgcgtacatttcaattatctgtcttctccgtgcgaggctggcgtcagaacctgacagacctgccattggtagccgtgggacccagggcaagttacttaacgtctctgactctcggtttcctcatcgtggaggggattgatacccatagggtggccgcgtggatcgaacgagataaggcagaggctgcgccggcaccttgggttctcttcggtccctctctgcaataggacgtcatacctgcttgtcgatttcccattttttcccccagagcaccctc

SEQ ID NO: 580 - DNA, 600 bp, Bovine  MMBT11175
accatgggaaaatgatgcgaaatcaagttcacagaaatttgactttgatgttcaaattaatgaatctctctccttgaatgtttgcggagttgtgttgtgattgaaaatgattacacaatgactataaaattctgtgaagaggatggaggttaaaatggaaaggattttgctgtacgaccacacttacataaccttttggtgagtgatattcaaacttactacacgctccacactgcatggggtgcagaggtgcagaaaaggcgggcggagggatgtgtgctccttgtcatttaggggctyccagtcaagtgagtgatggctataatggagtcacgaaaagggccctacggggaaaggccytcttcccatgaggggcacttgacacttgtctgaagaatgaggaggagtttgctgattatggtacatggagggttaaaaggtattctagctacacgtttagctgtgagaaaagataccatgttcaaacacagtatgtacttagtatgttagagctcaaggcaaacatgagctggtggccagagatattacggaagggtaggcaggggttggctcttcaaagtcttcattgaatttgttaca

SEQ ID NO: 581 - DNA, 600 bp, Bovine  MMBT09816
cagatggtaagggccagagagatgggactcacactgactttctggcccactgtgcgcttctctctatgctacagagggcttcatcaaacaggtgcagatgttttcaaaggaccgcagaccgaaaagaccaagcctttttcttggttctgtggtttgtgggcggtgggggatgaagagcaaagtctcactgaaaagcttacgtgggaggagaaagaaggattttgaagtggggaccgaactgggcacttggagcatcgaaaaccaaacctctcccaccttgcaagcagcagtttgtgcccyggacctccatttctctacagtcctcctgtgcagactctcgtcgtctgtcccccggtgactgattggtggcatgtttttgatcctaagccatctggcgcacatctggtcacctctctgaacactgagcgtgtggtcagagggcatgaattcctctgagcaagtgtctaagcaaaatgagtcatggaagcaaatcctcatcaaaaatagttaagccccggtgacaaaggccaggcacccaagaaaagattaggcgcctctgccgggctgtgttctgagagcagttttatgcttcctttcctc

SEQ ID NO: 582 - DNA, 600 bp, Bovine  MMBT05982
atgggcacaaatggtggaaacaatgttttaaagcagaggaccagaagatcagatgtcctgacattctcatttcacagttcaaaaaggatgtatttaatagaaacacagcatgatcacaattggtttcttttggtccatggaaagcagaagtcaccacccacccccacccccaatttattaatcacttaactcccaaacaggctatgctttaatgtatatttaaaagatagttatgcaaagagtactaattagtaaataacaaatagctagcttgggggtgtaataaacactgaagacagyttgcgtcaaatacttgtatactaaatttaatgactgacatcagaacctttgaacttgcctcaaactaagatcacactgtggtaaagtgtttttcagaagagcwgtgaagtttctgatcatggtagtgatgacagcagcatttattaagtgctgtgtgcagtgggtgctaagtacctcacttgcattatttctcttgattctatgagtcagatcaattcacagaagaggaaaccgaggcccagagaagtggagaaacttgctcaaacacctacctggctagtgaatggctgagcgggaatt

SEQ ID NO: 583 - DNA, 600 bp, Bovine  MMBT08842
agataattcaattgaaatgtataactgatgctggagtgtagatgcattctctctttctsyctcccayatacacatatgcatgtacaarctttctctgaaccaaactgaattccatcctagctcagctataaagccaagaagtagagtttacccaacttgacaaaattaaggagagaaggctccaaaccagtacagagtattgaaagttaactgtactgccactgagatgattcagagaaatagtgaatgacagggggatattattatcattgcttctcttyaaagaaaatgtaygtttaygcatgcacacgagtgtgagtgccacctatgtagccatgggatctgcctgtgccaaaagaaaagatcctttggtttagctgttgccttcagtcaacggctccagccctatccaatctccattcctccatcttttcccctttctatttcacaagttgctacagagagaaaaaataaagctcctattgtaatttttactcaagcatagtttgatttccaggggccctgggagaggaatggcaagctatggagggataaaggaggtagaaagaagggaaatagcaagtctatgccaagtctatt

SEQ ID NO: 584 - DNA, 600 bp, Bovine  MMBT08858
ccagtttgagaagcatcagtgtaataatttaaagacaaatgaaatactatttaagaaatatcccccttttttaaagatatgtggtcattctcattatatattgacataaaaatgtaatggagtaatgaaatattagcaaatagaaagttcataataaagagacatattaaaaagaatgaagattttactgagatgtgtagttgtgatgcagtgacagaatgcataagagagaagaggatagtgtgatatgtaccttccaagattttaatgagattcatgaagtgttctatgtaataagaygtatatgttaaaaatctgcaatgaagtgaatatgtgagatggtttaatgagctgtctcaggaagtgtcccgtaagatgggcatccttcagggctgaaatgagatgggtgaaaggaaaagtgtaatgagctggtcacataaaggagaggccgtataattagatgtataaaagaaggaagggagagtatataaattttccaaatatgtaagatataatgggaactaggttttaatgtaataagatgcagaaatgaaatgacaatgaaatacaaaaacagaatggtgtaatgggatatgtaag

SEQ ID NO: 585 - DNA, 600 bp, Bovine  MMBT08821
gctttcctggcaaacgaacaagtctgtctttctaacaaaaataagcaagcagccaaatgcgcaggagacacagggttgaaaatagctcaagatagaggccagctcactcgtattagagacctggccttcgtctcagggcggacgtcatcatcattacgtgttggaatttagctagaaggtggattcttctctttcaactgtcagagctttgggaacagatggctctcttcctcaggggcacttggtggctgattggcagtgtgaggcagaaacaggcagaactgcagaaaaatcctatayattggaccctagcagccttttttatttggattattttcctctgagtgatgacagcagaaaccacgcaaatgcagaaacccatccagaggagattttrcaagatgtatgaaaagtctactagaaagccatcattatcttccacttgaayggggaggagccccacatatagctgtgtcttgttgaaatggccctgacctgtcacgtttagagtgacccaagtctatagtccggagaaggcaatggcaccccgctctagtactcttgcctggaaaatcccatgggacagggaagcctggtggg

SEQ ID NO: 586 - DNA, 600 bp, Bovine  MMBT08047
agtggttttttttgggggggaaggggcacggttaaagcccattccattgttatgattrtaaacatgattatgtttggtttctaagatattgatataattagaaatggtaagctttcacatgtgttgggtttttatcactccagttagactataagctctttgaaatagaaatcttataaatctatcacaccaagtattttgtaaatgctcagaaaatatttattgattgacagattaaagaaagcaaaacacatgaaactcttcttctgtaaacaaatatttattktgcttttgaaatgygccaggcatcattctgttattataattaaaatataatgagatataacattatatattttcaaggtatacattacattgatttaatatagttataaattgcaaaatgactatgaccattccaatagctaacatctccatcacttcacataattatcctttctttgtttaacatcattaaacaaacatttctttgtttaacttgttagtttctttgtttaaacaaacattaaacatttctttgttcaatatcatttctttggttaatatcgagttttttagcaactttcagtatgtttaata

SEQ ID NO: 587 - DNA, 600 bp, Bovine  MMBT08134
ttctaacctttaaaagagtttgtaatgtgttccttagtatctgcttgtcaatctgccaacttctattagtcaagtgtctaggcctaaaactggaaaaaaataaaaataagcccctaaatcagttcacgtgccaaaactgaaaattcacccatgtctgtaaaagaaaacaaaactatacttcaaaagggaatatgttttcaacaaaaatattgtggcaacagtgtttttctttaataaactattttctgttttgagcacattgttctaagccacaagatttccagctacaggaaagctagygtggcattgcagaggggtgattacacatctgaatggatcaacacggggttcaggttcacacgtggaaattgtcacatcaattaaaactgtctcacacatagcagaaattctttgtttgttgaacaaatacatacccgtctaggttggatttgttaggctttgaagctatcattcccaatccaatttatccttatttctgtatatgtgtacgtggtcttttttttaaagcttttagaaaaaaaawatataaaaagggttgagaaatcctgtagctaatgggctgatctactaagagaatta

SEQ ID NO: 588 - DNA, 600 bp, Bovine  MMBT08138
acccatggacagaggagcctggcaggctggagtccatggggtcccagagtgggacacgactgatgcgacttggcatgcacatacatgtggagctgattcactttgctgtacagcagaaactaacacagcattgtaaagcaactctactccaacaaaaattaattaaaaaaaagaatctgtggcttcactaaggagggaagtaaggccagtggaaccttcctgactaatacttgtagcttcaggaaattgaggggcatgggggagagggtcaccttattaaggagcttaaaaaataaacayacsaaatcgcaataattggcttttacatgggggattaggaatactgatttttgcattataaaactgtgtgtttgttcctatggtagctggctgaagcagtgtggggaagacgagaagacagagaagtgatgaagacagttcggtttggaacayagggacggacgggcaggacgagaggacragaagagatgaagcctggtgatgggcaagacacccacttgggaagcaagataaatgrgagcagagaaaaagagaaaacacagtgtcccttgtcacggggaaccgtaaagccaagtggca

SEQ ID NO: 589 - DNA, 600 bp, Bovine  MMBT08142
atcccacatgccatagagcagctaagcttgtgcaccccagagttcaagccccatagcaaaagaagccactgcaaaagtcagtgctctgcaacgaagagtagtccccactcaccgcaactagagaaagcttgcccaaaagcaacaaagattcagggcaacgaaaaatatgaataaataagaatgtgggagaggaaacagagcagaatatctcttgggaacatttgtgatctggcagttcaggcaggtcgattattaatatttattcaccctctaaccttgcccacttctgttcttctctcyccataatttccttatctgaaaaatgtacataataaagaccatccmccctattaggagtgtcttactagtacacacaaaacaatttgcaagttacaaagtggaatataaaattaaagttgtgttactctaattgtatttgatatgaatattatggcataagtttgtaaacataaaattcaactgtctttttcttgtatccattgtttcttgccagaaagcagaaaagccataggtaggagcttttcattcacccaggcagaccttgacactgcatgagctttccaggttatgatgaaggct

SEQ ID NO: 590 - DNA, 600 bp, Bovine  MMBT08776
ttatggttcaagagggagttgtaacatttcttattcatcttctttcctagaattggttttgtgttcattgttaatacagatgatgaggttgatggaaaaaatgatgttggagttgccctttggcgagctttcaattatattgcagaagagaatggtgtatcacaagcgtttatgttcatagtacatgtgagttaatgcactacatatagtttcttcagaatgtagagtgtttttgtgttatcattattactatttgttttaacattttagtttataaaaactgtcatgatagattagtgyacaagatgaatgattcttgcaactctcagcttaagtacacaatattgtccccactttataaacaaggcaactgaggctckgccaaaatctgaatttgtttacgtttacccaactgataaaggaacataaattctatacataaatttagaggaagcatattgatagaaaataattagagaattcttgaactgggttttgaataaaatcatgaatggagaagattatttcaaatttaaatgttctaagtgrcaaaatttataagacttcgtagagattttcaaaggagraaaacttcatggc

SEQ ID NO: 591 - DNA, 600 bp, Bovine  MMBT08788
caaggaagtgaatttctacatgtgtactcccctccctcccctcatgttactgtgtctaggtgcttgaggctccagttgtttttatactgccatgtagtgtgttagagaataattgagaacatcaccagtaatttatgatcataaagcttcatgtaaccattcattatcttccttgtgttcttaagtcttagcaaaaattgagcaattttaatagaaattacattgtccatctccaaaaaacacattgacaacagtttcagaaccatttcttacagtaaatatataactaaaaggagaagyttaactctacccttgtattaactgttattttctgagtcctatattgtttcctcctgtgtatttcttattttgtttaaagccgttagtcattggatccctgctggaaaccgtggtggcttgttccagtagacagacagactgttgtacctgatggtgtctggtgtggggcttctaaatacaagtttcgctctgatgacctaggtcggcttgtattgccattagtgtcagcatggaagctgagaaaaagctgacaaataatctagtgcagagaagaatttcttaaatagatayataattatt

SEQ ID NO: 592 - DNA, 600 bp, Bovine  MMBT06902
agtctttggatcccataaaaccaactggctaaagacttcaatcattgcttttcactttgatatttaattctgagctcaggtcaattttctgctcccgagaagagcaattataaaacacttttcatttacatttgaaaagcatgaaatatcataaccatcagagctcgcctgaaaaatacatgcaatactcattcattcattagttctcccttttattatttcaatagaaaaatataggcaggcactccctacaacataaggtgtaattcaattgtctttagttttcttaacttctcacaytccaaacatctcaatcagtttctccctatacttatttaaaatcaattcagtctctagtagactggggactttattttctgtggaatggattagttcaatgaataaagcacatgcctaagaaagagtagcaattatatcaacatccttactatgaacaatagatcttactgggcacttaggaagtgtcaagctctgtacatgaatcatttcgtttgatcctcacaactcacgaagtagaaacatttcttcctgccattacacagatgtgaaaattgaggcacagaaatgttacgtagttgt

SEQ ID NO: 593 - DNA, 598 bp, Bovine  MMBT06713
  misc_feature (1)..(157): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacatgttttgtttgggtgactctcttgatctaccattctacttgggagagggttaaagctgcaaaccaacccagagaatggaatttcccttctaaacaaggctgccaaatatttatgttttacatgattacattttagcytttgctgatgaagcatatccactgaatttcaccagaacttccagtaaaagtacatggattatggttagcaggatttgggtaagaygtttgggcacatttctcaggttgcagctctctgttgtgtrtgcttgagtaactcttagagactacctgatagaagaggcaggatgaactgactggtacagcctatgtttaaatatcaaccttgatggagctgctttttaattcaaattcaactgagatttaacaactcaacaccttaactaacgaggtgctgtgtataaggttttaagaccta

SEQ ID NO: 594 - DNA, 600 bp, Bovine  MMBT06722
cagcttacacttgttgttctgatgttccatctggcttaggaaaaatcttgtttatttgcttttttcatgtcttaataattcccaatatttgcagtaaattaagtaaggatgtgatatctgttttcctttcagaatcttccacagtcagtctagtgttgtgtgagatgcatatgaaatgaattgagttaagtagctttgcctaattcttcccagataccatgtaactgataacacatattaggraaatatatgtgaaaacacacaggggatttactaaaagtgtgctctgagaacagtagytaaaggctcttcacaacctctagagatgataagagaattatttgctgctgggtgcttttgcaagccatgtatataccagcctgcctcgtcatatcttctgatttgccctagaagatagatcacactatcagactgctagttggtgaactgtgctttgacctgaaagacgtgcagtgttgccagttgatgtggtccctgtgtgtttcgggaaactatagtgtgtatttgcaagatacagtagatatacaggcatgcatcccatacttggagtgcattgtcatttattgtatgatggcagta

SEQ ID NO: 595 - DNA, 601 bp, Bovine  MMBT07732
  misc_feature (1)..(1): n is any nucleotide
ncctcagwtaaaaaaaaaaaaagcctgattatatgcagattgaaaatggccaccatgttccagacagaattaattagmaaataattacatttctgaacaagataattaaaaggcagatcctagaaacacctgagatagatgaggtacagtgctcataaggacagaaaactcagtggatctcagacatctttgaaaaaccagagtccagaaaacggaatcgaggcttacatgctcctgggggagaagtttttcgaggtccgattttatacccagccaaattttgatcatgtgcaaaagtaaygcaatgatatctccaaccgtgcaaggactgagatacagtcttttaaagctcatgttgacatatacaccccagctaacagagaaacatgttctcattaaatgctccaggttggggtacttattaaagcacagcttgtgagaggtaagccaattaaatagacagctaaatgtgaatactcaccactagagttctagaaagactgtaaatataagtaaacctttttgaaaccagaggaccacacaccataagaaatgcataccatgaggaatgcatgctacatggctgaaatgagaataaatg

SEQ ID NO: 596 - DNA, 600 bp, Bovine  MMBT08322
tgatttaaggtatgtgggaggttatgtgtgggttatatgcagattctataccattttatgtaagggacttgagcttgtatagattttggtatctgtggtgggggtagggaatgactctcagggacaactgtatattattgcctctaaacactatctttaagtccatttcttcctgaggaacttcctctgttagaaaataaaactgaggtctccggtggtatcaccctaaacatggccatctcatctgatctcagaagctaagcagggttgggtctggttggtacttggatgggagaaaayaaaactggggattacagaccatcttttccccctagaagagtaaattcaaatgttaaaatactcatattttatgtatgttcagctttgtttagaattgttgttcagtttctcagtcatgtctgactctttgcaaccccatgaactgcagcacaccaagcttctatttaaaactagcttttaagtaaacaataaaggtaatatgtgaaaattacatacaggtataaagaatttcaaactgtacggagaggtataaaatgaaaagaaattctttcccctcatccagttcccttcccaattaac

SEQ ID NO: 597 - DNA, 600 bp, Bovine  MMBT06733
ttccctagctttgcttgtagtaatgctccccagggcccatttgacttcccactccaggacatctgggtcttggtgaatgaccacaccattgtggttctccaggtcattaagaccttctgtgtagttctttgtattctttccgccacttcctagtctgtctcttgataactgtatttctgaagacgtggccctagtattccaaagtcagttcttggcaattgccagaagtgtggcacgagatttccaagtagcctttctatctgggactcttttaatgtcatcccactttctcttatttcygtttctcagaatttgagactcaatgattggacgtttagcaaacattcaactgagggaacatcacactggaagcttccagctgagaatggaaaatgtagagcatgagctactgatattactggagcttccactttacctgcaaggcttactttcctccttctgtaggtaagcagaaatccatagcgacttttcaagatactctttctgccagaaccaaattcgtaattcttacatcagcagatttcattataattgcatctgcacttattagaaaaaagtctttacatctgtgctcaggag

SEQ ID NO: 598 - DNA, 600 bp, Bovine  MMBT09907
gggaaaaccagggcatctcccctctcctctgaggcacctggttctaccctgggggtccttgttgacccccagttcctgtgtcttgtagagagctttggctcatgtctgtgggcgtattgacttccttttgtccatgctgagcagtggcacacggtgcccaaggtgggagccactcaagtgctcacccayrgaggattggccagatacaggcacgccgcggggatactgtgggctccrggcagaccgctgaagaaagcragcattgcgttaaagtgagtcacatgaattttttggtttccyactgcatatgagaggtatcttaacacaaatctgtartctgttagggggtaatagttaggtgtctataaaaacaatgtacatgctttaatttaaaaatgctttattgccaaacactgctaaccatcatctgagctttcagcaagtcatartaacatgagccatcactgttcacagatcaccataacacatataataatattgaaaaaaaagtttgaaatgttgcaaagattaccaaaatgtcacacacaaagtgagcaaatgctgctggaaaatggtgctgatttgttcaatgcagggctg

SEQ ID NO: 599 - DNA, 600 bp, Bovine  MMBT10504
tcttcagtaactagaaaaaaaaatcttatgggtataatgaaagtgaatttacaaatcctcaatttttaaaaattgtgttttacttttgcattgagctttgggttggacggaaggagtggttggtggacccctctcacygggcccctgtgagtatagtaacccatctctctctcccacaaatgtgttggaatgagccggggtagctgactccctccaaaagcccctgaaccacgggggctctgtgttgttgcaaatccacccttttgtaggtgtgcatgggggcacataacagtcgcttcyggtgttatgttgagcaggtctaatttaatgttttagacgaaaagattctccagccccattatggtgagaagtgacacgcagtcatgttaagtaaaacgacagggcgtgatgtccttgtgacagcaaggtgactaactgatgctagtactggtgtcctctgagaccctgggagcatcctaaatattggattgaaaggctgcatttggaggccgccagaaccaggctgcactctcccacttcgttgttatttagtcactaagttgtgtctgattctttcacaaccccacggactgcagcctg

SEQ ID NO: 600 - DNA, 600 bp, Bovine  MMBT07734
gacatgaaggcagatccgaacacccactgtgatggtggtccatggagggctgggraggatgggaggcattacgcctccatgccccattcagcagtgaagctctctatggagaccctgatttgattccatttgggagggtgatttttgagaatgtggtcccctggcttccagtgaattaggtctgacttttaactcatttcacctaactcacagtggttttatgggaattaattaggtaaagggctccttagaggtaaagccaatgcaaaagcatgctctttgttttcttttaaataattygaagaagaacatatgatagactgactggtttctctcttcacatcktaaggccagagattagttgaggtaatttgctttatggaaaaataacaaaatgcatttcagkatcatccaggttcccagcaagtttgtcgtggaggtcctttatcacctctccactggggttgatgggtaaatgatgagcagggtagttaagcacatttcccaaactacaaacttcagaaaacagtttacaaggtaattaaytccggagccactgrtttcagccagaaagtccatatttcctgagcagactcatts

SEQ ID NO: 601 - DNA, 600 bp, Bovine  MMBT07352
tttaaccaactggagtgtgttgtttytctttaaaaaaaaaaaaattttgaaaatcaccatcctgaaaaggaatattttattcatgctggtctaagtaatgagggggaaaatattcagtactcaaatggaataaaaaaaaaaaaaaaagtcagcatgaatttccaaagacatctggaaaactggcagaagaattaaaaatacgaaagcaccggtaatcccagctgggctgaaattgccttcctgtggaaaccctgaatagaaaataagcttctaaaaaggcccgctcaatgcattttcttyatatgcgttaccagacctaagactgctttaggaattcccaaagacaatcctctggaaagttcatttacacagtgattccgatttaatcaggggaaggcaaacctacaacgtgtccccagggccccatacgggctttcagttcacgaacgtattcgattctgcattgagaacaagaatccaggcagagatctgacctagaacagaagtcaaatctcaccctcccccaacccctttacccacgacagtcaaagactgagcctcttagcacaccacacctgagaatagggcttcctcactcta

SEQ ID NO: 602 - DNA, 600 bp, Bovine  MMBT08494
aagattcctgtaattttgggatggttacttttcttagtaatttttccttaacccattctcaagtgactatccaacaaactgaagattccaagtgtaaatttcaacatctcttgtttctattaaaccttttctggttttccagtcctttcttcaatttacaacccctcattattgtcttgttaagagtctctggtcacttccttctaatcttccctagtttagtagaaagtcttaattacataattataactttaattttgttttacactatataattcagtcattccaatctactactayaagacacttctccccagcctaaccctcagactaagttttactggaaattttcaagctgctcttaattctctctactgttttcctttaatgggtcaaagtacattttgtacaaaggacagtttgtttctttgctctttttagaaggtgtccctgcattcttgactgagtccttactatcaagagagtgctgttctgtaactggatagcattatcaaagtacaccattaaacagaaggcgaactcttgaaatctttccagttgaatctaacactaggtttctcatattcatgtttcttttct

SEQ ID NO: 603 - DNA, 488 bp, Bovine  MMBT06621
gkgttctaataaaaattagtaagatttacatgctgcctttgaagaagagagttgatttatatatttaacgtgatgtcatttaaaatattaggtgactagacaygaaacacaaagacattaaattaacatacttcactggattatgcaaaacattgaacagtgacaaaagcgtttcagagcaggatttgattattgtggccaaatccagtaatgtatcctggaaaatttgattccaaagatatgcaaaacatgataaactttgcactctgttttatctccagaacaagatatagcagtaayagttgattgtaccttgaygatattggcaagtcacattctggaatgcagacagcagtgctgtccaaatagaaggaattaccaaaaggcaayggaaaaaaatctgaamatataatcttcctcttacataatcttttggataatatatgcaattctaaggtcatgaggaggacacaaggagctgcagaagt

SEQ ID NO: 604 - DNA, 600 bp, Bovine  MMBT11125
ctgcagaattccatggacagaagagcttggtgggctacagtccatggagtcgcaaagagtcggacacaacttgaagcaacttagcatgcacaaaaggagttagacagggctactatgatgtgactggcacagctggaattgaacaatggaagggccctgactttttttatgagcaccctggtttctaggatactctaactgcttctgcttttgaggtttatggagcagaaaaggaacaaaggggaaattagtggaaataatttttatttggaatccaagcacatgtaatgtgtataaaayaatctattcaggcatacctcattttattgcactttgctttattttacttcaaatttatcrtttttttytttttaaarcaattgaaagtttgtggcacccctgcatcaagcaagtcatttttccaatagcatttgctcacttcatgtttctgtatcacattttggcaatatttcaaaccttttcattattgttatgtttgttatggtgatctgtgatcagtaatctttgatgttagtattacaaaaagattatgactcatggaaggttcagataatggctagcattttttagcaataaagc

SEQ ID NO: 605 - DNA, 600 bp, Bovine  MMBT08321
tacttagctactattaaattaaaacactaattaaagcactcagcattagtttttaactgataaatcaggtgcaaatattaccaacctttaaattgtacgatttctccattctgagtttttggcaatccctttagacaaacctcactggtaagagctaaggcaataccacagcttcctagcaagaagccaatctgctgccccccagcatcctgtggagaaaagataatgaacatggtaggggagcgaacrtgagcatacccaagcccaaaatctgacacttagtaatgctctggcacttgygcaatacattcatgaaatccccctgatatctggcaactgtcaaaatctagtgacaatatgttcttccaaataactgctacagcacaatgatttcctgagtgcaaaccatgtttcattaatctgacgctgctaacgatgaattccaccagccaaatgtggccattttactcaaaggtcagcaatgctcctcttctaaattaatctcaggaaatgaaataaaagtgaacatggttaagttgtcctgacctagccataacctcaaatccaaaaagaaagcaattcaggtcagaacaaaataaa

SEQ ID NO: 606 - DNA, 600 bp, Bovine  MMBT08483
acccagtgatgctgggattatcacctgcctgtatgttacagacaggaacagtggaactttaagaaatgacagagtttcttgcctaatgtagagcaatcagaaagtgtcagagagtggatgtcatgctgcttgtgccaactcaagagttcgatcttcccaggagggaacatgaagaaacagccgagagaggtggctcaatccaatccagtaaaaacggtggcgcatgaaagtccaggatgaatttgtcaggtgtggctctgtgagtgtcttggtaaagagaatgcactggctgcccaaagyggtttcctttgctttccttgtcttttttttcaagattttwtttttttttgatgtgaaccattttaaaagtctttattgaatttgttacaatattgctttttctttcttttctttctttttaaaatgttttggtttagtggctgcgaggcacgtggaatcttagctcccagaacagggattgaaacagcaccccctgccctgggaggtgaagccttaatccctggaccgccaggcaagtcccttccttgtctttacagaccaacagagcacccagcagagataaaactcactatgtaccaa

SEQ ID NO: 607 - DNA, 600 bp, Bovine  MMBT11172
tttggaagtgttctctcatagtacatcttgtaacatctaatcaatytctttattttccaatcagagaaccctgagtccatattcaaatacatcttcactccctttaggtatggacaatgtaaagaactctgtgtgtgtggcggcaggcggggggagaaggaagrtgatcccaggatcagtctcaaaggggctaaatctaatacttcataaatttttayactgctgtcattcattctaagtactggaactgtgcctactaatgatttctattctactaatacctataagtctttctagtaygcatttggctcccaatactttgagtggataatttgctgtaaaatctggcctcatggtccaaaataaagamatttaacaagaagaaaggtagtgctgagggscagttaactttcctgtaggttctactgccccggctctaggacagaagccactttagctctggagctcagcattcgaaggtgccctcttgtggtgtgggtaggaactgaacaccctacaatcctcgagctggcttgaggtataaatccagattaagttactgtttaacagccaacaagagaaacatagctgaactccaag

SEQ ID NO: 608 - DNA, 600 bp, Bovine  MMBT07346
aaagacgtggtatatatatacaatggaatacaactcagccacagttaagccgactggcctccgtaaagccccacttccaaatctcatcaccctggagaccagagcttcaacatatgaactgggtgggggacacaaacattcagtctggagcagacagagaagttgttttcaggctttttccccttcacgcccctcaccaggcagtcgcttcttgagcctatgtgagggagtccacagtcatgaactgcagagcgaggtactccttagatgctacctaaaacgtggtggaattccctctcyggctccccctccaatctcaggctataatcaccattttctagatagttgaagaaactcgatagagataaatgaaatgcccttttcaatttacttgactggaagagacaggaataggaacctcttcttctgatggctcttctctgtctccccagctgacttgagaagatgaccckgagcacaaaaaagccaaaacaatcccttctccttctacccttcagggaatagactggaaaaaccctacgacatcatgggagccttcctgggagcagagaaaacagaattcttgccatagctcgcctt

SEQ ID NO: 609 - DNA, 600 bp, Bovine  MMBT10409
agtgaaatcagcattaaaagcacctatatcggttccaaatctctctctttggaaagcagaatcgccagcacagacctatacacagtctttgaatatttggaaagagccatcattaactgagtttttcccccatgagatggagtggttagtctgtgtccacccaatttcaaaacaacttgtcaacgtggtagggacaaaaaaaatcccagtactaaccatctagttgattgagggaaaaattatcagtcagccctttgtcatttaatccaaacaaatggttgactaagtaaatctactttytaattagttacacttatattgcatagtcactgtgtcaggcaagggttttagtagcaaaacaaaaggctgtgaagatttttaaggagatatttctattaaatcctctttggaacccacacaaaggtgaaaacacatggctgtgtatttatcttagttcacggttattggaaggagaaattaactaattatgggtgtaggaatctctctggggggaaaaaattactgaagcgttttcaacaacatatttagtcacaaccaaactggctccttataacaagtcacacaaatatattgcattta

SEQ ID NO: 610 - DNA, 598 bp, Bovine  MMBT08935
  misc_feature (1)..(155): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagatcaaatatgctttttattgtgtttgacttcgcttgggctagtgactccagagaagggtatgtcgttgaacagagcagggacattcagaagcaagttcacaaccctgcaagactcctaacttttctctcttctaacaaaygtcaaaatacagctatttaccaagtgaaaggtaaaactccctttacgccagaccaataaacagtttccccaaatgtcagcttactacttattgtttctttacttatctttcccacatcccaaaggaaaagttttacttcacaggagacctcaactgaatgctttcccttgagcatgacatactcattcctctgtgtcctctaagaaaagaagagcaaaccaattttgctattctccaaagtaatttattttatacactgtaaatcatycatttattttaatatagacttgtttttttc

SEQ ID NO: 611 - DNA, 600 bp, Bovine  MMBT08759
gtttttttttttttttttccctgtgtctttcaaggcacatgttgtcctttcctttcttttttttaagatttttggtttcttgatgaggaccatttttaaagtcattatgaatttgctacaatattgcttctgttttatgttttgatttcttggctgtgagaaacatgtgggatcttaactccccagccagggggcaaaccctcaccctgtgcattggaaggcaaagccttaaccactggaccttcaaggaagtccctaggcacaccattgtcttaaaggactttccttggttacttctcyctgggtgatcataaacttatttcccagtaattcctgttcatttgctgaagactttagcatttgttctttttactctctatccctgctcttaacatcattcttgataataggaataaatatggtaaatccaccaaacaattamayctaacactttaataatgcttacaatatgatgggcacagttaagaagtctgttaataaagtcatttaatcattgcagtaatttatatagtagaaactatcattatctccattgataactccaatgataactatcattatctccayggatatggaaat

SEQ ID NO: 612 - DNA, 600 bp, Bovine  MMBT08946
attataagttatttactactctctagtaatattgaagaataatgtatrtgattgggaaaataccaagggaatgataaaagagarctatggactggcagagtgacttgcttcccattaagaagcagcacagggaagrgtgcaaactgtctggtgtatgttgttatatcaagaagaagtagaagatttggctagaatgtaggatctatgttggaataaaaatgtcccaaagtccattttcctaagctttaagaaataataatagtaataactggcatttattaagtgcttactatatattcygggtacttttcaagcatgatctccatcttcaactcttagatgytgtcattcccattcctacacacmaggatgctggagctcaaagaagtccctgagtttgcctaagtcacacagctgttgtggcatagccagcggtcctgccactgactactctataaaactgcctgatgaaagcatttttcagtttatataattcttctacatccattgataatagatatgcaattaggtgggtggtacaaaatttccaaggtatgtggcactgaaatctagtctatgccactagctgagcctgagcca

SEQ ID NO: 613 - DNA, 600 bp, Bovine  MMBT08053
attatgcttcttattactctgtgatcaaactgtaatatattttctaaagtgaataattgcccctctccataatgggctcaaaaacataatgcctttcagagggtttggtctttgacagactatttttggcagtccttagagtttcacatttcttaatttttgattaaatcctaatcaacctgatttccttcactatttcttcttccataactgtgtttctttctgccatctgtttttcatcctcatttagatcatcaaggcaaataatcaaattaaaaggacactgtcaatgtatttttytctcatatctaaaatctattttactgactcttatttagggtttgaagcatgattataaaatatattttccctttagtgatacagatataaatattacagcttagaaaaaawttttttgtaataatggaaaattaytcaggctatattaatacttttatttaaaatactgttttaaatacttaaaaattcaaaaacatccatgaaaattataccagatcaaatttcagtcctatgcaccttgacagagtccctgtttctgtttagagcttggttttcattcctcaagtctgstctttaaga

SEQ ID NO: 614 - DNA, 600 bp, Bovine  MMBT08063
tcatgtgttttcctagatactattatctgaaactgagatcagaatcatttctatgcataattttgggccacataattattttgaaaaggttaggtacatttcaaatacaatttttgcaaacaaagtgacactgtcattgtgtgtagaaattttatctttctaggcttgttttaattcatattttacttgggtgattaagtaaaaagattttgtgtttcaaagaacattgtcttgtggttttattttacaaactacatttttaaattaaagcacaacagatggaagcttcgttgcttaaayaagcatctatactytaatgcaaaaactcagaattaaagttttgacaaataacttaggaatcttccaaaaaatcttgattttcttcttagccacaatgtactcacattgacagatttttctttctacaataaaatgaagcaagagattcctaatatctgcatccaacctatctttacttccttctaatgtaagggcaaaaccatatgtctcttcagcttcaaatgattattcaacctatcagctatgtcacagattttaacagatgctggtggtagaatttttgttccagtttctcaatca

SEQ ID NO: 615 - DNA, 600 bp, Bovine  MMBT10433
ttgactatctttcatgtacataagactgtcttaagcaaatgcttcctggctatttttactaaagtattccaaatgtaaatattgcttttactttcataatatccacatgtttgtttaaataaaaaataataatattttaaattaacaacaggggagacatatagaatgtttcctgatcccatcactactgagagtggctaaaattgatccttcagttatacatagttttcttattctttggcttccagccactgcttcaatatctccaggcaatttatactctttaaatagcatgagatycccaatatttgcatgaagtgacagaaagaaagagacttcaatttgtatcaattcacctacaaatactagttctataactttgaggatatttccaaactatttccatttcctcttgtgaaatgagaaaagyaatatcttattattgcaagaaagaaataaaatgcatataacttgtctgatacacagtagaaaygcttaataaatgtaacgtccctttccaactctacgtagtgtgcctttcagtcttgcttaaaaggggttaatcaagaaaaataatcgagctgaaaaggaactctgaaa

SEQ ID NO: 616 - DNA, 600 bp, Bovine  MMBT08091
taagaacaacgcaagctcttacctcctgcaagttcagtgcagtatatgactagggaaggggaggtgagaggtgagggggaaaaaaatttagttcatgttagcacatatgtgccaaatgtaaaaaccgatttgaacaataccatctatcttatataattcattgttattacaacctcacacatattttgttcaacacttaacctcayttaataccccaaagtcacagaattctttatttcctcagtgaatcttycttttgattaggcatattatttctagrtaagtctatgtagyaaaatyagacaaagtgatgaacatttacacagacaatgagaagtgagcagccctggagatgactattcaccacccatcacttccatatatttgtgaaatataacagcacatcccagaacgtaaacactcatttctcccaaggccacacagagaccatagcatgcagtgtgtctgtgatacaaacaggctgkttttttttttaccactggtgcaagcagtcccattattcragccctaagcagctgccatggcaagaaaaggtgagaaggaaagcatttacccttctcagcatctccacgatgtttt

SEQ ID NO: 617 - DNA, 600 bp, Bovine  MMBT09506
ctcctccatattttgttttgtttgtttcctcctccatattgttcttcattcatgagacaatccaatayatgcaattgtaccctagcttttattatcatatattatatcctggtgctattttcctatatgtatgtaaatatrtatttttaaacaatcatttagtattccatcaacttatttaactagctcccaataagctaatttagattacataatttttttctaatgaaaaaattctgtgcaatgaatattcttaagcatatcttctgacatagttctgtgagtatatatccacagttytgtgattatatagcagtcagatatttttagtcaagaatcctatgcattgtttaaaattcctgcagatattgccaaatgtccttctaaagagcttgcatcaattcaccctctcgccaccagactgtgaccactgctttttactgtgtctgctaactttcacattcatgtcacccggtgatcccacsaawgttatgawgcaggttcaatatgggtgtcacccttgtttctagcatgaatcaaggctatgacccagatgttctgattctaagtacagaacgttttctcggacaaattaaagat

SEQ ID NO: 618 - DNA, 600 bp, Bovine  MMBT07416
tgttattgctgagataataggctatgtcaatatctactcatgttattgtaactgggaaataagatgggggagtgctgctgtgtgtctcagtatggaggaaaaccaaatgttaattttcatagtgtcatgtttggtttaaattatctattctaaaataaaggcatgtattcaccttcaatgtaatgaattcatttgctatccagccacagatgatttctatcaaatttctctccaaaccaattttatttgataggacacagaagaacaaaaacagtccacaacttaccagttgataaatayattgaaattcactaaaagagagtgttgatgaaatctttatattaaaaaaaaaaaaaaaaagagcatctctgtgacaacctagagaggtgggatggagtgggaggtgggagggaggttcaagaaagaggggacatatgtatacctatggctgattcatattgatatatggcagaaaagaatacaatactgtaaagcaattatcctacaattaaaaataaataattttttaaaaaagaaaaaagcatcataataaacttgggaaaattaatatcatgtgttagttgctcagtcatgttgact

SEQ ID NO: 619 - DNA, 600 bp, Bovine  MMBT07466
cagagagtcaaaaaatagaaagaggtcaccatactgttttctttaggtcagctagtaaagatctgctttctgattttatgcaaatatattgatatttgttctagctacagcagaagaaagggtcgaaattacagtcctcctgggggttataatcagtatagcagttagaatactgctttcaactgttctaacaacaaaatgtaacagtggaaaatgaggtggaaatttattttctcttcacttaaccatctgagaataagcagtcaaggaatgatttgattatcaggtactatcatggaytcaggcaaatagtggggtgataggttgcctgttcttctctgactagtgttaagccaataccccaagcttctagtttgcttattatcttaaaatacagccagaaatttaaaaaaagaaaaacagagactgggaattatgcatgccaatgtactgtgaaattcatgtgggtggatcagttttttcagtgcttataagtacttataagatacaggatatggctctggaagtccatccaaagagagagagtggtctttattggctacatttgacaactcagcaggtatgaaaaagcaaaaggaa

SEQ ID NO: 620 - DNA, 600 bp, Bovine  MMBT09832
agtatgttaccatattcagaattttttaagaatataaagaggttctgagaccaaaatgtctgagaaccyttgctgtctgggttatttgctgtcactactgttgcagtgtttccagctgactgctacatctttcttcctttgtatcttaccaagaccttagacttctttcmcaggagaaaagtgaactttttcttaaatatcagatgcgcacagttgagttaatcaaattcatcagtatagcgcagtatcaccattgttccatgaaaggacctttgtgttttattacagtaagttccctaygcatgaaygagttccattctgagagcgtgtttgtaagtccaatttgtttgtaagtcctacaaagttagcctaggtgcccagctaacacaattggctatatggtagtgtactgtaayaggtttataatacttttcacataaatartatatagaaaacaagcaaacacaaaaaataaagaaaacgtttttaatcttatatacactacctggaaaagtacagtacagtaccagctatatcacaattgcttttatgcttgcttccagacatgctggatttgaaataaagatgctatactactgt

SEQ ID NO: 621 - DNA, 600 bp, Bovine  MMBT07417
aaaagtgagagctaagtttgcctggtgtaaaacatctgtgaacaaattttcatttactgatgatcataaggcagaaactatgacgaattctgggaacttaactataaaacagaagtctgattaatgagtatttgaattttactttcctcttccatctctagttacaaacagtcagtcttatagctgagacccattgaccctcttttcagcaaaataatacttaaaactgcagctgaaaactacactctggaatcagtaaacaacaaaagccaagatgccacagcagctaaggcacatagycagctatttcctttcaaatgtgacagtttaacaagctgcttggctctctcatgcctggtttttattagagaaattcactaaaataaatcaaactagcatttgatcaatggattggggctgggagtggttttttttccttttttacctgatttccactgggctggatcaccttcaagggtgtttcctggaccgccgggctgactgcagtcgagtatgtgtaggcaacctgggggatcaggatggtctgcttgttggcagccagtgctcgcaagcacggaacactgttctggtcagcgatgg

SEQ ID NO: 622 - DNA, 600 bp, Bovine  MMBT09737
tttccttgccctggccctgaacccttgatgagatgtgggaatctgtttccataaaaccaatttatttttccatttatatgattaattgaaatcactaatactctagcctccaggtcataaacactgggtaataaaatcctctctacatctgtccagtgctttagtgttcgctaagcacttttaccaccattatctgatgtgaccctttagaacggtcctgtgagatacacaggaagggattacaatggtcagtttagagcccgagtgttgccaatggttacaggtagccgggagcagagygggaactgaagctagttcttatattcttaagtttagttctcttgtcaggtaaacagatgagcaggttgacccaggactcaggggcttcacaggatctgggacttttagctttaaaactgagaatgtccaggcaaagctgagaagaattggccaccccatttgaggaccccagggtgtctctcgtgatggaggcctgtcactcccaccaggttcaactgaggaaaatgtcctatcacctggcacargtgaggcaaacgctgtgcctggaccatgtaccatgatgtggctggagaagagcca

SEQ ID NO: 623 - DNA, 600 bp, Bovine  MMBT09680
taacaatgagataaagaatcaaggatcttttctcttctccttagttccaggcaccatgaagaattgacttcattttctaatcacaactcttttccagccccctcctcattctacacccacccacatgagcagctcaggggtgaacagaaattttcagatgtttgataatacatgtcctacttcatttcatgatgcagtcacgactgaagatatatatttagaaatatgtaatcaccccaccggaagggttagcaccccaggcatctgaaatatactatttctttcgaaatcaagaggctyatagccgaggactaaagtgaatgccaagccctaagaattctcgcaatcacacacacaaaaaaagagctgagaatgtgtgctttctgcagctttccttgttctgcccacctgtttcctggggtggaaaatgtacagttacactctatagattattataattaagtggtgtgcgaaattcgtttctttaaaaatagcttcatcgactcttcacggcgtatttctgtgagacaagtctacgtgaaaagcaagtgaggatggttattgttcagcacgtttaattaagtaagtatttctttcacc

SEQ ID NO: 624 - DNA, 600 bp, Bovine  MMBT07399
agggttgagcaacacggtgagtgagaaggagagaagttgaaagaagctgcaaaacttggcagagatgatacttgattggccttaaaagattaagtatcaataggatgtaactaactaaagccataggaggtgacattccaggaagaggaaatagcaccaggagacccaagatcatgagaakagaattttctgagaactaaacagactttggtgtgatgaaaagtggttcaggaaactgacaggactccagcctgggatctagtgtggggacaccatgagccataccccacagtttggaaytttggaggcaaaaggaagaggagagatctgtaagcagaactagaaaataactatgatacccggtggaggatgaaatggaaaccaagtatcargtaagacaatatatccagattaaaataataatagcagtttttattattaaaggactctgaatcaggattgtggtttaggagtttcaaacaacataaccccctgagctgagcatcgctgtgactggtgagagagtatcctgcttaccaagggtgttggaacaaataggctgaaagctgccatgggagccacagtgtatcttccctgcag

SEQ ID NO: 625 - DNA, 600 bp, Bovine  MMBT11042
gtttctgcaaaaacaactgagggatgtgcatcagacatgggtttccaggtccttcaggaaggaactataggtcctgcagctcggctatttggctgatctagcgtttaaattgttacgagctctcccgccggactgctgttctttgtctctgcgtggtctctctcctctgatcattaacccttgggccagactttctgaaattcagggaaggttcaggagactgaaggttttatttaagcgagaggtgaggaacaagctggggttggttactgagaaaagctggtctggtgattgatcggyttcaccatgtgtcgcgagctttcatagggtaagaaagtgaaagaaaatattttgattttggaagatggtgctttaaagtgagattctttgggggagaaaaatcctgaatctcatttgaagactgtcattagcctcartaacacaggcaaaaatgagtgttgcagggtgtactaaggggagtggtttttttttaaackgtggaatttcagtgagtaaatgctttcctacaaaattcataaatgccacttacaccccaaaccagcaacatttaacttatctgcagctggtyctgtgccatat

SEQ ID NO: 626 - DNA, 600 bp, Bovine  MMBT03112
gacgaggaggctgactggtgcaggcgggcggcctccgcggcggcgtccatgtccacgtcgctgcgagagcggggcacgttctccgccttccgggaccgcttcatctcctcccggcccttcaggctctcagaccggcccaggcgaatctctgagcgtgaactgggtggaaacagcaagagactttggggtctcacatctgaccagctctgacctgctactccatctcagggcctgcctyggcactgcaggcttccactccaaacaccagacccaacgtgcccaaactccccgtggcagacrctgctcagtgacaaaccgcttttactacagactccttcctctccccagctaggcttgatggacagagcctctcatcttcctctttcctttaaaaaaatttttatttatttatcttttgggtgtgctgggtctttgttgctatgtgggctcttctctagttgcggtgtgcatgggcttcttactgtggtggcttgtcttgttgaagagcacgggctctagggcatgcaagcttcagaagcttcagggttgggctcatcacctgtggttcccaggctcaasagtggtggccccgcgggctta

SEQ ID NO: 627 - DNA, 600 bp, Bovine  MMBT04326
ctctgagagccggactccagacctcatcttctacagacacagccaccctgtgtaagcccagggcagtatctccacaggtaaaagaaattgtttttgcaagtctttgtgtcagtgtgcattgaaagcaatttctcattaatagccttataaagtactttagcatttaaacattcagaaccaccatcattctaaaatatactatttatacagtacaaaaaagccaatctgaaaaattgttgatgaaactagggtagaggcagaaaacacctattaggaatattaaagccaatgcttctagaycagtaatgagctatttaggaatttgctggcaacctttgaatagtgtttcattttaacagcaaatgtcaagttagcacttctggctcaaaaagacagtttttaaataggctggctctgagaagttgagaatagcgcaccaggccctggtccayagggtcacaaagagaggggctaaagcaacctagcatgcacaaactcagaatacaccargcaaaacagaaatatatttgtcaagacactggcttgataactaggtccatggagatgcaggaggtgtttttccgtttgttttgtgttgtc

SEQ ID NO: 628 - DNA, 600 bp, Bovine  MMBT03172
aagaatctacctgccaatgcaggagacacaagagtcatgggtttgatccctgggtcagaaagatcccctgaagtaggaaatagcaacccagtctagtattcttgcttggaagtttccatgggcagaggaacctggcagactacagtccatgtggctgcaaagagttgaatacaactgaacaactgagcacrtaatccacatatcatctgctagtctgggaatctctgatttaggaaataccagttcaacattcamgtcttagtgaataatggaaataaaacctatgaagtctttctctcrtttttatgactctactactgtctaacagattttttaaagtactctgaatacttattttktttacatccctgcctttttctatgaaactgaaaaatgctttgaaacaaagagcatatcttatccttaagatatgcttaattcatatctatgaattatcagaatgcttctgataatatgaataataatgcatattattaagatatgcttaaatcatatctatgaattatcgtagttcaatgatgatgctcagatgaatagataagggccagaaaagggactagaaagatctaagagtccttg

SEQ ID NO: 629 - DNA, 600 bp, Bovine  MMBT03273
catcaggattcttaaaatagctctcttattcagaggccttcaggagccctgtgaagtcaacacaggagggggacacaaagagtgctggatccctagagatctcagaagctcttcctctggtcgctggctcaaaaacaagtcactgcaaatgcacgaaagctggttccttaccaagagagatgtattccctcaagatcctaaacttagagaggcctgtgtagacagggttctcttctctctggaaaagcaggaggctaaattttggagcaggcaaggctttctttggcattgtaatgaacrtgttctacatcttacattctcgtagtccaagactccatcccattcactcaaaacattgttgtctcggatgctgaccatacctcgaaaggcattgacatggatgctctgggtcccaacagatccatccagaggatggttgtcactgatgttctggagaagagaaggcagcaaggagaacagtcctaagtccagagttcctgcattgcccgtctctcgcaggtataaaggggtcctcacaaaaaatttgacggaggccaccccagattccctggtggctcagatggtaaagattccacctgc

SEQ ID NO: 630 - DNA, 600 bp, Bovine  MMBT03269
cgtattcagaccattcaatgggtcagactgaccgtgtcagcgggggctctttccttggcaggtcaaagcccgactcccatttttcttcccctcctaactccctctccacctccaggactaccagtaccccaaacctattctgagggaggcaaaaacaaaatgcccaaaagcgcctgatatttacatcacaagggctgggcacttcccgtggcagtgggccagcaggtagaaataaactgggttgtcagtcaagagggttctttatgtcatagaggcaaaactcctaattagggagatgarctttcaactgccagggcaaaagaacgcgtaaggttgtggaccctcttgttttgctagaaaccaagctggaaaccacccctgcttcaaaaccatatcactgacaactctgtattgagactccatcttttcaggccacattctctccttaacctttacttytctcctccttgagtgtttagagatagagtctttgtccccagaatgtacctagactcaaaaatcaaggtcaacgataaccactatctttcaatactgagtcaattctattgtgccttgaaagttgtgtgaatgatcaaagtt

SEQ ID NO: 631 - DNA, 600 bp, Bovine  MMBT03285
gctttttagaattcaaattgtatgcctcttataatatataattatatttctcttttcataatatattcagatcattctccagtaatcagggatgctcaacactgccttaagacacagtaaaatcgccatcactggaggtcaggtgtaaagtgtgcatgatccttaaaaagacagtatttcttgaatgtcttaggaggtagacttaatggtcttgaagacctgctctagtcataacatcctgattctatgggttttttggtaagaacttttaatggcttatacaaatagagttacagatgrtggaatctcaggatggcagggaatatatcttggagcatgaatgsctccaaccaactrcatctttttaarttttacttggawaaactatcaaaatatgacacctgcagccccagagatatgtttattttacagttaacaaaagagaaggcaactgtttctgaaagtgactgttttgcttcaagaatctcaatctaaatgtatgtgtctcatgggaaatggagaaagaatatatgctatggacatctgttttatttttattgcatttttgccttttttcaaaataaaacacatcattggagg

SEQ ID NO: 632 - DNA, 600 bp, Bovine  MMBT03064
tccttctacggctctgacccttctttcttagatttcttggctggctcacatccttcctctagcctgtcaatgttagtgttgcctacgtttctgttgtctcactctttttctttcttcttacgctaaactgtttctggaatctaatccaatcaggtggataccacctatatacatctttattctaattcatctgttgacccccaagaataaagtgtcaatatctactggatattgtcacaggctcttcaaatgacacatatgtttaaaatggagccatggggtcgcaaacatgactgagcractttcactttcactttaatgtctttcatccaaaatgtgattctcctcactttctccattgatgggtttttttgttttttttttttagagttagaaactgaggactttcctaaactctttctgccctggtgttctacgactcaagatactaagacccatcagttctacgctccaagtatccctcagacagcccacttctgtcctcagcacggctgcctgagttcaggctctcatcctctgctgtccagaccaatgccagaacctttccctggcttctttgacccattttgcagccagaga

SEQ ID NO: 633 - DNA, 598 bp, Bovine  MMBT04696
  misc_feature (1)..(30): n is any nucleotide
nnnnnnnnnnnnnnnnnnnnnnnnnnnnnnttactcctggctgatgagaattactccaggaatctggatcatagtggaacaggtctttactctcctcctgkgttacatttccatctctgggtgggtccytgggaaccccactcccctgagagttccctcttcagtctctgacccccaggcttgggatttgtttgttactgctcctggaatgttctccagcaagtcctttttccctggtcatcatctcagtcttcagagtggaatttgtcaatgactagcaaggctctcttgctcatatgycatatgtcgttaggctaaaaggccccatcaccattagcaatgagctaaggaggatcacaggattagcagggatagacatctacatcttactccagaaaataaatacaaattcatcaaaaggatgttttatggtggttccccyggcaaatgaccatgcctacaatagcctatctctgatgccagaattttcatcttttggggttaaagtactgtttcatgttaaactaaagactctttccacccatctcattaaattatgatcatatattattctcttaatgkgaatgagtttgtgtgg

SEQ ID NO: 634 - DNA, 600 bp, Bovine  MMBT05340
gcaaccttagctctccaccagacatttccacccggatgtcaaaccctcatttcaaacttaagatgtcgaaaaatgaattaattatcttcaaaaaaaaataggccacacttcctgatttctctatttctatcaaaggtacttttctctcatcataacacctgggacgattctcacaaatgttcagggccctgaaaagtaaaacagacacatggctgaggctggagccagccaccagcctccaatgcacccttaattctttccacggctaacatccctccatccatgggccgatcgcaagtracaggagggaatcacagagtatgcaagcctttaacaattggaaggggcacatctccagctaattataagtcagacttttcccctcccagccaaatctatccttatacgtaaacgggcaagaatctttctttgggtgacttccctggtggtccagtggctaagacaccgagctcccaatgcagggggtctgggttccatccctggtcagggaactagatcccacatgccacaacaaaagatcctgtgtgccacaatgaagacccagtgcaaccaaataaataaaataaaatttaaaaataa

SEQ ID NO: 635 - DNA, 600 bp, Bovine  MMBT04692
caggtacacagaagctggcagccaggctcccaggccttcagaagggggtgattcctccctgtgcccccccttcaacactccgctccaggggagagacgagagaccactcctcctcttcacctggggccatatgtcagcgcgccccagaaatcaacggtagtgctggagtaacgggtgggcaagcatgaaagagggctatgaaactccttccagaaaaaaaaccaagccagtgttctcagaggacgtctccccgcaaggtcggggtggctgcagtgatggcaggaagagtgcccccacacrctyggggatcctcaagtccccagggctgcctgcatttcctgtgtctcagacggtcgtcttmtctcccagggggtcttcctcccacttgcccagatkcccagaaagtggacaaatggcagaggccgggccatcctggccccgctagtgactgccccrgccaggaagactctgccacgagttcctgatggtcacaggccgtctcatccctcgagactggaatgggcccaggsttatattccaaggtctctcagctgaggcaatgtccacctctgggtaggatccttgcactgaaccccactc

SEQ ID NO: 636 - DNA, 600 bp, Bovine  MMBT04221
ttttaaaatattgtctaactgccagctaatttaaagctctaagagcttgttgttgtgtcatttcggaatagagtattaaataatttaaagtgaaatgaatcactaaatgctgaagaactgctgttaaatcttttgtgatataagggtttctttgctagagtcacacatgtaattgtacatttctgtgaaatgctctctgaacattagaggagatattcatgagctgaaattccaaaaacaaatctaatgatttgacagccctgctcaaaagacagcctctcagcatcttagaggtttcartgtactgaacgacagagtcagagggggcctaggaatatcctctgttctctgaccttctgcctcctcctctgtgtctggctgccatcgtcctgtgaccctgacagggtggcaccagcccaccaacggcctctcacctcagtgatctcagtggtgggggcgtgggggcgacactcaggaatccctgaacaagaatgtcagtagaagctcactgtagtggctaacccttgttcttgttctcatggcaattttttttaaggaaaaataatttccaggctctgcagaatggatttgaaatactat

SEQ ID NO: 637 - DNA, 600 bp, Bovine  MMBT04842
gagatgatgctgacgatgaggacacagccacaagactttgaacaatatataatataaactttaagtttaaataagaggtaacaacagaagttaatgagtgaggaacttaatgcaagttacagaagttgcctagtttctgttactttccgggttttaggacgatatacaacagctttgccaaaatcctttcatcgaagaccaattcctatttgccgccaaatcacctggtgaggactacagttcccagaaggcaacgctcggctctcgcgactcagcctcgttagccggccgggagttgtrgtttacaaaagaacgctgtggaacctaagttttactcccttgtcaacagaaactgggcggtatcggtctcttctccctccgggtccgcccttttctgcagcggtcgaattcgtgaacctagtccaggtgcttggctgggcgggaagccgcggccggttggccggcggggcgctctaggccccgcggttttagtctctatgactccgggaggcggtcccgggtgccctgacgcgagcggagggggtgcgggtcagttccgcgcggcgctgtcggggaaccatggcagccccaagaggtgag

SEQ ID NO: 638 - DNA, 600 bp, Bovine  MMBT04529
agcttgcacgctgtcccctcagccccaagtgctcctcattatccatccatccatcccatcgctgtatcccccatgtggtgcccaggaccttggacatcactcagtaggggtatactaaacatcaaatcaatagaagaaatggaaaatattcttaccagatttctttttcccaacatgttccctgtataggaaagaatgggggtgggggaagagtaatgagtcagtatctcttgtgtattgctacaagttattccattaggaaaaggagatttttccctcccacaacatctccagtgaatraaggtaagatccacgtcagccccagggacccagacctccttaaaagaaggaattccttttaattttctccttttgctctggtgccctggggacagcatctgcactctgtagaggagggtgctccagggagttgatgggcaggggtgggtatgcaatctgaaaacaggaggtagacccccacgctrcacggggcctgaggccacctcatcaggctcrggggcggcctcacctaccctgagcagtgccctgagctgaacaactggagcaggaaactcttggtggtgaggsgaatacattgca

SEQ ID NO: 639 - DNA, 600 bp, Bovine  MMBT04610
tctttgcaaacccacagactgtagcctgccaggctcttctgtccatgggattctccaggcaagaatactggagtagattgccattcccttctccaaaggatcttccagactcagggaagagaagaaaattttttaggcagaaaaagacagtcattgtgtttttgaaactcatctttccccattctttaggagaaaaaaacctctcagccagttgcaagttctagatcctgggggaaagcaggagcctagcatgaaagctggaggggacaggcagttttcttagaagggaggccctcatcrcagctgtggatatcggacccatccttgggcaacagtcctggaaaactgagatgcctcatcccttctccctaccctgccccaagccccacactcacgtaccccaggaagttgtgaatctttggctctagtgggctgtggctaagagatcagcagctaggagtgccatctatagagtatcctaatttcacgtactcatcttgtacacccatgtcacaggggaagtagatgccaccagagagccttacggcctattgccattgcaagaaaaacaactcaacctcaggcccttttgggcactgg

SEQ ID NO: 640 - DNA, 600 bp, Bovine  MMBT04588
atttttagaaaaataaataatagggatacattttcctaaatatgtgttcagtttaaaaaaatgctaatcttgaccttcctaatccattatcctcacttctaaaatacaatttgctttggttttatataggtttttccatatgccagataattaaggatcctgccttagcaatttcagagaaatgtgaattaagccttttatgagaccatgtgggtacagtttgaatctactaaagaaggaaattgaacattaagcattaacaccttccttttgctcaaccacaccttccaagggctcacrtacggagaacacttgtgatggggtgccagcttttggtgccgctccgcatagccagctcacatttagggctcctattaacttgaaagagagctccaggtgcattcaagttctgctgaagaaatggaaatttggaagctttattattagcttaggccattttcaactctcacgtgaataagagatggagaaaagttattagaatctatttttttttwaaactactgctcttaggagtgacgtcaaactaaacacaaaggtaggtactgagacaaaggtgtcggggctctttctttctgagtg

SEQ ID NO: 641 - DNA, 598 bp, Bovine  MMBT04327
  misc_feature (1)..(46): n is any nucleotide
nnnnnnnnnnnnnnnnnnnnnnnnnnnnnnnnnnnnnnnnnnnnnntgtaaagtccactgtaaagatgttcttattacccgccacggatctccccgtcgctgtagctgaaggctacattcagctgaatgttgatttagcttctcagagaacaacagtagccaatgagcaaatgctgcttgtatgaaactacttaaatataagaaagctgtgtaaaacaggamagcagcgctacctttggttttcctgctaatgactgactcggcgtctgctctggagcctggtactgtgacaagagtggrcagkgctcagagactcctcgtttgactcggagagccgaccacatcctgcaaaatygggtygtaaaaatatgcaaattaaggtcaaacagccccacatcggagatgtaatggctaatctgttcagacagctgcttcttggccattaaattacaaggtgactgagttcatgaagattttcacacacaactaactcctcaaattgtgtctcatactttggctttcatggacaaagctagycagatgagctatggttgtagcagaaagagccaatctgtcgccatttgttttccaatagaca

SEQ ID NO: 642 - DNA, 600 bp, Bovine  MMBT04460
gggagcctgccccttggggctgaaggagaggatgctccatgggctctgccactgacctgctgtggttctgagcatacagcactgccctactctgaccatcagtttcctcctccatcaaagggggaggagttgatcataatgtctaaagggcccttccaggtctgaggtctgaaagactctgcactttcactgctaagggcccagtttgatccctggtcaggaaactatgatcccataagatgtgtggctggaaaaataaaaggaagagggtgccgacttctggggagggagcgtgggaarggactggaattggcaggcagagggtgaatagaactttatcttttatgtactgtgtcccttgtgagagggaggccttctggtttctctccccatctcctgttcctgtcctcccagctggcctggactccagagcacatgtaggatttttttcccttgttccccagagccctccattagttgtcctcaaaacactcttccccaaggagccccaggccctcctatctggcccaactcgtggaagggattggttgaactgaagctcctcccccttctttgtatatcagtgaggaaatcgagccc

SEQ ID NO: 643 - DNA, 600 bp, Bovine  MMBT03482
tagggacctgagatcaattgctggttggagaactaggatcctgcaagtcacatggcaccgccaaaaatgaataaataaaactcaattaaaatttaaaatagtacatctcataagcagtgactcaatctgaacttgacccccaattgtggggagagagaatctttttaggtgaagtgggcaaggaagacttctctaaggagaccgccttcttaaaaaatactggaacaatgagatggtaccaaccatgtgaagggctgtgcatgaggggtgggatggagagtaacccaggcagtgggaacrgagtgtgcaagggtcctgaggtgggaagggccttggcatactttagggatggaaaggtacaggtgaactgcaacaagcaagacaggtgagtagtcctggtgagtttgtaggatgaccagagccagtttcagaggccaaagtatgtcttttgactttttcaaagtgcaataggaagccaggggaggcttttgagtagtggtgtgccatgatcagaagtcagtttcctccagctcctctagcactgactctgtgaataactaccatccgaatttccaagcagcagaggggttgaggagctgg

SEQ ID NO: 644 - DNA, 600 bp, Bovine  MMBT04248
ttcgtgttacactgattctgcaatttttgccccacatgttcatttaagaaactgacctacctataaaagaagctactgtccttaaacttactgcagccacctattatcacatggatactcataatctctcagtagtggcaagaaacattttacctcagtacaaagtagattacatttgcatatttatatctcacaaatccacaatgcattgcatactcataatgcaacttgatgtgaatatgtaaataccaagatatgtaagtatttaaatatcagaaaagatttcacatagaagtagargatatccataatgcaacttactatctgcctaatactacagcacaatccaaaaagttagtgctacctgtcagttggaaatgcccaagaaataagcctttccccaccacactgaagaagcctgagcaggtctagcctgagtagcctggtctctgtcaagagatttccacagcagaagacagaattcaatcagaattcttcctggaaaagcccagtttgcctctaggccatcttaattcrgatgaaactgaactatgatttaaaaagaaaaacacaaatatttatagagttccctactgttat

SEQ ID NO: 645 - DNA, 600 bp, Bovine  MMBT04077
atgagggccaagttgggctgtttcatgtgaatcctgcctataaaagaagcagcttcttccaaatttcgtaagagatcagtgacaagctggaatttttcatttctgggcgcagtgagaagttacatttaaagaaccatcctcatttatgtttcaaaaggaaataggttccggcttgccaccctggtgtgctttgaggctgctgaatgttcttggaactttcatattgacaataatttcatgactgaggaaaggtattttggtcgtttccataactttaatagtttccagccataacctcaraaaggaaggtaaaaaataacaattgggtgtggtggggatgtcgctcctgagtctttgttactgttgagggatgtaggagagggtctgtaaccagttgtcctctcaacccagartctstttgtgtaactgcttgtatatgtcagggcttgatacaatctgcagaggcagaaagaggtttcttytctttctttctctctctcttttttaaaataagatatccagggacttccctagtggtccagtggttaagaatctaccttgaaatgcagaggacgaggctttgatgccctgtcagggaac

SEQ ID NO: 646 - DNA, 600 bp, Bovine  MMBT05253
ctcgactcttcagagctagataaattgagcttcacctaatttgttgtacagagatttttgtgaagcatcaaccaccaccaagtggcagtacagtatctatgacccccctttttaaaaatcaactattattggagtatatttggtttacagtgttgtattagtttctgttgtacagcaaagtgaatcagctatgtgtatacacatatcctctcttatttcttggatttccctcccatttaggtcaccacagttgagttccctgtgctatacagtaggttttcattagttatctattttacrtaagtgtatatatgtctatgatccccctttaaaaaaaaaaaaagagagacaatgcctgctcctatccttgtacattctgttttcatctaactgtcaagtaaggcatatttgtggcttctgaaatggctggattcacttgattcttgaaaagagaatgtcatgacaataagggcttttgtcgataatctcacagccttcacacacagatgatgtgaggagttaggagaaacacgatttcaaatctggtggttcccaaacgacagcagaggattggaggcaggaattaaaaaaggatgggac

SEQ ID NO: 647 - DNA, 600 bp, Bovine  MMBT04836
tctcccartcatgcattttgtgggaggttttccagcattgtgattgaatcagatgttagaaatgaatggggggtttagcacaaaaaccggttgcacactcatgacggccattgttgtagcatcatgagaaattacyaatgactgcaagtctgatttaatgatttacactttcttcatgataaaataggaataacatacataggaatggattgatggggtgacctcgggtattcacttgtatgaatctatttgaaaagattaaatgagggtgaatatcatgctagatgggcaaaattgtcrcattcaggacagctgttttgactgctaagccaaaagtcactgttcagaaacataggaaaaaagaccaaacagagcatgacatatagtctatttaaggggagaaattacagagtaggacttctgcatttaggtgagggagctacccccctagagtaaatgattgctcaggttcctaaaacttaatacccaccatggtcattttctccccagtgatacataccataaacttttaatctgaccataggaattcaatggtgggttgaaaatgaatcaagaaataacaatacataaaatgaacag

SEQ ID NO: 648 - DNA, 600 bp, Bovine  MMBT04557
catcttatcttttcatggaatcttcagtccctgcatataaatggccaatgcttaatttaaatcatttaaagttcccaggtttgttcattttgtttactgtactgtaataacttattaaaaacgtacgtggaattgaacattgttgcacctggtcttaggcattaaatatgttataatgtgggactaaaggcattgtccaaatggccatagtgggttttcttaatttatttttttattgaaggataattgctttacagaaaaccatagtggttttaacatttgctttatttcctcctctaraggaaaggtttttcactgaaaaatccatggagattacttgggataattccccaaagctaccctaaatggttttgacagagtcataatttctctcatgcaaagaatatatgatgcttttacttagaaagtggaagaagaaatgtttgcagttgtactttgaatttttaaaaaattcctataacaattagctcttgattcagaaattataaataaagctattttatcatccagtgtcactgaaacattttgtcctgtgatgttttagtttttattgttcttagagatttaatttttatcttg

SEQ ID NO: 649 - DNA, 598 bp, Bovine  MMBT03577
  misc_feature (1)..(41): n is any nucleotide
nnnnnnnnnnnnnnnnnnnnnnnnnnnnnnnnnnnnnnnnntctgatttaccttgaatatgttttactacaatccttgcatataaatcattaataatataattatctgacggtgtatagaagctctactaatattagaacttcaaaatgtattaactctagatacaaattatgcagaaatataaagaatgagattattatcttgttttactttggtaagagacagggttaattttcatgataaatcaaggatttagatgcattaggtttkttggtcattgaaataacaaagggaactgtragttgatctraggcaaaaatagaatccttatttttctcttttaaaaaataaaacaactgcccagtgagaactggttgcaccaatccactatttgtccaattacactttttttttttccccaaaaaaggcaacttcagctctggattgccaaatgatccaaaagaaaggcactttttgaccatgggcatcaacttttagataaggcataaaaccagagtattggtactttccagaagaattgaggcactagatctggtgtcctggccagattgcaattctggtaattgcattctgcttt

SEQ ID NO: 650 - DNA, 600 bp, Bovine  MMBT05078
ggactctttgcgaccccatggaatgtagcccaccaggttcctctgtccatggaattttccaggcaagaatactggaataggctgtcatttcctgcattaggggatcttcctaatctagggattttcaaacctgcgtctctttcatctcttgcattggcaggtggattcttcaccactggcctcacctaggaagccctatctctgccttacttacagttcacatctttaaaatccatatgaacagaccattgaacagtactgaaattgattcagaaattttaaaactcccaacaaacaaaratgcaggactgctttaacacttgaaattctcttctygmaaractagagaggaaaaatgctggttcctcaactctccccattctttgatgtcccctgaccaaaagcatagacatttttttattttaaggattatattactatttaccataagaaacrgaagagaggtaaaacatctttaaaagttacagcgtccggggctctggagcctgtgtctattttgagatggcaacctcagaccctgtgggcatctgtctgtcctgattcctgaggacgcggttcacaaactcctccccttctttc

SEQ ID NO: 651 - DNA, 598 bp, Bovine  MMBT05305
  misc_feature (1)..(232): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatggattttcagaggtacattagatactaatagagtcatgtataaaaatgaaattttacaactcartattattgattaaaaaagaaaaagaaatgagacaatataagttttattcaaaatatcagttatctgtaagtgatatggcaaaaactaaggggctatttccaagtttttatgagatttataaatcagayttatgaaaatgttattacttccagcttatctttaatcttaatatatttttctccctgaatagtctgataagaaaaagtaatataagttcttgaaagagcaaatatttgaggggattattaatattaaataaaacacatttcccaagtatgtcatcaagatgaaatctaca

SEQ ID NO: 652 - DNA, 600 bp, Bovine  MMBT04864
cattagccktttccatcagtcttgattgctttaaacttatgcttttcatattactctgtttcctggtcaaattttgtccttacttcatgtatagacagatttatcacattttaagaaatttattcatgtggacaaattaactatataagtcagtaaaagtgtgattttttcactattttaattattatttactttgtcccatcatagtctttctacaatcttgaattgatttatttttgccttttactttatttcataatttaagaacaaataaggagataagccacaaagtaggtgacrataaaagatgaagaggaaaaggggcacaaaactcatgttaggagcacagctttggataaaagactctaaggggaattctttgggcactatgctctgacgaaaggagttatgtggtggtgaataattttcccacagatcttttgttccttgatgtatttgatgcacaaataaaaatatgggttgaaagtttgcagaatgtagtttgtgtgtttacaaagggggctgtaaagtgaatgtgctgatgtgtgtgaaaccagacgtgctatagataatgggcactattaggaagatatgttcaga

SEQ ID NO: 653 - DNA, 600 bp, Bovine  MMBT05216
gtttcttctttaacatttttcatcttctgattaaaaaaaagtaaaaatcagctcctttccattagtagtagttttgttccgtatttttaaaattagaaagactacttagatattaagcatgggttccctttggacgctgtgccgtgcgagcatctggactggccaccctctctctttctgagcccgggcactcaaatcgaaagcagcttcctctgcgaatttctgcgttttctggtcgcagatgtgcccttccatgttgcccgtttttgtaaaccaagcatatttttgtcatcgcctccragccctttaatcagctctaagtgttgtcacgggatgaaaggtccatctgtgggtctgtatgtgggtggcaaacggtaagtgaaagggtcagcagaaatattggcagattaggagctgggttaaaaatacttttacgcaaaacagtaacacttgtatattaatatatttattggaaaatcaaagcctttccaaatggtcccatgagaaagaaaagaagtgaaagtttcacggtaaacgtttgtttgggaagcggattaaagacgttttagaggacagtcgaggcaggatttttcagaagaa

SEQ ID NO: 654 - DNA, 600 bp, Bovine  MMBT03704
atgttatttctatgaaaacaaaaatattataaattattctgtatgacaactttttacagaatttgacaaaaatgattcaaattattttaccataaatctatactgaagttatgtatctacattttcagtatataagaatttcgtttaaaaatgatcaatttggtctttataaaagtatttaatttttcacctatagctctgagatagatagtatcaacatttgcaaatatatttttaagctaacagtatatcataggaaagtaccaatacttgcaatcacatagaaaagttacaactgcrtattagtgaagaatgaaagatgagacagaggaaaatcatagaaattttgttatatgtatacataataccttgaacccaagactgggaagaagcagcaagctgggttgatgatcaaggtgatggcagacttttgcttccaagctatttaaacctactgattagtaaaatgctaattttgtggtttcagtttaaccaacaggtttatttaaattctaagaattctctcacataggaaatcaatgttctgttcagttcctctcccaagaaattctaaggagagtttacaacaaagaagtgact

SEQ ID NO: 655 - DNA, 600 bp, Bovine  MMBT05178
aggaagaggagaagctgcgggtcaaacaaaagaaaccatgtctataaagcaaaggactaaagtaggaaaatagcaaacagtgcacatccacagctaggtggctcccaactgacggctcacgggtagcacacttactcactggagacacacacatatgtcccattataaactgggtgctatagaaagggactttatcaggccttgttcctttctcccaaatttccttacaatttagctacaggtaacattcatgggaaggaaaagaggcatttggagaacagtgtaaacaggtcacataartaactgcaatttgactgtatacgacaaagggtaaacattgccaagtgtcttctgaatacactgttgcctttcatttctttggtatgctcccctagtgcttgcgccccccaccacacccccaccccacccattttctttgcattataacaaaacagaagtcaataagctttgacatctagcatatacttttttgagcccacagcatacttttttaaaacaagactgggtaaaaaagggttttcaaggttcttgatgcctctttttaaaatggtgagcttcaaactaggtatttcttagatc

SEQ ID NO: 656 - DNA, 600 bp, Bovine  MMBT05169
atgactaaaggtgaagatttaatcaaatcaggtagtttagggtgtcagtttactcttaacttccccccacagtgtttagggcattaaaataacaacagtgttttgctgctttgagtttttgcagcatattagatcagctttcatcaccatgaactcatctgtgacaaattataagcagtttagtttctgcaagctgatttggctgtgtctttatgacatgttctttgatccataagtttcaaaattaaaaaaaattatttatcctaaattaaatatacatgattcaatttacagactgartttaaaattttttaaatgaaagtttaaatatagcaacaaaattgggggataatactgtaaaaaggaagcttaaaagaagtacctccaaatattttgaaaatataatggagcatctcacttaaaccttatacatcataaatttataatgaatttaaaatcaatattttaaatatcacaggttaatatatttatgaagaatattatgagtaagcatatgaataagcaatgtcagccatctcagtagataccttatataagaatagaaaattaagatacaaaaataattttgatacataatta

SEQ ID NO: 657 - DNA, 600 bp, Bovine  MMBT05075
cattggaaacttatagaaaatgactatttcaaattatatcataaacttccaattttatgacataccttatcctaatcaatcccttgttcttgcaaacttagggttttttttttcccccactatttgagataacagttgagggaacatccttatatataaactctgggtaaatgccccaggcctaatcaacttttattgaattctgtaaaatgtattgaatttagaaagcaagaacatctcatttggatttaaggcttgcctatgttctaaatctgaggtgaccttagattataatgttcratttagttaaagcaagttggagaaagaagaatttatagagtgatttttaaaatctccattcctttggaagcctgttggctccctgaaaaggaattggactgttcctggccagcccagcatttaatcccaacctgtcactagtttctatgaagtgaggtttctattacttcctggattgctctagtctatcagaggtcaccatctccaatttagcctagatgtggatgggaaaataccctgtacagccctagcatccaaagaacattggtgtcaaattcaattactggagaaggagacctt

SEQ ID NO: 658 - DNA, 605 bp, Bovine  MMBT03522
  misc_feature (1)..(5): n is any nucleotide
nnnnngtaggctctgggagttggtgatggacagggaggcctggcgtgcttcgattcatggggttgcaaagagtcggacacgactgagcgactgatctgatctgatctgatctgagtgactaatacacacacacacacacctgtgtgcatgtatatgcgtgtgtaggtgaatatgtacatatacacgcgcaaagttgattcttgtttttcgtggcagttatattctataaagtccctggaaacattgaactagcaaatactggaaccattgcttctaggagaaatacaagattaagttcctgtgarcctccagttcattttcatcaactgatcaatatataaccttattttatgtgtatttttgtttaaagacatacacacttttcatacacacagacacamacacacacacacttgataactcaccttgtgcttagaaacagcagacagcacctcaacactacacttggggggcattttaaacagtgaaatcacgaataaaaagcacacaaaaaagcaaaaatgtggcactaaatgtgttgcagaaagaaatgatcacacattaacttctccgtaccccctgccatttttttaaactttttattt

SEQ ID NO: 659 - DNA, 600 bp, Bovine  MMBT03874
tgtttgctttgtggaatgtgttctcagttgtgacagcctcatggacacacctcacctatcgtgagaggaacgtcaagtctaagagtgaagccagacattatgagaaagaggagacccccctgaactcgagatctgaccctgagatagaggaagtaagctctgtctgggaacagaggaattatccacgagacaaccaacgattccacatgtatgactgaagccccactcagccctccagcagatgtactaggacctgagagaattcagtcgtactacttctgtgagccctttatttttcaragagcattttaggctccctgactcaccacagattaaacccataaacaaaataaattgtatcaaaaggaatgtgcattgggggtgatttctcaactgtctgaaaatccctacacattgcagctaaagttctcctgactatgtaggcaggctgcttacttttacacatacacaaaacgtacaattcactgatttcaaggaaagacacacagaacagcttgccataaaaaaggactttgaaatatggggcgtattgggctgcatgtacctttaaggacactgacacagactgaacctggcgac

SEQ ID NO: 660 - DNA, 600 bp, Bovine  MMBT03870
acactatattatttcactgtttttctttactttcttcagctatattaaaaaataaacattctctacacctgcttgaaattttacagttgacttatacaatatcaagatgtactccatacaaggtacaagataatggaggtcataaaatattcttgaaatcttaccagatcagtcattgaaaccactaatctagagtattttccacagcactgagccctcagatcttcctcttcctttcatatatctctttagtctttctcaaatcaataaaakttatagttacatatctcttgtaatagrtaattgcaattactttgcatttagaatgatgtgatggaaactgtaaggttgtatataaaaaacaaaacacgtacatctcgttttactctgtctatgtctttgttgttactattctttatatccttgtactactgactagctgtctgactgtcaatcagcacccagaattgtgaacatttagtaaaaatttgtgctgtatgatctgtttgtaagctggaaaaccagacattctttagaaaaaggtttctttcactcttttgacatggaagttaggcattcttagaaaaatgtatttttcat

SEQ ID NO: 661 - DNA, 600 bp, Bovine  MMBT05361
atctttttcctttccttccccccctactctcaattatggttttgtatgtggtcttattcttcacacttaaatttactagatgtatataatgatagcaatatatttccaaatgtttcatattgatcttctttgctatgtctcttcaactttggtacaaggtaaaaactgcggtcaggtgaccatacacctctggtcaagaaacctaggtwctaaagcagatactctccatgacaaaccaacagctattagaaaagctacctactttcatgtgcccatttgctagcattttgtgtttgtgcrtgaaggagagccaaggcatttaaggaaggcaagtaacctgcagtggatgctgaaggaccagcaccttgtctgccatatgctcagcctaactgcacctctcatcacttgctgaataaccccatgtttgctcctttcagtctttagtcaatgcattcatttagcctagggaagaatctcttctaaataaatcctgccacctgttcagacatactgatgacaaatattacctcctctgggatacccttaaatagactgggctcttactccttggatttttaaaagtagttttatgaatagttc

SEQ ID NO: 662 - DNA, 598 bp, Bovine  MMBT04778
  misc_feature (1)..(110): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgaagttctgagaaacaaagactaatgagtactgatgaggaggaaatgatcaacaaaatgcaattctgctgatagatcacatgaaatgaagacataatattgacctttggatttagcaacattaagggcattrgtgacattttcttaatkttatggagagatgaatgtgaactaagyagagaatgrgagaagaattgaagacaayataaatagcaattcttgagggattttactstaaaggagaatagtgaaatgaggctgtatctcctagggggacatttatctttctatctgttaaaatatttagcttgtgtgtgtgtgtatgaaaatacagctattaatataataaataaagggcaatcagccagagaagagactttataagagtcaaaaatgggaatgccaaagacttctcttctaatgtgagacattttaatatggttttggaataactaggttacagtctaaacaagcctgtgtaatg

SEQ ID NO: 663 - DNA, 600 bp, Bovine  MMBT04996
cttaactatagtggaaaagtttgtcaaatgatatttttctattaccaaattttatttttgtttgtttaaaaactcttatatttttaagaaaaatataaaatgattgtacaagcaaccccataacaaccatgcatccaccctccatgtaaactgttgataaagacttttctatgaaaaacaaaacctcttccaaaagattgctttaattttccatgatgatttccatgttctaaggtaatattttatcatgtgttacttggttttaacgaccaatgctaagaaatcactgaaagggaagcrgtgggcagtgatgaacatcaatgcagagagcagataattggtttcagagcctgtccctaagctgccactgaccagctgcatggccaaaatgcatttcaaatttctgggtttcaatttccttatctataaaatttggaaataagaataaatcaactccaaggcttcttgtactctgtgacttattggtggaaatatggtaaattttaaaagattaatcagttgttaaaccgagggaagaagctttgaattttcaaaaggaaaattttctaactggaaaaggaatgcctgtcaagttttcat

SEQ ID NO: 664 - DNA, 600 bp, Bovine  MMBT04997
aatatagtttcaggtgtacaacaaaatgattcagttacatacacacatatgcacgtactgaactggccaaaagttcgttcagtttttctggaagctgttatgggaaaatctgcatgaactttctggccaacccaatgcacacagacacaygtgcacacacacacatacacagacataatctttttcagattcttttcattatgggttattacaagatactgagtatagctccctgtgatatatagtaggtccttgttattaaatatccctgagttccagttttcctcatatataaaatcragataaaaaacagcatctactttataaggttgtatgaagattatgaaaattaaataatacacattaacacattaacattttttaattgaaccatacttgatttacaataktgtgtgcatttcaggagaatatacagaatacttagcacagtgactcacatgagtaagatggctattattatcctatgtacggctattttcatttactttgtattaggatactacctttttctgaaattttttagaaataacctcaaaaggtattcagaaatccactaaaatcctgataatcataaaaggc

SEQ ID NO: 665 - DNA, 600 bp, Bovine  MMBT04628
ttaaatcagaataaaagccaataaaggataactccataaaaaaaagtgtacaaacactaacctaatcaggaagcaaggcataaaggggaaaacatgcagaatcagaaaggccaagaaagaaataatcatcaaaacaggcaaattttaaaagtaagaaactactttgcataaacttatgtaaatgatttgaaaactttaggtaaaacraattaacttctagkaaaatacaaattaggaaaactgatcccagaaaagatatgaagacaaaacacccaatatcagagcagacaatctaaagcrttccttccaccactgagtcttgagagggtagatgattcaaatgctacataaactactccgaaacccagaaaaacaaggaaactatcccatacttttcttcttaaatgaacatgacaataattcagaaattcgacaattaaaccaaaactgcmaccattcccaagaatatgggagcaaaaacgctaaaaaaaacactggcaaaaagactttagcatctgaccaagaagaagcaatagaaaatcatatttattatgtggttttgaatatataaaagagcaaaatagagaacaactgaataaa

SEQ ID NO: 666 - DNA, 600 bp, Bovine  MMBT04230
gatttaaaaaacttagaatactttctctactccaaattcccaaagaggaatttttaaaataacagtgaagagaaagaacaaatttcccttcatttcttcccttggtcagcattcatagtttataaaggcagcattttcacatctttgattattccaagtattcttttcayacaaactactacctaaatgtgataatcagttgtcaacccactttcaaaaggccttgccatatggtatgattttattggtcaattccagagtatatattaacttggaaaaaatgggctgctgctaatgggrtatggaatggaaatgctgtcttttgtcactaaggggactttatgtgtgaagttaatgtacacataaatcaacgctgtaaacamaaacaagagaatatcaaaaatttgttgctatcagttgtcacctatatacagatgacattgaagtttattatattttgagaatttgtttccatattcacctttatatcatcaacaaatatttccatttaggcttaaagaacaaactgtttaataaatcaaaatgaatttgatagatttgtacctgaatactgactctgaaattaaaggacgcttactt

SEQ ID NO: 667 - DNA, 600 bp, Bovine  MMBT04251
ttttgtggttcactgggcaaacataacttgggcactgactgtatctctgcatgtgtttgcaggctcgcttcttgccttttgacttttaaagcactagttgggggaacaggtttctttctgctaactgaatcttgacagatgaactcctccttgtttggaagtattttaatccttgccaaattaatttacctagttgattgactggagttaaaattcaactgcaaaatgagagcagattgttctcttccttgcgacagattcatgtccgttggagtacatcatcttcaacaaatatgaccracrcaggaggtgactctgaggattaacaaggtttggccatgtttatataactttttaagctcttattggaaaagtgctttggggaccataaaatgttgatcttaatctgtgtacgcttagaatcagaattgscttccataagttcaactttttctccaaaggcagtggggattagtaaatcgtgtttccagaaagttcaacctatatttgagaccagtttaaatgatagctgatgtgaattcagttgytccttagaacagagatcctccaactttaggatgtctcgaatcgcctggaggg

SEQ ID NO: 668 - DNA, 600 bp, Bovine  MMBT05081
taatgtatactaatacagggagacctggtgtgctgcagtccatggggtctcaaagagtcggacacgacttggcgactgaacaacaacatggtaatacattagtatctaaatgcagtgcttctcaggggctgttttgcagactaggaaatatttagaaatatctggagacattttcggttgttacaattggggggtgctactgtcatccagggagtagctgccactgtgtacagaacatcttccaacaacaaagaattatttgacccaaaatgtcagtagtgttgagattgagaaaaaccratctataacaatcttagtacaaaggaccaattgatggatgctgatatgctaagaagccaccctctggtaaaaagagactcccaactccacaaagaggaaaataatttaggagaaatagcacctcctgaggaatcaagaaaccttggaatggaagctacaattgcaggtttacagcctaactaacctgcttgtgagaagctgccaaaaaattgttttttgaattgttattttgcacccaaagtgaagatgatatattaaactttttttcactcagcagattatttttacttacttctttta

SEQ ID NO: 669 - DNA, 600 bp, Bovine  MMBT04563
ctgaagggtgtctgagctgcagacacccctttcttccgtcacaggtcatcctggggttcccaactggagatccgggctcaggttatcttggctgggtccaggtcagcagacagctcctgctgacgtcctacggaagcagaggcggaggctgccctcaaccttctcagatctggacagacaggctgcccgcctgagggcttgcttcagccaaaacccagaaagagccttgtcattttgcagtaaacaatgatgcaccttttattgcatttataaatgtccccagaggctattactcaaaargggttcagctaataaatacagaactaataattacctcagttcagagtgctgacgtgtgtaactgccgtcggggtcaagaatgtcccgtttgctcaacctccctggcaccacgacacctgcggttacggagccggggtgcaggctgaggtcaggggtcagggaacaggatgtccttcccgctgggtctgagtgtggtggacaggctgtggctctgtcactgggtccttggggtgtcctttccttgcaggggtgctgggtcctgctgtgggccctggacggatggcagcccccggagctgct

SEQ ID NO: 670 - DNA, 600 bp, Bovine  MMBT05264
tgatgattaggaaataggactggagagcagaaagctgactttaggaaaaagaatatttgttaattggctttaagtgacatctgtgcaattagccctcatgttgaactgatcttaatttcctctgggccacggatttcccatcagaaaaatgggactcatggctcggcccttaagacaaactcattaattaattgactcgtctataacctcaatgtgcaaagtcttgactcagttgtgaagcacttatatctatctgctcattcataaagcacttacaaaaggcatgagggctgtgtgatrtgtgtgcatatgtgagttaaaatgcagcatctacttagccagtggtccccaacgcaggcagtgtattggatactctacaaatcacagtttaaatgatgggggacactgaagaaaaggtatccctttagaagaaataatgaggtctttttgtctaattgctcatttatcacaggattttatctcagtctgccaacctgcaaaaaaggaaaaggcagccacagatttagccttgttcatctacaactttaaccagcatgtgcttctaatgaagccaagactttctgggctggagaatttact

SEQ ID NO: 671 - DNA, 600 bp, Bovine  MMBT04678
ttctagtcacccaactgaagaacctgttcatctgtaaaacactccaatcatagagcataaagattaaaatgaaacaataggagctctaaatagaaattccaacgcagaaggcactagcacctaacctgtcaatttgacagagctcacctgcttagcaaagaaccactacctggccttgttcccttaaaaataaccctcaaagcaaaaaaattaatttttcacatggctaagtttcaatttccagttggccaagcacagcagatgcttggtcatgactctaccccttcattttaaaatccraatagcagaaatacccctatgttctaccactcccaagagatctgcartcactgtaccccacctatttaccacaccaggcactcacccagcttcttgaccagtttcttattcttgttgagttttttcagcgcctcgatgtccatgtgggggatatccacagccttggcctcatcacaatgctgctggtcccccaagacacacacggagaacttggggcggggagtggacttaagcctgcattttgggggggacaggataggtcacatccagccctaagctaccaaggctgaaggtgaaagg

SEQ ID NO: 672 - DNA, 600 bp, Bovine  MMBT04363
ggaagagcttagtgtgcccactaaggttcacactgatgtatgcattttagcaaactgtactgggcactttatgccaggcagtgctcaggagaaaaagatctctgctttcatagaatcacactctagctagcttggactcagggtatctactttttgacttttttctgcccccattatttatttatatagactcttttagtacattgagagtctccccaaataattctatttcatgtttaaaatttctttaaattattccaaatttcactatgccatggatcattgtaaggattaagggcratggagtgagtaaagcaccttacacaaagtttgtgcttagtacatattagctctctttcattttcagaggaaaaagttgagtatcaactcagatcactcagtgattagggctgatgatgggctccacttactgtgcactgttaacctctctaaaacttacttttctcatctctaaaggaaaagtttgaaggaaggcaacccagaaagtcctttgcacaatgactcatcgtcgtatgcatcctaagatactgctcctcccacggggctgatccatcccagtgtgggctagtcccagatggg

SEQ ID NO: 673 - DNA, 543 bp, Bovine  MMBT04916
aagaatccacctgccaatgcaggagacataggtatgattcctgtgttgggaaaatcccctggagaagatatgtttaaaacaagactgatttgaattatgttcttttcacccttaacacactccagtatcccagtgacagaggagcctggcaggctatagtccatggagttgcaaaacttagcaactaaacaacgacaactaggcaaagttgcaaagaaatctcaatatgaacaaataacagggggttttgattgaagcaaaatattcctaattgtaggcagtctttccaaacaatctgcrcatataccactcagccagcttaacaatatataacagtagagtactgaaatggagctgttagtccagtctcctgattgttccagataaagctctccctgaccccatctttgggttgacttcaagtctcttgctcaaggaacactttggaagaacaaaacttacatagtggtaaagattcagcatatgatttgttctttctaaatttctgtcaccttttaatattattgatcaaaatgaataatt

SEQ ID NO: 674 - DNA, 600 bp, Bovine  MMBT04589
tatttaaaattaaatattcagcactttcccagggtttactagaagtaatcatttaactaggatttcatttgctgcttaagtacacacctccctcccccacacctataatttctgtgcacacaaatctacttatattttaacaacctaaatataaactttcctcaaaacactatacccactcagtgcttatttttccatgaatgattaatgacaacaatttacatagaatattctactaaaaatcaccttaaataacaacattgcctgtacaatcccatatctcattgcagtggagagctrtgcttagaataaatgctgctactttaactagttgcaaatcttccaagctgaatctctgaagaaataaaatagttgaaagaaagtatattaataggtatgggtgctgactattttatccctattcccagmagcagcgtcaagtaatcattataaattttccttctagagccagcggactgggttcagatcacaatttagctctatgctcttgggcaatctatttaacttttaagaccctggtttctctgtgttggcacaaggattttaaaaccatagtgcatatatttttaatgcactata

SEQ ID NO: 675 - DNA, 600 bp, Bovine  MMBT04567
tttctgctcgcctgcccaagaggacgtcggcagacacagtggggctcctcaccatcggccggcaacaccatgcctctgttccctgaagagcgcacactgtcttcctttagacacgctgggcattttggaagacgtagagtttcttattcttttaagcacttctaatatttgcagtctcctcagaggaatgactgagytccagtgtttttcctccttctttgcatcttcacctcctaagatagagcttgtccggcagccttgtccaggcagacagtggaaacactgttctcaggggtcccrtcgttataacacttctgttcgtaacactaatcatagtttcaagatctaggactccatttagtcataaagagatcctctaggctgcatagggtagaaatagtagatgtatcaggtgtggtaattattggtcagtcttaacgggcagaatacaactatttttaatgataattaaactagaatagcttcaatgttgctaatggtttacaatatgtagcacacctacatattgtaggtgaatatgaaccagttgttcacgctggtatatcagctacacacagatggggccaaagtggaaacagt

SEQ ID NO: 676 - DNA, 598 bp, Bovine  MMBT04415
  misc_feature (1)..(186): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaattctcctctgagaggggtccccgaatgtgagtgtctacacgaggagggggcatggagagggtgatggatcttgagttgggacttacagccagggaaccttcccagcccarttcagacagagactgaaagaatgaatgatttccactatattttaaagaatgtataaagttaaaaaaaaaaaaaaaagaatgttaaggaggtggaaggaagaagtttctacaattcaaaggtttgaagtagtgaaggaaaagggatttggaattaggtaccaatggaggaaaggagaaagagcggtgctacttgcaccttgttttgcaaaaataagatctggagttccttttgagggttaggaaaagtcaattcttccttcccttccccagtgaatgacccatggaatcctgaacttgc

SEQ ID NO: 677 - DNA, 600 bp, Bovine  MMBT02996
ctggggacagggaggtatgggcagggccacttgtccactcccctctggtgggcagcaacatgccacctacaaagcacctccacctatatgacccactgcatcttcagtgaaccgggagaygtggattattacctccatgttacagaggaagcaggttcagagcagttgtataacttgcctgaagtcacatagctgctaagtggcaagatttctaattctgccaagtccaaagcctccttccactcctagctcttgcaatgctcctctggacactcctgaaagtgcttcttctagagctgyggtctaaattaaggctgggaggaaccttaaaatcacctaacccttgggctttctaaaccctgggcctggggagctgtgcaaccttccagatatgcagaccctagtccagggagtctgactcataaatctgaagggacatctgggaatctggtggttttttttttttttggaggcactgtgcagcctgtgggatcttggctccccaactagggatcgaacctgtgccctgtgtggtggaagcacggagtcttaaccactggaccaccctagagaaggggaaggctacccactccagtattc

SEQ ID NO: 678 - DNA, 600 bp, Bovine  MMBT03177
cctgtgtgtcctggcccgatccctggagggtcggagtgcaggcacggggccagggcaggacggccggggccggcaccaaccacggggctcaggaggggccagagagaaggggggccctccagagaaccagcatccctgaatccaggttgcaacccctgacccccatcggaaagtgtttcggttcacggtggttggggggctccgaccgtctctgcggccgcccctgtatatcattaactctccccagttgggggtgtgtgtaaaggggccaggagagaccccggtgacaccctgccgggyccggctcagaaaacaatatccccacgaagacgacaagattaagcacaagagaaaagtgaaaatgctgctggcgattcacacgccctcaggagtgctgtgttaaagcgtgtgaatagtgagctcccctcgtgccccaggcccctgggccgcgcatacctcccggttgctatgactggcttgctatggcctaatcgccgacgagggggaaattcatataaaatatcgagggccattgtgggcctaaygcggcgtgacagtggctcacaaagccagattcattagccccagcaggtaatcagg

SEQ ID NO: 679 - DNA, 600 bp, Bovine  MMBT08569
tctggaaagtgggggcaaaggactgtctaccctctgagaaggattagaaaaatactaygtatttttaaaaaattcagttattgaactatttcctaagaccctgcttcaawttatgttctgtgctatgtgtagctggtacaaaggtgaggcagacatgtccttgcccttaaagactctctctggttgaggacaagtttgggatggaagagtcctttggtaaatggattctgtctacaggagtcactgcagcttttccaaaggtggcaggtacttggctgggtcttgaagtatcagattccrtcatcaactcacaggggcagagggacagtaaaggcagaggaaagacttgcatgtaattttagcagatgtgaatttccaggtggctagaacaagggaaatgaagtgagaggagagggctggcttcagactctgaaggacattacacagctgttcttcaagaaggtgaacagygctgcacacattgccttagaggaatgccctagagaaatatrcatatacaagcctgcaactctctcaatatacacttatttatcttactgtggcaaaatacacgtaacataaaatttaccattttaacca

SEQ ID NO: 680 - DNA, 600 bp, Bovine  MMBT05720
cccgtgactcccttcagctgatgggatgcgggagggagggcaggacagtgccaaggcacggcagcctgagtcaccatataagaggtccagctgctttgcagacaccccatgcaaaggccgatgtcagcagagaagggaaagcgaacactccccctcagcccctgaccgccaagcccagcttgggcactcttgctaaggtgccagtcagacctggagtgaaggaccctggatgcccagcctcatcctaacccgtgcagcttcaagcagaacccagtgaggccagcagaagagcatctgacraggcccatttaaccagagaaacagccccacgtgtcaggtcagggctggacaggccgcagatggctccagtcattcaagggtcccgtctttggggtgccagctcccagagcacagagaataaggagatgcctgtcagtgtaagccactaaatgctggagtggtttccatgtaaccagaatgcagggtgaggcggaaatgggcggtgaagacaaggactcacccagtgacttcgttccagggctgggttctctattttgttcactgggtgtctctgagcagagcctctgccatcttgttaca

SEQ ID NO: 681 - DNA, 600 bp, Bovine  MMBT06465
agtccatggggttgcaaagagtcagagatgactgagcatgcacgcatgcaggcatgcaggtcactaactgcagcccacactcaaggggagccatcctatggggccgtgagctggaggctggggccactgaagatcacctttgacggtcgccacttgtcaaggcctgcctgtctctcaccctcggaggagagcaggacccctccaggctttcttgctgttcagctgtcttcacctggtcttggagatggaggagttgcatgtgcttgcattctaaccctcagctgagagcagagacacacrgggcttttcctgagaacatcttggagcccagaggtgggttgaaggcagtaggagaccaggaaggtctgaggccagccccaaggaaggcccaggaggctggtcacaagcagagacatactcccaaagccttgagacaagtgctgtcggcctgggcycayggttggggattttaagtcctgcagtaatccctataaaatcctatatctttaattatccaacccacagaaactcttaaaatagatgattaaatgggagataattaatgactttccgtgcaaacctgcacgtttgccagtggaa

SEQ ID NO: 682 - DNA, 600 bp, Bovine  MMBT09569
gtctttttggccatgatgcatggcctgtggaatcttaagttccctcacctgggactgaacttgtgcccccttgcaggggaaagtgcaagcasagtctgaaccactgaaccaacagggaagactctagagcttagttttcatatgggaacaaccaacactagagattgagagctgtggggctagatttgggtttaaaatccagctcacctctcagttgtgtggcctcaagtcactggtaaaatttggatatcctcgatttccatgtaaagaccctgcggaatcagaaatgtgtggaagtcrtctaagatgctgcacggcagataggtggcacatacrtgagtgttacaactgtgtcctcacgttttgcctgaaatccaaccctagtctctcctgaatgcttcatrtaagaattgttttctaaaatgttacgtttgtgattaagctgactggccctgaaaatgcagttccaggcttmgcgtggtttaacttatagtttctctattttatgacagtggaagtgatatgcattcagtaaaaatcatacttttgaattttgatctttacctgggccagcgatatccagtacgatattcactactg

SEQ ID NO: 683 - DNA, 600 bp, Bovine  MMBT08104
gggaatgggggcagaagtggctgacggagctgctcctggggtctgggggcagtggaatggagggaaattttattaagcagtttgagctccacactccatatgatctgatgagatraaaaaggagcatcccacccyatcccaggaagatatcccttcccttgcagccacgttcaactaggtcagtccttttgagccctgacagcttgtgctccctacrccccagggaagggttaacagatttgggggcagggcccccctggggaaagtcccctgggaggtgtcccttctttgcttcttcarttgcatcaggcctccaktcgcctttcttctcagagaacatcatggcaagcgtggctgcakttctgacctgggctctggccctcctctcacgtgagtctccaacactgacttctccatggaggtgtgggtggactgttcttcctggaggtgtgggtggactgaggggttcctgagggaggaaacccagcccctgttcacctcctcttcacagtgctttcacccacggaggcacggagaggcttctgggactacttcagccagagcagcggggacaaaggcaaggtggagcagcagcagaag

SEQ ID NO: 684 - DNA, 600 bp, Bovine  MMBT08116
agcagttccatgctgtttattattatttgaaataggctggaaagcaatcagaattggattttcttgaagggagggtggtgaaagagacaaattaagccttcacccctactccgagggttgggtttgtaggaaaaagrgaatgggctggacttgggggggggtccctyccaggggggatccytccctcttcttggacaccagcaactgagggaagacggtccttcctgctgctgagggaacaatgaggggctggtagccgaggtgggctgggacctagcaagactcacagccttctccacrgggagtcaccagagccgctggccctcctcacrgtgggatctagttcccaaggagggtgccaggcagaccttctgcccctgcaaaaacaaagctgcctaattgccttttaatctggggatgtcggtctgctggtgtcggtactgaattgtaaggggagatagtatctttccctttgagtgagaagttatttgatctctgcgtcagaggaaggcctgtgcccagggaagaggtgggacggaagggaaggtggaaggagagagaagagtgagggcctggctcccggccgacctgaggctttat

SEQ ID NO: 685 - DNA, 600 bp, Bovine  MMBT08823
tcctctctgcatctgggacctctcttgtgttaggtttgaatctctcatttgaattctgctggggctcctggtttcgtccggatccatccctgcttcatctgtgtatctgtcaccccttcccacatccattttaatgatcccatttctgccacattttttttttttttttggcactagggctctttgtaatggggcccggagaatattctatttctcctgattaaatatgttagatttttctttttttcagggccttgttgagttcttttaatttcctcctgtttattacttttcttctcratgacgttactatgcctcgagttcctctcctgtgcgtgtgtgtgcgagtgcgcacgcgcctgtgtgtgcgtgcctttaattacttgcaaatgagcacatagggggatgaaagagcccgcggagagaagcgtggctgacttgccagcccctgacttcagtctaagacctcacttcggtccgtgatgaaacatcgtgaatccactcgggtcgccctttcagagcagctttggaaaacagacattgggtttgggggcggggcggggggtggggagcttgtcaaaactgcctgattaagaagct

SEQ ID NO: 686 - DNA, 600 bp, Bovine  MMBT09610
ttgccacgataagtgaaagctgatagcacagttctgtgtttatttatgactttccttccagctatgagaagttttttattcctcttccctcaatcgctgggagctgctgtgaagcaagtgtcttctcarttttatagtagagcaaatggagatgtgaagacatgtaattggctgtctgagcacctagtgagaagactgttgtgtctgtgggtgtaagatgttagctgtgtgactggcaggagcattgtgctaggaggttacagatatgtgcgttctgcttccagttctagcatggagtcrctgagagagaccgggcaggagacattgcctctctcagggtcagttttgtcatccaccggccctcagtgcacaatgaaattctgaacctgcagagggagcagggaaggaaagaggattgagtagcaagagccggtagagcaaatctgagagtttcagctgtgcggatggggagctccagagtagagacggcccgttagaggagcaccttggacagggactgttgggcggtgttgcccccgtcgcatccagcccttggctgggacccacccagcctgaaccctggggtgcgtgctgaagaag

SEQ ID NO: 687 - DNA, 600 bp, Bovine  MMBT06468
gaggtcttagctgcagcacgtgggatctagttccctgactggggctcagactctgggggtgtggagtcttaaccactggaccaccagggaagtcccacaaagttttcttaaacagactaagtcagagaaatttatatacaaagataaatctatcaaagtagatctataatgaacaccaaaatgcttagatgacaaattctcattactagatattactagatatattttgggaatcagtgatgctatctaagcatctcacatgaacttgagcaaactctgggaggtagtggaggacagacrcctgctgcagtccatggggtcgcaaagagttgggcatgagttactgactgaacagcgagaacagcatcttgggaatcggaggaaaacacagacaaactcaaaaagctcaagttagatggcccactaacagtccgttctaggattctccgccctaacaattcacccctcgctgtttggaaaatgccagcctgcattatgacagaagaagaacattactctatttaattttactctagggaaatggatccttgttatctgagaactactgtgacttgtgcccccaacctcccaggacaccaa

SEQ ID NO: 688 - DNA, 600 bp, Bovine  MMBT06409
ctcaggggtgacacgtggctcacggctatgacactggactcacatgctatataacawttccgccaccacctactggacagagctgatctggaatataccatttgatataggccagcagctttcagggatcactcacaaagcttattactattattgaagaaaagtcctatgttttgagagccatcctasgtgacaacagattcagtatgaggatatgaactrggggcgtgttcatatgtgaaacttgactcgctgccttgacagaattaattgcttggctcacacaaccgggcaattccrtgcagaaaaaaaatcagcaagactggctgttcgccttcaytggctagtgagttatatcatagaggcggcctaggccagtctggcaataaaaggttccttctatcagcctggggtggggaactgaaggctgaccagggccgtggttaactctaagccccggcaaagcatccctgacaagcagaatcatcatgagcttagtgaatgccatccatctactaattaagaagccttctgcagcaacagcgagtcgagcatagcagacattccagccaaccttggagcaagcgccctgggagacag

SEQ ID NO: 689 - DNA, 600 bp, Bovine  MMBT10077
gaatggaaccagggtctcctgcattgcaggcgattctttaccaactgagctaccagggaagcccaattctatgtctacacatcagcaataggaaaggtagagatcatgggtgcaaggaaactcctctgtaagatctgtcttagctcttcaatggttaacattgtattgagattccttcacgcatgcctgaaattcatgtccttgtggggcttatttagcttgacggcagttttaggtcaatttcagaaatccccctgagctcctgagaaggctgtggaggtgaactcagctaccggggtrcagcctggttacactgcctttccctccctcgggcccgcctgactcgaggacacaaccacatagcagcttgctccgaatctaaaggtcatgcttcagaaaaaagtatcattgcttcagtattgctttggtgtcttctctgagatctgctcgagagagcatcaaacatcccccaagttagtgaaaggggggggagaagggacagagggatttggcaagtgcatcttatttcctcgttccagcggaagagaaaactgctgctgcttccacctcccactgctaacgggtcccaggggaccaatg

SEQ ID NO: 690 - DNA, 600 bp, Bovine  MMBT10041
tattaaatagtcacaactcctctatggggaaggcaccaaagccaccccttttgacatttgaggaaaccagatctcagagaattaagtaatttgcccaaggccacccagacaataaccaaggtctgtctgactctgtgcacttaaatcatctgcagtaagtctatgattatcaaaagacttcctacatgaggcaggacttacagggataaggagacttgaagaatgaggcaggaggggatggtgatgaccctgggaccaccttaaatttccgatcgacaccgcagtcagagccctaggacrgagcctgtatgtgaggtggctggtgaggggcgctggaatccagtcctccttctgtcatccagagaagagtctccagagaattggcacatgccccatcctgcaggggagcccctgtttcctcaatgcagggaacatgtgaaggtggctccctccctacgtggagaaacctgagggctgtgtcttagggccccaccgctttctcccgggtgatcttggataaggcccttaatttgtgggtgtgtctccttttctttagcaaagcaggaaataaaaatacgtatgtcaaagagttattgcaaa

SEQ ID NO: 691 - DNA, 601 bp, Bovine  MMBT06400
  misc_feature (1)..(1): n is any nucleotide
ngtgatcctctgagctgtaacctcatcaggctgaaataacttgacactcccatttgtctgacacagaagtcatttgtctcccaaamctcagggtcagggtggttgtgaattcctccccctggcctcctcttggagggttgtgaccacttcatcaaatgctcttgccttgcctctgagaggttccacgaccagcagggaaggagagatatcccgggtagagagtgagaaagctataggccaggtggggctggaaatcaatccaggactgttcttgctgagagctccttgccaccttcagggratccagactcacccaatctggctcaaaaggcaagacagagttctgcagcggtctgctaacccagaggggtcaggactggccagcaaggatcctggctcttgggtaaytggcttcatcatagcagcactgccattgtcatcaggtatgaccacactaccgcaacgctgtccacagagcagcaagtgaggcataaggaaaactggggccaagtccaaccctgcccctcagtagccctttgggcctcagtggcttgactccwtkatggggataatcatagctatttcagggggcaggtcagcc

SEQ ID NO: 692 - DNA, 600 bp, Bovine  MMBT09510
gtttcaacatatttgtcacagttggaatcccacacttatttgattagcatccttactaggctataaacaccatgaagaataaaatgatgtcttcttttgctcaccactggatcccaccatagggtccacaaagcctggaatatgtatacagatgtatgtatatctggaataagcacagaatatccatcaaatttaaaaaaaggaattaatgaaagaataatgaatgaaggggtagatcaatgaaccctccaaagcacagacgcccgcagtcactgtttgtgaagaactgcacaagttccrtcaaagtgtcccctcttgcaaatgtgagagttattcccaaagatcccttaaaaataaacccatatacaatgaaacctacttaagcagaactcatcagtggccttctctctctggcacaaatccatttcatggaaagaattttcagtgctttaatgatgcctttctgccttacagcatatgacaattcagagcaattagctctacaactataatatgaaaaggttggaatgcatttaaattggaattgatttttgtttaatctgtgttttcatgggtggaaatcgggtatttctgagccag

SEQ ID NO: 693 - DNA, 600 bp, Bovine  MMBT11051
ttgagtcccaatctgagttgtgcagttctgccaggacccagggtaggtgctagtaaaataaacacgatcatctctcaaggggctcatattctgttagaggaaacccacaggtaagccaatgagtgctaatacaatgtgatatatggtatataagagataaatacagaatgttgtaatgtacgcatataataaaagcataaagggacaggagccaatcctacaggagctggaaattggaaagttgggagaaagggaaactgaagctgggtcttgaaatacttgaagcagtagtttaccaarcaaagggaagagttctcccatttatgctttctcatttcaaaaacaagaatacattaaaactggaaaactttttttgtaagcaaaagataaaaggaatatgctcataacatctattctacactatgctagcccctcaatccctgtgtaagatgcaatttactccctaagtaaatactaccagtgtctcggatctattttccgttcagttctttatattcttcctcatttcctccattgtattttctctggaccctttcttgacaactactcttcaattatccagagacatctctccatttc

SEQ ID NO: 694 - DNA, 600 bp, Bovine  MMBT10042
tgtcctcctatgtttttggatagtctcacctcaccccttaacagcaagcagtgcgtctgtcaccacccaccagcccccatgagagcagtactcatgttagttcatccagcagcaggagtgagacaggggtcataaccagcagtggaagtaacattcctgacatcatctcactggactaaagaaggactctcgattctaggaatcattcatcagaactgctctttcttggatctctggtccgtggaagctattttttgctaatgattgctttgatatttattgaaatgtcagatggattcrtttgccttctgagagatgaacacagatgactgcaacaagaaccacatgacgtgcacggatttttcttactcttggtgtcctctggagcatcagctacattcagctgtaactgtatcctcctgagagatggatttcaagttcatgttactggatagattctacaaaaaagttaaattttttttgttgtaatacacagcaataaaattatgtaaatattcaagtatacttttttctaattaaaaaagatgtaatcagtgattctaaaatgacaactttttgtttaacctgatgtgaaggaaa

SEQ ID NO: 695 - DNA, 449 bp, Bovine  MMBT08508
caattgtatgatcaagtctccatcctacactcactgaattacaaagtgctaaatgttagattcccccacattaggatttgttagatccatcctatagctaaagcttacaatcctggacatttcagaatcacaattttaaagctagaaggaaactcagatcctcaattccccttactttatataagactaagacctcaagtcacaaagctacgtattaggagagttgaaaccagaccccatatttgatgcccagactacgagaggacagttagctcataggttccaaagtagaccttagcrtatttccaagattaacttttcttaaaaacaaaaaactcagtcaaacattttggaacatgcacgatgatacatttgaaaagggtcatagtaggtaattcattattttgcagaaaaatgagagacctggagacacagctaaagtttagttt

SEQ ID NO: 696 - DNA, 600 bp, Bovine  MMBT07839
atatgcgtttggggactgagtataggctaggaggaaagggagaatctagtcaggtgaacgatgaccttcagaagcacatgtaaaaattgtgatctctcttgtttttataggagtcacagctgaaagcaatgaaagagactgtgcaactctgcctctcaactgttttccgcgatcagcatcctctccatttgaatcccttcaggccgtatcgaactcagttatcagtcccaaccatgataactgacaccaggactgcatatgtaagcacaacggccaaggtactttcttgacttcaattcrtattatcatcaaagtgaatccaagtaagatagcaaattcattgaaaaatcaggatgtaaacgggagatagtaacccagtttgtaaagtcttcatagtcacttggagaatgttggaaaacaaattttctgtataagagaacaaggtgtttcttaggcagaattattatcatcataattattttacaatattataagaaaatatcttgtattatattccagttttcaccaggggtttattatggaaaatactttcttctagggtataaccaccatccttacaaaagtggatacatttttcag

SEQ ID NO: 697 - DNA, 598 bp, Bovine  MMBT10764
  misc_feature (1)..(30): n is any nucleotide
nnnnnnnnnnnnnnnnnnnnnnnnnnnnnntgtaaaactgaatattttgctgtatacctgaaacactgtaaatcaactatatgtcagtaaaatttttttaaaagaccaaaaaataaagaaccatgcaataggacagaaaaaaagtctcagaaacctgtgagactacagcaaaatgtgttatattcgtatcatcaaagacccagaagaaaagttaaagagtgtggggctgaaaaagtatttgaagaaataatatctaaaaacttcactaatatggcaaaagacataaacctacacattcargaagctcagtgaacatataacagtataaacccaaagaaatccacatattattgtcaaattgctgagaaactaaataaaaaagaaaaaatattgaaagtagcaagaaataacacatacaggagaaaaaataatttgaaggatagtcaaaatgtttttgtatagaatctagaaggaaacagcacaacattaaagtactgaaagaaaataactatcaacccaaaattctacatccagcaaaaatatctttcaggagtgaaagggaaatcaaggcatttacagatgaaggaaaactaagaga

SEQ ID NO: 698 - DNA, 600 bp, Bovine  MMBT05623
ctgctttaaacactttaatcacactgctatttagtaccctagagtttaaagctgtgtgtgtgtgtcagtggctcagtcgtgtctgactcttagtgactccacagactgtagcctgccaggatcctctgtccatggaattcttcagtcaagaatactggagtggattgccgttcccttctccggaggatcttcccgacccagggatcgaaccctggtatcctgcagcacaggcagattctttaccatttgaactacaaggaagtcctagagcataaataggatttgatgttagaggcttcrgttttattttttaggaaatttaggattgtctcagttatttggaagcatcttttgtccacaattatactaacacgagagttgacttatatgggaaaggtgattttagtaaagagctagtcctcatcacatacacagattcttctgttagaattcctttccatctctctgatcatcgcctttgtcctttctaatccatactgaagtggaatgttctttcaaacctaccagcttagctgataaggacatgggccagatgtttcacaaggttgactaattttatgatttcagcttgcttctata

SEQ ID NO: 699 - DNA, 600 bp, Bovine  MMBT05621
aagctgtgtgacctagttctgaggtcacaaggtggtaaggcctgaggatgtatcaattactaaaggaatgcggcaagtgttgcaaggtcagtggcactatcctcaggtgtgcatgatcacccagcacaaacctgtataactgcccaagagatataccagtgtgctgagacacaggagtgtaagacaagacttggggattctattagtatgccgctgtggctattatttgctgatttgtgacttgaggaggtcatataatatctggatgttgatttcaacactagtaaaacagaacaacargaattatcttcttgtggagtatactgagatctttccatggaaataatttttacccttgttctgaaatctggctgctctcttctaatatctaaaatagcctttgtaatgggaagaaggagaaataaagaggtgaaagagaattagatagcctaggcaggtgactccaggtaaggcagcattcctgcactgggctggggctgctaacatcctccccttactctaaggagcctgactgagcctttaggagccttgtcactgaaggttctaaaacttaagccttatttgcttgaagttaagtcc

SEQ ID NO: 700 - DNA, 600 bp, Bovine  MMBT07379
aagagaaggtgtccatggttatatattaagaaaatttgtttttcatgactgttcatttttgcttagttacatctggacatttaatggagtcttttagacataaatatgcataaagcataaaccatgtctttgagaaactctcaatcctttggggggtagctttggccaagggactgtcatctgggacgtgctggtagtgccataatagagagtcaagcagggtgctttgggcatgtgtaatttcaactgtggtggtaatgagatcatttaatatgttgctacatttaattcagaagttcrtctgaaatagttggcaaatatacttttcttatgatgtgaccggtacygtgcttttcactccttttgcatttttctgtttcagagacgcccaagcagatggccagcaatgaagttccgaagaggttctggccatcctgcctatgctgaagttgaaccagttggagagaaagaaggttttatcgtatcagagcagtgctaaaatttctaggacagaacagcaccagtgctggcttacaggtgttaagactaaaaatttgcctatacctttaagacaaacacacacccacacacacacacaca

SEQ ID NO: 701 - DNA, 600 bp, Bovine  MMBT07844
tcttcaaaagcttgaacataattaagtggcattttttgtaaaatctgttaccagttctcccttatgaagctgacatttcccccacgtcctcatgggagaattcatcaaagtttcgcttcatataatgaaaagtgcgtcaaaactttagtttggatatgggtaacttctcaagaatcttccgtgtgtgtaacccttctccactagagcgatgcttcttttccattggcctcctgtgttcagtgaatctgagtttacaccatgtttatcaagagaggcctactcagtgccgtttgttttctrttagtcgagtgttgcagtgcctggctgcaccattcctttaagcactaccagtttagacatctaaacatgataataattgccactaggtcacatgaaagtcattgtgatgcttttttccataggcatcttcataacaataaaattaaaagcctgggtcaacactgttttgatggacttgataacctggagaccttgtaagtttatttctgttttggataatcacatttgggatgttgatggtgcagttgggcatttcactgcagaaaaaaagtaatggtcttgagttcagctcattattaa

SEQ ID NO: 702 - DNA, 603 bp, Bovine  MMBT10783
  misc_feature (1)..(3): n is any nucleotide
nnnggattctcataggcaggcaggaaaaccaccgggtagtcatcgtaaggaatccggctgtccatctccagcaaggacctggaatggaagcatgaatcaaagctgatgaaaatggtttaaaagggaaaatagcccagcaagttttagaaaacaaccccaacccactccaagactgtcagtctatacgctgagcccacttctaggtaggtgatagattttgggagagaagaaagaagaaaactatcaacttggctgaatatctggatgctaacaacctgttagatacactatagaaatgatctrctttctcacaacaatcttgtgaaacatatgttaccgtcctcattctagagaggaggaaatcaggatcgaatctaaaactatctgactactttcaaaattcaacggaatgctgattccaactatccatagaaactcggggcaaggcactgccccacattccctaatgtgatcagtaatggtggaggtccgcagattggcctttcctttaccaccagccaccttccagatctctttcccgcatcgtgcctgagtcctgtgcccacagcgctgtaaaagttgtcttactacctctccaacccg

SEQ ID NO: 703 - DNA, 598 bp, Bovine  MMBT10772
  misc_feature (1)..(34): n is any nucleotide
nnnnnnnnnnnnnnnnnnnnnnnnnnnnnnnnnnttgccctcatacagaagtctcacctgggcagacagttcccacagatggcattagaggtagctgtacaattggcctgctggatacgattgatgacagcacaggtgatgcaagtctgacatctatggtgtccccagctgcttttgtatctgcggggagggcaggctgtgcagtatgcatctccaccctctccataaccacaatcctgtagagaaatgtaagttactaacattacagaaattttgagataggattagctatgggactartggacactgcatagagcaacattttacaaactgcaggttgcaacccactactgaatcatgacatcaatttaaaaggtttaaaccagttattattgaaagctgaaataagataaaataacataatgacactaaatatcagagtgaagagcatgtactaaagctaggtatttatatcaattatcataagctaggtcagttcagtacagttcacttgctcagtcatgtcctactctttgcgaccccatggactgcagcacgccaggtctccctgtccatcatcaactccctgagtttactc

SEQ ID NO: 704 - DNA, 600 bp, Bovine  MMBT07857
ttcttagagtttcaactccagcaatttactcaaatacaattttttaattccaggtgagctggaaattactcaaagcaagataggatcttaagaaaaagtgttctttattttcttaatgaaaattgaagagcaattatgtagtattgtttatcctagaaaatttaaccaatgtgatgaggtaggggccaaaaatgtaagaaggaagagatcaactttaataatgttactctcccaattcccctggaaaaaaaaaacataaggaggaatttcttgtgttacttatgtcttagaggtaaatarctaatgcttctagatagtaatgggtaagtgtctacaagtgccttgaaatccttagaagaaaactcctaataaaatgaaaaataattcttatacctaacatgaatgttaaaaaataaccaagaaaaatagatttaatttctaatacacactcatatataaatatatgacacttagcaaaaaaatttaagagttataaataagtatcaaactatcacagtgatcactcaataggattcattaaggatgataaagctaggaaagtttgcttttatacaataaaagcaaggataatggaaacaa

SEQ ID NO: 705 - DNA, 600 bp, Bovine  MMBT10071
ggttcctgggttgcccatatccatgtcacctccaaggagactctgctaaaaggttaaaaaggaaaaacaaacatataaggttaagttttgacattcgccacccccctcaccaactgcttgttagtacttaaaccaatgcaataaaacaaacagcatctgctaaagctgaaacaattaaaacccaacccggcagaaaggaaaagaaaagccgtctatgaagctgctccgaatctgtgaatttttagttctttaattttggagaagaaggtagaaggtgatgctcgttaaacatgattttcrtcttttaagacgactgatatgttcaccttgtaagtaaagggcatttatgtcaggtgagaattttcttgatctagagttaggttcatatctgggaacaagtcatgcccttccctgaacaagaaccagggagaatctgatttttcagacgcatacaacttccccccactgctcacactgggggaagagtatagacgttcatatccactgggaaccctgcctctctgcgagaccctccacgaattcacaccgcacccccagaagacagaatgccatctgaaccaggaggaaattcaaaatgct

SEQ ID NO: 706 - DNA, 600 bp, Bovine  MMBT10834
gaccagctgtcttctttccagaggaccctctcattttacttctttgcatattgcttctagttggttttttgaaattgtcttcttcggcagattggtgtccacgggtttgagaaccctgctttctggaactcattcaaccctgtttttattccaaccactgtaatatataaaacattttatttgattgttttctatggagaccttgaacacagtgtgcttcctaaaggcctattaaagcacaacacacactactctcttggaatctggatttcaaatcctgtttcagggccaaccaattarttgttagtgacctctttgcttgctctttgatcctcactacccctcacccactactctcagcctacccaatcactcatcagacctgcccataaattagttttttgatttcactcaaaagacaggaatataatttcagagaaagaatgaattaaactacaaaaggcagtggaggtgaaattcaggatttctgaacaggaaaaatgacaagacaaaagaaacaagaaagattaatttagctgcctggaagcaaaatgcataccagcaaaggtttttgtgtaagtccaggtaggcctgaactag

SEQ ID NO: 707 - DNA, 600 bp, Bovine  MMBT09508
ccggggactgtttgcatcttcctgcattttacttagtgaccgtcgtctttatagagtacagagctgtttatcacagctggatatgaccagtggaatgtcactttggacattaagatgtcataagctattatgaatctctggaattctgcatgtagtattaaaaaaacattatcttgaactatggcatcaggaaaaaatataccctggaagatgtgaaatttaataactcactgaatccaataggccctaaaaggggtctacttcggtttttaaagataactctgataagatgtttgatcrtctgaaagaaaaggatatattagaggtggaatttgagaaatgaatgtaagtcagttttttaggtgtttgtgattctttcttcctaaaaatgactacgatttacatgatgggccagaaaatgcaaatgatgtcaaatcaccatggggacgaggacaacggcccttaatgagatgttggaagacttcggcacttctgaaccagacataaagggaatgaacatccccaggcccttcctcttctcaaagatgctaaaagggacctcaagtcttgtgagacacagctattcccactccccgcacc

SEQ ID NO: 708 - DNA, 600 bp, Bovine  MMBT06347
aggctggaaggsgggccattctggaggatgctgggctttcagattctcctaactcaccccacatagaaactgatcacaccattttaaactgaggaagactcctgctcaccyccctagtagcagtgcytctaattagttcatccagtcaggaataagtttctaccttctccttccataccttcccctccacctaacactgtgatttgggacagtttcattctgacacaaaatttcacactatgaaaaagtcacaagtaaagtagacttccacagaagagaaagcttgattattctgaatgrgtctccagactcctcctctggttcctgaactagggggcaattacccaggtaaacacatgctctattggaaatcctaccggtcatttctctcagcagtttctcggaagcacccaggtgctgactagaggaggcatcttttctttatagcaccgaggaagcatttttaaggtcataacattggaacagctgcttcaatacagaaatgtggaaactgagtccccaagaatttaggcctcttggtcactgtcacacttatttgtgacagaatctgaggccagagctctgtttgaaatactgctg

SEQ ID NO: 709 - DNA, 600 bp, Bovine  MMBT06705
tttccaactctaggcgagcactggggaagtcagtgtgaaataaacccttaacttatgcctccatgttcaaaattatgggggccacaggatatgaaaacacccacaaaaaatctgtctgtactcacaaagtttctttattgtttttcaagagcagaaggtaagtttttaaaaacgcartgagtctagaaacatgcctttgctacaaatgtgtcacccctcaatgtccagagactccaaaacttattactgggaggctcatcagtagactgagaaggaagcagatgctgtcacgtggtcctrttgaatctacccaatggtaactcattcatgtcctttttaatgttttaaaacttggtcttaaacgatgaatcgaatctgccttaacattgtgggacacagtctgttactaagtcctatgcaaagtgtcttttaggcattaacatttattttccccaaagctctctgagcagagattattatgatcccctgtgatggttaattttatgtgtcagctagctcagccatggtacccagtttttggccaagcaccagttgagatgtcactgtgaaggtatgttttagttgagattaacacttaaa

SEQ ID NO: 710 - DNA, 600 bp, Bovine  MMBT06709
atgtcagacgtcaatctacttttaaaaacatgtttagttgaaataaatgagttttgttcacagcttttctctgttctttttttccctaaaggctgttacctctttttcctttactttatacttttgaatccaaatttctgatcatctctattgtccgctttctcccacccacttaaataacgcagtctcctctcttcttggagctcccttatacttagaagtaaagtttgaagggaaactaaaccaagatggcctccatctgtagccacttcagttgtaagaatcagcaatgccctgacrtttaaaatccactcaggatgacaaaagtagggatgtggcagtcaggcttctggttctgttatcaccaacaaaggatgacccctctactgcctaattttctcattattcatgctgaaggaaagggggctttaaaaaatagactaatttgggatcagcttcccttgtggcttagtggtaaagaatctgcttayaatgcaagaagacttgggttcgattcctgggtcaagaagactccccgggagaagaaaatggcaacccactccaatattcttatctgggaaattccatggacagaagagt

SEQ ID NO: 711 - DNA, 564 bp, Bovine  MMBT05744
acaacagtagacttttctcttccttgagtttggacaatgattgttctccttccagaaacagagagagaaaagggaacttggaaattcagccaggtgttagccaacctccttggggggttctcttctgccaggtcctgaaatcccaggcctggaacaggccccactgactttttccaaagtttggcctttattagagaggttgaggccagggatttttccatgcacaattctttagctccaaaattctggatctgaccttctagtccaagagaacttgcacatcccaaccttgaagacatrgtgtgactataaagtattgagttgtttttctttccattgccttttcttatttccagaaagagagtttgaaaaagacgagtatttgagatgttatttggcttagaagcaattttgtagagaagaatgtcaccctaggggttttccatcataggtaaatttttctcctttgctaagtgaataattaatgttgctttaatatggaactggcccttcatttagataatttatatgcatgaatgcccaccccttctttctcttaaagca

SEQ ID NO: 712 - DNA, 600 bp, Bovine  MMBT08137
aactaaaagttgaaaagggtaagtaatctaaggtcagtggctagttaggaggctccatagagtggaacccaggaatgcccatcctttcaactcctcggtaatgcctcaggagggcctgatggtcttgcatttctcactagggtttacttggcagattctcgaacctgtgtttatatagtgaaatatcagacctcattttggttgctaattttagtttgagtacataagtacctttaaaaaattgtttatgtgtgaggagaaagccacataacctgggatcttgtttcttaaactttattrtgcatrtaagtcacttgggcgttttgttaaaatgcagagtttgactcattatctgggttgggggggcctgagattcctttctagcaggttccccgggcataccgacatgttgctagtccctggaccacacttcagttttactgccctcaagagcatctgctgttaatccaataatctgcttttcccaagtcgaggtctttgatgggatctttccctggccactcagatctctggctctttccttctcaggtggccctggggtcaagctctgcatcagtgatgtactgccygtcctggcaa

SEQ ID NO: 713 - DNA, 600 bp, Bovine  MMBT09509
tgccaagggccacttgcaaattctctcctygtgtctggaacttggttataaggaagtttgctccagggacttgtggtttcttggaagatcccatttgaaagtatgtctttcaatgtgagcgctgcagcatcttaattcagagaaggtaaaatatttagctaggaaacatggaaagtaaatgctatgggtctgaaaatactatgagtctcaccccgagagctcttaaaataccaaggctttttctcttctggcagcaaatttcaaaaccatgacgataacaacagccactgtggttgtacrtgtgaggcacttcctgtgttccaggcactgtatcatagccctttccaagccataactcatctaatcatcacaataatcccccaaggcagttactagttgcatccccattttacagatggagaaactggctcaaagaggtccagtcccttgcccaaactaggaagtgattaagcaaggattcaaacccaagtcaggctacttctacagcccatggctttaaccagtcttaagtaaaaacataagacagtggtcacttacattctattccttccctttagaagtcttttttgctcttgctag

SEQ ID NO: 714 - DNA, 598 bp, Bovine  MMBT06428
  misc_feature (1)..(173): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaaaactgaagtatgatttgtatcatattcaggaaccactagctatttggaaatagagtttgaaagtatcttacagtttgggtaaatgttatctattgaagttaattgactgcttggtagatgartgaaaaaattcacatctgctttcctgcccaccctactgaaaaagcaccagatatttcaccctggccaaaaattctataacatacacgatgtcctactaaagctgagcattgagagagygccaagcagtcattcttcccactcgttggaacgtggttatgaggcaccagaacgtggaacccacatcctctttctctcatccccttccattcccaccactgggcaagctgaaaacaattttcaaaacctctgctctgttcccagaagattagtatttctgtacttgtgattagttttaaa

SEQ ID NO: 715 - DNA, 600 bp, Bovine  MMBT09274
taattgcagctttacttgtgataataaagaattatgaataagcaaaatgtcccatagtaggggcgtggttgaaaatttatggcaaatcattaactgtactattcattagataagtcattaaatactactagtactgatactattactactattaaatttatgggacaattactactactattattacttctaaaattaaatttattgagcagttactactactgctactactactcttagtactatttctgctaccgctaactttactgagcaggtattaagttccagatcctgttctargtgctatacagatgctctctcatccaatcctcatgacaatcctatgaggtaggtacttagtatccatatttttcaratcaggaagtggaggaaaacagggtgctcaaggttctagagtgattttgggttagagtagaagattcaagtcaaacaaaatgactggagcttaagctatagacattaaaaattatgagccacagattctttaactcaagccttggtatataattaaagttgaaatcagaggccatgtgtttcagctgcaattaatgagaaaccttggaagaaattcgaggtagc

SEQ ID NO: 716 - DNA, 600 bp, Bovine  MMBT10770
gaaaaagtgaaatcttaaatgtttaagtgaccgtagttgggcttaaatacctagctaatatactttgacatcttatttcctttgacttatctctctttctatcccccaacgtggacctcttgttttrgaaagaccgatctaagcacatccttttgtgataattttcccagactttcatcttggtctgatgctgtatctgagctctgatgttgcagtgcacctgtgcccaagatttattttcatttccttaatctaacttaatttttcagtttgacacctgccttctatctttcttctggracacacttagagcttggagaaaggagtattgatactatttttagaatgggaaccaaattcccttctttttgacctttatstgttcatttatctgcragaagcttattaacttccattgtgtgctaggaactgtgccaagcacagtcctccaggggtttgtattctaataccctgaacaacattacaatcatttcttttgcttaaaaatttctaattattgacatatcatctagcgatcatcaactttctgtctgtctatccatctgtctattaagacactacatgtagtaaaagggaggt

SEQ ID NO: 717 - DNA, 600 bp, Bovine  MMBT10866
ccttaaatcagttatttacaaccataagacatctgggagcagggggagggagaaggcaagggagggaagagggaccacaaggaagaatatattcttttcagaggttaaaatgagttatttaagaaatgtgatgtacaataataccatgcatttactctccaaagctagtcactagcaagctaacgcctctaacactacaaccaccaattacagctgttttgctacagtaactgagttctaactacagctatagggtagaaagggtgggctgttccattttgaactttatccctttgaaartggccataaaagcattttctgtacaagtttaatggcacaaaaaggtgactgaaaacattgtaaagaacttaccacacatgagaaatgcaaaattcaatcaaaacatgcattagttgtgtacaagtcataagggatcattggcttcaagctgcaatatattgcaaggaccatacattggagacattttggtgtaacctcttacttgctcaaatccctttaagagaacttaaaaagaaatggcattggaaagggcattccgtaaggtcttgctaagcagtgacattcccaagggctatgcac

SEQ ID NO: 718 - DNA, 583 bp, Bovine  MMBT10869
tgcaaactttaggaagggaaagtggaagacaaaaacaaggaaaagaaattccagttcctcctcgtcaccctcccactccacttttggcttgtatccaggcaaccagctgaaaccagctgccggatatactcctagagcctcatccgaggtcccaatcagctgcaggaggcgggcagaggaaggatgtgtgacaatctggaagatcaccctccaactcttgtcccttcactcactgtccaccccaactgacatctgttttctgaaaagaaatacaggagggaaagaaggagaaaatttgcrtgttggcattcagcttttkcttttgtagactctggatgctgagtgggcttgattggacaagcagatgatgtttggatgatggacttctgagtctccatcacttgctgggcctattgtacaaccagatgcccactcacttgctacagaagattgtaccaagctcaatgccttcgttgtaggctgcagacctgtaaaggtgtttccattatttttctagagaatttgttgttgttgttcagtcgctcagtcatgtctgactctttggaccccaggactgccgcag

SEQ ID NO: 719 - DNA, 600 bp, Bovine  MMBT06345
acaaatagattcaagggwttagatctgatagagagagtacctgaataactatggacagaggttcctgacattgtacaggaggcagggatcaaaatcatcctyaagaaaaagaaatgyaaaaaggtaaaatggttgtctgaggaggccttacaaatagctgagaaaagggagaagctaaaggcaaaggagaaaaggaaagatatacccatttgaatgcacagtttcaaagamttgcaaggagagataagaaagccttccttagtgatcaatgcaaagaaatagtggaaaataatagaatgrgagaaactgtatacatgcagcaaaarcaagacctggaaatgaccgtggcccagaacaccagctccttattgcaaaattcttgcttaaattgaagaaagcagggaaaaccactaggctattcagatatcccttatacttatacattggaggtgatgaatagattcatggtgttagatctggtacacagaatgtctgaagaaccatggacagaggtttgtaacactgtaaccaaaaccatcccaaagaaaaagaaatgcaatatgtcaaggtagttttctgaggaggctttacaagtagctg

SEQ ID NO: 720 - DNA, 600 bp, Bovine  MMBT11088
atttttccatctcttttctagactggctatgatttttctttgacatgttaattctgtcaaaattataacttaaaaaaaaaaaatcttcccttacattttaacatcagttaaaattacataaaaacattcaaactaccagggaatttttccaaaatcaagacatcagagccaccaatactaatgaccatgctctttcttgagaacactgaaagatttttataatctaataaaatagggaaaagcagaaaaatctgccattgccaattacttaccacgttcatggttatataaagggctcartcagacctacaatcaaaccttttataagtgccaaaattcactggtgggtgaggatgagagcaaatgctttaattcaggctttttacaactattagttacgaactatgattgaaataagttccattgttacagtaactcaaaatcatgcaaaaataataattttagtccttttatgagaggaaggcagaatatattagcatttaatctgcctgaaaataacagtgactcaccagaactatctggatagcagtcagtcattcagtcaataacatttatgaaggcctgctgcatgaagatgac

SEQ ID NO: 721 - DNA, 600 bp, Bovine  MMBT05921
gcaatttgaggtgattcattatttatcttttttatgattttaatgaatacaagtgtctcttattcattaaaaatagaacaacaaaaatattcatctagtcattagcctcttgattaatcttccccattaagctaaagatccaagcagagcacctgaaagcaccttaattcttcttcagagatcatcatcacactaaaattatttgcttctggaaatcattaatttctttttatggatatgagatttttttttttctggattgcagtatattaacattcgttttcattcaccccattctarraattcttggtaataaagcagaactaaatggcacacattaaacattattcatttaatcttgggggaagttagttacaaggaaagtttgaagagtgagttgagaatagttcttcaatctcattgttggatatttcattttatttgccagtaaatacatagctatatatgttactaatacatatcaagaggttaaaaaatgatcacataattaattactcatcattattatatgctagaaactcttgagtttggcacatgagccccttgctcaccttctgaggcgtctcctggcttcaggag

SEQ ID NO: 722 - DNA, 600 bp, Bovine  MMBT06419
acctgaacaggttccactgaggaaatgattcttccttaacaagatgggagttatgagaggtgttataaaggagaatctatacaactcggtgcccaaatgaggtaagtgaggaaaagcgggtctaggctgactcaaggctggctagactgactgaagagattaggtgaggagcctgactgggtgaaatgaggagttctgaacacagttcatctgtagagttgctgagacttgacctgctctcctcagcagggagatggcgtgtggtgggggaggcagactgacaacaaaagaagcaggtgrtcagaaaacaaaccacgtaattaaaaaaaaaaaaaaaaagctgaaacaattctcatagactttagatcaataaggactttaaatgctaactgctctacacacaagtaacacgttttaaaaagttaactactctcatcatatatgtgagtaaactagaaacgttttgtttttgctttaatgaacactatttattcaagtggtaaagaatctgcatgccaatgcagaagatgccagagatgcggttcgatccccgggtcgggaagatcccctggagcaggaaatggccacccattccagtac

SEQ ID NO: 723 - DNA, 600 bp, Bovine  MMBT06307
ataaagcctataaattacctcatcacatattaaacttaatcacttctaagatcagacacttaaataaaattcagagtgattcctcctcaagggtgcagacaggacagttgagaatacttaatgatttccaggttcagctctcttctcctttttgaaagaacgtgaaacagactttmcagggtcattaaaaggagtagagcttcaccacatggcccagcaatcccactcctgggcatatacccagaaaaaaactgtaattcaaaaacatacatggggacttccttygtggtccaatgggtragaatccaggttcgatccctggtccaggaaaattccacctgcctcggggcaactaagcctgtgcagcacgactactgcgcccatgctctagagaccatgagctgmagctgttgagcccacatgccgcagttgctgaagcccagcaagtctagagcctgtgctctacaggaggagccaccacaatgagaagcccgcacattgcaacgagagagccgaccctgctccccacagccagagaaagcccaggcttgcaaagacccagtgcatccaaaaataaaccagtaacatttttaaaagcct

SEQ ID NO: 724 - DNA, 598 bp, Bovine  MMBT06753
  misc_feature (1)..(63): n is any nucleotide
nnnnnnnnnnnnnnnnnnnnnnnnnnnnnnnnnnnnnnnnnnnnnnnnnnnnnnnnnnnnnnnatttgaaagacaagaaaagatacggctgtcttcatttgcatttctttgggcattagtgaagctagacgtttttttaaagcgtctcatgatttatgttgtctgtgaattcttcccatcctttcctaccaccctgtgtaaatctcagttctcaattaccaatttgtatagaaacaaatacatgtacaataagacattaaatctgcaagaggatagaaaatactatttttcaatttgctrtttaacttttaattgtgcttaagatgttatacatatagatgttacactttaagtatgtacgatcgagctatcgatacttttccgtaagaggaaaaaaaaagccccttcatcattaaacatcaaataaatttggtcacttgctcaataagaagtaaatttcctgttttgtcaggcttcccacatgggggcattggcaaccttccttccctaaacaaaacaacraaaagttaacacattcctaagcactgggagttccaagtttaaacaatggataactattttacacaaactataaggt

SEQ ID NO: 725 - DNA, 598 bp, Bovine  MMBT06750
  misc_feature (1)..(2): n is any nucleotide
nncacatgcttttgtgacaagtataccatttcttcctaacttaatgcaatctgtacttgtggtgtccatgcagtcgtaacttagagatgtaatgggtctgaacctcagtctgtttttatacaaacacaaagaaaggaattgacatttgcaacagatttcaatttttttgaaaactcatcatttggcataatgattgacattaaaagaatgccatttaactcttggctgaatgaatgatctattattattatagatggctctataaaacattggaaatacacagaatatatgaacacagtrcaatatcagtataggtgagtgtgagtggttcagattctgatttattatcaacaattgttctgttgtttcccagcaacaactatagmctgaactcttgggaaagcrcttgttatacccagtttgacttccaggaaacttactcagtgaaatgatttgagtaactagggcaaaggatataattattggtatatagtaatttgattgacctctggcaccagagtatttgtattaaatattttcarctggagcctgggtttaaatttcttccagtttgtctgcactcttgcccattttgagt

SEQ ID NO: 726 - DNA, 600 bp, Bovine  MMBT08578
tagtgaatttttacacagatgcagggaggtacagtgatgagctaaccgaattttgcatttttgtgttttattcacacgatagtgatgagctaatctaactttgcatttttgcatcttactaacacgggagggcatgcttgtgtctctcagcagtcagtaacctaaactgtgaggtagcagaccaaacaggagaatttcttgaactttgaaaactttttattaggagtgtttccttcctccaatcccttccccaatgcaaacgaccagaggattaattcaagagacagaggcacagatgcrtagtttttgtactatataatagcacaaataatgtattttatattactttctcttaaaacatacaaatatgatacaatacaatttattttaataaaatgccaaccaatatagtacaacaaaatgaatttaatacattaggaggcaatacatcacgacactaaaatcccacacagaaacagcagtaccccaaggccccatgagtacagcgtctctattttaatggagtcagtcctgctgatgtgtatacattctagttggacaggtgctggattggtaagtcaagcttgcaagatagaagga

SEQ ID NO: 727 - DNA, 600 bp, Bovine  MMBT07447
tcttttcttgagaaccgccttcctccttctggtctgagtagcctgggctcagaggctcccagccgtgcccctcacgccctgtcccttttctttggctcatcgtgtcatgstccttaacatatttaaatttcatcctgcttgcccgctcctgtattcttggctggaaaactccatggacagagaaacctggtaggctacagtccgtggggtcgcaaagagtcagtcacarctgagcacccacgcaaggaggaacatcagaktcgtrattttataagacgtaagagcagaggttaccaagcrttcagatttcacacacatcctcagcacattttaatttgcacactgataacattttccttctgccaagtgaggacaatgaccatctattgttgccacaagtttatgaaagagggggcattgtgggaagcacatcatcttgaaatcaaaggctttccgatgcagtggatttagcctcaggaaaacaccactgcattagccttctttttctgcttcagaccttggcccataggaagtgggctatagtgatggcctgaagagccatctgccttctcccatgataaccggctccacaaccccaaa

SEQ ID NO: 728 - DNA, 600 bp, Bovine  MMBT08527
gtatactggttaatgctattgagacataaaaytgtgtgactactggtcttcrataaagcactaagaagaactaggataccccttataattaatatttggtaagtattcactatgtttgaggcactatatgtccctacttaatcccaatagcagcccagtgtgagagaaattcttcttcttttataggaacttctctgaaactcagagaagtaaaagtacttgtttaggatcacagaattagggacagcagagatgaaattaaaactagagcactgctgttaaccaacttacatgccctcrgttttttagctaacaccaagaaacaggctaaagaggactaaagagtctgataattccacagaattatgaatttaggaagctgaaaattttctaattggttgcctaaaacagcccaagattaatttttagtgtatcacgcaacagtctgaatactttaccgaagataagaggttaaaacttgagttttgaatcatagttttatcacactcaagctgtgcgaccttgagcaaatctcttatcctctctgaggctgcttacttatgggtcaaatgagaataatatttcaatttaccaattcta

SEQ ID NO: 729 - DNA, 600 bp, Bovine  MMBT10871
ccttgtgttactgtcctagatacggcataagtttttttaaaaagcaccaattaacctctctatggaaacttctgtgacattcccagtatattttgatattgcaagtcagagttggacaaaatattasttttgtatttttcatactctgagaaaagtccttagaactcyatcacttgatgaagcttgccaggagcagaagaatcactragatgtggatccaaagcctgacatgctgagcttggagctgctggtattattcaggataggcaagatgctgctgctctacctaacaacccccaratgttagagcaacagaagtttatctctcatgggacagacccatctcttcatcctcytcctctgaaaaatctggctttaccatctagaaagtcagtcaccactgccaaagaaagggagaagatggagcaccgcatactggatcttcaacacccttgacattccttctcacgtttcattggtcagagtcagtcccatgggcacatctcacttcaagggagtggagaagtacagtcctgctggtggtctggaggagccgagctgagtacttggtgagcagaaatcatatccacactcatcttc

SEQ ID NO: 730 - DNA, 600 bp, Bovine  MMBT07065
taaatctttccttatgcttaaattrtgactctgttaaagagacacattttctaagttcttcatgaatagttgatcagtttattattgtctcagaaaaagaactgttgaagacaaaaaatatttttaataataactataagacagcaatgattttaacaaattaaactaccaagctaagtaaatggcaatccttaaagtggatgtgagtttatagcttttgtttaaaaatgcatatatacacacatatatatacacacacaaacatatacatacacatatgcatacgtaaaatcaagagcragttatatcttttttaaacctttataatctttgaaacaattctttacttaatttgtcattcctctttatttttcagggtagtgataaaagtaacaaagatgattcatacaatctaaaatattacgggcatggtaataactcagaaaataacttttgaatggcaaaatctctgattataccattattaatgataaaagtacgtatgttccaaccatgctaaaaattttatccattatatatcttaagcttaactatccaatggaattttctaaagaaaggtgtgcaaattagactacttag

SEQ ID NO: 731 - DNA, 600 bp, Bovine  MMBT07175
aagctgtgtacccttaagacaattcattttcttaatttcacgttaatggaaagaatggaagaggtttatttctggatcagaaacaacatgctgtggtaaagttgcacaggccttaaaatcaaactcaggtttgaatccagcaggctcactggcaatgaccttggcataacctccttcaatctcagtttcttgatctgtaaaattagaatcatccccctttccactcaagtgtgtcataaacgctcattgatatgacctgtgtcagtttccttgcacggttgcagaattttaggtggaccrtaaayagacaaagagagaccacaccctctctmaatttatgttcctggcttatttagcccagcatatggaagccgggtatcagccagcaaagcagatgcagcagatgactcttgtctttagctcctggggtccctaatgaggggtgmtcagctgcctgtgacactagtcaggtctcactggctcaagaagcttaattttgtgctgccccatagcccagttataattggggctgacatcaccactcgcgaagaacttacagaaacattctctgtccttaataagaaatacaggcctcgaccc

SEQ ID NO: 732 - DNA, 598 bp, Bovine  MMBT05930
  misc_feature (1)..(128): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgatgtacgatgcagatggaaagaaaagaaaatgatggattacaggacttaatccatcaaaagcctgcctctagaacatacgaattatgctaccatctctggaaactaattgatatggagatctggactagttcacaaaagtgttttcgttacagtgttggaagaggctrttgcccagatttctttggctttacagaaaattggggttgtttctgcctrtaacaattcaaatagagtgattgcaacattaattgaaaaagaaacactttgctgaagattttctgttgtaaaaatgactttagtgacacatacacacacacacaggctctttctttacaggttgctaatacattccatgataaagattttccaatacctgattttaaaatacctgaaattaacttatggaaacagaaacagtattctcagccataacaattgccactcaatgaccatgagtttaaaaat

SEQ ID NO: 733 - DNA, 600 bp, Bovine  MMBT11082
ttttctggaggcaattccttagtttaattctagatttctccccataagtttctagcactcagtttcaactagactttctattggttggtttccttagcctctcatatgagaagctcttctgtgggtaagatgggaaagtggcaagagagagggggaagtgctaaaatggatcaaacattgttcagaggatgatgttttgtcaccttccatgtaatttcatcagatggcatctcaaaccagagctaacatgctcttttctacctcgcagcaaacaaatcttgggagaaattcttctggctragcgcttctccaaggcatccttctttaaggggagaatgtgtaaacaatttgatgttgattttcagtctggctgccatttggtaactgyctgggtcaccaagcgaagaaacataatgtgtcacctgttccgaatataaatatcacctgattgtaactgctcagtgagctccgaggtcaaaggagaggttagcaccagtggaaaagtatcactttcaacacaggatgtgctgtgcatattagcaacatgtaccgcattaagcaatttgtgcaggtttccatgaacttgccagcctggtctat

SEQ ID NO: 734 - DNA, 600 bp, Bovine  MMBT08896
ttgcttaacttaggagcagttagggcccaagggaaattcactgcttatgccagtgtggaaattcctctgcctgggtgcacttttatgacctgactttttcaccactaatgtgaactgatcttttttttctgattggaaataatctaactagttctgattatctaattcaaaattttggtcttgctcacggaagtctgtaacctattcctgtgcgtgtacttagactttagggcttgttttctcacatctgaaccactgtcatgccctgatttctcttgctttgattttctcaggggaccrgtcaataaaggtcttttaagagatgatctgttcttctctctcctgatccaggcaggtttccaagttcttaactcagtcatttgggcaatgcatcctcctaagaatcagaagtcactaattagtgtcacagcaacatggcaaaaccagccaagctgaagcagcacagaaaacattcctggacaggtctgggagcatgagacagccaagaaagggacagcatgcatccaggcacactgtgataccgctaaagatccatggcagaggtacagcgttagagacacaatcattcggatttgtgtc

SEQ ID NO: 735 - DNA, 600 bp, Bovine  MMBT11040
tgtggaagcgcagtattgagctgcctctgcaaggaatctctttcgtgaccaacctcgtgcagtttcccctgggttaatgccagcgtttcttgggtctctctcagcgtgtcgagaagacggtccctctcttccagcatagagaccatcaactgttcaaaatgtgaatccgcatctggctgcgaaggggagctggacccttggctcccacttcctcccggggggccttctgcttcactgatggtcggcatcacctcgcacatcatcttgaaaaaaagagacccggaccaccgtcatcaggcrcttctaaataaaggcttctacaaagctgcaactttctagctatctggagctgataaatgagaggccttsctatttccagatctgactgttaggctctgtagagagaagtagtcagggaaaatacacacaggcctatccgaagtgcaaggcacacccaacaggagaacatgactactgaccataatcagtgaaggggtaaagaccacacagactacccctcacacaaaggacaaaccctgtggcattttgtttgcaaagccgtactttctgattgttgaaaaacaagtgtgcttctgtaac

SEQ ID NO: 736 - DNA, 600 bp, Bovine  MMBT10777
gtgagagtccttagtctcttccagtttcattgtggtcagcatgatacaccacactgtgcaggcccaggctggtgaacttttgtcttggtcaagatccagattttctttttagttccaagttccagtccaagttttttgcaggtgatttcttcaggattggtgcttacattttttttaaattgctgactgttaaaactctgaaatgtccctcaacaatcaattttcacttcagccacagaaccactggtccaatggggtattaaacagtgaaaagaaatacattctatgccaggcttaagrgatctaaaaactgtagcaaggataaaatggactgaagagaatggaacttggttctaaaagaggtgatccagggtagccatgccacttgcagtttactttctatatacccattgccatggaaatattattggcaatagacaatttgaaggctctactggtttgtggatggttgtgtgttttccccttagttctacttcacataaacatgaacccaagggatgtacaaaagtctctaaaaaagcatctttcccaggtaaattgtctatgtagaagttcaggacaataagaaaatattctaaa

SEQ ID NO: 737 - DNA, 600 bp, Bovine  MMBT09255
tcaatatctaatcagctcaatgccyatgcttacgtgttttttactgcgtcatgaaaaacaacagtaatatttatgagtaccctcagaatcccataaaagtcaatatggaacaatgataaaggcattaccactttcaagtctttgaaaactgayaatctggacagagtatatagttctttactaaccatactgtagcctctaaatgtactagatgttttcatggttgctataataaatttcagtgataaagtaagaagtgtattaaagatgacattaagattagcaatgttttggctaatrttcaaatatatatcagaagttaacagtcatggataaactaacataaaaataaacatttccctcawccagttttagattttaaccagataatttggtctaaaaaaggaaaagtgtcattatacaacatcacagattttttaacaatacaaaaactggaaaaataacttaaatggtatggtgtaataatggccaataagatatataactcaaatatgctactgataaactatatttcctagttgaaagaatattcaatttaagactcccctatagacaagagatctaaattactaaaaaaaa

SEQ ID NO: 738 - DNA, 598 bp, Bovine  MMBT09606
  misc_feature (1)..(11): n is any nucleotide
nnnnnnnnnnnacacgactgagcatgcacacatgcattggtaaaatattcagtatgacttgaataaagcaatcaaggctcctgaagagggagttatcattccaaaacaatgcttaggtttcacttactacgatttcaatcaatatcccaaatgggtgagttttgamcttgacaaattcatgataatcactagtattctttagaacttactgtatgccacatatatctatgtgccatatgagttttaattccgttaatcctcaccacggtcccatgcagaaggtgatactattgtccttaragaagatactactattgttctcatgggagatattgccattattctcaaatgcggaagctgaggcaacctgcccaaggttagaaggctggcagatgccaatacaggatttgaatttgaacggaaatccacctgaagttcctatgttctaaatgccattgcaactgtcttttaaaataaaaactggggaaataaatagataaggctaccaaagaaaaacacgaatggaggcagactagccccgacagctatctctggggtggggtgtaatacacagtgtgatattatatgaaaacagata

SEQ ID NO: 739 - DNA, 535 bp, Bovine  MMBT09271
ttttggtaaggtttacatgttgttttttaaatgtaggtgaaagaaaagggactgacccaggagtcagggctcccagtcagggttgtaggtgatttggggcaagtcagtgtcgttgggctttggttctctcatctgtaagaagactggttggaccaggtgacctgagcccccttgcagcacgaaggttccactttccaggggacaaaggggctgcccatcaaactggtgttccagggagaggggagatgaggccagggtggctcgtggctctcctcactcactaggactcagcctcatctrgcctaatagggctccccggtggggcaaatcacctcccgccatcctgctcagagtcgctgtggctactgtaaccctaagtgggctyagtaggagcatacatctgaaaaggtccagtgtatacatgagctttgcagatgtatacatgatagtctcaaatttttaataactacaaaataaaaccttttacaagttataaaagtagtatgtcatggttatataacaagtgagttcatac

SEQ ID NO: 740 - DNA, 600 bp, Bovine  MMBT10405
aagccctatgaatgcaaaactgcctctaataaatattaaattaaatatttatatattaaacatttataaaattaaatatatattaattaaatttatgtataattaaatatatattaagtgcttaatatatattaaattatatattacatgacatttccaaagcaaatagatcattactcaatccaaaagccatttttaacgcttattatcttcatctctttatagtgtttgctttaatttgcccggtccttctatgtgaaatactggtttctatgacactagaacccttctgctttctcrtcactgtccatcgctccctcttttgggaaagactgtacacagctcagttcctttattcctctgacagctctgcccattctgtccccattaccttagtagtttctttccgtcttyttctctgacctgtcggtatgcacctaagggtgcaagcttcaccctcttccctttcatacaactcactattccttaataacttcatcactcatgttaccagcctaaacymgtaactgccaactcatcttttatctcgagtacagatgcaaattttttctgtaaaggcccagatagtagataatctag

SEQ ID NO: 741 - DNA, 598 bp, Bovine  MMBT10531
  misc_feature (1)..(154): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacgaaactgttgccaggggaaaggcaggtgacatgctctcccatttacactgagccccagcctttcagagactcgagcaagtgcaccgtcttaaaaaactcaccaagttaaaactgtggcccaggtgccttaccttacacaaarcccccaacactctccagggctggagaaacaacactgtttggaagcagaatggccctgtggccaggagcacaaactctgtagttagaccagaacagggcccagctgagctgagtgactgttggccagggagcgtgggtgagaacaatgcccctgccccactcaccggcctgccatgagacttaaaccagctaataccagcccagcactcagaacagcgcctgccacagcgcctgccacagctggtgcagcgtgctaactaccgacactacggctgctatcacgcctgttaccggcatgc

SEQ ID NO: 742 - DNA, 600 bp, Bovine  MMBT11111
tgctgcctgggaagccctgatattgcttcttacttgggggcatctcagcttccctgatcacctgtcttactgacaggaggcaacaaggaggagaactgcagacctcccagggagcagcttttgggcatttgattgaggcaccaagacatccagaggacaactgagtattgacgatggatagctttgaatggcttttcttttttaaagatttatgtgtttttatttatttttggctgcactagatctccgttgctgtgcrggattttcactagttgcagtgcatggacttctcattgggtrgcttctcttgttgccaagygtgggctctaagtgcacaggctgcagtagttgtgtgctgtagagcgctagatcagttgctstgctgcatgtgggatcttcctggaccagggctcgaacccrtgtcctctgcattggcaggcagattcttaaccactagaccaccagagaagcacctgaatggcttttattaccatgttgtgaactgactttggttcttaagagtggctccatgtcggttcactcttaatctcagtactgagacatcactccaagctttcctaaatggtaggacttgcaaga

SEQ ID NO: 743 - DNA, 600 bp, Bovine  MMBT06043
tcttataccactatgacaaatccatccatttgggtaatcttaactgaacatctattactatgatccaggtatgatactatctgctaaggcacagacatgaatagaatacatccccctgttgttaggacattcacagaccaaaagcaagatgctcacacaaatagagcactacaaaacaaattagatcggaggtccactttattctaggtgcagtccgaggagatgagaactgtatgcaacaaattcacgttcaaggtcagtggggatgcaaaagattctgtgatcagttctgctcccacrgggaaagggtcaaagatggctgcacagaggaggagatgcctgagatgggtcttgaggratgaataggagtttgctaggcagacaaggagaaagggcattctgggaagaagggctgacgtgtgcaaaggctgcagtcaggtagctgcagcacacagagggaactgcaggtgggtgaacaacatgaatactttaagggtgagacgcagcctcgagttgtgcrgcatgggccggsggrggggkggggmaggcaggtacgtgtgttcttcctttaagaggtcagtgtgtttccacttcatctgt

SEQ ID NO: 744 - DNA, 598 bp, Bovine  MMBT10538
  misc_feature (1)..(51): n is any nucleotide
nnnnnnnnnnnnnnnnnnnnnnnnnnnnnnnnnnnnnnnnnnnnnnnnnnntctgtttgggagccggtgattattttcctgtccgagccttgctttgcagtgggatttgcagccacgaaaagttcttggccaggacatttgtgtcttaggaaatgttgggttgcacttttatttttagctttaggaatgcgacacttgatattatttgggttgtttaagatgggccaactttaggatgagaactatgtcccctaacccacgccaatcctggaaccttctcgtcagaaagggagggtctcrgctccacactggagacagcaggctgcatgtgccctgtttctggggaggcttctgtccaaggttcccccamcccgtgtgtgctgagttcacgccatcagctgggaacaactggtgaatcagaaagcaaacctgttgtccaggaagtgcaggagtgggttcccagtccaggggacaggtttccccaggaggggcctctctgagtcatgacccctcaccccyaccccatgggttgcagacccaggaaaccgcctcacttgtgctgtcagctgagtacacagccatgtacacagagccctgg

SEQ ID NO: 745 - DNA, 545 bp, Bovine  MMBT09773
  misc_feature (1)..(19): n is any nucleotide
nnnnnnnnnnnnnnnnnnnttggttccctctccttccttctgagggagcagctcaggttcccagctggcgatggatggccaggcctgagggggggatgctgtggccgattgctccttctcgctctctctgcggagacagatgcagctgccggggccctgtccccctgcaccgtcccagcaccaccccagcctcctctcctgcctcttcccaccaggtcagtgacccctgcagcccagagggagctttggggtggcagggagggactagttcctttggaaacttgccagcggtggggtgcrtaggactgggggccggagcttgatttctccctaaagccccaatttggattgaagccgtgggtccttgaagtgtgggtggggctgtgaagaattagggggacaccaggttggattctggcggaggtggttttgggttcagtatctggtgtccaggcaacatagagggtgagggtgaacgggggtctgtggaggcagctcagacatctttggattgggggttttctagatggagagaggggtggggt

SEQ ID NO: 746 - DNA, 600 bp, Bovine  MMBT09036
gacccacaattaaaatgagaagccggtagtgaaagaagtgtagatacagtttaactcatgtagatctggtggttatgggaartataaggcacaacatatcacataaattattatcagtgggcggccagcagggagatgcaacacaattgcttcaggccagggccccwcagtcatctcattctctcttggcrgcgtctccaggattcctctttacctctctaggccttagtccatccactggacctgytgatgcaatgcactcacgagctgaagctctcctctgcaggttctccatccccrtgccccaggaatatgactcataaggctcctgcctgcagcttgagcctcatgcacctgctactctacccacactgaatttctcaccatcccctgggcaccccatgcttttctaatgatcctaccagtgaatgcattgtttcttttaagtagaacgtcatcccttcttttgtatggtgaactcttactcatacgtcaagacccgtatcacctcttaaacgtttacgacacttgtaatcacttttttatatgtgcattatcaacaacaacagcgatagctaatgtatctagtgtgggacctgg

SEQ ID NO: 747 - DNA, 600 bp, Bovine  MMBT09068
ccgagagttgccatttttaaggccagtttactagctacctcttacactccgccgccgagagctccctttgctcctgcagtccctctgctcctgcggttactgcctttgcacacaactgcatgggaaccgcgagggaccacccccgtccctttaaaacctaagggggatgtaggaagcacagacatgagatgcagtactggctttaaaaaaaattttttttaagagagtctctgcaggttggtttgctttcaaggtttggacaccatggtactcattggaatgatctacattcttacccartacagtgggcgaaaacctgccctacccaaattccggccacattctcactaaccccsgaaactaagcgtccaaatataggagcagcatcgactcagccaagaagcaccatctcagagggagggaaggggtggtttgctaacatctagtccaactaggactttcaacatggaaccatccccacagaacccaaagcagccattgcctctgtatgtgttctgtgtgtgggtgtagggatctgagtaagaaataacctgtttatagtgtaagaattcataacgtaatcaaatgaaacctttactg

SEQ ID NO: 748 - DNA, 598 bp, Bovine  MMBT11262
  misc_feature (1)..(2): n is any nucleotide
nnggttggaatctgactgcagattcctcccgcaaagtcagcatccccaggacctctcatcctagatggggactgggagtgcttcctcattaatcacagctctttaattaacagctctgaggctggaaccaaaggtgcttaccgggagaacgccagcgggccctgaactctggccgcctgttctgatttggaagagttggcgcctgggggagggggcctggcatggctgggcactgagcccggcagggggtggggtttggagggcaagcagctggcaggccagccgcctgtctctgcctcrgacctcaccttgcagagctgactcgactcagtgcaagttgcaggcagctctgtcctcccagggcccatggaggggagatggccagagaaagacactctcggacagcratctcaagacttgactgcaccctagaatcactgaaggagcttcagaaacattggtgcagggtcccctgcggtcctgatgtgataggtctgggatgggatggggaaatgggagttttcagagcttcacaggttatcctgatacacagcaccatttgagaagcacggttcagcgggaggccctcaggctgtac

SEQ ID NO: 749 - DNA, 600 bp, Bovine  MMBT09777
ggacctcccttgcgaggtgtccatatgcctgtgtggatgagtgtgggcacttagagggggacccttgggggccatggtgaggtttgacagaagtgctcctacctggggaggtgggaggcacccaggggtcctgggatggggtgctctgtcctcctcagggatcctcacacagccctgcaggaactcctgctggctggcaccctggcaatgagagaggaggagtaggagtggatgaattgctgttgccccaactgcttgaatgtgtgcacagagcgggctgaggtgagagtgtggaggccrccgcatgggtcacaacctgccacaactccagggcatgccatctaccaaggagacagatgtccggagggaggggcttggccctgtgtgacctgctcggccacgtgtggtgcccagcgtgtagggatcctgggccctggttttgattatctagcactgctataggatacagtaccccaaagacctggcacagtgttccatctccactgcttagctgtgaggccttggatgcatttcttacctctctcagccttcctttctttacgctcaagttgggatagggtctgtcctaaaaaccttgtt

SEQ ID NO: 750 - DNA, 600 bp, Bovine  MMBT07218
ccttgccagcggtagacgacgaagccttgcaagtggagttccttaaagatgatgatttccggggatgggcctgtgaagaggagggcacgtttgagcagcaggatgcagggaggtggccgtgatgaaaacgtgcayggtacaaggcatgtcagcattcccctagtgctctccctcctgtgtcctccactcttcccgacccacagggctgccccaaaatcaatatgcactctgtgcaggcagagtaactgccccaagacgtccatgtcctagatcccagagccttaactatgtgaccttacrtggcaaaagggactctgcagataggaccaagttaasaagctttagatggcaaaattattctgcattacataggtgggctcacatgagagtccttgtaaggaagaaagggatacaggaaaattagaattgagaaaaaaatatgtgatgatggaagcagagatcatagagatggagggagatttgaagaatcagtgctgctggctttgaagacggaagaagggaccatgagctaagagatgcacgtggcctcgagaacttaaaaaggcaaggaatctgagccttcggaagraaagtagccct

SEQ ID NO: 751 - DNA, 600 bp, Bovine  MMBT10404
tttttttttttaattctacctagttttaatggtttttctttctctgaaaaatagtgacttgttctttctgaaatctgaatgatcagatgcagctgcatttttgttgctatttgagtttagggagagggaggtygagcactctgaagggacacagagattagagtaactgttaggctgacagaaggagaagaatcacctattctttgcctagtttaagatttagagacagtagagtgggtataggtgaaaattgtagaaggaaaataaaccagatggattaagatttttttttttttattraagtgttactacatactgaagaagatgacracgttctaccattagaagcaataaaggaaatcgcagaggaaaaggtcaataggctttgactacttaaaaatttagaactactttaaaactttttattgcttagataatgcatatgtgcttagaaaaccatcggaaaacaatagaaaataaaaattccctcaatcattctcccaattggcagctctattgctataatgacattttacgatcatcctcccacacttaaaaaaatttttatgtaagggaaattaaatgtgcaaacaaataaat

SEQ ID NO: 752 - DNA, 600 bp, Bovine  MMBT06041
gcagcccactttaagacaaattttaactgatagaatctgccacctctggagtcggttccactctctttcctgatctgaagctcccctactcctgttcttttttaatcattaatgtttttcttattaaagaaatgtttccttgctcatattgtaggtgactgagctcaggtattatttctctaaggaggaagagattgatttttctggtctgctcttgcaggagtaatcatgacctttctgcatcatccttgacttaaggatgcttctacaaaaggaaaatggcaacagcaaggtttatcrttctcactgacacatctaaataaaggcttatcagaactactaatgcaggcatccatgatattagtaaagactggacagagctgagatggagatgggagaagaggagggattgagtcaagtcccaacaaatgaccagcacaggaacttcaggatagagtatgcaatgggttggagccaagcttctatggctttcaatggtctaaatagatagcatatcaagatattcatttcagtttagttcagttcagtcgctcagtcatgtccaactctttgtgaccccatgaactgctgcatgccagg

SEQ ID NO: 753 - DNA, 598 bp, Bovine  MMBT10943
  misc_feature (1)..(172): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccttttctctactttctgaaacttttcttcactgcgtatttcctgagactcagaaggacggaaggttcattgtgtatgtgtgtgtgttccccaaccattgactgaagttcatgaaatgtggttartaagagccttcccttacgttgacttacagttctgccaatctttttggcccagatgagacgctatatttttgttcccaagaaaagaaatcatggccaccatcgtcatcaccttggctgcttcttattgtgtgcttacgcactggacactgttaggtgatactgggtgcctgatctcgtgggatccttaccattcatatagtcctcactttaggcttgagaaaactgaggctctgagtctggagtcaggatttgaattttgtgctattaagctcctgctctttttaccacttaatgcccc

SEQ ID NO: 754 - DNA, 550 bp, Bovine  MMBT07203
  misc_feature (1)..(172): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccttttctctactttctgaaacttttcttcactgcgtatttcctgagactcagaaggacggaaggttcattgtgtatgtgtgtgtgttccccaaccattgactgaagttcatgaaatgtggttargattttcatccaactagaagcaaatgttctattttgaaatgtggatgaaaagttgctggtatgaaagtgtacggaaaggaagaatgacatcagcctccttgatgagcagtgcaagccttctgaatgtgtttaaggtggcagagaccaggacaggcatggagatggcttcagagcactgtagaataatgatgcctttctttctattgtatgcattaggagcaactctataataaaacaacaacaggaatga

SEQ ID NO: 755 - DNA, 600 bp, Bovine  MMBT08245
agtggtgttttcaccaaggaaacaatatatcctcagggttggcttagattgataaccagaaagacattctatcagcatgcaggaaatgatattggtgacatatttagtatacctggtcttttactgaacagggagcgaccacaagcatcaaggtaaccaattcctacttttcctaccattaacttcatggctgtccatacaattctccttttccgtaagagggctggacgttccttcatttgtaagacctgagtttatctaatggcacctataattaggctcatataaaaatgtagtaarttgcaacaaatacartggcaccacaggaagtaagctttggagctggaagggaacactgtaatattkytgtcgccaaggacagggagaccatcactagcagaaagtatcttttcatgtccctcggcatcctttgggatgtaggtaggggtcgtatgaaagttacacacttgatgaatctccattcctttttttgaactgacttttagctttaacacatgggcaatttatcttggaagatcaaatggttaatctgcctggactaatgagcacagttctggaatgaagaggttctcactgctt

SEQ ID NO: 756 - DNA, 600 bp, Bovine  MMBT07518
gaatagatgattgtacttaagaaactgatgtgaagattcatttgttattttctttgtttttaatacctaagataaattaatttacaacatagacatctgtccacaatattattggtggcatcattaaggatataataaatgcatgtttttgaggaaaccaaaagagcaaattttgtgaaatatatgagaaacatatcatttctttacacaagaaccaaaataatgttaaaacatgtctctgatttggtttcttcttttgatgattttaagtttattttagaattactacatgctagatgrtttaaaaattattgattttaccataggtaatatttgcaaaatgctgactactttcctcagtgattgaattagcaatattctgcattctcttcctgcttcttcactgtggttttactgggattacataaaactgaaagtacagcgttttgggcagaatactggagtgcatagcctttcccttctccagggggtcttcccaacccagggatcaaacccaggtctcccacatgacaggcagattctttaccagctgagctaccagggaacagcacaggagcggtgcaggagcacagaacagct

SEQ ID NO: 757 - DNA, 600 bp, Bovine  MMBT11163
caaaatgaagaaatctcaaatgcatgccaattaattgataattatttaattagatrtatatccttgcaaaatttattgatgccatgcggtagctgtcaacttaattcaccttgctagtagttaatttttatgttaagacatattttcctttaaacctactcaagtctcaacccactattaaaacttatagtttttatttggactcatgaataatgtgattccaagtgtgacatacaaaatatataaatgaaggctttcatatatttttcagagttaagcataattctctaaattcaaatragacttgccattctaaatacgttatctattatgcagctttttttggggaaaaaaagctttttggtatgtatgacttaatggatctcygtagctactacttcttatatattcagttttaaaaacttttgttaygatacacatactgaatgaatctggcttccacagtgaggcaacaactatttgaaatggaaatcctaggacacaagtaatagtagatgaggcctggaatgcttgaagtcggaaaaaagaataaatatcttcagaaatttctctactctgtaacttgttgtcaggtctact

SEQ ID NO: 758 - DNA, 600 bp, Bovine  MMBT11162
ctggacactctgtctctgcctgtgtataggtagccaccttgcagcagactgttactttgctgcaaaaggataaagaatatctcaaccgccaaaacatggagcttagtgttcgctgtgcccacgaagaggatcgtcttgaaagacttcaagctcaacttgaagaaaccaaaaaggctagagaagagatgtatgagaaatacgtaacatccaggcaagatttacgttattttccatataaatagatataaaccaaaccatcttctttagggaactctggctttggggacaaatagtgatttrttggtaaggtttataggataatgttaagataattggtttttgtttctccacaagatactcatattctaactgatttttttcttaagacattttgtttttttccaaaagcctgtttcttttaggtagggatatatacactgttactgtttttattaatttttttttatgatataatctttttagctcccaatgactaagatctctgtttaagtgttttaagaaagtatttgtatacttttatatatttagtgttagttgctcagtcatgtccaactctttgtagccccatggactatagac

SEQ ID NO: 759 - DNA, 600 bp, Bovine  MMBT11161
ccttgtttatctattttatatatagtagtgtgtgtgtgtgtgtgtatgtgtgtgtatagcatgcagcttaattttgatacttaggtatttcctaacttgctcctgaataaaccctttcaaattcatgagtatagcatataatttacttgaaattttaaaacatgtgaaactttgtatttatttcaaaaaacatatacattttgtaaaagtataaaagtacacaaaatactgatacaaacctacttcaacatggtggctcctctagattaaggaaaaatagattagagaatggtgcaaaarggggcttccttgtacctgaaatagaccatttttttttcattcttataaatcctgaagtaaatagaaataatattaaaatctgttagagctcataatgagggagacagttactttctttccccttatttttctctatgtttgaaatatttcaaaataataaaattggaatatctcaatattataaaatcgggggaaaattgaggcaagagatgacaagaaacttcctcaaagtcaggaactttctatactctcctggcaggaaggtgtttactcacccagcccctaccccctcatccctgc

SEQ ID NO: 760 - DNA, 598 bp, Bovine  MMBT10191
  misc_feature (1)..(163): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagccccagttgtcccctttttaaagtgctgttacttcaagaggttacaacaaaaaaatagacaaaacaaaacccaagaaggaaagcaaaacaggatgaaagtacaagagaaggaagcaaaataacttgcaacatraaatatattaaagggaatgcagtactgaaccagaagacccatagtatgtttgtatgcattgcacataaccactttgtcattaggaacaagtttcagaagtggaggggacagggactgtggggccagtaaggtcactccactgtattcacaattggggctctgaagttgtgcaggagggaaaagtccccctctcccctttcttacccacttgggtccagttaaccccatgaggtctgatgccctggacccttccagctgcttttctaggatctcaacttagcttggaggggaagcttat

SEQ ID NO: 761 - DNA, 600 bp, Bovine  MMBT07967
gttccacccaaatgtagattacagcaacctgaagatagaaggtccaaattcctaaatgaaatgtttcactataaagctgcttagaatgaaggtcttccagaagccatctgcacaatttatcacttagccaggaaatatatccccttaaatgtacaaaatcatgttggtgtattgtgttggggtttacactgattaataaataatctgaaaaatttttaaaaaggttattgagaatctgctagctgttcgacatactaaagacttggtagaaaagaaatcaaagtcccttctctccaagarcatcccttctctccaagagcagcttcccttctagtgagagagccaggggggtcaatgtgagcccgcaaaatggcaggtggtgatgagtttcttaaaacaattagagcaggataggaggatcaatggacttcccaggtggcactagtggtaaagagcctgcctgcaaatkcggagacagaggttcgattcctgggttgggaagatcccctggaggagggcatgacaacacactccaatattcttgcctggagaatcccatggacagagaagcctggcgggctgcagtctatagggtctcaa

SEQ ID NO: 762 - DNA, 600 bp, Bovine  MMBT08694
aatgaattattttcttaaaggagacagctaaaaaatatatttattttatctctaaaaataaaaaaaaaagaatcttaactttaaaatttagattattaaatattctctggaaagaagttaaggtggagagatttaacttttgcggtatattctacttttgtctgagaagagtaaatgacaacatagatgttcttataatattgttacatatcttttaaaattcaagcatttctcattgtactgtaagtaatttatcataataatcatgattataattggaatgatcttgcttgcaactcrcactattattttataactttgtactgaattcatctcttaagtctagtaaagtaataaggatgttgaaatgaagtgaaagtcactcagtcatgtccgatgctttgctaccccacagactatatagtccatggaattctccatactggagatgggtagcctttcccttctccaggggatcttcccaacccrgagatcaaacccaggtctcttgcattgcaggtgtattatttaccagctgggccaacagggaagcctataaggrtgttatgaatgtataattccttcycctatattctttgc

SEQ ID NO: 763 - DNA, 600 bp, Bovine  MMBT08275
gtagcacaggcaacatgctccctaagaagctgacccagcacctggcagggcagatgggggatcagggttgccaagtgatctgaggaatgcctgcacccagacctggttccagactggcccctggagacaggaggggctcctcatggaggtaaactggctctcctttccattcctgcaatacaactgtggcatctgcacagaattaaaactaaagaatataaaaaattatctgtgatcttgcaatttctgtctctcaggcaataaattttgtcaacaaattacaagacaaaagcatacacrtgtacattgcaataaagcatatgaagtactcgctagactcttcagagcctagaatctctaattgaaaactgccacaccattgcaaagcacatatccacagtattagaaatggaaattaaaatgtaagattattgtacacaacagaaagacaatttttcatatgaatgaaattttatttgcatacatttttatttcacattttaattatttacaaatcaaaaagtcacttttaatatgcatggctgagtcccttttgctgtccacctgaaactatcacaaaattgttgattaactctgtgt

SEQ ID NO: 764 - DNA, 600 bp, Bovine  MMBT06819
tcctagagatagagacgatagcttgtgttccagatggccattaacccagctgtgtatctaacctagcatgcctaccctaccataatctctattaaattgcttccctataactttattaactccctccattagttgaatttaatatctttgacatgtgttcattttgtaattatatgagagtcacgctcttatctttcagaatattatattgaatagctgataaaacctaatcaggtgaccaggaacaagtccatggtctgataaaataagatttattgatttgcagccagggagtacacrccagaggaattctgctggcccagagggaggagggaagtgtgttttataaggtttggcttttcactgaaggactctaaggaggtggctcagtggaaaagaatccgcctgccagtgtaggagactcagcagatgtgggttcaatccctgggtcaagaagatcccctggaggaggaaatggcaacccactttattaatctttcctggaaaatctcatgggtagaggagtctggtgggttacagtccatacgattgcagagtcaggcacaactgagcacacacaygccttcagttcaggacggc

SEQ ID NO: 765 - DNA, 600 bp, Bovine  MMBT07934
gtttgatctccttgcagtccaagggactcacaagagtcttctccagcaccatagtgttggcttaaggagcgtgcagaagaatggaagaatcagagtgaggtgaagtcaatccagaaatattccaagcactactgagttcaaaatttggtcctgagaagaggtaacaaatgagtgagtaataggtcctttcttgccattcctagccatgtgtggttgcccttaaactgactgcccaaacacatcagtgatcagcttgagaagagtgatatcttgagacytcaatcaaaaatataatagagrcagtgcacaggggcagcctgttggtatttctatctttctctctgccacatccgatggagagttgctgtagttcagtggctaagtcatgtccgactctttgcgaccctgtggactgcagcacaccaaactccctcgtccttcactatttccctgagcttgctcagactcatgtccatccagtcagcgatgccatccaaccatctcatcctctgtcgtccccttctcctcccaccttcaatctttcccagcatcggggtcttttccaatgagtcagctctttgcatcagatggtcaaagtgt

SEQ ID NO: 766 - DNA, 600 bp, Bovine  MMBT09703
ggctgctccctgaactgaaaattcatgtrctttggtggccagaaagtataggtttcactgcacagtcatgatcttgattttcataaacaaagggccacaagattgaccaaagyaagtttggtaagagaatcaaaacaraattctgagcagaaatctatcccttccactgccatgaaattcatgacactacatcagacccagaggctgggaatccagcctccagcaaccctggaaaagttataaattgcaagctgtacaaatctatatccagaacctactaagggtttttaaattctactrtgctttacattgagagacatcttaaaattcaaaataacttctaataaccaagaacctcaatgttaaggacatctattcctgacaggggaaagacagcaatgcatgagctgaagcctaaaatactgtgacaatcttgcccggaaaccatttaaactttaaacaataagcaactctgagctcactttgggaacagcttcctctgaaagctcactgttaggacaggcttgttgggaaaatgcggcctgtgatgtcctccccgattgtccccccgaaagaaggsaatctytcatattggcccaa

SEQ ID NO: 767 - DNA, 600 bp, Bovine  MMBT07677
ttgtcccatgctctttcctccaaagcagaattatttggagttctcttgggtcttttctacctgtcactatgactgtgataccaatgatgagaaaactttggtatgtaccatgactacagtgtcagacaggttcatgtaagtgatctcactgactccttatagccagctctgaaaggcacacaaggcagctattgatactcttctattgcagctgagctcagagaggtgaaatcacagccatatcaactagtttaagacagggtttgcaagatcagatgccatccccagatttttttactrctataccagtcaacaccttggtttgaaaacagcgtgttgtttcgtagcagcccacagtgtgtgtgcctcaagccaatattcatagaaggcctccagctaattcttcgtgtttagattaggttagaaacctaggccaatttaaatgaacaaatatctaagtgccttatgtgtgtctagcctggctatatggtggcattcagggttcagagagtagaatgcatatcacctatggatttagattctggatggacctgactcaaatcacagctcttctggggactttgaacaagctacttaaac

SEQ ID NO: 768 - DNA, 598 bp, Bovine  MMBT08905
  misc_feature (1)..(55): n is any nucleotide
nnnnnnnnnnnnnnnnnnnnnnnnnnnnnnnnnnnnnnnnnnnnnnnnnnnnnnncatgtcacttaggaactaaacacttggtgtttggcaaggggagatattttaaggcttgagagttaataggtgaactgtgaatatatatattttttcatacactgggatatttttgtcttkgaagcaaattaaagccttgtcttccaaggcagggagttatgtgcaacatactaggattatcttggtatatttttcaaaatctttttctgtctagatattttgatagatgatgagagatattcatrttactttaaatatgttcatcgattggaagatagttgasagggcagagaatgttcatataagtcagagaattaagaagcataggcatgcaagatgtttattactttataataataaccccccttgtataacccycctttatacaattgcktattatctctccctcatatttattattacacttatttagctaatgcttcaacttttgttggtttcaccagatttaaattttcatacagtcagggactatttatatttttcaccattacattcctggcccataacagatacttgaactat

SEQ ID NO: 769 - DNA, 598 bp, Bovine  MMBT09781
  misc_feature (1)..(55): n is any nucleotide
nnnnnnnnnnnnnnnnnnnnnnnnnnnnnnnnnnnnnnnnnnnnnnnnnnnnnnnaccgggatttcggggagctttgtgggtcgcatcaagggtgccaagtgccctttcgacctcccccacacagcctagtacgtggtagctgcatctcactgactccctgaggtaggtctttgacttctgaccgttaaatggaagaagatggcctctgtgaacagccagaccctagccttgtagttaggatgggtgttctttattgatggacctttctgttgcataatttctccatcatctgtacaacrgggtagtaatagtaacaccttatctacatcgtgaggatgatattcgttaatacgagagcttagaacagagtctggattgttgcagctccaaagaagcattagctgctgctgctattattattatcatcattgctgttgttgtaagactctgtcctccagattcctgggcagcccctcttgcaccatgtcagtcatccccgccagtctccctccctgaggcctgcctgtggctgctctctgtctttgtcctccattcttcctcctcctctctccccttccctccttgctgtcctggctc

SEQ ID NO: 770 - DNA, 598 bp, Bovine  MMBT06176
  misc_feature (1)..(19): n is any nucleotide
nnnnnnnnnnnnnnnnnnntctttgttatcccatggactgcagcccgccaggctcctctgtccatgggattttccagacaagaaaactggagtgggttgccatttccttctccaggggttctccctgacccagggatcgaacctgggtctcctgcattgcaggcagactctttccatctgagccagcagggaagtgggtctttgacctctatactgacaagtttttctratggtaaagggccagttcatcaggtgtactctgtggaagggcttatctgtctactactcaaataactccartcttctgactgattcgatcatagaggaaatctcctggcttagttcttcccataatgtttggcaaaaagattcagaaacttggaaagcactactttctgtggyttgagatatggtgayaggtatcacagctgtaaaactactgatagtttcttttagagtacttatggatagcttggaatttggataccaaawcctgattagggtttaaaccaatcttatcaggttttccttgttcttgatttaacttaaacatacagaactattgtcttggagaatacccaaccttggagctaggaaa

SEQ ID NO: 771 - DNA, 600 bp, Bovine  MMBT06159
ttggtatgcttgcttagagaccaatttggtaatagctgtaaattttattttaattcagctatacattgatttagcaaaattgtgtactaatgtattaacataagtgcccaaacatatatgtagaagaatgttctttgtagtatactttgcaggaacagcaacaaaaaaggaaacaaccaaagtgtccatcaggaggggacatgttatgttattgatgcaaaggaatatcaaacgatcatttaaaagaattaaggaaatctgtatgtgccgatctgggaagagctcaaagaacatgtaagraaagcaagactccgaaacgtactctataatagtttggtcccactggggcttgagtgagtgagtggatttttatttgcatgtaaaatatctcagaaggaaagagacagaaacaactgttaatagtgatcacctctggggagtggcagctataggggaaacgggatgagagactttgtttattctatgtcctgttcagtggtctgaattatttttcatttatacaggttttacttatgtacttgttaaaaagcagtgaaaatttttgttgattgcaggtagttagcttagaaattctatcct

SEQ ID NO: 772 - DNA, 600 bp, Bovine  MMBT08349
aattagtggatttaaaattgtttgcctcttgagcagttaccaacttcctggagatcctgagaaggctaactgtaatcacctcaccaatctgatcactgtttcttctaatccctctaagaagcacatatggatgaaatgactgattttaatcaaactgatctgggaaagattaagacacttcttctgaggctgtacacatttccttcacaacaaaggaaatctgcttggagaaaagtaggtatgcttaggaaccaatcagcttcatgcacagagagcaaaatgtgtaacttgcaaaatgtrtaacttacaaagtcttcaagctggaaagcccccggaaggcacaatcagcaatgtagttgactctgttattcccaatgtgcaatgtatttagcaagcttaggcccaggaagcttgaatcatccaacctcgataagtgattgtaygttaggtccctgtaaagagaaaacgaacaacaacaacaaaaaatcaacaatagcttttattttctaattcaaagcagtgatttgtagaaaaaaacaaaacaggtaatatatattaccacaataatccttattttaaaactcctccttcttaataata

SEQ ID NO: 773 - DNA, 600 bp, Bovine  MMBT09348
cccaccaagctcctctgtccatgggatttcccaggcaagaatattggagtgggttgccatttccttctccaggggatctttccaacccagggactgaacctgcatctcctgaattggcaggtggatagtttaccactgagccacctgggaagccctctgcccagcagtttcaagttgtggatttaacggacttcaagtgaaggggtggtgagattcagagggtgggcgaagctatttaagaggggatttacaactctacaaggaaaagagagctgaagacaatgtgtactttacctgagratattaaacagcttaattcacatgcaggaggaacagttatattagcagggtggggggtggggaggaaggccccacagatatctttacacatcagcatgagattgaaatagatggaagtcaagccttacaggtgccactcaagatgctgttacctgtctcttctgctgtctgtcactcaggagctgcttgaggtaccagtcactattctgctgctgcagccctcgcaggcccagtgcaggtgactgcaggatcttgaacaaggctggtgcagatccctgctccaaagccaggtctatattt

SEQ ID NO: 774 - DNA, 580 bp, Bovine  MMBT08319
atgctcagagtaacyagcattattctgacacaaaatgtgaaggtctctgatggggagggaaaaggcattttaaaagattccaatctgagggaaaaaatatttgtcatgagatttctataattaaaagcttatccctcttcccttcctagattttcttgtcctccagtctcctcttcacatacagaatttaatcttgcaactgcttattaatgctcagctgtgaggcaggcagctgatggaggatgctaaaattatctggggagtaataactgtctcaaacttttctaaggccagagaacrgagttcctgagccatgactcttgcttgtatgccctcaaatagagggaaggtctcactgagccaaaaaaaaaaaaaaaggaaaatggaaattcccaagttttaggcaatgcattttcttctggaacaatttcaccactaaaatagtacagagaagcaatgaagtagagatctgagggtcaaagtttttcttaatgatggaaggacagtcacagaaaactaaatataaacctgctctttcttgggtctatggaatggggtaaagttataacaagagtgggag

SEQ ID NO: 775 - DNA, 601 bp, Bovine  MMBT05494
  misc_feature (1)..(1): n is any nucleotide
ncccttgccccaccctggtccagactccagagcccagagcgaggcagcagctgtccttggtactgaaaagagaagctccgtttgatcaaaggcaagaacagccaaagatggccctgtgtggacccagctgaaggccaggccaraacccacctgtgtcctgggaacccaaaactctgaccccactttcctctctgctcccacaacctaaagaatgttagatctagaaggaagctgggagacagacttttaaccaccattttacagaagaaacagaggcccagagggaaagtgaatttctcarggtccctcaagtgagagccaggactagtcctctaaagtttcagggtgagtttttggaggcctttctaggacaacatgaggaaaataaaatggaaggaacaggcaaaaagcaagggaactagaggggaggctggtgcaatcatccaggctttgaaatgaagaggagggaaygggcaaggctcaagtcaatgagaggtatggaagatcctgtgatgggcagacccagaacccagaagactgggtcccagagaggggtctgtccccactttacacagccctgcccttcagggaactgggccat

SEQ ID NO: 776 - DNA, 600 bp, Bovine  MMBT07500
taaagctgtcaattcaccaagggaaaataggagtcctgaatatttgtgcacctgaaagcaagtttcaaaataatgaagcaaaaatgaatagaactgcagagagaaataggcaaatccataattataatggaagatttaaatatcactctcacagtaattgatggaataaatagacagaaagtaaataagagtataaaagatttttacagcactatcaaacaatttgatctaactgacatttataaaactctctactcaataatggaaggatacatattattttcaactacatacagaacrtttaccaagatggattaataaagtctcaaaaatttwaaaggattctaattatacaaagtatattatctgttcataatattaaaaaagtagaactctatagtagaaagatatctggaaaatctcccaaatatttggaaactaaataatgcacctccaaacaactcacatgttaaagaatgaatcaatagggaaatagaaaatattttgaactgaattaaaatgaaaacttatattaaaatgtattacatgccattatagcagcatttagggaagaatttatagcactagacgcctacatta

SEQ ID NO: 777 - DNA, 598 bp, Bovine  MMBT06031
  misc_feature (1)..(97): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgtgattttaaaaatgatgaaaacgttcatctaaataataaacagcacctagaacctcccagattttctcaaacgtatctcttttaggaacagaaaaccccaggcaccgggaaaggaaaacattccaaaataacctgaagggcttgatgcttattaaatagcaagatggttcagtcgaaaaagctaatgatgccaaggarcgtcagattttctccagagcttcaaggtgaagacaaatagagytctcagcagcattacasataatgaaaaccatcaacaatttcctgcttcttctgtcttgcgctgatacttctgtcgtgcagatyacccraatttgattgcaggatttttctcccttgttgttgccaagaactataaacaccatgggatgtaataaagtggtgctctgggtcttttattgtcattattattctaactcagttttagaaattagatgtgactttactggctaagagcagagctcgccatcttttcaca

SEQ ID NO: 778 - DNA, 600 bp, Bovine  MMBT09663
ttatctctactccttgtagctctgtcccactgtatgtcactgmaaaactgaataaaaggcatgaaaccagaaatgacagcagataagaaccagcaggaaaattttggaagccatgaagcggttagacaaatgggcagtgacttaccagaccagagagagccaagaaccgatgagggtagagccaggaatcaagctaatttgtgcagaagaatcttggtaagactcaggaaggagaagcactggggatgcatgcgtgcaagggagtcagagcataggaggcttaactgattctcattcttraatagagcagatcactaaaagatcccaacatttgctgaaaaccatgaaagctacggaggctagagtaacagaaaacattggaatatcaggatttacagaatgtgagaagaggggaaaaggaggaatggaaaacgaacaaggaaatactataagaatctccagaaggtcattagtctctagattgaaaggattcactagttgttcactgcgagtgtgtgggtgaataaatgcatgaataaatgaaactgaacacctcatgacatgttgttgtgcacaggagatgcgagcatcctcgtgtaa

SEQ ID NO: 779 - DNA, 600 bp, Bovine  MMBT09730
agaccacaggtaagctcctgactcaaggacaacccatccgctggctggccaaaaacctataatgatccctggcatgaaaagatgaactgaactaacttaactctccctttttggactctggattaagaagtaaaaagagaagtacatgatgggaacatatgagttaaaaaccaaagagaccctatggattagagataagagcttgaagtgtagaaaggcaaaaagtagtcaggaagcagaaactaggtaagtagaaattatgaaatatagaaaattatacagggtaaaagtggatggggraaggaacatgtgcctaagtgcctaagagagcatggagtcactgaatcacattaataagagtgccctggagtaaagaccatagactcctgcaactgaagtcccactttatgccgctctgaatctctgtgccctttctcgctctctgtgtcacttgtaagaatgcccatttgcttgaggtgccttaagaggttgtctctgtaactgacaaagcccaacctaaccaaaataccattcttggttcatacagttgctgtcacctgtcaaagactgagggtattatgttttcacattttttaccaa

SEQ ID NO: 780 - DNA, 600 bp, Bovine  MMBT08393
agttcatctcctgccatgaggctgagaacaaagacaatttttttttaaaggtatgtagaggaccatatggggcccttatggggctctgggcatatggaattagagatgtggaaatagtcctgaggattatagaaaggaagatttggcagaataataaaggaaggaaaattacatcttgaacaccctttcaatctttatcaaattataacaatttaaaaaatcatttaaccataaaagagtataacttaattagatccactaacttctggaaaatgacaaagtatgaattttaaaaatctrtgaaaggaaagcaggtcaatttaggactggccacacaaakaactttaatttggactaaccaaagaaaagaatctgtctcagtgatataccttatttatggcaaactttgacaagaaagataagtttaagaaggtcaagagttaaagagtaagatcttaatgtatcttgctttaatgaaaaagtccatcatttgtaatcaacacattgattgtatgcaaatgtatgtggttgcaaatgttcagaaacaaaaggtttccttaattaaacattctacctccttatattttgattacattattc

SEQ ID NO: 781 - DNA, 600 bp, Bovine  MMBT08656
tggtggagaattgacattgatgtgtgtgttactactgttcagtaagacaaggaagagaggacaggagaatatttgcattctggtgaccgcaggagagcaaggaacaaagagccctgttagaagacaggccaggtggagtcctgtttcagtttcaatccttaggggctctgtctctgattgtcacactattgctccttttagagcccacagaagaggagccaagagcccaccccgtcgccaagattatccataaagtttttattttgtttcccagattcatcatgttattctcgctaagcrtggaaaaacttatatgaaatgtgttamwctataagataaatttgaaaaagtcaattgattgaatctgttcaacttaagctggtaataaattcactggctttatgatagcttgcctacgacggagtattaggtaggttctgttttcagttcagaagctacaggcactctgattctagctttctccctgcaaacaatttgcaataaagggtgtcactggcagattcaaagacaaacatgacacaaagcctcattatttctcagcaccaatcaagagtcagccattcttctaggcatcgtgga

SEQ ID NO: 782 - DNA, 600 bp, Bovine  MMBT05483
acccaactctttcgtaagtggcaggctgatttacagagtagatccctgctctcaaaagattcatgctgatgcacatgtccaacctccttctacccggactttccccatttattcgtaaattagagattgaaaatcaaaatgtgtggcctacctgaagctacaatcagcccagattagactagaaaggtgcctacctgaagccacaatcagcccagattagattagaaaggtcaattgttttcttttgtcttcattgccaaagatggattgcttttagacaaagtatttgctcatcctacrctccttgagtaagcaaaaaacaatgccctactgcataagcaaagttaggaaaactaaaacttttgtcagatgtctacaatgctgcttttagttttacttttagaggaacattatagtaagagcacattttgaatctccttttctttgtaagccacatcgatctttatgaacggtaaaattgctggtctatgttgcttttgaggaatttaagtggggatagaggggaacatgattatttaaacataatggttcatttaatgaattctcttcattttggaagtaatcaatctgatgagcctt

SEQ ID NO: 783 - DNA, 600 bp, Bovine  MMBT08301
cttgtgtacaaacacacaaagctctttttgctctggaatagtcttttgcccaaataagtgaagtcctccaccacatatgtctctcactcttctatggcatttaatttgtgcttctcacaatacacagctactgtctcctaaaaacgcctatttctattcataacattaataataaaaataacatttattcctatatctggttgctctgaccatgccatttcatttttcctctcagtatcacatattatcacaactgattccaaacataattctagatcactgaatcaaagtcagaatctrtgcaattcttaggtatctctagctatattgatttctgccattaaccatgctcaaactcccatttcctatctccaagctttttttcacttgctgctcatggataaccttattttatattggggttccttttgaaactcatgaatatataatgagaggaagagatttgtaagaggagagttaatagttgtgtctcatttcaaacaaacatttgttaattggcttcaacacttttaacaaatataactaaaacatatgacttagatttcttgaaaggcaagatagagctgatatttataattc

SEQ ID NO: 784 - DNA, 600 bp, Bovine  MMBT06079
agggatgaaagggagactgtatacctgagtttaattcgccattggatctcttgtaccagaaaaaacacatatcaaatatccaagaagtaaaattgatcactagcttaatctggggactcactataaggaagggtcactttgactagaacacagatacctacaaatacaatgtgagctgatttcttggcaacctttaaaatgttctgggcagcacaacttctaggtctgtacagttgatgtaagtataattaagtagtgaaattgtatggtatatacctatatgccaatagtgtatacctrtatgtgcaggatttgctaatataaccatttcaataaaaacttattgaaaaagatgcattggccacatggagtgctgttggtggaaacctgtatcagtgaggactctcttggttgcaaacgactgaaaccccaacccaaactggcataagtaaaaaaatagtgtggtgttgcccaaatgctaagtcmaaaaaaagtgtagtgtctcccaaaagctaaaatgccatgagtgtgcgtatatcacttacggaatgttttggccctcaaatactgaaaccaagacacatctgctagttatagcct

SEQ ID NO: 785 - DNA, 600 bp, Bovine  MMBT06050
tagttgagcagaaataaataagcgctaaccactgagcagaagtttgctgagatgtagtatttaatgctctgaccctgtatctattcaggaagatctgctaccctggaaggaaaagaagggaaagcttccctttcccctgcaagaccaagcatgctcccacacccacacccacaccccctccacatacatagaagctttaatgctgtaaaaaacaaatggagggtgggacagaatgaccacctcctttctggagaatgtggatacatgtctatactcaagtcaagcagcattgaggacctrtggtccagatatgcgccccaaccatttactggcttttaatttcatctctctcagacctaaaaccaatgtccttcccttctggtattgagagataagaatagttctcacttaggaaatgcaagtckagagaaattatcaatgccttgagacccaaattggcttctctctccattgacagactaaaacatatcacctgcagaaccagcgagtacagtgttcttttgcaaagggccagatgtttttgtcaataatttactctgacagtgtagaaatagctgggctctaggaaaagagatccag

SEQ ID NO: 786 - DNA, 600 bp, Bovine  MMBT08318
gcccttttatgagcagcgacagctgggcgtgcacgtgtgtgcacgcgcacacatgcgtgcgtgcaattgacttgctaaaggtcacccagctcagtaccacagaccccccccccaaggtctccccagctcccagcttagaattttccaaaatagagctccaggggggcttatacaagcagcggccagagaaaagaaggaagcaggaactagaaggttgaagaggacaggggggtggagctcctgcagcaagctcttaagctccgagacaaattatctccgcatccctgagaaccaagcacrcagtgggtgctcaataaaagtttgatgaatgaatgactgaggctgggcggctggggagggaggggaggtggtaattgatcaagaaaactcgggagtcactgctcccaaataagccaagaagacagcagctgagaagcctaggctcgaaggctgggggagctggggagaggctgcacagccactcgagctcctgcgcctgccctagagcagaccgtggaacctctgtcccagctggccaagagcatgagggtgactgcctgaagagaaagcagggggctattttcccaaatagttctttaa

SEQ ID NO: 787 - DNA, 600 bp, Bovine  MMBT07572
caggaagccagggccctctccaaccagaactgctacggtggtctgacatcatcagtgggaaacccaaactcctcttgagaggcgcttggatgcctggacaaggagaggaaacggccagagacagttcccattttggtctgcagttcacaccaggctggggacaagggcagaattctcaggctacacaactaacatggcagctggtttctaggttcaaatcaaaagcttaacagaataatggtctagtcaatcaaacacaagacaagtaccgagtcacatgaaatcccacatccatcactratctaccaactgttaatattatcccacatggtccctcctacagggcaggagactgaagactatggaggtggggtgacccgctcaaggtcacacagttgataagcagcagagcctgtgaaactcagagagtctggaatccactcctaatctttgctgtttccacccctcataacacacggaagtgggaaacgcccctgctcaggaagccagggaagcggccatcacactcacctgcacatctctctggacaagggtcatgtccacgtttgtgctttcatcccggtttccctgaaaggaagc

SEQ ID NO: 788 - DNA, 600 bp, Bovine  MMBT06849
tcttttcacctcttcaataaatgttctttaaaaccttgaagctgcaaatttagtttatttagtttacttaaatggcttgccatataatctaattggaaaggctaattttattgtcaaattcattagtcccatatgatatactttctgccagaaaatggctaacttgttatttctattcagataagcatatattttctcttgacaatgacccactgctgatgaactaattctaaaatagataaggcagaggccctcaccaagaatttgtcatttagattatttgggtcacatagcacggarcatttcttaccaaagttttctttgcgttscttttactgtgttctcaaccaggagcaatgcattttctgacagtagtcaaggaatggaacagaccgagctttgaatcaattcaaaatcmtcactcttattgtctcaccctgtgctatcttaatccggaacatcctgataacagaccaaagtacacgatttctcatatcactcttcatccttgaaatctaggacatcctgctatgggtttggttgttttgtaaaacggaggttttgttgatatccaagtgtccatttgtttggagacctcta

SEQ ID NO: 789 - DNA, 600 bp, Bovine  MMBT06826
ctggtgtccctgaaaactctrtttacctgtttgggttttaggctgaaaattctgcctgtctccctatagaatcttaatatttacttcgacattgttggctatatcaaaagtaacttgacttgcatgctctgctagcttaattccctcactggcggtagattctagtgttggcttgagatatacataacaaagtactggggaaaatatttttaaaacttactttcttaaagagaccatatttttcatgtcagatttttcaaataagatgtctggccagataattgaagctggctgttatcrcacaagagaatgtgttcaagtgataattgtcatgattagaagcctgtactgcatttcagtattaccatttcctgtcagtaatcatgctagtctggaaagcaggcagtgaacgtttatttggactgcaggaatttttaaagacagataacacaggcacagaatactctatgaaagacacacagagttaaaagtatttgaacagatacataggtatttgaattatgtcctggagtggctagtggtttatattagcttgtcaactcttagattcatcacaactctttcagattcctctgagat

SEQ ID NO: 790 - DNA, 598 bp, Bovine  MMBT10418
  misc_feature (1)..(140): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaatctctaggtcagcaaatacccaaagattatcccagaataattgctctaataatcgtgattttataaactggtgatcagtttaactgagtataatgatttatgaataactatttgaagaggtaaaaacaaggcaatgtaggatttcattttgcarcatatccaaayatgctttttccttattaaccatgcagcaccaaatgttcacygttaacatatttcattcaacatcttagtgtatamattattgatggaatcattttaatagttccttagttaaaattcaagtatgaktttcatttttagggcataaagtgcttgttctggataaaagcatctaggttgtcaatttctcctgtaactactggctttttgtgtagttttacgcagttttagccaacttggctcagttctatattctctgtgttgcgttcagtggctcagtcatttttgac

SEQ ID NO: 791 - DNA, 600 bp, Bovine  MMBT08633
agaagcagtgcagccaaataaattwaaaaaaaaaawwwttttttttaaataaatctgactaagctaggaggaaaagtctaaatatacagacaacaagagctccctgtgccagacaaggatctccagggaagcagagaatcaacaggatataggtatatttgcatgaagacatttatattaagggattggctcatgcaattatggggaccagaaaatccaacatctatagggcaggtcaacaggccagaaagtgagtcaggatttctttgttacagtcttgaggaagaatcacttttcttrggaaacctgtttttttgctcttaagggcttcaactgattagatgaggtccatccacatgattgagagtaatctcctttaaagtcaactgactgtaggtgttactcacacctacaaaataccttcacatcatgtctagaatagtgcttgatgaaacaactgggcactataggctaggcaagtgaaagtgaaagtgaagtccctcagttgtgtctgactctttgcgaccccatggacggtagcctaccaggctctgcggtccatgggattttccaggcaagagtactggagtgggctgccat

SEQ ID NO: 792 - DNA, 600 bp, Bovine  MMBT10561
gagaatgtgctcgagcatctctcagctcacgcatgcaccccggcccagctgggagagagaatgcaggaggagtgggcagcttcccttgagagggcccagcagctcagtgggggcgggggcagacgcccaggggccaccattctagatgcctgcactctggaccccaaggcctggcacgagaatgttcccagcctgctctgtgcctcctcctctgcggccctctcactgccccccaacccagaggcatcccctgaggagtgggaacaccctgttacagctccccaggaggtggggcrcccrgcacaccgtgttccagaggccagggagagcgtgttcggcctcagggcggtggaccgtgtgtgcacacctgctccaaggcccagtggcttggcaagtccctgtcggggacagccacactcagccggacatccagctcagcaaacctkgagatggccagagataacaggaactcctgggagactccagcctgccccccttaccagaggccctgcaaatggtccaggagaccctgacagcccacctctctctctctctctctctctctcaccggggaaagagcaatagcagaagcagtgggct

SEQ ID NO: 793 - DNA, 598 bp, Bovine  MMBT09844
  misc_feature (1)..(76): n is any nucleotide
nnnnnnnnnnnnnnnnnnnnnnnnnnnnnnnnnnnnnnnnnnnnnnnnnnnnnnnnnnnnnnnnnnnnnnnnnnnntgatgacccctcctgggtctcagcctgcagatggaaaaacctctgtcctagagggtgggcattctcagaagagctgctcttgatcagaaaggcagtttgatagctgacctcttccttgagaggcacagtgagctgctgaggtcagccctggtggcttttcacagcccggggacgcctccatttcatccaatttcaaaccaacacttcttgtcaaggggctactrcactggcctctgctgaccactctggcacgacgccagatgggaacaatgcacccccttctctctgcagtccctcrggtcagctcygagaggaccaaggctccgagtgagggtggggagagcaattagggaggaggaggaagagacgtgaattttcaaaggtcagttgsagtatgatcagccaacgcttggaggtttattccaaaggcctttcctgattagaaaaacaacaataaaagaaaaaaaaaaagcccccaacccacaagtggggtaggaagtcgaagaacactttaattcataa

SEQ ID NO: 794 - DNA, 600 bp, Bovine  MMBT09465
tgcagaagtgctgtgaggccccgccccctttggcctcagtttcactagccagagaaatgggaggaacagtcttgtctgccctttgcaagaaagtgtgaatcagatctaaagtccagccacagcagaaacaccggggatgagcttaaagtagggagaaacaacaaaaaactgtaggacaagcttgaatagatcaaaggttcaatcagagtgtccacctcagacttgaatgtgcgtgaggttatttggggatcttaaatgcagatttaaggtctgggtggggcctgagactctgcgtttctracaagcttcccaggcgatgttgaagctgcttggctggtgactgtgcttggaatagagaggaaataaaagaactcaaatctggttctrctagtgtcatgtcccttccccaggctctgccctcagagattctcaagttattggtctggggtttggcctgggtatggtaggtcttcaaagctactcagatgattccgatgtagccaggggggttactgaattcctagaccaagattttgggcaaattgggacatggggactatctcatttccctcctgactccatctctttctctcctttctt

SEQ ID NO: 795 - DNA, 600 bp, Bovine  MMBT10218
tccagccttgtttagatccaccagaagtgttgaatatatggactttcatgacgttacctaaacacttggccttcctctcaacatcctaaacatttgcttgtgaattttcttgatttgggatttatatttctgaagcatacacccaagggaagggattcaggactgtcctcacccacctctgtccatggctcttttccacaaaaacrcctattccttctaggtcatccttttgttcactgccttccctgctggtctacccagctcctatggcaaggcctccttcacgccagacttcctccragaaatcactmtggacccctcagcccatcttctcctgcccatctctgaatacatctgggacctgatttcatctggactgctgctctggttgtgtcattgataagttagctgacaaagacaaaatgaagtctaatacaaaatgaaccatccgttgattcataaccatacagcaarggagtctctctggtcactttcctggacaggggttcaaggaaacattagaaagaagcatatacattatgaagcgaaaaggggagctactgagacagtctctgattcgcaaaggctgatcaaggtggg

SEQ ID NO: 796 - DNA, 600 bp, Bovine  MMBT06276
aactcagagaaggtggtggggccagagttctgtctgcaagggacaggggacaaaacggcctccctgccctggagtcccgcagggcctgtcagcgtcaatgccccacaaacgcccttcctccccgctccgaaaacaaccgtgggttcccagcttgttcctgaggaagcctgcctgggctactgaatcctggaggctgccctcgatattcaaattacggagcaactttcacttccacttgaggaccgaggcttccactctgccagcagggagatagcatttgcccgaggccatgtgccttcrataaagcaggttcactagcccttcaaggtgtctctggggtgggactgctcttccctgatgctccccgcacctcccagactttcaccgcacttcccctgggtctgtgccccaggcccgctgctcccttgaccgccagtcccctccaagcagcggtgacctgcaggaactgctgagaagcctcggagggtgggatttccagcaaatagggaaggagtctgacaccctgctggtagattcttgcaggatcactctcctcccaggagaaaaagaggaaaaaaggcaaatcactttcctcttgct

SEQ ID NO: 797 - DNA, 600 bp, Bovine  MMBT08083
cagaatcctactccgggttgtctcggaaaagctaacctgtgtgtgctgagggtggggtcacatccaccctcctgcctccagccagggacccaagacctcattctccacggcagataacgcctgtcttgcaaacgggagaaaaccgggcacccaaaaagaaacctgcaacgtgcgctctgcggttggcttggagggaatcgctcgcaggccgctggttctgcagccctcgccccactctcctgggacccgctcctgcagcgatccgggcgcttcccaaacaccgcagttttatttaaccarctcaaaaagacgtgaacttctcctgaagagtttaacataattggaaacatgcattctggcaaggagggacggagaaattcttggtaacactccagcgaaaaggccgatctatcaaccgctgggtctgacagaggctggctcactgaagcccagtgagctcccgagcgagatggagattgggccgtcgcggggtggagccgcagagctgcccaggaagactgcaccgagaggtttacgaagaaagaagactgcaatcggtttccctaaaccgacagtaaactcttttccagtgagaaacgg

SEQ ID NO: 798 - DNA, 540 bp, Bovine  MMBT07791
atcagaatcagtcaaacgggaccctgtaggtacctagaaacacattttcagtcccacttacaacaaaagaacaacagtctttaaagtgctgcaaaaaataataagttatgttccttgtgaacaatcccagaagaaatgccattggagacataaactgctttactgtgactatgtgaatgtcctaggaagactgccttcctattccttaaagccctcttgcttcttgctttgaacaaaatggattagattgtttaagaagcaggagcttggggtctggcagggaagacaggtcgggctctrctggtgatgcatagcgagaggcagctttacatttggggaaactcagtatcctcagttttatcacccaagtcctctctgagagcttgggagagctctgagtggcgccagtcactggcctcttgtaggatgtggaagcacaaaacaggtagactctggggtcgatggagggcttaaaaagccagagccagatttttcactcagatgattccatcaggagtggatagactagagcaagggaca

SEQ ID NO: 799 - DNA, 600 bp, Bovine  MMBT10744
acatttaaggtttttatggcctcttgatgaatttgccctcatgtgatactaatatagccactccagctttcttttggttagtgtgaacatggtatccttttccatcttcttacttttaacttattcatgtctttatacttaaaagtgtttcttgtgggcagtatagagttgcattctttaatcctcaaactctgctcagatccctgggaccttcaagaactctcttaattctccaggctacccatctccttataggaggctgtgataattagagcatcattcctcataatgagagccccrcctgccttctatcacttccctgccctgcgycccccaggaatagcagtgaattgtttccacttccccaggacagtttttcagaaaacatggacatccaaacctatggcaaatccttaggcagtgccagatccagccacactggatcaagcaggcccatggaagattacccaaggctacttaagaagtaccaaaggctaccttggaaaaagtaagtgtgggggagaaggaaatagaaaactaatttctaagaggaaggattttattgactgaaaaaaaaaaaaaaactcacatgtatttttt

SEQ ID NO: 800 - DNA, 600 bp, Bovine  MMBT10219
tctgactccccccaccccccgcattccttttctctttttcccccccttttagtagtcaagggaaaaaaaaaaagagcaagcagagctgacaggtatcattcagccgccctggcttgtgaggggtggtataaatgaatctcagggctcctggcttcacatgattcaaacatgcgttattgaagatggatgttccttaaaaaaagattgatggtggatgccgggcttagggtgccatttatcattttgaatattatttagacttgccrtgtaaacctgtaacttgagagttggacgagccgrggctgggtaggggcctgtgtgtgtgtgtgtttccatcgattggccttgggttatcattgctgctgaccagatgcagtccctcccatttacagtatagaagacacccccctcccgtaaaggagggacggtttaattttgaataatttccaaggacactggggaaaatgaagtatctgtgatttacactaacaggcaacttctttctctctccttctctccctctctcttccccgacagaggcagtcatgtacgaaacattaaaatataaacagagccgtagttgccgaagccaggaccctt

SEQ ID NO: 801 - DNA, 600 bp, Bovine  MMBT06305
cagatagagaggctgccactccatcatggggaattggaatctgttccagtcatccatgattactgtctttgattcctcaggagtgcagcagacaaagagctaactaagctgccctgggtgagarccccgcaatttaacatggaatataagtctttatcaaccaaacaggtcttctgagccagaagccaggcaggcctccagcctgcgttttctgctctcgggcttttacttgggcttgttgtccagtcctttgactcactggacccctttcactgctgtgatcccttaagaattgcatcrcagactgtctgttattgctgccggacacaacagcaccatcacccggtccttatctccagccctgctctggccccctgccagtctggtgcatcctcgctctcacaggtcatcagcaccagtctccagctcacctgactctgtattttccattgtttttcccagataccatagtcattattggcaagactgggaactacagtcttttataatgtataccacctgaccatctgtagccatgtctcctccctttagaagcttatatttacacagacaaaatatcacacaaaataaggaccttac

SEQ ID NO: 802 - DNA, 600 bp, Bovine  MMBT08466
cttagagaatctggttgtattttaaaggctctgacaagtcctgcagtaagcaaccggtctcacttggagcccaggactccaaatttacttgcccacgaactgttttaacacctacaaacagttcttkccttaaacacatcaagtgacctttccccctgtcccatggcggtcctgaatatcacccttgttgggattctaacrtctctcttcttgttttgtccccagattgcctcggctccccagtgtttactcctatcaaggcggayataagtggcaacatcaccgtatgtacttggcctrgcagccccagtacccagatcaggattctaatcccaccctggttaccactgccctgctacccactgcaagctccccaggctaaggaacagaaggagacgtggaaaacaggcctggcccccagctcctctgactcaaggctccaggttcttggttctccttgcagtcatgccatccagtcacagccaaactgtgattcacagtctggagggctgacctgagaaggaactggctggtacttggattcactccaccaaacaaaaaataaactccggggtccacagttgcactgacccagccctt

SEQ ID NO: 803 - DNA, 600 bp, Bovine  MMBT09910
ggactgaacctgggtcttccacatcgcaggcagattctttaccatctgagccaccagggaagtcttagctgattactaagcctcagtcctgggctggggtggatattcctgcttttgatgtgggtggtttcctctgacaccgcaagggaggtggctccttatcactggatagtggtgacagtcctgactctccagtggtcatgttgtgacaccaccccagtgaggtgttgggggacctcactgggtagaagtctaggctccccaccagggctttgctggcatgggtagatatgggggccrccagtgtttttgagcatggtgtttggctggggcacagcttttattatttaaatgtctgctgtcttgctaggctacccctgtccttgggagagyaggctcttgttgggggcacctttttcatctatgccctttgatgttgccaggttgcttgcttcaacactaagcatggaatggctgaaacaaacagaaataagaacaactctccaccatgtttttctgtgggtcctgagtttcctagctggtctgtcttctgttctccacctttcagggtcttcttaagtttgttttaaatctaacgtc

SEQ ID NO: 804 - DNA, 600 bp, Bovine  MMBT09876
gaagttgctgattgtttagtcgctcagtcgtgtccgactcttttgtgactccatagactgtagcccgccaggctcctctgttcatgggatttcccaggcaagaatactggagtttgaaatggcaaaaaaaaaaaaaagaatactggagtgagttgccctttcctcctccaggggaccttcctgacccagggatcaaacccatctcttctgcattgcaggcagattctttaccactgggccacctgggaagccccggtttagtagaggtgggtctaaaagaaggaccttttctgrctttcrtgagtaattaaaagctgtgtatggtctcccaaggcactgcggtgaaagagctgtcacaaaattagcttcaaaggtggtggctttccccagatgtttgcttcagatgcttggcttctagcatttaaattcccattaaggagctgccgtggctgcgggcaggccaagcccactctttacttgaaagggatcaaatccttggccagaaatttgacttgaattgtgattgttcttattcatcttgaaattcattgaaggccataaatccactcatcctgcctcattctcttaactctatgaaga

SEQ ID NO: 805 - DNA, 600 bp, Bovine  MMBT10697
gctaccctctgatatgattccccttctgttctgggggtttgtatgtatgtgtaagatatatttgtttattgtgtaatagttttttaatgcaaaacttggggggaatggcagggagagcagtatattcattgttggatacatccaaaattggccacagagtagaaaatccataaaatattaaactaattttttccaattacacggtttctattatattagataaaaggaactgtgccactttgacattatgagcaaaactgggttatttgagtaaccagagagtctttattagaatttgtrtaagtataaggccagagtctatgtagacagagccttaatttctaaatggttcatttatatgtattactttttgaaaatcagcaccaatttcccacagaaataatgtcccatatggscttcagattcccaggccagcccaacatatctgaatttgaggactgatagtactataaaaacgaacctgtatgtttaacaatgtctcaacaagaatacgcactgcattcatcgggtacagagagattatgagcacaatcttgaagatggtgtgttggggtcatatttgttcacaattctagcaag

SEQ ID NO: 806 - DNA, 601 bp, Bovine  MMBT06566
  misc_feature (1)..(1): n is any nucleotide
nctcccaaccttgccttcctgccgtggcaaaggcaatttcctctgcctggaaatcttatcaggttttcttcatctagctcacctttaggtctcagctcgaatgccaattcttcaacgaggtcttactgaccttcaaatacaagttgcttcacttaaattttttttttggsggggkggaattctgtattattgctttcttaacatcatcacactgaagattcatctgatgcctgcctttacctccagaccacaatctcctttaataatgaagtatacttaaaagtgacttttaaaagtgacrtagatcattatctgggctgcaaaacctagtgtttcctgtgtggccctctgcagagaaagtatgccgacccctgggtatgactgtgttgctctcaggccagcgggcaccgttcctaacccagaagacacacacagtccatttgtcacctggatgctgagcagtacagctaattcatctcttttgacacagtcatttcctgcattgtatcacctcagctggcttatttctttacttgggatgaagcaaggagacatcaagccttctcctttctatgattttgcactgcaaatctgctcttat

SEQ ID NO: 807 - DNA, 600 bp, Bovine  MMBT10667
ttactgtactttcctcacttctttagctcctctcatttctgttcacaaatcggaatgcactgtaattcaagggagaatttaatccacaagaggatagttgcaaatatgctctctctggactttgctaccaacattattacttatgtaaattgaaaggtgagcttggactacatcagctgacaggtggatatatgaaaatttgaacacaccatgtgatttgaataaactgtctgyatagaatacacagaattttgtattgggctgtactgtatgttcacctacttggtaagaagagcaacrttatttttagagtctaaataagtcaataaataagttgggtggaataaatctaggaaatgcatgaaaacaacactagagtcctctctcccatcctcttccctataaaacattaaaataacaaaatcaaagactgtgataatgattattttgtatcccttagattgagataatgagcacacccaccacctgcaaaacatcctcctgcccatttatagtctttctcaccaaactttccccacacaagactccaagtcaccccagttccgtccccaggcatcactgatctgtattctgttgtta

SEQ ID NO: 808 - DNA, 598 bp, Bovine  MMBT05505
  misc_feature (1)..(114): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgatttatttgatatctggtgaattaatggcccctaattatgatttgactccctattttgatttacaatagtgataaaaatgggcttgtcatgtcttagtttagttagcttgagactatatctcaggacctgacgattcctggacactagcttgaaatgggaaatctctggacatttaaagtrgagatcagatcctagaaagtgtcaacsgaattggcttatgacccartaacttctgcccagctctaagtagtattccctagacaaaatgccaccactttttaatttatccttctttccaagaatgtactattaaattaactaaagtaaggtttgtgaaaagtgmttcaccagctaaaaaacatattagttggattaaaatattatttatcatttgggggttatatttatacttttaatgtgaaagataatktatttcarttaatttcttagtgacaaggtcatctgtcagctttargta

SEQ ID NO: 809 - DNA, 600 bp, Bovine  MMBT08401
tgttgactgcttattttcatttaaaaaatttcatttatatgagagattatgaccaatgtaaaagagaggaaactttctaccttttaccaaataagttaatcagattttactcttctccatagaacattttttgatagcaattagcatctgatggaaaataaatataaattcataagacattttatcaaaatttgtatataaaaagtttataaaaatccttgtgggaaatcaataaggtatcattatattaactttcatttagagtaaagcattaaactatgattattgagaacacataartattttatttccaaagaaagaaatgaaaaggggcaytcacaaaaacagttaagaaaaaagaaagaaagaaacaaacaattttagaagtaaatattcagttttagcagaagataaaaattacaaatcctaaacaagtgtagattctgaataaaagttgtgaattacagatagagatttctgtattgtawaccactactaaatttaacttctaagttatatgatacttcatataactaaagtcagtttcaatggtaaatgcatttgtttctgtcattaatgttcaaataaactgcctttcag

SEQ ID NO: 810 - DNA, 600 bp, Bovine  MMBT09853
agtgagtttaatctgtctgtaaaatctgcttagtctacacacaaactaaggaaggacaactgcgaataccttcaaacaaatcgccatgatgcctcaagtggcttcaaaacttagtcaaaccttcaagtttcaaagatacttaaacttcctatgtccattcttcccatcttagttctcccaaaatacgggtagttttcaccggtaagtactggctgtttatacacaacagagttccaaactgtaagtcatgtgatacgttttggycaatgcagtgctgcttccaactcgaagcgacartgrcttctgtgtctcgtttacagcaagctaacacaaccaaacactacgtctaakgcacagcrcaatcattcaagctactggacatgctgcttttacttaayaactttacctgtttctgaatgatttcactttgattagaagcttggagggtgtgttcccgcttaatttctatctgttgctgcttcttcttttgctgctgatccctgagttgctgaaccctctgcaactgctcttgcacactggctgcctgcactgcgaccacattctgaatgtggtgagtctgcacagggctgctctgctgaa

SEQ ID NO: 811 - DNA, 600 bp, Bovine  MMBT05571
cttcttgtcctgcctacaggtttctcaggaggcaggtaaggtggtcaagtattcccatctctttaaaaattttccacagtttgttgtggtccacactcacaaatagtaacatgacaaattaatcatattatttggatttatattctcctcctaaatttatttgtcgtcctttgcatcttaattttttccttttaagttcacctactgctacaaatcgaaagctaaagacaaattggtaaaatgatgagttcattaaaaagagatacatacagtttagtccttaactgcaaagcactatcrttatgactatacataaaaacacaattatatttcaatgaccactgttgttgctgttgtcgtttcttcctgaaccagatgtctatatttcaggcagtctgcttgaaatcattattaggtttggaatgaaaatctctcgttgccctgatggctgtgaagtctatatcttcatatgtaatcttccagaatgctcttggagtctggccacaagttagggctactgttgcatcagctggttgaagctaagggattgtaaagcctagtgctggggaggaatttgctaagcttgtcctgtggtgtcag

SEQ ID NO: 812 - DNA, 598 bp, Bovine  MMBT06249
  misc_feature (1)..(12): n is any nucleotide
nnnnnnnnnnnntccctctaaggtttttattctttctcctcctatctcccccacaccccaagtcccagaggaacagaggaaaagaaagcagcaaaaagctctgagaagaaaaagraactgatggtaggggccagccagagagtcggctttcagagctggtgttccaggaggtcagaagcatttctctgtacggtttccctcacctttgtttgtgtgggtgacttagtggcggggaagcagagagattaacttgttatccccatgcagtttggtcagtagctctataggaaggccaataargmggagacagtcccaatcatctgctgagctctatttgcagcataaaggagtaatgagtagaactcttgctattgcacttattccagcaattatgtgtataagaaggatgaggagctgtgggcctaagagagaagggagggggccatggaaatcacacagtgtctcyggggctccccagctgtgtcaggactgaaatatgaatgtcatgcaggttggtgacttccttgtggcatgtacacattatcccacccrtgccacaattaagtcacattcagtagcacttcattattttaattaa

SEQ ID NO: 813 - DNA, 600 bp, Bovine  MMBT05578
ataatttgacacagttggcccctccttcttggacatacatttttctcttagcttccaggaccctgtacgttcttgattttcctactgcttcacattggtcactcctccatctccttggctggatattcccttttctctgccctgttaaggatggagcacttgcgactcactccccttcacctcgcctgatggtctcatccaatttcagtaatatctgtatgctgatgattctaaagtagttcacccttcctgatctctcccctgacataccggctgatttttccagctgatgacacaacrtctttgggtgtctaatagtcatctcaaaatgaatatataaaacaaaattaacatctttattttcactccacagtttgttcctctccctggcattcctacctccattctgctcttcaggttgttcagaacaaaaactttagagtcattcttaactttttttttctttccttgtcccctcctacatcctatcttagaaaatctgttgactgtacctacagaacatacctgaaaccagatcaattttaccactgtctctgctactagcctggtctgagttattgaagtagactcctaactagt

SEQ ID NO: 814 - DNA, 600 bp, Bovine  MMBT06645
ttagattaggcttctgttaaacatcatacatacatcatcttatttaatcttcacaagtttttaacattggtccattatacccagtattatacagacaaggaatccaaggcatgactggctaaataagaggcccaaggtcacacatctggtaaatgatgatcaaaaatacaaacacaagttgatctgacccagaagccaagctctgccaactctgtgcactgcctcttttgccagactcactgggcgattcacagaaattctgacgtcagagacacytaagatatcttttagttcaacacrtgagttttacaaatggagtctaaatgaactgccccagatttcatagcagagccractctacagacttctaagccagtatccatctccactaatggagatttggtttattttttttatttttatttttttttaggttttaaaaaaawtttttaataaaataaacagcaatcattttaattctactgtagaagaattaccaagaattattcaagatttaattgcatcaggataaattaagcttccatgtggtttaratacaacagatctttgcaaagctaaaaaagcttactgactgctaaa

SEQ ID NO: 815 - DNA, 600 bp, Bovine  MMBT06644
gcatggatctagtcaaacagccccagaaggcttgggagcgctgcatgtattgctgccttagaaggatggatgggtaccgcaaacttgtgtcctggctctggagcaaacagcatctagttagcatcagatgtgacaggcgcacaaacagagaaaaaccaagaaaacaaggtgttttcctccacttcactgtgggactgaggtgcacacagtcaacccaagacattaggaagtccaattgcaaggtgactttgcatgagatgccattgtctaaaatccaaacactgatacatacttgagaargattttatagggtaaagttgattaataactggaaattgagcattcccaaamcagcaagatcaatcagctgtaataatcattgaaataactccagtgaaatatcactgccgggtaatggagcatattgctcgcttttcacaaatgactccccacacaaatagctagaatgaaatcagctgggttctatgaatttgtaacttcggaacactaccttgagcactcagtcacatcagacttggctgtgaacagctgctgcagaagcccattcagtcgtactgtgaactcactcacgccgtgcag

SEQ ID NO: 816 - DNA, 600 bp, Bovine  MMBT10275
actcaccaccagcaatgtacagacctcaggaactggaatcaacccaaatgtattcccagatacacattgttggtgtttagtcgctaagtcgtgtctgaatcttttgtgaccccatggactgtagcccgccagtttcctctgtccatgagatctcccaggcaagagtactggagtgggttgctatttcattctccaggggatattcccaacccagggatggaacctgtgtttcctgcattggcaggaggattatttaccactgagtcacctggaaagccccccagatacatagtctttaarttaaatcctcccttgctcaagaaccttcaaggaccgcccattaccttgcttggcacatctcaractggaacccaagaccttttaataccagtcctaagtgtttccccagctctctggaaagaagtgcatggatgagatttttctcggtgttgagtttttcccttatccattcttctaacattattggcatagactcccacttagccggaaaaatccttgagataaaaggggacagctcacaaacaatgagttcactggttgtggtttctaatgctctactgaagctggtcccatctcagc

SEQ ID NO: 817 - DNA, 600 bp, Bovine  MMBT09168
acagaatagaaggcaggaatcagttattttaccatctggaagtaacttctggtctagagcagggatcagtaccctgargtccctgggccaaatccagcttcccacctgcttttgtaaataaagttttattggaactcagccacactcattcatttaggtactatctctggctgcttttgtgctatgatgagttragtagttacaacagagaccataggcttcaaaaagtcaaaatatttactgtctggtcctttgcagaaaagattttctgaccttagtctaaaggagtgtgaaggcttrtatctatttcaaatattacataaacaattatacaatattttaaacccttgcctcaaagagtatctgtacctttacctaaaagaagaagaacaatgtaaaatttagtccaataaacagttctttcttaaactttttaattgtctattcatgtcagctgtagtaaaaactggtaactccttttctaatacactccccaaactcctccaaacccttaaaaagcatggttagccttcccataccactctagaatttgaagagcttgatccactactttatatacatgttttggtcaaagtggtt

SEQ ID NO: 818 - DNA, 600 bp, Bovine  MMBT06504
ctgtgcttggggtagtgacctgcctgagaattcagtcttccgattccctccaggtaaatccctttgatgaagagccaagcatccagcttcctctacattccaatcagacagctgcctcttctcgctcagattccaggctgccttggctgtcttcagataatttgacttcccacgtagatttcaccacagggagagaatgtgcttgaaacagagtgtgtctgatctcctggccgattctacttgtcgttgtaaattaataaaatggcgttttgatttacacatctgtctcttgtgaactcrgttagtatgactgaggggcccgataaactgatcttgccccagcacgctgacaaaaccaattttctcagggtttgaacctggaaaacaaaagggccagaccctggacggtgtggttaaatcaccaaggtaaattcccctttgaaatgtctggcaacgggacagccagacttccctctgctatcaaacacattttttctcctggactttaatctttcaaggtgaatgctccctgttcaaggcccactcagatgattgattccatggtgataaatgtaggaaatgggaagtttgcccctactc

SEQ ID NO: 819 - DNA, 600 bp, Bovine  MMBT08766
cagctgggagagggtggaccaggcaggcatgttagatcatcagagcagccagggctccggtgatgagaatatgaattatgagcagcagagggaagacagtgggaagggtgccgaaggactcccactggtcagtttcgggaactggtaaataacagaaatgaaggagtggctaggggaaaatgggggaaatattttgttttataaaataaggtaaatcaagcaagaggaacaataaaaacatccttcttccacccagaaaatttaagtgaaattagtattgtgcaaagaaaacagttcaargataaaactgaattacataaattttgcaaaggagcacagaacagattagaggacaaaatgacataaatggaaatccaaacaatatataacagccaccagaggaaagggaattaatgaaccctcaaaaattaggctcgtgaagtgtggagtaaagtagatgaaaattataaattttcttaaagcaaagccattcatcatgatggactcctaggcaagttttaaattctacatggtatcaataatcagtaaaatatgcaaaacctacagttcatttttaatttacattttagatcagccatt

SEQ ID NO: 820 - DNA, 600 bp, Bovine  MMBT11317
tgattgatctatccaaattcatagcaggagcacaaataaggatttgttgagataaattactgtttggcagggagattacataaggcaatgaatttgcctttgggtgacagagtatgtcgggggaaaaaaataaaaacaataacaatgttttaaaatactatttatgttacatattaagtccaacttcttgtgaagtgttaaacacacaaggtaagcttcagagcctacacactcactgttctctgtttcctgggaaaacaaagtgtgtgtaacctgacctcatttatactgtgtgggtgrcttgggtttgtttttgtttttttccattttcyctttcactagtgagtgctatctattattcactaaggctccagacttttctgcaagatactctttattcctgattaactattcatatagtagaagatggtttgcttggccttttacaactttttccagtccattatcaatatcaaatcatgttccaatagccacatcactctagcaaataatactacatatgaaggaaacagtatagtgaggagatagtatcgaactattttaaaactacagtgatgatacatatatatacattaaata

SEQ ID NO: 821 - DNA, 600 bp, Bovine  MMBT10743
atgcgaagtgtctggttgtgtcattagtgttcattctggttgttgactttggctactttccagacacaaatttcatgactcaagaaattgcttcaaaaatacaaaactgtaatttttccagatattgtttcattgcctgccaaatcccagacatgaattgcaagggaaaaaggcattaccttcataatttagggatccttccctatgtgtataatctgtcaatattatttgtagtcaaatcatagtttttgatttttattatctcattttttggcaaacacttgttgagtgacaaacacrttccagactttgtgagacggccagagtttatttagccattaccgtttggaggaggcacggaggccttttataataatgtgttgttatccattccatgatgtagattggaataagtgagcagcagggtgaagaggtgcatctgtcacagggtgcagagatgactattgaaaatactgtattcaaatcytagtccagattgtgttaacaaacaaaaaaawgtcaggtgtatgtggtaaagaacctaaatagaatttcaagaaattaaaaatagtaattgaaacaacaaatccaatggagagg

SEQ ID NO: 822 - DNA, 600 bp, Bovine  MMBT11422
atattttttttctctcaaaatagatttccccaacattacatgtagtgttagttgcccagtcatgtccgactctttgtgatcccatggactgtagcccgccaggctcctctgtcygtggagctctctcggcaagaatactggagtggactgccatttccttctccaggcaatctttctgacccaggggattagacccaggtctcctgcactgtaactcgattctttactgtctgagctacagagaagccacaacattacatggtcaataaaaaacataagtaaataaacaaatggctaatragctatgtgcatttgaggtcaatacytgtatattaatgtctgagaaatactgttgaattgtttcccccagatctaaaaaaatttcaataaaattcataaacgtatacataaacacttacacacatagacattaccaaaaccacaagaaaaacttttattaatctaatcttaggtttacttttaaaaaacctactataattattttaccttttacccattgtaggaataaagtgctatatatgcaaataragagatgtgttgcattgctaagttcttgtaaaagaaactaagaatgtcatt

SEQ ID NO: 823 - DNA, 600 bp, Bovine  MMBT08771
taagatgcccacatgctgatttaccaagcagaaaatgaggaataataaagaaaacatctgccatcacctgggcagttgatgttggcatagtgtcttgaatttctaccagggatcatgcctcttgatgaagtcataggacagagcttctgggtgatatatggtgaagccttagcaacaaacattaggaacattcacatttgcaagggtgaacaggaaccgtgggggcgcttactattcatgcatggactgtggttgtttctctgtctagtaggaaagaaagaaacaactacaggatcaaarggaccaaagggagagaggatggattcagagtcacctaccagactgtgatttggaggaagacccgctggcctctctaagcctcacttcctttatactaaggggctctgataacaagtcataatgaaatgagctaagcatgcacgctgcctatcagaggtctgggcgacacagtgggtaaatgatgcgtgtttgttcctgtctaatgacaggctcccgggaagcagagcttgagacacagattggatacacatgatgtatggaggaaaggcttttaggacrtgcagagaggaagatgctcag

SEQ ID NO: 824 - DNA, 600 bp, Bovine  MMBT07330
cgagcttatcctcccaacaaagcttactgcggtgccattctgtgggatacagccatgtccctcacccctggtaaccaggcccagtataaccccagcacctgccacaccccagagcctacactgtccaacttctgccagcttctccatcatgcgccttcgctagtaatactcagagcagtgcacaggcatcagggctggtcaaagtcctggaaaaactgactgaggctgcagttttaaagtaaatatcttcatccccaggctgactcccttcagagggagtatgtgtgtttgatgtttccraagaatcagcctttgatatggacataaaagattcattataaagtgctcatctagtagtaaagacaaactgccatttatgtgccttattaggacataatttagtaaatgtgctttcttatatatcttctgtcagcagttttataacagttctgtgcaactatcctttcttaaataatagctctctgtaaatctttcagaatatcctgaggaaaggaggccacacagaaatcgaacctcagcatttctgtcaagtatttcagagagagaaaggtgcactcttagtcatcatcagaaatgaag

SEQ ID NO: 825 - DNA, 600 bp, Bovine  MMBT10280
cctactcccaaaccaaggatggcccccatgctcaccgtcctccatctctgccccctacagccttgccgctttggcggcaagaagatcattctgtattgaagggagaacatgaatcaaagagccaaaaacagcttctttgtcccccaaattttgctagaaacaaacatcttaagttctcaattgctttctccctggcgcaccctgagtggcttcctgaagaatgaatgacaaagctgattgctgcttcacagagaggaggcagaaaaggaaaacaggacgcacactctaaggcttttcatrtgtcagtgacttagcagagagagctgcaaactaagagcctactgggattctgcttccggagcttctgggtcttcatcttgctcatttaaattctgcatttcagcccactctgcctctattgattggcttcagtctgacttttctaatctgagtagtactaattggcccagaaggactgctgcaagttaggtactcttcagggctgctacccttcggggacttcaaccaaagatggtgcagaaaaaccacagttttggagacagacaggcatgggtccctctctgcatgaccttgggcaat

SEQ ID NO: 826 - DNA, 600 bp, Bovine  MMBT07342
tactatttttctcactctgggctgacatttattgcttattataagagactacccaatgtgctaattttttatgcaaaataaaagaggtataggatattmtttctttttaattaaaattaacaggccaatgtctccatcctaggtgtgaggggtgagtggtgctaattctaagagaccattttatcaaaggaayggatagcttcttatattttcatgaacaaaagtgagttatattttgtaattttgactatggagagagattctctaagtgagaatacattcaatatttcttacccttcrccacaatttcaaagacataataaattccaataaaggtgawgtgaaacaaataatttaacattgaatgaagattgaaaaaaatgtacataattgttctagcagtgccacatttcacttactttaagtcacatcaatttgactgactttattgttcaagttttccaacctcaataaatatgtgagaattaagttcccataattaacacaaattcraaataaattattggatcgtaccraaatgaattgttcacaaacaaaatgaactttaacaaaagatgaataacaaacatccagttataa

SEQ ID NO: 827 - DNA, 600 bp, Bovine  MMBT09456
aggtattgatatttattcagtgcctagtaaaaagaagtcaggattcagcattgctgattttaaattatgtaatactgttatctaaattgtcacgatgactgttagaagggaaaacatggagaaaaagttctgtccgagcagctgctgtgaatcacagaatgagccaggaaagggtaaaaaacatcatcccttaagttatggatgaaacgtcttcgaaccaaagacatctcaaagctgaaagggaccttaaatccccacttattgtgtaaatggagaaaccaaggctccagaaaagaatgrtctacctggttttaaagaaaaacctgaaacagcttctaggtctcagggaggagaaaaaagaggtatttgcaggctgttggttccaggctcacttccaatcccaaactctgtggttgctcaggccccttataccaaatggtgggtacgctcagcctccacgtccacaaacgcaagagaccaactaaagtttgaggaggttttgcagaagttgaatgcgtaccacatttgtggggtgtcagtgctgacccgtggggagggggaaggagaggaagcagggacatgtagactgctttgggttcc

SEQ ID NO: 828 - DNA, 600 bp, Bovine  MMBT09150
tgttagataatcctgggtagaatctgaggcaaatgaatccacatcctcrttctccgagtcgtcactgctgtcatctgcagccggctcccctgtgagggctatgcgagcrtaatcatctgtgtctatcgacttgcaaaagtggatggcgtatttcagtttctcctccagcacctgcttacaggaatacctgggcaacttcaacaagaagaagcatgtgtaggattcaggaaggaaatggtcaggtgggttgtatttatccaatacctgttaatgaaaaatgttaaataatcagagaccatrtacaggacaggtaaaactgcaatctgttttattacgttcattagagttgacttctcatttcacatacagcatgatgtttttggctaagaataacaaaatatcagaaaaaatatcatctagtcaatttcagaaataaaaaggaacaactcattaattcttaggactttcagtaaaaaatagcaattggttgctgtgatttcacccccaggggctggcaggtaaacagagcctgattctgaccagtaagaactcaaggcagaactcttatcctcaatcgaatgggcactctgatttttctca

SEQ ID NO: 829 - DNA, 600 bp, Bovine  MMBT08493
agcggtctcaccctcccctsaactgcattcctccatgatcccccctgtagtgctgtcacccatgctaagagccttccacgtttccttccatgtttttctctatacttacataatctattcagacactcacgtttccatttatggatttgggggtcattgtctcacaaaaatggaatctcattttttacatttttttgcatcttgcctttttttttttttttaaattaaacactccatagaaaatctagttccttaatttcatgtgacttaacagatggaatactaccctttgtccatccrttcctctgttgatgggcatttgattttttcccaaaatggagacctggagagatgaaatgagtgtcccagcataatgcactgagtagacagtggagccagggttcaagcccaagtttgcctgcctcagagcacgtggccctaatgaccctgcaccactactcatccattcattctggcgaggtgtggagagtgggatcctgtaaccgggggaagccattacagagcatgartgacagaattgaaggtctcaaatttgggaggatgcttcagagtaatccaggtggttggaggacctgaaaa

SEQ ID NO: 830 - DNA, 598 bp, Bovine  MMBT05528
  misc_feature (1)..(142): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgattgatctggttagggtataaaaagaaataaagacatgtagatttcttttgagagaatagtgaagaatgatgtatttggtctttaaaattcaggaaaccagctactgacaaattattaacataagcaggataagattaactgaggacagacratgtgtttcacatagttcagtctgggttctttaaatgaaacaaggggcattgtatactggacccaaatgataatacatctgacrttgcttgagttggttagaaacttaycacaaaagccamagaattttcataactaagtttcatgttccttcaaattatatgggtagtgatttttcttacaaacctgtacttttcttggtcttcctcttcctgggtagcaaatatcttccactggaaatgggcaatgatgctactgtggttgtgaatagttacagttcgctgattggccagagatat

SEQ ID NO: 831 - DNA, 600 bp, Bovine  MMBT11401
gaaacaagggtaggattactgttttcaggaaagtaaatttaaaatattgcatgttgcatgaatttttctttgagtccactgctggcacaattagtagataaatagtaaggctaagaatctccatggggattaaccatggcactagagaaactagaatgagagccttggagttggggttcagcccagtggaatacctgaagtggatgtcttgaagatgagtgagaagaggttgggaatggggagccatggcaaaggcagacaaacaccatagttttctacaatatgttttattctggtggrtagcttaccaaactgaaagaaaccatttaggaaacttttggctattagtttatccatgtcatgtgggaaataaattattgatattccagaaagtattttatggagattataactaaatcataatgggcatacttgtaaattagtattcttaattgcctttataaatttctgtttttcttaagagaaataccagccatgagactgttttatatgtgtatatagccttttttaaaacattgaagtagttgatttacaatgttgtattaatttctgctatagaagaaagtgattgagttatac

SEQ ID NO: 832 - DNA, 600 bp, Bovine  MMBT06224
atatatatttctgtgctttagctttagctactatcccgcagaaaatctgatagagtacaagtggccacctgatgaaacaggagagtactatatgcttcaagaacaagtcagtgaatatttgggtgtgacctcctttaaacggaaatatccaggtattaagtctcagtttatataacaaattaaatctaacttttaactaatagtaattgtttttgatgggttgtcaagttctgagtatttgagtatagattatatcatattttatattctgctgctggctgattttatttacagctctcrttcaacttccctctttactatcaattcattcttatgcctgataaacatatttacaagcaaaacgaggaaggtgaatttcctggaaaaaaattgcaaggaaaaatcaatttgtaaccacattaatgaatgaggggttttgattcttgactgttgctccttgtccttaggaatggagtagctacttaagctgtacctgaacttgagaaaggcgatatttcatcaactattttagtatagttatttgtcttaccttcttgctttggattattctgttctcagttttattttaactttcatttt

SEQ ID NO: 833 - DNA, 600 bp, Bovine  MMBT10657
tgataaccttgttgttatccttcaagtccctttaaggtatcttcacctttttttaattcttgtttctttttgttgctctgattggataagtcccattgctgtatttgagttcactaatcttttcttctgcttcatgtatcagatgttgagccccgctattgtatttttcagtttcattactaaatttttcaggtctgtagtttctgtttggtactttcttacattttctacctctgttgaaattctcaatttgttgatccattgttctcctgagtttagtgagcatctttacgatcattrttttgaactctttatagagtaartcacttatgtcagtttcattaaggtctttttctgaggcttcatcttgttcttttatttggaacatatccctatttcttcattttccttgattctctgtgttggtttctatgcattaggtaaaatctacgcctttccaagacttgaaggagcagtcctgccctgctcttggttgtgtcttgaacatatgattgtccaagcagcctactttattcttagtgcctccaaggaggtgagcgtgtgccagacctgtcactgtccccaagagggcagatctta

SEQ ID NO: 834 - DNA, 600 bp, Bovine  MMBT10626
agttgaacatgtaaaaataagtgcatttaattagtatgcagaatcaccaacattacaaaaatagtacatgcatatgtattttattcttatcagaacagtggaaattctgcacaaaactaaagcagctggtttcattttcacttttttatatgtacacattctaataacattctggtttcagctcagtggtgaataaggaaggactcaaagggaaggaactctggatttgcacaatcttttcttgtcctctgacatctccatatgtgattggctcatagggaattaacatgtgtaataaaraatactataagaattcctgggtcactagagacaaccatcaccttctttctgcatttgaagcaatcgctggttcacatgagggatccttgggatggttggcatcgccactcagtcaaagccatcaccgctggccatcctcccatggagtctcacacacctcccaccgatcgtgaatccgctgaratyctgtgctctgggggccctgagtgctctatgtcagcagcaggcatgcctgtcatagcgtgtgtcccctgctcatgcccatgctgtattatcccatcggacctcacaaaacrcaag

SEQ ID NO: 835 - DNA, 600 bp, Bovine  MMBT08075
tttttgtgtgtatagaggtcaacttatctttgctccttgtatatcgttgtgccttgcataggaaattgatgctcgatatttatctgaaacataatttttaaaggatgttcatataaaaaagttaagatttttgaattatttgttcaataaaatgtctttgacatatctcactcaagatgagaatttctttcatatcactttttttataagactttatttcaaattatagaataaaattaagttatattaagtcctttataactttgacatctttaaatattgctctaagtaactgccatrtataaacataataaaaaagtaaaaaggaattttagaaaaattccatatgatttcagttaacaaacaaaactyatgctttggaaagacacaattcattacttgactggagtggcaaacagaattgatgcttttatataaaggcataattttcagttatgaaatccattcataactagaaataggtggtaagacttaggaaagataaagtattttaaagtaacgtagaatactgataaacttgaaagaacattttcagtctagtgaaatatgagtatatattcattcttgagtgtttagaat

SEQ ID NO: 836 - DNA, 600 bp, Bovine  MMBT06611
ataagagaatatgagaataagagaagctatccagcaatttgtacatataacacaaactactgaggtaacattaagagaagaatctttgaaatgcttcaaaaatgtaattttttcttccttgtttttcaggtaaaagagaaaatttaaggtaacagctaagagccagactttggtgccagcctactggggttttaatctcagttcaacacttactataaactatgcaagttactgctctatgctatagcttcctcctttgaaaaatcagagtaccaacagttcctacttccctgggctgtrgaaagaattaaatgatttaatacatgtraagtacttagaacagggggtgccttggccctctgttaagggctcagtaagcattagccattattatcattacataaaagtcaatctccttttccaaacgccaacaagtgaagcctgcgctacggagaaggccctgtctcttccccctcacctggccacaagtacaacttacaccgtgttttgtttctttaacctgttttttgggcgtcctattgggttagcatagcgccgttttatctgtgctgccttcttctgtagaagctttcttccttt

SEQ ID NO: 837 - DNA, 604 bp, Bovine  MMBT06582
  misc_feature (1)..(4): n is any nucleotide
nnnngttcaatgtagcttggctgcagtgtcaccaaatgcttaaacttgcctggagtggcgtaaaaaatagcactactaatcagaagaaatggtaacagagttaatttgttccagaaaggtaatgaggaaaaaaagagaaagggaatggctgctgaagaaacattttccctaatgtttttcctcttattttttcagatttccaaggtgggtagtcgtttkttttgtttggtttggtttkgttttcctcactgatacagaagactggggaagtgttcaggaccaagctgcgtgtgatatagcactraagaaatgctgaaaatggggctagaatgttggaaaagagattgtctatataatcttctttcctccttcacttaggacatctagatggaaatactcagaactgggraaaatttagcctgaagataaggtgtctgtggacactataaaactcccagaggaaaacacaggcagaacactcttggacataaatcatagtgacaccttttttgatccatctccaagaataatggaaataaaaacagaaataaacaaatggaacctacgtaaactcaaaagctttgcacagcaaaggaaatgataa

SEQ ID NO: 838 - DNA, 600 bp, Bovine  MMBT05913
gatattgcaaatgccttaatattcagagaaggaggaatcatttttttaaacacggaaataatgttcttaattgttgggtcttttctttaacaatagtttccagcccaagggcaagtgcaagacagagcagacataaagaattgcagagccactattttaatttctggcattcatagcatttagtagccggaagtctcaaaggaaaacagctactttcatttgtgcctcctgcagccaccctgtcaggggagaggtctgggctcagaaaatgcagctcattaaaatgaagaatattccccractttgatattcacagttcactggggacttactacctgttcactgagctattttgtctggaagggggctgcaacgcagcagactctaccttaattaaactgctttaatcaaattcattaggtctctaacatttataaaacatattgaattatgatactgatattcttagtatatatttttttaaattgtcaagttttctccttcctttatttaattggtgcattgagcaaaattcagaacaatactttcatctgtctcataaacgtcttactggcaagcaaggtacatgctctttgtatt

SEQ ID NO: 839 - DNA, 600 bp, Bovine  MMBT07243
tctgttctcagcacacactccgggtaggctaaaacaactagagttggcatatcatttagaatatatctgtcacttttggttgaaataatctctaacatccattttggatctcatatttcaggaatatattgctgctgtggaaagaatcatgaactcaggatcagaagaccaggtttaaatcctggttctgacatttattacttctgtgaccttaagcaaatcaattcatatctttgatctgtgtgtgttttttttttttaatctgcaaaatgggaagaaaatatcaatgtcctatggtcraagtgaagatcaaacaagatatatgagaaggcacccaaagcacacagcatatcctgggatattgtagacattcaatcagccattaaaattaatattttaaaggtggcatctggtgagacaaatgcatatgtgataaaattgctaagcatgctggaagccaagaggaaagtgaaggaggaagggagggtcrttcctatttggttatctcagcttttccctttttccatcactgctggtgatggatcctatagtcgtagccaaaatgctggcagcccacccaaatgtcatgtcctcgatcct

SEQ ID NO: 840 - DNA, 498 bp, Bovine  MMBT10740
ttttcactttcatgcattgggagaaggaaatggcaacccactccagtgttcttgcctggagaatcccagggacgggggagcctggtggctgccatctatggggttacagagtcagacatgactgaagtgacttagcatagcatagcatatcatcctaggtctttaaaaatcttgcagcttctgttctcacacacttagaactctgtggctaccacgtgtagaacccagcctactgaatgatgagagagacaagatatgtgaatgagactgtcttaggtcatccagcctttagtcaacctrtaagcagaaattagtggaacctgcccagaccagaataactgctcaaccaacccatagaatcatgagtgaaaggactggttgctttaaggcactaaatttggggacttttttttttacactgccaaatgaatgtctacactaatgaatttaacactaattaatgaatgcctacatttctttattgggctgataacccgt

SEQ ID NO: 841 - DNA, 600 bp, Bovine  MMBT11366
ctttttgcagcagtctgtctggaagggatgagaaggataatgatttcacaagaacttgagttgaacccgtacagaggaagagggagttagggggagggtctgccctgaaatcaacctgcttatttaagtagatttgaagaaaaacagagcatgaaaacaacaaatcagcctgacttatctaggaggagtggataaaatagtccctgctggaggaaacgtgtaacccaatccagtactttatcacatcttcctgaaaccttgaaataggtctatgaatttatattgtttccgaaagccctrtgagccgtgctatcttaccctgccccactgtgaaccctgaaatcaatccattgctctctcaaactttgggaaaatgatatgcctctaatgtcaatgaactagctgcgttcacagaatggcttttcactccctgagtttactgaagtggaagacagaaagggtatgactttctgaaaataaccacatgtgctcaaagacctagattttctaggcatgagtgcatttctgataaaaaatacctccttagtgtgaagaaacctggttattcctcctctccacaaatcgtttgcatcctttata

SEQ ID NO: 842 - DNA, 601 bp, Bovine  MMBT06204
  misc_feature (1)..(1): n is any nucleotide
ntgcataattcacctgggttgaaatctctgtgatgcccttggtatgactttggggcatgatagttactgtaaatgtctttcttctgttaagtggggactctaacagtgcctactttacaggcttcattcctagtatttgaaaggaaagcattcaaattgatgcaggggagtttctctggctgaagtttcattagttattaacattatttaattcttaactaatcaccacttctgttttcttcaacatgttgagttagaaagcttttagcgtgtttctcttgtctggctttttaatacctcrtgaataatgtgaaattattgagaaacaaaagaaaggtgattatgcaaatgcttgaaatatttaataatacattaaagtagtcttgggaaattggagaaatagctttactgaagttatagtagctttttgtagaggcagaaggtattaaggagaaaaaagatcatttcaggaaaagaaaatttaaaaagcagaatgcattagaagcaaatgacctaataaattcaattaagtaatgaatattcagatagcattcattttcctgagatataatggccaagccaaagagtttaaagaatgaaa

SEQ ID NO: 843 - DNA, 600 bp, Bovine  MMBT09194
agggtgttctaacacctgagccttattaacattttcatcatgagcttccactttgctctggtatggacactcctggttggaccatggatgcccatgggtgagtatagactagagaagcgtggctaggagcagaggaacccaggattctccaggatcctccaaggacagaagctgtgtcattttcaagctgtgtcactttgtatccctagtccctagctaacacagcaccctgcacatggtgagtgctcatttcaagcctcttgattagatgaatggtaatgaaatgaaaaatttccccaratacacagaactagagagccttcaattgtgtcagtacttcctgttgtattccttacaatctgggggccctttctctctcctctatcttctcttgtttttcataaagtcacctcatagaggaaatgactgattagacacacaaaacaaaaaagaatcttggattcagattggacccaaagctgaggcgaagtcaccagtgtcttaaaacaatatgataaaaacaaaacccattaagatctgggagttccttggtggcctagtggttaggattcctggctttcactgccatggcctggattc

SEQ ID NO: 844 - DNA, 600 bp, Bovine  MMBT06996
ctaagtgtatacatgacacaattattaagaactcagtaccaccagcgatacagagatgctaactaaacactgcataaggcttgcaaattaacatcaggaaccacaaaagaagaaattgctaatagccaacagcgccatcctcctctctgtgccggacactttacaggcatcgattctaaccctcattttagtaatgaagtaactgagcttccaaagtcacataaagaagagacaaattcaagtgcaaacacatatggctagaaaacctagtctctgccacccatgctgataaaatggaartttaattttctaatgaaggactgtacaaaatcccaatataaatttagcagatgaaaaaccytgaaatttctggtctataaagatactacaaaattaccatgttgactaatttttataagcaatttatttaaaatagtatgtttttcaacatttctgagttaaatctacccatwttctccatccttacacttacttgtatatgcacatgatgtgtataccttttatagatatgctatacattacacagagcacaactttttaatattgtcaaactggaatctgtatacattggtagacaca

SEQ ID NO: 845 - DNA, 600 bp, Bovine  MMBT09860
gcgagagagacagtttccatccctggagagggaagaagggaatggcaacccgctccagtgctcctgcctggggaatcctgtggacagaggagactggcgggccacagcaacgtcaccaaaagtcggacaggacggagcgacttagcaggcacagcacacgaaccttctctgtaaattcaagtcaaggtcgtacacgaattctccaggaacatcactgattctgtaacatgttacactcgctcccctttctagggtgtgattttaaggtcttgattgtccccactgctcaaggcaaacgcractgtgtttaatgttacactgaaagtttgaaaaagaactgtttgtgtaaatacttactayatagaagcaaaatgaccaaaggccgctatttttcctcctcttacgaaaaataaatgctaycacgtacatcagggagacaagtgaagccgcataaccaagcgtcaggacaacctgaaaacaatacaaagacacaccaaagtcaagaaaatgaaacattaactgagggagaggttacaagcgttgctgaagcttctcgtcacacatgctctctgcgtggtttctgtttgggtgtgtgacaga

SEQ ID NO: 846 - DNA, 550 bp, Bovine  MMBT10201
ccgtgccccgcccgcgtgcacggtcacttacctccaggggtgcaggcccagcgaggggctgcaggggctgcaggggctgctgggactcagcaaggacgggctctggctgcttggagacagactgcaaagaaagaggccggggacggtgaacctgccaacagcccctgcgtgtggctggagacggaccagggcgtggttcccttagggagaaggggcctgaggctggggatactgggtctaccgtaggccacgagggcagggccagatcgatgagccgggagggctccccggaggcggtgrtgcgattcggggcgacttgaacagagacgcggaggaagagtggttgtcaccctgtccctcttcccctccctctccccttccagggtcaagcactcactcgagggtcagcgcccgggatgtgcagcttgtccctgcgggacttcatgccgaggccgcgtctatgcgaccgcgaccgagtactgacgcccccttcgtggccgccctgatcgtgtcgcaatcggacggacagacacaggacgccaggacagca

SEQ ID NO: 847 - DNA, 600 bp, Bovine  MMBT09902
ggtgggccaggcagggtggccggtgggagygcagccctggaccacagagtcytcgtctgtgaaacgggatcccygactcytgccarctgaggagatcgggggaggttggtggggaggtagcgagggatgtctggacccacaggtgggccagggtcttttccatgggccacacgccactgcccaggtaggaagggactgaccgacagagccctgggctgagctcctcacgctgcccagcatgccgctgcctctacaccctccccactggaagtgaaagggctccgaatgtggggacacgcrcaggcccgagctggacacggtggagctggattccacgcccgtctgcctcaggggcctgcctctcccctgcctggagatgcctcaggacctaggaagccgccccagcttctccactcaggggcccccagcctgcccartggctcggctgggaactgatgaggcttccctctgggtacactgggggtgctacctgcccttccccaacaaatattcacggggcacctaggtgtcaagtatgtatccccctgctgccccaggcgggtccccaaagccacacctccctccctccacactagcctg

SEQ ID NO: 848 - DNA, 600 bp, Bovine  MMBT09021
ccttgttttaatcccaagaaagaaatgaagactctgactagtacttcaccacagttgaatcccagtgaagacaagaaactaattgcacatgctgtcccaccaacatcagcctttgtttcttctaggaatctccacagccacccrccacacgcctgtcgaggagtcgttctctgaatggccttgcttccctctctgccaacaccctccccgtacatatcacagaygccaccaggaagcgggaatctgcggtccggtgagtggtcaggctacacgaggctcttggtgctcggatcttggccyaaatgctggaacgcacccatctgctgagcctcctctcctgttatcagagagacggagaaaggggtgaaaggggagcctctgatcaggacaggaattcatgtgaccctcacacactgagtgctgcagaatgccaagccatcactcagccagtatccttgggggagtgactttgtgctgggcacagtgttaaagytggagataccttatggaacctatagtttaatatctagtctgaaatacagaaaagcaaagaagcaactattataycttgtgagtmgtataatgatgggggaatatggg

SEQ ID NO: 849 - DNA, 600 bp, Bovine  MMBT07517
caaatcaagtttattttacagcactaaatyatcaaaaatgctattatttattcaacaaacaatttgaaaattaacaaaagtttggtggcttcctctaataattcaaattgyctataatacatatatagcaatcaaaagaagaatcctgaggtctattatgacacaccactaattctttattaatataataagatgttaaaaaattacagctttaggttatggtctggctgaaaagaaacagaaaccaatcaacataagtagctttctgccttatgctgagtatagctttttaaaatttcytcagtgtacctttaaatggcaagaaggattaagttttacttattcaatatctctctgtgtctatattttcttgaaaaagaagctagcggtttaaggaactgcacaatcttcccataatctccataaactagatatgtcaaagttgcttgaaatgaattactcagatagacttcacctgagcatctttaaaaaataaattattaccatcctatttctcttgattattggatattctccactaattcatatcttaaggtccaaaattaggttgtgtttattgagtaatatttgtagaaatta

SEQ ID NO: 850 - DNA, 600 bp, Bovine  MMBT08239
caccagcccaacccttgtctgtattgcccaataaaggccagattttccgaatattatgttttagctgagcttgcagcaatcacaaatcagtcattaggaatcacrtgcatataacaacgtttgtcttcatagtattttgaactaaatataagcaagcatatttaaaatggtaatatccaaagaatcatatctcaagacttccctggtcatccagtggttaagactcggycttacaatgcaggaggtstgggttcaatccctggttggagaaataaggtcccacatgccatagagtgtggygaaaaataaaaaagtgaatcagacctcagcaacttggttttatttgcacactccatagtgtctaktattagcaattaacttgcattgtccccccacagtccatctgggggtgaataagtcattctctaagaaaaagtttgtgggcaaaaaagaaaaaccttaattaccctctatgggaaattttttcttctgcttcaaattggacaaaagtggctcttagatataattttacataacctcagtggcatgttgaagtatgggaggcaaaagacatttatgcaattaccaagtctattgttt

SEQ ID NO: 851 - DNA, 600 bp, Bovine  MMBT05625
aaggaaaaaaaaaaaacattctgaaaggtccatccttggaatgattttgtttatggcgctgcgatagttccgggcaattaatccagaattgcgtcactgaaaagattttatattcttaagtgttcactcatgtagttaaagtaaattatgtccttttccaaacatgtttcaaagaactgtactgggttttaaaaatcctggtccctaaatcctacttgtttgtttaattaatctgaaaataactgctccttctttgtttcttaatcacagatcacatacactgtatttgttagcagctgygaatgcgagcatgtcccagtgtgtttttcttgattgtttaataagagttgaataatactctatttaatccatcaaataggacattacaataacattgatcttttgtttgacagcaaatttgtttgataacaggatagaatataatgtaaccaaatcagtgtcagaagtgcatttcagagaatccaattaaaaacacccatgcacactccagacayggagcagtaggccaaagggaccagtaacagcaagacacactgggcaggagggtactcakggacaagctggccttgccaaacgtcc

SEQ ID NO: 852 - DNA, 600 bp, Bovine  MMBT08323
cacctgcccctcaatctgaagatgagcacaagccttcaggaataccccttctgttaaacacccccatccatccctctccccctgccaggtgatggatggtaagactcagttcaagcttttttttccccctgccccccaccccggctttttctcaaacccaacctaattgtcaccagggttcctaagtaattagggaatcccagcccttgcccacctagtgttcttcttcatccctaggttctgaggacgctcaaggctcagtttgaaacagttacatatctctgcccgacctggcgggayctggagatcctctagtaacraaaacctgtgagctggtgaaattcctgcttggtcacgtattatttttatttttcagtaacttgacaaacttggactagatcaagaaaccttctatgggccaagcctattctaggtacacagcgtgagtcaagttcagttgggttttttccaacagaaaaaatctgtgtttggacaactagagcttaaaatgttatgcaaacaaaagatgaacctacatcagcccaggagaaaacttgatagacttgctactgaaataactttcagtgactctttggggga

SEQ ID NO: 853 - DNA, 600 bp, Bovine  MMBT08388
gtcagtttaaaaagaaatcacagtacttcttagtataatctgcaaaagagggaaaaagtcttggacccgctgcttggaaataaatatcaagtaaccgtaaaaatattcagccattttccaggtcttcagggaggttcatggatggtcccaggcagaacattagagttcctctttgaaatagcccagctttgccaatgacatctcttttctcaactgcataacttcccaaaacatttggtcaactacacaaacagaaaagagggacacataaatcataaaatatcatcttaattatttttygtttcaatgaaaatttaggattagttgaaatgccaactggacacttctaatgatgtacctagtgcttaacatcctatcactgtttcacactaacttttccatgtacttctgagcattccagttttattaatgaatatatttactgctttttccatcacaatttgttagatattatcaatgactaccatggtagacatttcagtgtcctgtgtaactggcaatgttgctgccttcttgagtaactattctcaatgctcaattgtgcaagagttatcatctcacttatggatcttcttgctt

SEQ ID NO: 854 - DNA, 600 bp, Bovine  MMBT08377
tcaggaagtggtgatacactgaataaaagtaaacctgatgaaataagattagaagatcttgtggatattttggacacgcaagacagcagtgaccatatttgggatgatggtgaaaaggaagtgaatgcagaaatgagtgagggtcaactggatcaggaccagatgactgctctggacatgatttgctccaatgctgtgacagtcataagtgggaaaggtggttgtgggaagaccacaattgttagccagctttttaagcacatagagttgttggaagaaaaagaagtgaaaaaagcttgygaagattttgaacaagactggaatgtaccagaagaatggatcaccttcgccgagcaaagtcagcaggaactggacaaggctatagaagttttacttacggcacctacagggaaagcagctggcttactgagacagaaaactggttttaatgcttatacactatgtcaggtaaaacctcttacattttttctacacataaaacagttaaagatggacttaatgrttttatttttcatttcttcccgacaacaattagtgggcatttattgaatgttttctagacccttaccttgtggtagc

SEQ ID NO: 855 - DNA, 600 bp, Bovine  MMBT09178
ttattcttagaaattagaaacaaaaaaaggaccatgcaactttaatgtgtccctattttctctttcacttcttttaattgcctgcgttatggttatttattactctttggtgccttcaatgaatggggaaaggagaataaaattaaaggatcacttatacttattagcaactstggtaaagttttggtaaggaaagctaataaaattaagaattataatcattatttatctgtgtgtggtatgctaaataatggcccctgaagatatctacatcctaatttctagacctgtgaatattaycataaatggcaaaatggaytttgcatctgttattagttaaggatactgagatagggagatgaatttgaattatctgggtgggccctaaacataatcacaaatgttcttcttataagatgagacagagggagattttattacaggcagaggagaaggtgacgtgatgacgaaagaggagatttgagtgatatacttggaagatggaaggagtcacaaaccaaagtacaggcgaaagctgaaaaggcaaggaaacagattgttctctcagagcctccagaagaaaccagccctgaggacacc

SEQ ID NO: 856 - DNA, 600 bp, Bovine  MMBT06038
agttgggagaactgcccttccatgctaatcctccaacaaggctgctgtaactcttcccccatgacaaagggtcagaaacctatagcctggaagasagacataggaaaatatagggtttgttccacaggtgaagtccagaatagtcccctttattttctcttaccactccctctgaaccctctctcccctggtactgsaacaactcatttctcatgattgccagagtcattttatccataataatctccttgcaatttaatctgagatctgataataaccactgatgtaattataattaayaagaatgcttagaacatgtagagtgttttttctcctatgtttcccagaaagcagtgagaaaaaacaggcttccaggtcttgcaatcttgagcttaagtaatggctccactacccactagctgtgtgaccttgtacaagcgacttaacctccttaaaaatgagaagatgaggcagacttattgtcaattcaaccctccttccttggagagcctgggaagttccccaggctcccttgcagctaaagttatggatgggaagtaagtcccactagttggtggttctcatgggaggtttggagct

SEQ ID NO: 857 - DNA, 600 bp, Bovine  MMBT11010
tctccctgctgtattcttacggggtccttccctgccccagggcgatgacgtgactcagaagtctgggaacggggctgaagtctagcgctggtccccttggaaggtctgtacatccagtaggcgtttaatggatgcaccagtgactcgcactccagcactgtgcagcagtgattaagtgctggctggtggggatgggcccccattgggaatctcggctccaaaccctccaccatcccagtgttgggcatcgggtgctgtgggcccttctgaaaaagagtctccaaaaaaaatcactgcacygctcagggcaggcttcaggacaaacacccaactttgctagaacaaggtcttttttcaggcccatgggaccccaccttcaacccatgagccaagctcaagccaaacatgccaatccctttctggaaatttctgctaatgggctgagaaaacaggggtctccttctaaaccagaggaaccaagacataacgtgctttatttaccaaggggagcaaaggcagccaagaaaatgggtgagcagagaggaatccttggggtgtatctgggagagggtggaagagaaacataacagcatgaaagtg

SEQ ID NO: 858 - DNA, 575 bp, Bovine  MMBT07733
  misc_feature (1)..(1): n is any nucleotide
nggtttcctaggaacctccttgtcagtataaccacaaattaatattgccaaactagttaattatgagatcatctagtatcttaatatgtgtctgagattctctggcatttaacagagaaaggaatcctaaacacatattatcttcctcggtgggcttgcccaggaccacctctgtcacttgggaagacggatcacccccatgtggtggaggtctggygctgggctcagaggatatggattcttttttttttttttgactgcgctgggtcttcactgctgtgcctgagccttctctggctgyggagagcgggggctcctctctagttgagatgtgtgggcctctcattgtgggggcttctcttgttgcagggcacagctccagggcgcagggctcaggagttggcacacatgtttagctgccctgcagcatgtggaatcctcccggaccagggatcaaacctgcgtcccctgcactggcaagcgttcttatcctctgtaccgccagggacgtccccagagggaatggatcctattttccccctccagtcctcctcccctcctggctgggccaagtt

SEQ ID NO: 859 - DNA, 601 bp, Bovine  MMBT07415
  misc_feature (1)..(1): n is any nucleotide
ngctgaaacaaatgttgatagtgaagctaaatactgttcagcaaaatgattttgtacatatatatgcattctttttatattcttttccattatggcttatcacaggatattgaatataatttcctgtgctatacggaaggaccttgttgtttatccatcctatatatattagcttacgtctgctaacccccacctcccactctatccctcctccacccccaccgccttggcacacagaatcacaacgtctgtgattctgtttctgagtcatagatgagttcatttgcgtcatattttaaaycctacatataagtgacatcacacggtatttgtctttctgattgacgtcccttagtatgatcatctctaggtccatccatgttgctgcacayggcattattttattcgttctattccatttatacatttatacaattccattgtatatataccacatcttctttacccattcatctactgatggayatttaggttgcttccgtgtaaataaattataaataaaatacttactaaaataggctattataaatagaacaggcacaatattttgaatacagctggtggctccaggactttagga

SEQ ID NO: 860 - DNA, 476 bp, Bovine  MMBT06784
ggcagaaaagatagggtgctacatttaaaatccttgaarttgcaatktctgcctcaaacctgtcaaataagttgcaattcaaatgatgctgttttcaacacagattgttgtctgacagtgaacaacwgtttctatccaaataaaaatgtttttaagcactcctggatgtgaatccaatatggaaatggatttgaaataaacattaaacaktttgccatctgttgccctgctgagtcactgaagaatatctttctcaaatgttcatatttttagattaactggtccatggctgccaggcaygaagaagaaagaaaatctgaaactcagtaattccactaagttgtaaaaagatgcactacagagatactgctatttggggatgaggttgtggattaatgctggagtcaatccaggggaaacattcctaggttgtcagaacattttatccaacaattaatcataatcagcacattcta

SEQ ID NO: 861 - DNA, 598 bp, Bovine  MMBT10443
  misc_feature (1)..(53): n is any nucleotide
nnnnnnnnnnnnnnnnnnnnnnnnnnnnnnnnnnnnnnnnnnnnnnnnnnnnnccaccttccccattcctggtttttcaataacttttattatttcttctggactcttattggcaatattgctttctttgcagaaacatccgagcattttttagaaaaataaaataatgcagttttggcatgcatacagtgtattttaaatggattaattttaatgtgatcagcactatcccttgtatgaggtgacctctatgatttatattagttgaaatatagttccatgatttaataaaggatcccytgaaagaaatctgaattgaattattgaatttgtttatacgtcggcagtagaaaagagtataaacgaatcttacaaaaattaacagcctttttctgttgatttttcaccgtccctgacaattcctcagaaaactcaatttttatatcttagggatctttatcttctgaagttggctttcattacattttaaatgattgcctatttacaacactctttcaaatattatcttctgttaagggcgaaaagtcagtcttattatcttcttttatgcatataatgaaattgaaactcagcaagg

SEQ ID NO: 862 - DNA, 600 bp, Bovine  MMBT09624
tgaaaaaagtcaccaaattctatttctttgtctataaaatactaaacaaatttcattataaggcactctaatgtaatgtttacagtatactggtttcatcgcattatgaggcagtaaaaaaatactgctaaattactaaagcctttattacytcagcacttggtgagacaatttccaattgaacatattttggaaattctaccctgtttctggtggtatcagagaaaatgctctaggacactgaacagcatcaaaagctaactctagagggcgccagagtaccagaaaattggcttttcyttttctctttcttaccaggaatttactatttgtcaccttggtgcaaaagaaaaaccaagtgcctggcagcttttctgctgggttcctgtaacgacaagattgctgaacaccccacaccactctttatttgrttttactaaacacagacttcaaccctgtggcrgagtcacactgttctaactcaccagagggcatggctgagagtggttcttccctgcggctggtgctgcttccaaactcacctgagaggtggcacattttctcaagatgtctttagttgccccagggggtggagtaatc

SEQ ID NO: 863 - DNA, 600 bp, Bovine  MMBT08193
taatttgttgttctttcggaaatatgttcacttttaataacttgtctgtgttctgtcttgtcattagtatgttagggtccttgcctgaggcatacacgtttcttctaattttcttctaatctgctgttggtttgaaactcaaataaccaacttatgctctgtatcagacattaacattttgctttgtatgcttggaatattttctagtaatttaaaagggagagaatgtgctttctatgaggggccacctgagcctttctatgagtaaaattttgaactctagtgagaaaaaaattttcycttactttgcctttctaatctatattcaaaataagtgagttttccaaatarttgatttcaagatgggtaaggtatttcagtcctttacaaaaggatctggttagagattttctcagtctagggcactggttctcaaccagcagtgattttgctctccaggaacatttggcaatttctgcagacttgtttggtggctgtggcttgtagcaaagagaacacgacctgcatctagttggggagggcccaggggtgtgtgaaacatcccacagtgcacagggcaagccccagtaacagttacct

SEQ ID NO: 864 - DNA, 600 bp, Bovine  MMBT06650
aggagaaggggacgacagaggatgagatggttggatggcatcacgaactccatggacctgagtttgagcaaacttcaggagatggtgaaggactgggaagcctggggtgttgcagtccatggggttgcaagagtcggacaccattgagcaaccgaacaacaatgtatttatgaagtacaccactttccttactcatgcaaatgcattatctatgtctttaatatacaagctgttttacagattgggttttaaaaggagccacagaatatgtttgatcacaaccatttttcttattaagayaaaagggcaggttcctgatgcccacagaggccaaggcactttactgtgcagagtttctattttcaagacacgatttagccagccgaaatttaacccctgagagcccttcattgtcgcagtctgttagaaagagcgtcactgatgttactgctctgctaagaatagtccgcagatgtgcttttaagtaaagagggatttaaaaataaatgtatttgacaagttgctgatcagaagcctatatttaccacaaccaaattagaatggtgttgcatagaagttgaagtgtatcctggaaaattc

SEQ ID NO: 865 - DNA, 600 bp, Bovine  MMBT07382
taatgaaaaaatttagaacaagatcctgagctttctaaagaatgtcagttatattactcgtagtatgctcacttctgagactgggtccaagtgacactgatgaatggtttgagaaaaatttttttttttcaaatcagttgttaaaggagtcctggtgcaggacagaagccgaacagtctttgaagccaacggagttttgagatccaaaaatgaagagctattgccagcagcagtgtcaaaacaaaggcaatgaaacatactctttttttttttttttcggaccagggatcaaacctgcaycccctgaagtgaaatctcagagtcttaaccactggacttccagggaaatccccaggcaaactctttagaaggtttgtataggtataatttcaattgattacttaaaatttggctgtatgacacaaaatatagcccttgtgaaagaaattttaacatccgtaccagaatcgttatacttgttatcaaatagcaccaattttcattttgttatagcatattttggtaatattgatttacttagtgctaatagaataataacatgtttattttaactccaaggatagtgggagggaggtgtgt

SEQ ID NO: 866 - DNA, 600 bp, Bovine  MMBT06785
ttgagaaaggagaaaagtgattcagaaactacctcgatagcttctattgctcacttctaacccctccgcattttagcttcagttcacatctcatgttttcccctgaggggctcgcaccactgaggtcagctccacgctttccaagtctttgaaacaagccgcatcacatccttagtccgagagtgtatactgttctttaacagaatccagaggcctttggggtccaaatacatttgctttattgcccgttttctgccactcctgttgccttctgccctcttttactaaagaaaatatttyatccatgtattcctaaggaaaaaaattagaaagatacagacaacagctctgaggtcgacttcagtgactcgctgctacattcactgtgttctgtccaagaactggatgtaaatacaaaagatggctcatgccttcaataagatcaaagtctacaattaaaatatcctctagatattttagaaatattgtagaaataaggtctacaaggaaaaatcctccttcaataagatcaaggaaaatcaattaaaatatcctctagaaagtgacatgcggataaacataggagctttaagaacacat

SEQ ID NO: 867 - DNA, 600 bp, Bovine  MMBT09831
ttgctaaataataaataaaagtcagcagtatctctatataacagcaagaaacagaaaatataaaattttaaacaattccatttacaacaatgaaccaaatgcaaggtactgaaaagtttaacaaaaggcatgcaaatctatcatggacaaaattatacaattagattccagtatctaaatacacagagaaakaaattataagcaaagataggaagatcatgaagatgttaagtcttccaaaaataacctataacgtcagtgtaattccatctaaaatcccaaaaggattcttgtagaatytgacgaactgattcaaaaatgtataggaaggaactactgtatagcacagggaactctactccatattctgtaatgatctgtatgagaaagaagcactactctgtaatgatctatatgagawaagactctaaaaaggagtggatatatgtactaatatatgtataactgattcattttgctgtacagcagaaactaacatgacattgcaaatcaactatatttcaataacattttaaaaatacattgaaaagtagaagaaaaaataaataaaatgtatagggaagagcaaaggccaagatt

SEQ ID NO: 868 - DNA, 600 bp, Bovine  MMBT07408
tcctgggtcgggaagatcctctggagaaggaaatggcaacccactctagtattcttgcctggagaatcccctggacagaagagcctggcgggctacagtctatggggttgcagagagtcagacacgattgagcaactaactcactagtgtaaaactgtctcagccaaacacaacaccctcaacatatagtcatgggcctctaagaacaccttcccacggggtgctgggggcctccccttgcactgtggcaggagccctttgtacagggtagggagggggctgccccaatggagggtggcrctggccctgcagggaccctgtcccagaatcacgtgctcctggtcccagctcagcatacctccccatggagccctcaatccagcccagctgcccttgactgcttaatcacctgcttcctttcaccttccttcccaccccagcctcacggactttggtaaaaagcacatctgtagtgtacactggtcccctttcagagccccaaattcatcgatgtccattagataagttcagtcaatcgaaagataatttcttggccctcagagatgaataggataattttatgtcattaaaccctacaag

SEQ ID NO: 869 - DNA, 600 bp, Bovine  MMBT03274
tgcggacccctgaagtacaggtgccccgaagtcaccatgctgtggagaccacacagcagacracatgtacgcagagaatgtcagaggaaccccagctgtttcagccccagcartttgaacattcccagactcaatggcaaacgtgctaatgaggaaaacagatgacccctgcatcatccctgcctcacggcaaccaggtgagagaccctgagtgagaaccacctagcggggcccagcccatctccagattcctgagagacgacaatagtatatgattatcattgcttcatatcatcaackttggggtgttatttcatgtcacaatagattaccagaacacttctagatagaagtgtggggggcgtctagcccagacttctgaatatccctccccagtactcactgaaatggcccacagcacatagaggggaaatttttaccctgagtggcaagcgcctctctgatagccagtctggctgctggcccagaaggaggtgaagacaaaggcaagataaccttcagccctttggggcagtggctttgcaaaacattaagaagaaaccttgcaggagtgacattccttgccagatggctctcttc

SEQ ID NO: 870 - DNA, 600 bp, Bovine  MMBT03366
aaagcattggagaagttttttcttttgttttattgtactgtgtgatgataggctgcagcatggacctggcatacataccaggatttcttccatcaagagcacagtttgtacagtacagtaaacacaagcaatgtgctcataaccagtctatgtcagctcccactccaagcatggtgccatactggaaagtgtacgcttctcatacagtctaccaaaggaaagaacttagggrcagtccagagaactaaaatcatatcaaaatgatcaaataataaaggagttgcctcaggagaatagackaaaacttaaatttttaggtgaagacataataaccaagaagtttatgatcaagatttctaaagtgcaaaatctatccactgattattagaatacgaaataactccttaaagtttaaaatgcagtataccagaaggaatgccaggagaaaagacataaaaactcaaggaagctctggaaaactatatgaaatggtagacttataagggctttgagagaaaatgggtatgtctgaggctaaagacagagttagatgaaccagaggaaggacacaacagaataattagtatattctcgtattct

SEQ ID NO: 871 - DNA, 600 bp, Bovine  MMBT04834
ygtatttgatttacataaggatcctttcttttttcttcattttggttaaatataccagttgcagaaagcattccccataatattggttttgcttctccaaaagaaaagtagaagaattatgtactcttattgttataataatcagtgataataataaatattattaaaatagtaaatattaatgacaaatattatttaaataataacaaatattattattaagtatrgtaataatatgaaggtttggttcttagtaaacaagatttgattatcaagactcttttccaaaaaccttgattktgatgagtgaataaggaagatggctgaacatcctgtctttctgtctttcatgtagactgctctactgtggctgtgggtttcccaggtgtctcagtggaagagaatctgcctgccaatgcaggagacacaggttcaatccctgaaggaggaaatggcaacccactccagtatgcttgccagaaaaatcccaggaacagagaagcattgtgggctacagttcagagggttgcagagtcggacatgcctgagagactaagtgcacacacacgcaactgtagctgtacaatgaagaaaagacac

SEQ ID NO: 872 - DNA, 600 bp, Bovine  MMBT05165
tactttgagacttactcttaaaattaagtgtacccactgggaatcttttgatcatgattaaattaggaaacccagcagatctcttaggaaacaggctataatttatcaacggctcaaattttacatggttactcaaatggctttttagcagactatagttccatttagaacttgtgaaggaaattacaaggatttctaaatgaaattgtttacaagagtgagatgtcatacagggtcatttcctagtacattaaattgaaccaaaggatgatttcaattttccaaatgatgctcctttakcgatttactaactttagtctttgaattgaatgtgactgtcctgtgacagattactggctgctaatcttgttgatagggcacttaattacatrgttcacatcttttaaggttcagtttccataatcatctcaatgaatactttyctcagtgtattttgcatgtaaaaagtgtgtaagaattctattttatttttcatcgtgtttagatgcttttgacaacaaatagttacgtgcaaatgaaattagaaatattgctactttattaaaatgattgacttgagaacaagtttggcagagttat

SEQ ID NO: 873 - DNA, 600 bp, Bovine  MMBT05267
accccagtctattttctcatgggtgaaatgatgatatcgataccttattggttgctgtgaatgttaaatcacataaaatagaataggtgatgtgtagatattactcaacgactgatagctattattttctaactttcttgtagctccaaacatttatcaatttcttagatttgtagatttttactggttaatttgtctaggcaaggaataagcaaataacactgaaaaataaaaatctgccagttacttgttacaagacagaagcactagtgatgggctcctcaccatcacaataaagakataattgatatggccaaaactcattaaatctgagtattaatctgccaacagccacttgttaaaaaaaaaaaaaaaaaaagtatagccctggcatgaaagaaaacactttctggctgctggtgtggtaatccctcctgtttaactgaaggcttcaagtaggtggaagttgtaacctgtgccacatattccaagagtcatagagctgtcaggtcctgaggccccacgagaagcagccaggacacaaggggttaaactgccttgcccatggggcagagctttcaagggtcactagagggcagc

SEQ ID NO: 874 - DNA, 600 bp, Bovine  MMBT04184
tggggtcgctaagagtcggacacgactgagtgacttcactttccttttcactttcatgcattgaagaaggaaatggcagcccactccagtgttcttgcctagagaatcccagggacgggggagcctggtgggctgccgtctatggggtcgcacagagttggaaacgactgaagtgacttagcatagtggcatcctgaaagatactcctgcatgatgctgggcagctgcagagagttgtagctccagctagtcatacaatcacaagagtaaacagccattcacaacttacaaccattctakacccatacagcaattttatttttcactttcagtacactagttaataaattatatgagatatttaacactttattataaaatgggttttgcatgagatgattttcccaactgcaggcatatttaagtgttcaatacatttaagttaaggtaggctaagatatggtatcaggtagagggtcattatatagcttccctggtggctcatcagatggtaaagaatctgcatgcaatgcaggagacccaggttcaatcgatgggttgggaagatcccctggagaagggaatggcaacccactccag

SEQ ID NO: 875 - DNA, 535 bp, Bovine  MMBT03240
aggccagcagctgacccctattctcacttggtttttggcctgggtcagcttagttttcttccagtagttggtaaaccgtctttgcaycaggagagagatagtaaactggactgaggagagagggatggcggggaaaggggaaggaagggactcgaaggattaatgagctgatttccattaaggctttgacatcttggaatgaaaagcggactgtaagagcagaagcccagtcctctactccggccatgctgccagctggccattcatcaccaaaaattccccaacaaatccayggctgtkgcttaatcacctcatataaatctctattaatcttgcaaagtcaaaacacwaatatatgacaaaagtctttatgtaccctcgattttgtggtcaaaatgttaaaaaatggaactgatcatccaatggttccaatcaactttttttttaaacctccttttggggaataaataaatgacctccttactaatgttttagtatctactagactgaataaactcaagctaaatgatcaaat

SEQ ID NO: 876 - DNA, 600 bp, Bovine  MMBT03032
ttggaaatattgttagaatggaaatcaacatttgttgctacacagggttgggcattccaggcagactccggtcgtttttaacggtgttgctctcatgtccacttacgtcacatctgccgtgacagtgacaggtttcagtaacacagctgccatcagagtgataagcttgtgagcgaagcctttgggaaagtaataaagtcatttctggtcccatctcaaaggacattattgaaaatgtctttaaaagtgatcaagataacacccatgaggctgtgtaacgtttgggtgtttaaagttackaacaatctgcagttgagtccatttcaagctgaaaggtggctcttgcacaaactcccttttaaacaccatagctggttcaaagttttaggaaaatataaacatcagaaattaatagtcaatttcaatagtcagtagtcaatagaaagttctagggcagaagatacttctaagtttgtagctgccccgatcagatttaaaacttgaacatggcagtgctttgcattttgtaatatcttatgagggcctcgtgatttattttgtkaatagtatctattagctgtagtacaggtccagttttaa

SEQ ID NO: 877 - DNA, 603 bp, Bovine  MMBT05170
  misc_feature (1)..(3): n is any nucleotide
nnntagagggaggaacagatcaaggagggaaacctgaactagtctgctattcatctgttcttgatttattctcattgtgtaaattgagcaacaccctgcccatctatcttgatgtgggaactccatattctatttatttactctatcttcttttttaaaagtaataccyagttttgccacgcctgtgttcctgcttattgcaatgattgcacctgcctttcttctggtcattaagtgccacttcttggtatttattatttagagattctgtcattcacatttttatcaggaatcctaggtctktaatgtcatttccaaccttccctacagaagacagctaccactgagcttctcagtgatactgatgtacctccccatagcacattctttagtatttggtaaatggagcatctgatgggctcgcccctagattatagttagctggtggggtttctgaccttacatatttattttttctcaggcatgcccaattcactgagtctttgatctcttcatccttcatctcccatgggagttctggaatttctacccacttagcataggtcataaattttctcaaatttctaagaaccatcctggcag

SEQ ID NO: 878 - DNA, 600 bp, Bovine  MMBT04773
gcaatctgacagtttgctttggtgaatctgcatatgctgctggtacagttcaggtatcctgccggctggcagctatgatgcgttataacacttgagtctaaaattagttgaactattctattttaaggataggctgacattagtagttcatgtcctgcaaaacatgtgaaagttaaactcttagggtattgagttacttcttttaaaatgtagtcagaaatagggctaaatagatagtagtttatataattgactcaagaatttttgtgatggtgatttgattgtagcctgagtatcatkctrtgcatatagataatgtctaagagcacaaagttttactgttactacttagaattaagcagcaggtaaatkatcgtgtttgagttttaaaaccatgagttatgagrttaaacaagattacctgatttttctttcagcgtagttttggaagagctaccgcctataaatatttatgaatgctggaaaccactggctgccttcgctaggaaaaaagtatttggttgtacgttttgtgatctttgtaataactttatttacatgacagaaactagagaatattgataatacttggtagataaa

SEQ ID NO: 879 - DNA, 600 bp, Bovine  MMBT03805
ttaagacaaccttgaagaacatgttgtctctggatttcaagttatgtgaaaatataaatgccttcattgttaaacytaattgaattacatattctgttacttgcaggtaatctattttaactgatataagcccacacatatatttttaaaattgaaagttaaatcatgttaaacatactgtgaaagaatattaaatttattttttgtrgtgactttttaatatgtcaatcattacatgaaataagtgcttcattggctggggctaaatataatagagacttttcataaaatcacattttktttttactaattaattccttaatgttttaaatattttaacactctgtgaagctctggggaacaayggtataaaaccaaaataacacataaatttgtgtctctaagcacttatgtatatgtacgcctagttgttgttctgtcactcagtcttgtcctattctttgccaccccacggactgcagcactccaggcttccctgtctttcaccatctcctggagtttgctcaaactcatgtccagtgagttggtgatgccatccaaccatttcatcctctgtcgcctcttctcctcctgccctta

SEQ ID NO: 880 - DNA, 600 bp, Bovine  MMBT08941
tttatcatctatttaaggtctagagcactattgaagttcgcctccccttaaaaccaaacaaacaaaaatttttttcagagcttccatgaacttccgtatttatagatggaaagatatatgggactacacactttcaagcctcattgcaggaccctagttttagtgggatcatgtaaaaccttgtattgttgaaaacccaaccttgtattgtcttccatcttgaagcagcattgagtattttatcaaactgatagcaargaagtgtttcacctgcttgactttttcttactgtttcatctkagtttcagtgcagtgtgtctacaccctgctgggtgtggaggccgtgactcacctagagagaggatgtagttctctggccacatccagggtgttgcaggatgactgaggcacttctcacttgggcttgatgccattttgttccttccctggttctcacttggatatttgcttggctacttgctaccaaggagaaccagtccgttgagtatttgaatattaattcctctttctacacaagtggctgagcaagtttttactggaagcgtagactactgcctgaggaaagatgggggtggggag

SEQ ID NO: 881 - DNA, 600 bp, Bovine  MMBT07674
atctttcctcatcttattatcaggtatcacttttctaacccgttcttgtctccagtcaaaatgactggcttgtttgttcagcaagcatgaacaagtcactatcattttcatctccgcagctctgagaggtgatgccattaagcttgtataagaggctattggctcagagagagcttaagagstagaaggctactaggtggtagagccaggatttgatgccaggtctttaagaactatgggagccctagtctgctggtttccatcaaccatttctctgcctagaatatccttccacctcckttcctttctggattccatttgtcattcagggtctcattccctccatctcctccaggataccttctgaatcattgaggacaccttttattgcaartgatagaaaattccattccaaagaggcttaagcaaagaaatggaagtttgggggcacaagtaacccaaaagtccagtgagtgaggttggatttagagctcaaataatgtcatcagtattttccgtattttctttcttcctaaatcttggttttgccttcttttctgaaggctgaagtttcaggctccatatggtagcaaaaaggca

SEQ ID NO: 882 - DNA, 600 bp, Bovine  MMBT10612
tgtgagcaagctccgggagacrctgaaggacagggmggcctggcgtgctgcagtccatggggttgcaaagagtcraacacatctcagcgactgaacagcaggcaacaaaagattgaggcccttggggttaatgygcgtaaatcagctacaacgattctcttgaagaaaaccgtgtggatccccgttccccttgctaacctaggaattgacaaagaaagcagaagcccttcctggagctgaacaaygggaacctcatgtctgagagcccctcaggtcgcctggggacgcattttgtgtctkgtaaagagaaatgtgcctgctggagacgtatttcagccccagcatcaattcatcatttccccactctgatactgttctcgtatttttcagtctttcctcccaaacttcagactcttttcctccttggaaaagagattgaatcgtagtgtgaaactttataaatttcaaatgtcacttctctgatcatgagtgatggracttctgccatttaaatacaagattatctggcttctatttgtaaataaaatcagctgtacatagaaatcgatgctggcttttcatttttcacccgagatttct

SEQ ID NO: 883 - DNA, 600 bp, Bovine  MMBT08333
aatgtggaaaggtttacttccagccttataggattgatgtaaaggagggctggccacttcctcttcaggactcatcgttctcagtgcaatcccattcacaatttctctgataactgtctgttctttggccagaaatctggttcttgaattccctctcctgttcttcccatggtttgggaaccaactccagctccatcttgtggtgccggaagaacagagaggtagagtcacttctggacagtggcacagcaagcctacaaggggctggggacgtgaagggagaggatgtgatcctcagakgggaaagggcagggttgtccagagcagagtttgacatcagccggaagagcacccccacccagccactgagatccaaatgtgcgcacgatggaactgtctttacagccaagggccccctccctcccaaggagaaaatcccacaagtggggaacatctggatcaaaccgcaaccatgaaagcacaacatcaaacgagggcttcggagcgaccctgcccacaggccctgctccaagagaaactgcagatcttcctgctctaagcttttaagtgtcactgaaccactcaagtttgggatctccc

SEQ ID NO: 884 - DNA, 600 bp, Bovine  MMBT10749
tgcaaccagctagttgcagatagttgaggaccacttttgtttgtacattgttttcctccagcccctctacctaagttgttttcttcatcctctcaaatctgtttcttccaagaacctttctccctcctggccttcatgagccatgctcactccatagacaaaaacaaggacaggagactctttgccaaagttaaaagcgcatcaaacacgcctagcatttattaatcacaaacttacagacccctcagaacaccctcctcggggcatggccccaacaattcaaagctgacaaccttgggkatatgtgtaggagggatggggatgagcagggagtgtctcttgataactctgaaatggggaggacttctccaaatggagaactgggtggaggccagaggttgggggtgacttagcttctgagtaggaggtgggagtcaaaaaatcagataaacagaagagtgggtatgtatgcttttgcaatcctccccctatgcctctgtcttggtgggataggcttccacttgttcccgggctggggaactccctggaaaggtcccttccttcatcctgttcctctacatgttgaaaaagaatactgtg

SEQ ID NO: 885 - DNA, 600 bp, Bovine  MMBT08144
ttaactaatgaattagtacaaaaaagcctgccccatctataagtaattcaccacgtgctgctctctactgtgggtacacattccacagaagtaatcttgaaaaggacataaagtccttgctatttctctctcggttgtatttctctgagaagacactgttgtcaccagttatatatggtcactagcaagctcccaacaatgtagctggaaggcaaagaaagaaatcaactgacctttctgcaaaaggaaggaaggtgctgatagatagcagggaagccaaaccagttcggaagggaccakgactrgagggccttctccttagttgcgaatgcatctggcctgtgtccatggctagatcatatatctgacaatatcctcccttttaatgctttgcagatccaaggtatattatcataccccaagcctgaactctccagggaaattatgtcaagtcatagccaaggaagttggattataagaaaatcactagaggaaccagctgtctcgtattcactgttttggaggaaggagaaaccatttaccaaaaggtggcactgtgagactgcaggatggtgactcaactcggctttactctcaaga

SEQ ID NO: 886 - DNA, 598 bp, Bovine  MMBT09156
  misc_feature (1)..(115): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgatcagatgtgtatcctatgaggctgtgtatatacaggaggactctgggagcctgcctgtgtgtgtgttggggggtgtcctggggaaccggggagaggcagtggaaggggtaatctcagaaatggctgagcactagctgaagactagatgcaggagtcagggaggcccttgataccgtgtktgggaacagacacaatgaatggctgcaggacsgagagagggtgtggggggaggagagccaacagaaagaggacttcccaggatacagaaaaaacactcagtatgtttatagacaacaagcacatacaatgtagctctatacaataggtgcttaacatatgtactatgtacagtaagtgctcaacagcagcttgctacatataccatagaccttcagcatgctgaaggcagcgcacaaggcacgccacgggaattcctgactgtgtacaagcaggaattccacatgttagctacacata

SEQ ID NO: 887 - DNA, 600 bp, Bovine  MMBT09657
gagggcacgagaccttccttaggaaggcctggagagccgaagccagcatccggacccaccaggcggccactttccttgcaagcccccagagtctcctttctctaacaaaactgtccccctgacccttggatctgctccagcaacaggtgaataactgaggctgccraggcrcaaactcgcatatttctgccattgtggctgctctggtcgccctgcccaaagcatcctttccacttgccatcctgtctgacactctcctgctcctttttcagatcttcagagcccagtttttggggaagkttgttttattttttttggccatgcagcctggcatgtggaatcttagttccctgaccagggatcaaacccatgccccctacatgggaagtgtggagtcttaaccactggaccaccaaggaagtccagagcctggtttaaatgccaccttctctgagaagtcatccttggtgaagactgtcagcctgcctggcttccactctctgccccactgtgtccactgcrtgctccactcctgccctggttccctgctctaatgcgggatttgtgcttctctggagcagtgatctcagtttggagctc

SEQ ID NO: 888 - DNA, 474 bp, Bovine  MMBT08682
gatagcactgctctaatgaatagatgtctttgcttctttgttaatcctttttgccttgtaagtgagtaagccacctaaaatccttgatgcatgatcattttacacttatctcttctgtttgagtggtcatcataattacatagcatcactctattaaatttgcagtgtaaatggtaaacttgtatttttcccccccttctctagttgctttcaccagaagatttagtgaatgcatgcaagatgctggaagcgctgaaactacctctcaggtaaaagaaccttgtgggaagtttgccgtckgttgtcacaattccaccctgagtagacagaacagccctgtaggtctgtcctcttgcgtggtgagccagcatatacatcactcttctggaagtttgtttctcacgtgggcaggaatcacctggtaccatgggcatctgtcatcccagcttccatccttctcaaggctgtgcaagg

SEQ ID NO: 889 - DNA, 539 bp, Bovine  MMBT06949
aactttctgcagatataaccctaagtggggactttgatatctttgtacaaatgcgtgaactgtttgcctgcaagatccattccttcccagcagtcctccaccccacgacccacattaaatgttatttcctctggaaagagcatctggagaggtggctggtgtttggggactaggtttccccagcacagtgtacacacttctgtgtagacttggcacactgaattctaattctccgtttatgtctgccttccctcaagggctgctcaagggcaaaatccataccctcttctattgtgtctkcctaagaaaaaactttttttgaccgaaagtgaccgctgaggaaattattgaaagaatgaacccagagagctattatacttatttagaaaaagattatgcttacaagacyttcatagcttgagcatgagataaaaggaatagaaaggctgaactggtttacccgctgtttgctgattcataacagggaggaagggaagagtgatttggaggtggaggcaggggaaaaacaaaaggcagtg

SEQ ID NO: 890 - DNA, 600 bp, Bovine  MMBT09046
cagaaagtttgtattttcacttatatctgagaccaatgactgatgaaaaatactttcatgaaaatagaagttcttttgctttatttcttgcacagtggtagtcataatattgtataacatataattaaattcacttttaaaacaaacagtagctgttattggggtaaatgtagcccatgctgctcttcttggtaaggggggtgtttaacggctgaaaaacttttgttttgaaatgtgcatgtgaaawgttaatccaaacctctgaataaggtgtttgcagatgtagctagacactataakacacatgcyacatacatgaagacctgtggtctccatttataggcttgcatgcatacttccaaaacactggtttgaagaacaygaggagcaaagaaaggaggtgaaagaaaaaaaaaagctcatacaaaattcttgagtttcctggaggcaacagcagctccttaaataaagcaacagatcatgggcagaagtttctacaacttcccagtgatagagagatacaatggcttagcagtaaaactcacaaattaaccgcatatgcagaaggggaacacatcctcaagagtattaggattaatg

SEQ ID NO: 891 - DNA, 598 bp, Bovine  MMBT11189
  misc_feature (1)..(175): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggttttgttgatgcccttgaaatttctaagtgtaccaaaatttcatacaaccatgatagtctgtatgtactagcatatattaatttaatcctttattttgcaatatcctgcaattgctattkcaagttgagttttcaaagaaccctttaaatttctagttctaccatataacaaatgaaactaaacattacctgacccagaatttactgtctaacccttcgacagcaaatatgagaacaacggatgagtgacaatttgtgtgaggtttagatgaagaaacagatcaacgtatgataaatttaayagcaactctaacctaaatgaaaatggaaacgccagattctcccgagtcttaaaagagagackagtcacaggctatactggggataaagaatgtgacgcacttgaatggaaatgaaa

SEQ ID NO: 892 - DNA, 600 bp, Bovine  MMBT08981
ttaattagagccaggtcacagggctcccatactgtctatgtactgttagtcgcccagtcgtgtccaactctttgcgaccccatggaccgtagcccactaggctcctctgtccatggaattctccaggcaaaaaaactggagtgggtagccattcccttctccaggggatcctcctgacccaggaattgaacccaggtctcctgcaatgtaagcagattctttaccatctgagccacagggaagccctatactatgtcctaaacacagttaaagacattgggcacaattaccagaagaggkaaatgaatgctgtataagcaatacagcagacatccatgtaaggatggaatactctaggacagtaatcttaacttttaggatcacaaacccctatgagaatctaatacaagcgctgcatggacgaaaatgagcaaaagcactcacaagcatacaaggcagttgtagactaaaaatgtatgtccttcaygcaagcagccttgcaragagttacatttcttgctcatttttcttatttttataagaaattartaagttttataagaaaattataaaattaataagtatttcctgaaaatgata

SEQ ID NO: 893 - DNA, 600 bp, Bovine  MMBT08818
ccatcccccttttccgtgttcttcccccaaatgtcttcggagaacggatctggcagttaactgtggagtcttgcttctgctttgagtgtccccaagcacgtgcgctctgtgtttcaagagagcttattggctaccttctgctcggcatgtttcacactgagacccactcagaggctccgtccagcactgtcctgatcatcgcagctttacaatgagagttaaaatcgagtcctgtgcgtcttccaacttcattcaacaaccaatccaacctttaaagaagtaacatgtgataacgtatgkgcttcaagttccgtttcagatttttaacttatgcttttatgggaattggcgagttatgattagttatcagtcagccccaccctatttcaattttagtatgtactgtacatattcacaataccagcattcaggggaaaagtatgaatttgagaaccaatgtttgtaaagatatcacagtcatacgctctaagttgtcctggaaccaggttgacctcgatcttcagttaaataggtcagtgcagtggaggctgctttctaggaggtccagccccacgtgactctgagaactccccttccgag

SEQ ID NO: 894 - DNA, 600 bp, Bovine  MMBT07662
gtgttctggagagccaggatcctatttataggatgaaagtcttggaaggctctcttagcaggaacgatattaattaagtggtggtaacacagaaaggagaaggaactgggatatgcagggggcacaggaaacataaagaacaaataatctctaggtcttttctttgctgggaacacactatacagagmgtacaagcatataacaactaaatgaattggctgttctgagtttttaaaaaaagcaaaacaaaacactgttttttcttctctctcccaatggattccacttaggattttgtaktctttaattcttgaagatgttctacaacactgcaggaaggagcatagccaaggttggttgggagtgatgggtaaggttttacggacagatgcacatggagtataagaagttttccttttttaggcagaaaggaaataaactcagtgagaatataagagtaagacttagatttcagtattgatttttttttctatgatacatttgtattacttttccccatcaccctctacatcccagatgtccatttcaggtacaggttaaatcatctttcctcaaagaagattatatataggtagccaa

SEQ ID NO: 895 - DNA, 600 bp, Bovine  MMBT07106
ttagcctccaattaaaataaataaatttgaaaaaaaaataaacaaatgacataatttcccatgatgatacagcaacatgaactatgagatgttacggagaattatggaatgaagaataagttggagtgaggagtaactttgtacaggtacgttcatgaaatcatctttgcagaaatggtaaatctaagcattgaatggtaaagtgttaaccacaggaagatctagagacagagggttctggaagcaaaaagaaagactcaacgtcctagacaagcatttagtatttgaacaacagaaaakctgcctgcatggtaaaagcatggtgactatgtgagcgtgtatgatgtggggtgggagagagctgaagcaaacagaggtgagggaaaacaagggtagtctgaattttattctaattgtgataggaagtcatgcatcagaagttttcagtattttctcagaaaagatgcctgcttggtgcataactatgtgatgaagcaaatgaggctgttctggctcctgtgtaattgtttgtttcatgcaaatacagcaggcacagctgtcaaagcaggtacttctgtggttggtactcagagtggttgt

SEQ ID NO: 896 - DNA, 598 bp, Bovine  MMBT10822
  misc_feature (1)..(126): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatgaatgaatgaactcaattcactataattaatataactttttttaaatgtctagggtagtttatactagggctctagtaacaatatgctgggttttgaaatgaactcattttcaaagagagaaaggtgacacaaaatgtaaataatamcaataataataataataaackttcatctgtatttcttaaaatgtctaaatcatgatggcaaagtgaactattctttcctgagaaaagaacaaccacttaagtattaataataatagtccaagttaatgtgtgtttctgttatcatcattttggtctttgtattatttcataaatatattcttaaaagctggatgcatctatgaggttatatttacttcagctatcatctatgcaaattaaaataaaagagcaagtgcattgtatgctcctttacttgcatgggccatcaaaaaaaaaaaaataactgaaggctttttaa

SEQ ID NO: 897 - DNA, 600 bp, Bovine  MMBT10413
ttcttccaggcctcagattccttgtaacccccatattcgggtctggggaaagggaccagcctaggggctggaatgcacgagtaaactttgcaagttccctagcttgcaagtttgagctttatgcaaaatctaagaacatccgctgtcgtttgcagtgagattgcatattcgataagtccgcagagtccctcttagccagtgaggcagcccgcagaagtcaggtgtcagggaaatagaaataggtggtcttactattctctctggttttacatctgtctgcagagactatggcttacacakattagcagactcgacatataccgagacggtgcagagagtgatgcttgttgacattatcagcaattcctggaggggagttttcatactttcttttctggtcttgctttcctgagtttgtttctttgttctcctgtacacctggctatcctttatccccgctgctgtttatctccctgaaatagttttgtgtatctagccatattaaatccacttatttattgttcgtttatctctgtttggtgtatcaaatgtttatttataagccactcatgtatctaaaatttacctgattgttgcctg

SEQ ID NO: 898 - DNA, 600 bp, Bovine  MMBT05999
ctgtgttgtccctacaagtttactcttgaacagatctcttattctattgacctgatcttatgctatatcaaatccaaaagtcatatattttaccctaattcacttagtaataatacagttttgtatcagacggcatgaaattttcttcctttctggtccttcacctgaatgtgggtctaatgtacttcgtgtactttgggttttgtgtttttttttttttttgtaatgtgtacctcatttggcacacgtagagataattcattcatttctccatttggggactttaaaaatcaggattakgctttgtctccttgttccattgtttcctggaatgcttaagcacctctagaaaactgggtcgcttgttagattgagttgaagagccttagggatccatttttcaaggaagtctattgggtctgcctcctctacccctttaggcagtccagtaattctgacatgctagttcaaaacagtatcttaaaactattatacctcttctggtacggtatatctttcattttgaacagttgctttatcgttagattaagcttaagtgtctgggagcattatttgatgttctttattttttgctttaga

SEQ ID NO: 899 - DNA, 598 bp, Bovine  MMBT10699
  misc_feature (1)..(116): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcagatactagcttttctttgctggtcatttgtcatgttctttttatggactggtgctcagatgaaacagacaagcccagttccagcagagggtcagagacatgactgctttggaaataagatcctaaaagaaatagacaagggagctggaatgtgatacaaaagggggaaaaaaactaakaggggtgatgtaacatttatgttgaagaggatgaccagctgttctctagctctattgaggaaagaacagcagcaacaacagagttaaaatcgtagcctggagaacttagtatgatatctggggaagaattcaagaacaaccaccctggataaatacctaaatactgggggcagtgcattcatcttcctctggaagtatttataggagaacagatgccccttcaagtctggtcctatctgacagcaaacaagagtgtaaagtggcttcataaccttcctttcctctgacccgctggctt

SEQ ID NO: 900 - DNA, 600 bp, Bovine  MMBT09631
atggtgtcattagatctgttaactttcatgtgttttagtgtttatttttctgttgagtctctgcatacattgagatcagatacttactgatattttctgttagtttgtaccttctcttttcttaaacatttaatgatctttggatttattttcatttttttgtgagtaagaagtctaattttgtgcctgctcaggcccacacaaaataatcaacttattgtctccactcaatttattgaataactcattctttccagtgtttttagaaatgaaatatgtggataattaaaaaataagackgtttgaacttgtgttgaaggtttgaaaaggcctctgtggagtaccaggagcacctgtgtgccatgacaggtgtcgattgctgcatctctagcttcgacaaatccgttctcacrttggctaatactgggcgtaatagtgccagccccaagcattctttgaatggtgagcattccaagtttaaacaaacagttgtagtcaaataatttgtactcatgatcttactatacatttttagatatctctgctctttgaaatatttataactgctttggatctctcttgctgtctctttattttatg

SEQ ID NO: 901 - DNA, 600 bp, Bovine  MMBT06735
agttaattcatttctttccataacaattgaatgtcgaaaatccttgaacactgtttcaggaggtaggggccttagacytatgatatataaaacctctgctcttgagaatatgagtcttatatccaaaagcagcaaataagcaggtataaacaaataaaataagcccaaagaatttgcaatgaaaactccaaacttgcaatgcatttataaagctaaaagcttgttataggaaacaaaaaaaggtggaaatttattgaaattgtgatatattcagaaattcttgggagtttggcaagactktccaagctagatcttgccttattttatcaattcatattatggcaagttgatgtaaaaagcataacatgctttgtaaaactttgttcctgaagtctcagtcagcttctctctctccacacgtgccctaagaggatgacatgtaaaatgccactttaagaagtatggaaaaacaggcaagaagagatggagaaaacttgataggttcagagtcagaaggagaaacgggaagtgtgccttgaccttgcaggtcccactgcaagagatttgttggctagcttaaacgcagcttgtgagcttggr

SEQ ID NO: 902 - DNA, 600 bp, Bovine  MMBT05740
taactggcagggcttggacacatatgggaagacaggaacgaccaaggatgtttgacttaacatgtaaaaatcgagaagctattctggctgctaaaaaagaaatttaaaatgatttatcactgacaagagctgatgttaaagtgatttaatatataatctcaagctatgaagcatcattgccaggctgttccaccaccctttactttttggccttaaaaataaagaggcttatactttaggacttgagtacatacctgattctgttgagttcagaggatgacccccaaattttatttcagkttggcggagtttagtcatgtttagcagctgtgtgacttgtggaacatctgtcgttagttggcagcttcgtggaataatgtctataggttcatctattggaaagggagcatcttgtccagctggaaataaagacaaacattcattccccgaatgtaagcaatttctgccaaatggacataccttataaatgaaaacagttaaagtaaagcattttagagtacgactttggatgggttactcagtgttatacagtcttggttacctcatctgagcataaataattttaaggtttactttctg

SEQ ID NO: 903 - DNA, 600 bp, Bovine  MMBT05669
tgggcacttaggctacttccatatcttaactattgtaataatgctgcagtgaacatgaggtgcatgtatcttttaaaattaatgtttttattttctttggataaatatccataagtggaattgctagatcatatggtagaaataactccgtgaatgtgtggtcaatcaatctatgatgaaggaggcaagcrtatacaatgggaaaaggacagtctcttcaataaatggttctgggaaaacaggatgtccacatatgaaagaattaaagtagaccactatcttctactatacacaaaaatkaactcaagacggatgaaagatttgaatgtgaagaccaaaactgtaaaactcctagaagaaaacgtaggtagtaagctactcttgacattagtcttggaagtaatcatttggacctgacttcaaaagcaaaggcgacaaaagcaaaagtgagcgagtgagactacatccaactaaaaggcgtctacatagcaatggaaaccatcagcaaaatgaccaggcaaccaaaggactgaagaaaagtgtttgcgaaccatattcctgagaaagggctaatatctgaaatatattttaaaaactcat

SEQ ID NO: 904 - DNA, 600 bp, Bovine  MMBT07569
caaatactacttccgtgtctcatgtttatcatcctgtattctgctatgcccaactattattcctggcatccctttccacaattgtcttcctcgcctcctgcattcatccactccctgctcatgattcttatgtcctgcactcaattctattattggtctcatgtatgccctacattcaattttcctctcatcttccattccaattttttcttgcactctatcaaaatcttaattgttttcgtgctccctctttaaagtgacaccccgaaatcatatcatatcatgaaatcctatactcckcctgcatctcaagcccttctttcaatgattactttcactcatcccctcatcgacttaccaagtagatgtttgttgagccccctattgaacgccagacgctgatctagtcaacagccaactcctcactgcactaattgttctcttgcagcagcacaccctctctgctttcatgcaacccgtgcatcccctcctcagcctcccaacaatcttcccagctcctctccaacaccttcaacaattatgcttgagcacagcttcccctcctgccaaacccagagttcgccacctgccctgctctca

SEQ ID NO: 905 - DNA, 600 bp, Bovine  MMBT08264
gaaatatatataagcctggagatagtcctcattcatggtctcaaaattggtatcattcaaagatgacaaagaaaaagattagctccatcacaattcttctcttttggattcatatatttttcaatcacaaaacattgatttcggtgcaatacccatactgttcagtaaaatttagggtcagaataacagcaggggcaacaaaattcctaatatgttattatccctcagtgccttcckaaatcttagtgcctatcatccacattaaagatattaactgaaaaatcaccttctaaaatagakcatgtcttagctgcagacaaggccatatctatctttaaaaatagaaagtgtccccaggaaaagctgcagtctcattaactctgcaaccattaagtcaggttggatgctataaacaacatttcagagcctctgtgggtggaagcactgaaggctactcaatctcacctgtttaaatgcctgtaaaacttccgctctctggctgaagtgcttgaacagcagctgcagggctcctgatagcagaggcgggtagtcatgcatgatcagatgaataagaacccgtaaaaacgtcctgcctccttc

SEQ ID NO: 906 - DNA, 600 bp, Bovine  MMBT06164
gtttgagtgtgatatgtcaaactcagtatttatttctgaaggtaactattgctttaagcattttattgacaattttagtaactgctgcctatgcagagtttctgcaaattgaaatgaataagaactggtctaataactagaaagactaaaaaaaaagggtcaaatttgatatttaagacacgcaaaaccataactttgtgcatactcaattatttttgaatttttaacttctcaaggtaagacataattggaagttttggcttaacctataatcaatatacacttattagtatagtatgkggacttccatttgyactcttgcacagggttgccaatagggtcagccctttccaacacatttgtgttaaagatactttaaaatttcttaytgttttttgtctgcatagactcacaggattaatttttacagttaaagcaaaatcaaaaccagtttgcctttactgaccaccatttcattttatcacttgaggttcaatcatagatgcagaatcactatgaatattatggaataagaaattttttgtacaaaaccaatctcacactattgtcagaggagctaggaagtaaagatctgaaaag

SEQ ID NO: 907 - DNA, 600 bp, Bovine  MMBT08141
tttaaaagtgaccttcttagaagagtctcatgttctacatacttttatgtcttgtgtttgtatgccaacacagtgtctggcacagagcagacatcagtaacactttaattaattccattgatgaaaattatccagcatctctcatatgtcattattcatttagagattccaccatcacataaatcatggccagtctaataatactcccattgttttatagataagtgacttttctaaacttcatatagatggttaatgatggtgctgggtctgaaaccaaggattccttcagctccagakccatataactgaggtctaagctatttatttatttaccaattcaaataaggtatgtatttgtttccctgattggatgtactcaaggagcatgcctgaatacgcatttgtctaaagaaggaaagggaaaaaaaagagaaactcttgaagctggcttatacatttgaagtgcagattgaaactaatttatagggaaaagggtgtctccaaataatttacaacactgtctgttcccagtgagtgtaaacaatccagagtggtaatgaattcttggtggttacgaagtcagcctccagtagagaa

SEQ ID NO: 908 - DNA, 600 bp, Bovine  MMBT06374
tgtgagtctgtaatttagaagacaggctgaagttaaattgtcagtgaagacggtaaaaaaggagaacatggccaaagagggccacatggtgggcagggagggtttgagaacaggttgtgctgaggtgtgtcagaaaggtatggaagttgaaaattagggaggctctacattacgaaataagggaatgatgaaagcacagccagaaaattatcacaaaactcaggcttgtaagtgtggaattatagtagtagaagggtgcctgttcctgacgtaatttgtgatagggctctgttagagackttgggctttgcatgaatcttacagcaatctttatttcataaaagtttataagtagagacaaaaatttgaacacagagttatttagagtctttgtataaaaagtttcttagaatccttgctgtttgttgtcattcagtcactaaatcatgtccgattctttgtgactgcacggactgcaatgcatcaggctcccatccttcactgtctcccagagtttgcacaaactcatgtccattgagtcggtgttaccattcaaccatcctctcatcctctgatgcctcctcctcctcctgccctcag

SEQ ID NO: 909 - DNA, 600 bp, Bovine  MMBT09512
gattcctgcaaaggaagcagggagctcttcggtcccccaggagccatggaggaagtcgtcacagaggaagagagataaagagcggcagaattgtgaggactgaagatgtgcagggcagacatgcaygggtgtattaygtacagtatagatttggcaataggtatggtgttttcccctgtacttgtggtacagtagaaaaattaggaaggtgccaaagatttcttgaaatttgaattataatgtggaatatcacattcatagttttgagatttcatattgtatctgtcagactgcattgaktgcagcttgtttaaaaaaaaagaaaaaatagcatcagaaaaaaatctttttacatgttaggaggattggaatagtgtgaattggactacctcaaacatagttttttaataatattcaacacacagtgaaactcatacttgcagaagtaacttattctctttttctctgttatttgccagtcacacaccatctgtgcaagtcatatattattttattcagtataaaatttatagttttaatgtctaatactattgatgtttgttttactggtatgtattttgatttatggggccattttaa

SEQ ID NO: 910 - DNA, 600 bp, Bovine  MMBT08761
aaatattaaccttaaattttcattttttaaaaactatgcagtatctaagaatctatacattctaataaatgtttttcagggcatccttgattttatttttcactacattctttttctgagtgtttcaatctccagaagacagcaaggaagaatcattgtcatctgttctaataaatgtattttcttgttcttatatttctccctctagcctttagatttgagctctttctgtttctctygcatttcttagcgattcattccacacacctcactctgctagttattagcgtttcctccctkacaattctttatgtcttctcttgaaagggacaccctgctgctctcattacttgttctttagatttccttyagatgtccccttttgtcagctacccagttcccagtttgcagggaacctgtggatggcaatatttctgtcttcttttttaatttttactcaaaatactcagaatgcyrtttgagtaacaatggtgataggtatattgcatttataaattacccttcattaggtggattcaattaatttatgtgcataaattcattaatagtctcaattttctgtgagatgtgggtcagtgt

SEQ ID NO: 911 - DNA, 600 bp, Bovine  MMBT06081
taatttggtaaattcagataaatttttaggattttttcttttcatttcacttgttttrataaaatgtkaaaaagaaatcacattatccacattcatatcatttcttccagtagtggtctcttctcatgtctgtcttattgggtaaattagacctctaaagaaaataaatgccatcggatgcagtccatyaggagactcgcctyctgccgttaagtcagaacagacacsggggaaggtaacacttcactacttgtacaaagtctcaaaactaacttatatacttttaatatttcccgctaktgtttccactttgctggagttaacaataaattttagcatggctgatgtgatgtgaaatggcaaaatatttttaaaacgaaatgtacttcacaggggaaatgagaaccaaagccctgcttgtgaccagccctgccctgtgtggcagagagctgctgccgctccctgaggtcgggctgtgcgacactgagcatgctttacaacttgtgcgttgacatagctcacagccgaattcaggaactgcccggcagacattaattctgaaaatgtctaaactactcctgataaaactcccagcctggg

SEQ ID NO: 912 - DNA, 598 bp, Bovine  MMBT10750
  misc_feature (1)..(75): n is any nucleotide
nnnnnnnnnnnnnnnnnnnnnnnnnnnnnnnnnnnnnnnnnnnnnnnnnnnnnnnnnnnnnnnnnnnnnnnnnnnctgtattaacactcttagcacctaccaaaacatacacacggtatggcctccggcctgttggaacataggcataatatcctccactttttaatgtatgtcttgtcactaggtggtcagtgaatatttttcttcccctcatacacacagggtattttgtttttaagcattggagagcaacaatagaagcagtgtgtctgaatgcaggaacagtctgggaattcaggkgctgtgaattttatgatgtctttgctatttccctaaagcacgattctagaccatttaatttctttattccagtgtttcttcatctggataacagaaatgatgagaaggccagaattgaaagtattataactatcttaaccctatcagtctaytagccatagtacatgaatcctcataatcctcataatcattctcataattttctttgaggaatggtctgtataaaatattttttgctccttctcactaagaaaaccagttcatgccctaggctcaggaggcttcagcctgcctatag

SEQ ID NO: 913 - DNA, 600 bp, Bovine  MMBT06230
tatatttaaaacataaattaaatttcttgcatctggatacattatgagaaactggatggaatcctaatgtaacttctctgggaacaaatgaattccccaaccaactaaatcagccaaatgatttttttccccaaagatttatctttgctaataaggcagaacaagcattttccaagtgtagtatattatttttttgctacacatttttccctcctacttcttactcctgcatacacagcatatacataagcattgaagttctcataggaaaagctttatctaataatggcctactggaakattcacaaaggcaaacctcagcatccacctcaccacccatcctaaaatctaggatactcaaatctctgacagataacattaactagttgacaaagatgcacaaaagaaggagtagctaaaccacaggaaacaagtttaagtccaggattcccctaactagctaacatgcaayaatatcttctacatatctctggaaatgtaatgaaaaratactttttcaaaacactcagtagggtttgtttatttgtgtgtgtgtgtttgtgtgtgtgtgtgtgtgtgtgtgtgtgtgtgtgtgcatcc

SEQ ID NO: 914 - DNA, 600 bp, Bovine  MMBT10500
aagataacaaggaaagaaaaccatacctgtagaaatgccttaaaggggagcagtgagtcctagagacatcacttcaagccttcgacagcctttgaggtaaacacactaggcctcctcaagaaacacactaaattcaaactcatttaattacatgtgtcagtcagggcctcacaatcaaacaatcaaccagactcctgcgcaataacaacactgaagccatacctagacataaatacaataatcaggtgtgccaaaaatatgtgaaacattgttacttgaattgactgatgagcccacctkgagcaagatctacttggcgtttgaaatgaacaactattaatatagttgcttatctgtgatggaggtataatcatgatagaaatgagacaaagtctaaccayagcccaaggaagtaccaagttttctgccacattcatcacttcagagagtcaggtactgagccagtgccagagacaaaatagtgtctaaaatatccctcctgcccgccagaggccctgcagtccacttggagattggtaaacaccagactgcgacctccactcaccctgggacagaaacgtcacatgccttatctctaat

SEQ ID NO: 915 - DNA, 598 bp, Bovine  MMBT01917
  misc_feature (1)..(53): n is any nucleotide
nnnnnnnnnnnnnnnnnnnnnnnnnnnnnnnnnnnnnnnnnnnnnnnnnnnnntgcgggaagaagcgcgcacagtgaagagctttatcttctatttaaaaactccatggacaaatccatcaagctctttgacaggtaaattaagcagggttccagtttccaaggagcccaactcatattccccttcaggagcttaactggctttaaaacctgcctcagaatttatgcgtctcggtcttcctcatggtcagagccaactcactgggagccacccacagctactgctgtttctcctggatgwggctattcctgtaacaggcagacttttcttcttgaacaacccacccagagggtaagtcattcctttrctgagcttggggaaagctgtggcagttacaaggcacattttggtcactgatggaccgtgacattaaagtcagtaaattccrtttggagacagagattcccagaccttactttcactaggattgargaaatcatagccccwgtccaaaaagaaaaaagaaaaaaagaaactacacaggtctctttcctgaagagtgatattctgaagggagtgggaaggaactaaatcaact

SEQ ID NO: 916 - DNA, 600 bp, Bovine  MMBT01902
ttgtccttctccacggaatcttcttgacccagggattgaacccacgtctcctgcattgcaggtggattcttcaccactgagccacaaaggaaacccaatttatggtggtagaggtcagaatattgattacctttgaccagagcaaatgaataactgggactgttatagcctatacataacaatctgggtgatggttacacttgtgttagctttgtaaaaattcattgatctacacaaaatgatttgtgcccctttctgtatgtatttatgtcacacttcagtaaaaacagctcacttttwaaaaagtggcatgggaggataaakgtattaagagaaataaatgtgatcgaaatccagggaacaaaagcccaagagaataatagaactgtaaaatgtaatgaaatatgaagagaataaaatatatttattttgatataaaagactcaagtaattttaccaaaatattctataattattaaactcctattattaatgggaaacaagtgacatcttgctgcattatttattttcataaatagcttttgatgggtaaataggttctgtatwtttattctgaaaaggattgtgcagaccaatatt

SEQ ID NO: 917 - DNA, 600 bp, Bovine  MMBT02074
atttgcattgatagttggacttggtaacttgccagttaccaaccagctttgtacatttcaggcttgaaaactcccaagtactgttttcctttgagaggctgaaatgtacaaaactggttttctgaaaatcttccagcaaaagaatttttagaaataactccaaaaatttctttccctgtaggagggtgatacgatagtgtggaacgatgatccatcgtgtctcatgttagaatgtatactattgtaattggtttaaaaagaatgtgtattattgtaattggttttaaatgagagaaacawaataagaagctaccctcccttttcagtttttttttccttttactcttacaaatctttgttactgttgaagttcttttctctaatgtagtcatcattttcacaacactatgtctagtgcctactaaaaggagtagaaaggtaagaaagttcatgttttttttgttttccgaaataatcccaagcttaagagaaacaccatgtatgttgctttgaacagtatctttccaacacattttcctttcactttctctcaatttggaaaaaagaaaaaacagaatttcaactcaaaaatatttccat

SEQ ID NO: 918 - DNA, 600 bp, Bovine  MMBT02221
tcatatatcatcatcagaaacttcaaaagacttggctgagcatggaattgacacgttataacttgagttatgcaggcttcagtgtctaaactctgtcaacctggagaaggccctgcttttcagatcagtatctaaaaatagcgaaaatctagtcagatgttgctactgtctgcatgtgactttgggatcatttttcctactctctcacctccttaaaatcatgtgctatgcttttatttgcctaaagaataattcatatatccaccatagaaaatggaggaaatatagcattgacacagwaaccagagtaaaaagatactggggatccaggttgtcccctccccagataacccaccatgaatatctttggtatgtttccttctcgctttttttcggtgtacatgaatacaggtttttgtttttttccttgccacaaaaatcaaaatactgtgtgtgctgcttttgactggctcttttcatttcagaacatgttttaaggtaaaacattaatggttttttttataccatgaaataatctacaacagtggtttcacactggttctagctttcatgctggtcccaacaaaaccccccaagggt

SEQ ID NO: 919 - DNA, 600 bp, Bovine  MMBT02463
agcagtgaaatgatactttaaaattttaatatagaatctatttgaagtcacttcagagtatagttatcagaaagagagaaattattacttttcactcatttgtacttctctttggaaaatcttcttgcatgttgggattctccttggaccactgatacttcttgatggattcttctacatttccttcttaaatttcttaattttttttcacagaaaacaactattcatactcctgatattcaggttagataaactcacctcatcagaatatgttataacatgctataaacaatgtgattwtttatgtggaaaatatttggagctttaaagctttgtcaaatgtctcaaagaaattcataagaagtttgtcatagaatttcaataagattwcatccataaactttataaagtaaggcttgtagggggatgtatattttttcagacacagagaaatgttaatgccccaaagtgtgctatcccttttagcactggaattggcaatctgatgagctgattttgtaggtttgccagtgctcagagcatttttggaactccattcatgggagtgactttagagctagtttatgaaccacacaagga

SEQ ID NO: 920 - DNA, 600 bp, Bovine  MMBT02274
ataaaagttgttaagaaagagaaaatgaatgtctctgtctattcattctgagagtgaaaagatcgaatatatcttgatgttcaacatccactgtttgggaagcatatacttttttttgccaaagctgcaactcaagattattgaacatgacatcaacactggtggtattctttgctgaaagaagtgaaccatcatgggccttcaaggggtcagtggcagatgtaatggggccatttgattggagaactttcagtctcgttgctattcctgtgcagggacttctccctttatattcagtcwagtaagtaaagtggaaaaattcagagaaataaaagccaactggagggactgcttacccccaggaaaatttaataaattgttcactagcctactgaactcatgcacacagagctctttagtagagatgtgttttcaacttcctgtaacacctgtctaacatggtttaaagaatgtcaggagtaaagatcttttaatggcaaagacaggaaggataaccaaggtacacatttgtattaccagctcatttcgatccaggccaagctgtaaaccagggtgctgagaaggaagttgatcatgaca

SEQ ID NO: 921 - DNA, 600 bp, Bovine  MMBT01504
aaggcagacggtggcctttgatgattgatccccaagatcaggtgtgtaaccagtgcttcagatgaagagcagcctaytaactctgcttaatatcattctattacaaattccaaaagtagacttcagtgtacttgtaaggtcttgaacgtaaacctacaaggccatcaagatgtcttatagttcacatccctcattttatggagaaagtaaaaagggaagagtccaagtgctctgcacacttgattttggttggttttattcagagrgttgaccatttgttttctgttttctatgggagcwgaaattcattcctgtatagtccttgtccctaagagttctgaggagtcagaatgaagtcagggtatgatgaatttggcgctagtggtaaagtatmttcctgcaatgcaggagacccgtgttcaatccctgggtcagaaagggagtggttacccactccagtattcttgcctggagaattccatggacagaggagcctggtgggctacagtccttggggttgcaaggagtcggacacaactgagcaactaacactttgatgtgatgaatttgggccagctttcctggaatttactaaattcc

SEQ ID NO: 922 - DNA, 600 bp, Bovine  MMBT01418
ggaaaaaaaggtcagtattttagtgacaaaagccgctgctgtgctgcaaaaaattcatgacttgagttgaatgataaaaggacctaattctttcttacttcaagcaagcaaatgaaaaaaaaaagtaaagtcactgaaaggtttgaaactaggatacgttaaaagtacagactagaagtttgaaatgtttccctctcttcttaacctagcccaaaaagacagggtgaagattacaaagcatcttttcctttttgaaaactgaagtacagttaagaagtgtttgggcttttcaattaaaawttttcaaacttagaaactaaatgaaaaaggacttaggatatgactgcatctgcaaagcaaaatgtccagtggtttcttggatgttggttcttctatttttcattgggaaaaaaaaaatccctgttttcatttgatcttttaagtcaagggggtgactgcaaaaagctgggtgtgaggattccttaagatatcagcagagttttcttctgtacacaattatacataacagggctcatgttttatgctgttgttttaatgttggaaattgtatttcacagtgactttcatctggccttttgg

SEQ ID NO: 923 - DNA, 600 bp, Bovine  MMBT01143
atttccagaaaacagattttggcaaaggttaccactaaacctgcaaagaatacagttccgttttgggggatttttttttttaaagaacatattcattccttttagccacaggctttcatggactatgtttatttttccttttcaggttatagtacatggatttttttcatcgtctgatgtgagaaacacacatttctttcctttcttcgttccttcctcacacagttctttcaactcgtgggtggttagccaaagtgtaagattgtattttagagaatctattttctttattatcattawattatttctgagaaagaatgagttaatcagtccactttctgagggctttgagaagaagcaaacacgcgtccagcaagcaaggtatggttacggatttyaagtacaatccccggacgagtggcctaagtggcccagaatcctgcacccagaggggacagcaggccctgggtctgctttggatggtttcataaaccaaaaacaaccactgcaagtgcactggtttgagaggaatgtctaagaaaattgccttccttctcctcacaacgtgtcattacagaaaaataggaacccgtacattcc

SEQ ID NO: 924 - DNA, 600 bp, Bovine  MMBT06602
gcattgctggctagagatttcccaggtagaagagcatagattgtatttcccatcctgtattttaggatgtaccttcttccatttgtcaagagatgctatttccaggttcctggaggaatctgtctgtccagcttatgtggtgaactgctaccagggttccctaaagggagggaatttgactcatttctgtctataactttgtatcagctagatcagttaatttttgtctttaaattaaaagttaacaagtatagcaggagactaagagaagcatttttacctaagtcagtcccttccccwcgatgttcacatccaactgcagcaaaaaacatgtagtcagaaaatccttagtggcttgagggaaatctgtttctttcaggcagggtagtttccttgtcaggttgtgaacttttcttgactgaacctactttagagataagcttcacttaaattgtttggctcactggtcctggtttgaaaaaggaaatctaccctgaatttcactctctttctctttattctgcagcctcttgtatacttttgtcttaaaaaccccttgtttggggcttatttatttatgagtaatcaggtgacaacata

SEQ ID NO: 925 - DNA, 600 bp, Bovine  MMBT06833
ttagccccaccatattattcccttcttgaatgtagaagacattcttattgttccaagcagcacttaaaatacattgttaartgatgtcaayggccattatttttctcatcctttcagtgsttgttcctttattttaccagtcagtgatgccatttctgatttttaaaataagactttttatatwtttttwaaaaatgtttcatcaagaaaacccctggtactaaaaattaaatgtctcyaggaatgttttgtgtcattagaatatgaactaatgattatcagattgggtctctacctagwaactgctcaggagacccagattttaattgactgcagcaagtaaaacagggctgtgtttgctatgctaggcaactgtcaagtctcaaagaagtctctgagcatttttcataaccaattaatatatgacaccttaaataacatggacttgctattctttattaaaagaaactaggacagggttgctaaatgaaaaaaaaaatgttagaaatatctgcagtcagacaattgtattttctgtgcagaattcctgcaattatttcgaaaggaaacagagatgaccctaagattttctacaaactt

SEQ ID NO: 926 - DNA, 600 bp, Bovine  MMBT08625
agaatactggagtgggttgccatgccctcttcctattggattaaggcctatctaatgattaattttaatgtaatgacctcttaaaagaccttatctctgaatacagtcatatgctgatttatgctagggcttagggcctcaacacacgggaggagacaccatttcagtccatatcagaattattttgttataacttgataaccaggggtagcaatataagaagcataggaatgtgttccaaagtattagaaaagtactggtgtgctttaagaaaaggaaaatgggcctaacacaaatttwaaaaaatttttgagtcttcaagtaggaaatgctgttgatctgaagagggatggtatttgaggaaattctctgggatgaaggccagattacttcctaccccagctcattcgttcagtatattaatagctgcattgagctcatgttaggtagtacctggattatatatgttactctcctagttaaataaagattcttgccttcgggatgctcacaggcacatttgcatgtatttgtgggtgtcagtgcagtggggagagtgggtggaggataaggcaagaagacatacagaacagactttaa

SEQ ID NO: 927 - DNA, 600 bp, Bovine  MMBT13626
gatcctgggaaaaattaaagaggaaatcaaaaaattcctagagttgaatgaaaatgaaaataagctgattcaaaccctttgggatgcagtaaaagtagtttttttacatgctttaaaaattgcagtagagttgatttacagtgtttcagatgtatagcaaagtgattcagttttgtaactgcaaaagcagttataagggggcagtttatagcatcccygctggtcttgttgactgtgtctccaacctccataaatttcaattgataagaaagctcctggttccctttcttctgcatctywtctccccatggagggtggaggtgaagtcagacagaaattgttagatcttcttttgtcttgctgacttcttgcctcttgcagtggctttaaaggatgggagagggagagaggagctgaaatgtattctgtttgtgttttgtgcatgagaagccaagtccccatgtggtaaatgaaagagatcagcattgtctagctagagagaagcagagccacattctgtggtctctccatgcaggggtcctttcagaggtgcagcctgtggcttggcagattctccccagcctgaaatggcaacttggc

SEQ ID NO: 928 - DNA, 600 bp, Bovine  MMBT11764
gggtgacaggtatggagcctcctggggctgaagggttggccaaagtcctggcttgcttccctctatggcccagagatctgccccatagccctagtttaagggctccagggcaccacaaagccccaggttctgccaaggagtttgatcagcaaagggtcttcaaagaataccaaattgggtcaagattcctaggttcaaattccaggtctcaggagtttggggagagtgaggggggttgataatagccacaaagatccttggatagttgggtgaggggattcctcatgctgagtaacaagwgccatgagcaggcagatcggtcagaattagctgggagtgggccaggtctttgaggctcttccgctcaggaaaaccctgttctccatcctcagccaaagggggaaggaaaacaggaaacacatgttctgtaggggaggctgagcacccagccccgagacgcccacaggcaggactgcctcctggatgagagtttcccagccccacctgaggacccagtcctgaccagccttcagggagaaacacacccttcaagcgtatacaaagagcctagagccactaggccaacatctgtgttctcac

SEQ ID NO: 929 - DNA, 600 bp, Bovine  MMBT12640
gcatatagattctacctcctaagtaccctttgttcttccctcacacactgcctatcttttagttcaagtctcacctggtccttgccctgttcagaccccttcaaatctcatggatgatcttcctgtttacaagataatgggcaaactccgtgatctgacagtcagacccctctgtaacctggccccatctccagttgctcctgccactcacccagggctacacactgagcagttcagtttctccactcgccatattccttcctgctctagccctcacagagtctgctgctgctgcctaawatggctttccttatttcatctgcctggaagcaccccttgatcctccaaggccaaactccaatgtcatggccagcactgtcacccctacgtccacatacacaacagactgaaatacgtactccctcctttgtgttcctggagtatctggtattgccctccttgaagcatttaagagttctgaaatcacctgtgtccctgcctgtcttcttcacaggtaatcagattcagagctgtgtacttagcacaagtcatacagcagagggcttggctaattgagttaacagggaagggatcaagcat

SEQ ID NO: 930 - DNA, 600 bp, Bovine  MMBT12876
cgaaggggagacctcgccgtttcagaacagctgaggccccgatggcttcccgaggtggcggtgacggggggccacgcgttccgtggctttgccaacccacgtggggatcccgcggctctgtggacccaaggtcccagcacagcaaggctgggatctcaccccaggctcagcgtccatttcgctcaagtcgatgtgaattcagagcccgtggctgtgggagcaacgactgcttcctcactggctgatggctgggccatcctcaccttcgaccaactgcagcccctcatctttaaacagaawcctcatgctcagaatattcctgactgcctacctgcctcatccacttctaaggggccatgtgatcacattggtcacactgagttaactcacgtggcccaggatcctctctgcagcttacagcctgcaccctgaatggagcgccccctttgctgggtgacagagcatattcgcagtgtcatgctccaatatgccgtccacctcctcccaccatgccctggggtggaagctcggccatggtgagcagatgggcagcaggaccctggacagcatctcagccccacggcttggcacagatgtgca

SEQ ID NO: 931 - DNA, 600 bp, Bovine  MMBT02624
atgattaaaaacagcaggctagcaaagaagatggtatctcttggattagactggccgagaagatctggctctaaatctgttatgcttcccatgaagcatgagctctggctacctgacagagggcataaatcatgagtcttagttccagtctctggaaggcttcatcagcattctattgccccagccaggaggacagcaccaaagtagtttccacttagctaaaactgggactccaagtaaaagacaatagaacattcttctaaagctctcaaagagccaaaccatgatctataatatatkaagtcaaactgcttaccttgattcgaggcatagtaactgtaggtggctttgcttcagccacaaaactgagagatgatcctttttccacaagataagttgtgtagggcataaatttcacaccctttgatccaaacacaaaatcatctctcaaggcatctatcagcagaataacaactttactgaagagcggtggtggaagctcggtccagttggaactggctcctaaagtgtttgaaaatgaaaaaggaaattgaattttaaactcttttttagtatccaggaactttataatctggtttc

SEQ ID NO: 932 - DNA, 600 bp, Bovine  MMBT01735
atatacatcttatgttatacaactgagaaattcagaaagcaatatacccaaaaaggaggaaatgacttaaaaacaaattcgatgatagacaatatgcacgtaggtgggttccagggcttcaagtgataaatccagaatttctcctggtcagtgttctcgtctgagggtgtcttggtcccccaggagatatttgacagtractgaagacattgctgattttcacaacttgaagagggaggaggtgcttccggcatctagagtctaccctctagagtctacagtacccaggacagcttccgmacacaaaaacaattatcccactgccaatagtgctgggaaaccctgggtgaggggatgctgtgtcgctgtctgttactagtcaatgtctgcttggggacttgakctacatggaatggtgggtcagtttcaggtctttactttttaaaaactgcccacatccagcagccatccagactgatagaaactgatatatttatcactagctattagaatggccaggattttcctatgtcattcagcctgagcaatttcctaatttttagtagttttctgcatggttcagactagagacatatttct

SEQ ID NO: 933 - DNA, 598 bp, Bovine  MMBT02010
  misc_feature (1)..(253): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcacatgcacccagggaggtgactggcagagatcttgggagcccmatattaaaattaatagaacctcaacatgggtggaacctgggtccttgtatcactgcacagaaaacrgctgagtgggctttgcatactgagagcaaatctcaaatgtatgtaagcactggggtttctgtgttcatgtgttatggccaccagcattctcttaactaacacagagctctgtgatgggagcttgggaagtgttcataacacaacaaggctgaggccaggtcaacagccttgggaggcaacaggaagatggttttgaaagccatagcgccctgcttatgagctatgtgggtca

SEQ ID NO: 934 - DNA, 600 bp, Bovine  MMBT01208
ggcttttgtgtatttaaaaaaaawtatttaaagaattctttccattgtaggtggttatgatgattggcttgccaggagctggaaaaactacctgggttactaaacatgcagcagaaaatcctggtaaatacaacattcttggaacaaacaccataatggataaaatgatggtaagtaaaatgggcttgatttcagctagaaggtattctaggtaatatttttgttttttatccattttgtttagtattttagagagaggagtttgggcagttaaatgtttatgtaagtaggtgctttacmtgtaaggtaaattgctttccttccagtgactagagtccattttctgtagaagttttttaactcaattatccagtagataacgacgagctgattggcattgggtggtgttacaggataaaatgtcctttcttgtagcattgaggaaaggcaatgtttaaattttttttcaatttaaaaaaaggtggcaggttttaagaagcaaatggcagatactggaaaactgaacacgctgttgcagagagctccacagtgtcttggaaagtttattgagattgctgcccgtaagaagcgaaatttcat

SEQ ID NO: 935 - DNA, 517 bp, Bovine  MMBT01560
tgttcttctctgccatgttgcatctgtgacaggcagtggacttagaaaacaagactaccattcaatagttgggcaattaatataagcagtttctacttccatttccttatttaaaaactagaagcccagacctccagatagttcacgatgggattttccgttacctgaatgtctgcactatggaaatgcctgaacagagggtcagcaggctcagggatgctgctcttcttcttgatcatcttcaacaatggcaaaacctttttccagtaatgaacacttctgcctatgtattctcgttgmtcataaaaagaattaagaccactgccctaaaatacaaagttagaagcacacaaagagacacaaacgaacagattaaaaaactcacttgcagatgctctgaacaactggctaaaatttcaaatcctaggcaaaatagaatctcaaaagtcatatgctcacctttccaaattctagaataactaagcactttaccatcagcactcattctagacccaac

SEQ ID NO: 936 - DNA, 424 bp, Bovine  MMBT00811
tgttcttctctgccatgttgcatctgtgacaggcagtggacttagaaaacaagactaccattcaatagttgggcaattaatataagcagtttctacttccatttccttatttaaaaactagaagcccagacctccagatagttcacgatgggattttccgttacctgaatgtctgcactatggaaatgcctgaacagagggtcagcaggctcagggatgctgctcttcttcttgatcatcttcaacaatggcaaaacctttttccagtaatgaacacttctgcctatgtattctcgttgmaagtcccacagcttgaagcagaaaatgggattcaaacttgggtatgtctgactctagagccaaacctgcacttccatccactgtgctatatatactgtagtctcccaaaataagtatgtataaa

SEQ ID NO: 937 - DNA, 598 bp, Bovine  MMBT01830
  misc_feature (1)..(48): n is any nucleotide
nnnnnnnnnnnnnnnnnnnnnnnnnnnnnnnnnnnnnnnnnnnnnnnnttttagattttaacttacctaaaaattttcaaaacaaacttggagtgttcttcatatgttccctgcattaagtttcccagtgcctttgataattcaccttatattccatagttaagaattaaataagaatttcttttgaaaaatttattgtgagtttggaaatatctataatattttgttacattctttgatggtgatagaaacatgataaggtacaaatgtggaacataagtgaaaaaaataagttacagmtatactttaaggtatttgtttatacatattgraggtgacattgaacaaaaccatacaatcctgacattagatcatacccttttcaattttcaaagtccacgtattcagtcaaacaatgtgaaatgatactttcctgatgtatttccatgtatgttttatcctagttaaattgctataaataaaaaggctctacatgtaaatgtaacaattgtcagcaagtgagtaatttctatcactaaattcattaaaacatatagaataaatttcatttaagagtgaatttattaaatttacatat

SEQ ID NO: 938 - DNA, 600 bp, Bovine  MMBT02096
tgtcttaagagcagaggggatttttacttatccttgcatatgggagacgagccaaaccagctcccactacatccacttagtagctcccactaccatccacaattcatggtagatttaactcctggatccatgagtttgtgacatgttcaaatactgactgaacactttacacatgggattaactccaggttcacagaggacagcaaaacagctggtatttcaattatcattgcaatgaatgtataaatgatattggggagactagtcaccttaaaagtactgaagtagactctatgaacmcagtatatctttctacctattatgttctcttaagartgtcaytttaaaataaayggtggcgggacttccctcgtgatccagtggttaagaatccgccttccaatgcasgggatgtgggctcgattcctggtgggggaactcggatcccgcatactgcagggcaactaagcccttgcaccacagctattgagcacacacaccgcaactggagagaccacatgccacaaactagagaacccacgtactctggaggccccggcatgactggagagaagtccatgtgccatagctgagacctga

SEQ ID NO: 939 - DNA, 600 bp, Bovine  MMBT01986
ctccttccctttgttgttcctatctggtaaaagatgaagctttttccattcatggaaactcacagaatcacatgtctcataaagatcataactgtctcactgagtgacatggtcagaaaaaaagctcacttcaaaatgtttcctacttgatgccagtgccccttaattctaacaaattgtgttttttcttaaattaatgtatataggtattatagtcccagccaatactattattatcatgtgtttatgtgaaagaaaaygtgcaaactactaatatgtttcccagttcctgacaagttmtacatttaacatattaagggtggatttaagttttcttccaacaaaagcattttagttgtaccaaccccatatctggagacaagcactagtcagataccagcagttatttttgcttcctactcattttttgcccttcataagaactcaacccttgggagctgacaaataaagataaattaccagtctggagcattctaactaactaagccactatagtcacttaaatgaatgttgaaaccctttttttgctatgttagcagaaatttctcattgtcttgtactctgtgactaagaattaca

SEQ ID NO: 940 - DNA, 600 bp, Bovine  MMBT02024
ccttcagcgacgtccacgcaggatctggctcagggccggcctgcagtcggagctcagagtatctcgtttccctaattaaaccagtggttctatgccgtgtgctccctgactcctgactgtctttcaggcctctgtactcgtccagagtacaaaagaccacttgtaaacacttctcttataataaggatcagagctcttctttatgaggtcatagtttctacctggctgactctactacaacattatttaaaaagtaatcatcacattgatacctgccatggtttttcctttaagactttmccaggctgaggactgctagcaagtgggttggataaaagtgcatcatgatgaggatgttggaagtcagatgaagggcagggggcttcccctgtgcagagtttcgaccccccccccacccttggctctcggcggtgtttttctcatacagctttaggatccaggggaaacgagtggaaccagctctttgaacaaggtcacccaacagcatcacgaggtgatgacgtcactgtcagctcttgcccaggaaaaacctagggctcaaataactgaaggagaggacaggtcatctccatggcaggt

SEQ ID NO: 941 - DNA, 598 bp, Bovine  MMBT01753
  misc_feature (1)..(127): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacatgattttattttttgatgacttttatttttagattctattacaatgtgcaggtctcaagtataactacaatataatttatgacaaactcaaacattttgagcattcatatattatgaaatttataaagaattctatgtaaacagcattattatattcatggctattcmtttatttttatgaagcaactcaattattttcctcaagaatataacataacaaaccacagttattaaaagaaattggtggcctctatacataggtcctaaacccaagccagttacttggccattctaatttagctggcccactttcatcattcccattaacatttctctgaaattgctatttagaactgctttatttacatatgcatttcctcttaacttttgaataaagctatcaaaattctataaaatcatgctgaacatttagagttgaagttttcatcagttagcatttagaaac

SEQ ID NO: 942 - DNA, 600 bp, Bovine  MMBT02506
atatggaaaatatcacaatataaaattattaaacttagcacccaactatccattgaatgttttaacatggtgaaattcaaaatatatttagtgtttttaaagtaaatttaaatctttgtaaataaaaagagttcaaagcagtgcttactaaggtattatttcaagcaagctttacaaaattataatagaatagtcatttggaaattcagcatggaacttacttcctattgaggagtctaattaccagacactttttgctcacattgtcagaaggttatgattagaacacattaaaaaacmagcagattcagatctaagtgaacaacaaggtacataaggtaaggaaaggtctcccatgaaagcacaaggccacagccattaagtatcttctgtgagagtaaaatcatttagaaatcaatgcacaatcttttagagtccatgttcagtaaaatayaaataaaactgcccggaagaatgagagcttctgaattttgcatgaactagaaattacatggagagtcatagggaggaaaaagacttgagtatgtagattcataacaaatattagctgttttaatgctttatagttgttattgagca

SEQ ID NO: 943 - DNA, 600 bp, Bovine  MMBT01404
agtggcttggtctgtagagttaacagtggggctgcactgtggctgcagcgagatcatcacacacaatctgtttaatccaggttagacccatcatgggcgcttctaatagtcaaaccactgggagtaaatgggagagaatggtgtcgggacattggtatgtctcatctgtggtgagcacaggaaatattgtttaagcaccgctgccttgcataccaacagcactagaggcgggttatttccaacacagcctcacaaaattgaggaacagtttaaatactgagatctaatctatataatttmgttaaaaaaaaaaaaaatctggtcttccctctgcacctcaaacttttgttaacttggagataaagtgtttaggttgtatttttccccaccctccccgagaaatgctctataaattaagagaaaaaaaatcaaccacatggaggaacatttaggcacagagagtaatgtgttggttctgagcttgcatgctggaatttcactgaaaaggtaagagaagggcaggaagtgacagaaaggagttcacttctttttgccaaaaaggctgaacctcttttctttgtctttctctttgtccttctc

SEQ ID NO: 944 - DNA, 600 bp, Bovine  MMBT00836
caataaatattcttcccacttctctccttccctttctttcaccttctcttccttaccatttttccttaagacctaaaggtgaattagcacagtatatgtgttcaattcttgactattcagcaacctaataatatgggcagtgactgtaaatgaaaacacctctaggctttctagtcagagaaacaggaagcttcaattaaagaacatacatcagttatggaaatgggaagggtaggggcttgcaagacagaaaagaggtaatgccactcctaacttctggtaccgactttcaaggatgcmgagagggctaatttccagaggaaggatcatcttaaaagtatgaataaggctaatgaggctataaagtttttatacaatgacyggacctgtccactctgtatccatggtctcttcctgggaagttaagattgttctttggcagttctctgattctctgatgtcctaactggtctgtgatagggtttggattgagtcaatcaatttgttagcatctgctatttatatttctctgcaatctatgtccatgccatgttgcttcaggccgtgatttacaatcataagctgtggtttatactyatc

SEQ ID NO: 945 - DNA, 568 bp, Bovine  MMBT02670
ttaataatctattctgtttctgcttcagttgccaataggctaggggggaaaaagagaatataaggaaagatataaacaaaacaaccctgcatttagtgaacatttgccactaaaaaaaaattacaaaaacatttcccttttttaagaggaaaatttttcattatcctttattttgactcagttgcctaatttcattgaataacctctaattacattattcagacctaatgagctaaattatatggaagtttaattccatttcagaggatctcaaggtttgttttctgcatcaacacagcmgtgggttaacaggttataaccctgtttcactccggaaatgcatctttgatggctggacccttccatctgtttccattagaatctcacagagtaggcatttcagctgacagagatgtaccacccaggactggctgcataatgtacaaagtgaaagtgaaagtgttagccactcagtcatgtctgactcttcccgatcccgtggattgtagcacgccaggctcctctgttccgtggaattctctaagtagaatacaacagtgttccatct

SEQ ID NO: 946 - DNA, 598 bp, Bovine  MMBT02798
  misc_feature (1)..(177): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctctgtgtttttattaacaaaaaaaacatgggttttacaggaaggaggctgatagcaaattcgaatatttctatgagggatttactaaagccaggctggctatctggctgggaaaggaamatatttgcagaaacatttacattttcygagaaagtatctcatgycatgtttcctgagctgctgatccactacccaggaattctgttagaactgsttttctttggtaaaagaaagatctttcttcacatcgcatctcacccctccctcatctattgaatctcctccatgaaacatcagaagtcagtccacttattcacagactttccatgtggcaggcagcatgctaaccaccaataatgatgtatgaattgcagcactgatgtcttttgggagaatagcaaaaagagccttatgtttc

SEQ ID NO: 947 - DNA, 600 bp, Bovine  MMBT01384
taaggtgcaccataggcaaccatcctgacgtatgttcatatgttttctaatgtctggtgtgcctgtattttaattctgcaagtagtattgtgcatatatgtcattaatttcttaggcatttctcttttttattttttttaatttaaatttatttcttttaattagaggctaattactttacaatattgtactggttttgccatgcatcaacatgaaggcatttctcttaacaccatgattctaagatccacacacactgctccgtgtacctttacacacttgctcctacctgccgacccmttaggtaagtgtgcacatttcaccrttccctcaagaaaatctttgtgaaggtttccttaagtatcagtgttgagaacttctctgggatgtatacaggagtagaaccgcagggttattgggacaattgtccacgttgctaagagcttctggcttcatgggtagaatcacagaagcatcaaacaggaaaaggatcgcctccaaagggagtacattgagatggttattaacaaatcatgggccacatgaacaaacatttaaatacaggatacagacacgtkwatgcttcggaactgctgccct

SEQ ID NO: 948 - DNA, 600 bp, Bovine  MMBT01780
actccggccgctgccgccgcggccgccgctgagttggagaagaggccgccgtagtcgctgctgaaagcggacgacgtaggggacgtggaggccaagcagaaggcgctgttggctgcgcccgagcctcccgccaggccgcccgagccgcggccgccggtggccactgcgaagcccgagaggctggacccgaggttgcagctggacgaggagcgcttccagggatggaagccgcccttggcaaaggcgctcgactccggcagcgtcgtcagcgggctcgtgttgccgatcttgttacaggtmgccgccagcatggccaacggggtcgttccgaagcgcggttcttcctagagtgggtggggtgagggagggagcaaggaggaggagggcaggaacaagtgggaggaagacacaaagtgcacccgtgagcagccccgtcccccagccgctggtcccgaggcggggggcggggggtcgtggccccccgactcgcgcctcctcccggtgagctcgcggaggatgcgccgcgccccgccgcgccccacgcgggacagagggaatcccaagagagagggtcccggagctgtaaagttgttcttcggt

SEQ ID NO: 949 - DNA, 600 bp, Bovine  MMBT05624
tgggacgttaactgatcctattacatggtctgctctgtgagttagaatgatgactcaaagaaagaattaaactatattaaacacagactttaaaaacaattaaaaatgtgacccatattgattcactctccacatcttttggctttagcagtattattgtcatgccgtgacctcttgttaattaacaagattacaaaagatggattgatgaaaatgatgtgctaaacaacttatctgatgacactgcaaataagtaaaaattcttttggaaatctacttaatctataccaagagacactmtctgtttacaccagaattgttttaatatttgatctcatattctcattcccaataatttattacaaataatctacttacagaacaaatatttaccaagctcttactacatgcccctcactgtaatggatggtgaaccaacttagaagaaggaaaaaagcactttccacaaagatatttatttcagtattaactaagatgaaaagcttggaaactaaatcttcaacaactggggaataattttgtaaattttgctgtaacaattcaaagtaatagttcaagacattaaaaatgccgtgtagg

SEQ ID NO: 950 - DNA, 600 bp, Bovine  MMBT06373
tgccataggagctgggcttgggcttctgccttgtgagaaggaagccactggactggrgtcactgtccctccttccctgtccctagcctgggatttcttttctctcctctctctgatagctcggaagcaagcagaacaatgacgtcttcagagaaaaggccatttcctgctggcagtgtgcacrcttcactccaagtcccagagcttctgtaaagaggcaccctcctccctgagcycagatctcctttagtgctataggctcagtaggacaaagacaacacctggatctgtccccgggtcmgctctgacaagattagcctaatctctgctatctgagagaagaggatgtctagggaggaagaatgttctcatttccaggcagaggaagaggttcatggtccccagccttgccaagggtctctgaaatagggtggggtggggcaggatggacagaggtgactttttggcttccctcatccatctctgaatctgctcttcttggaggagttgggatgacagtaaggagacatctgagcaaatggaaagaggtgtctgagacaacattccagtactacttctggtgctttcatcagccaaagaa

SEQ ID NO: 951 - DNA, 600 bp, Bovine  MMBT08709
tgcagtcgttgtgttagtgttagtcattcagtcatgtccgactctttgtgaccccatagcattctccaggcaagaatactggagtgggttgcagttcccttcttcaggggctcttcctcacccagggaatgaatctgtgtctctggcattgcgagcagattttttaccatctgatccttaggcaggtctaaatattgcatcacttytaagatatgtgaggtttcagataatactttgtcaagaaatttctcattgtgcacatggcaatacacttctgtcaaagtaccaaattgagcatcmataagtaaggaatgaagggtcattcataaaaaccacggtacctattaggcctctaatcagaacatttaaactaaggacagatacttcaggacacatttgaggggtattttcctctgaaatctgtaattttactgtgcttcaaaacgtctacaacctagccatgagttgacagggtttttattttctgccaatttggcgatcaggttggtaatgaatgaatccagtacaaacatgacttagtttgcaattcaagtaggtttcgttttttcgttctgtttttaagtggaaaagaaggaaaag

SEQ ID NO: 952 - DNA, 600 bp, Bovine  MMBT08067
agaagtaattrttgagggctgccaccaaaatatgaagtgtgcccttctagaaatttagtaacacattctcttatcctcatttaataacacattctcttatcctcatttaataacacattctcttatcctcattgtattaatttctccatccaagaaagggctaacttgtcaaagccttttttttttttttgaagggaaaaaaagatggcagagaaggaggactttgagctcacttactcccacaaacacatcaaaaatatatctgcatgtggagcaactctagctgtaaagaaattggamactggcaggcagctcttccacaagcaagactgtaagaaagacccacacaaagataggtaagaaaggaggcaaagaaatcagagtttgaactacatattgaacacctcattcctggggtctcacattgagaagacacatcactttagctggtttgaagaygggactgtaagaaactgagattttacttttgaagaatgcacacacatccacttgtttttgggaaaatgggaaggaagcagattgaaaactctctgggattctggctagtttttttttatgaccatcctagagctttaatac

SEQ ID NO: 953 - DNA, 600 bp, Bovine  MMBT08035
ccaaacagctgtcgggcttcaattgattttgtgtcacttggaaaccaagaacttagaagttaaaagaaccatatcacaaggttgacaccttaatctcacttacctctggttccctgactgacatgattaagagattaatgagtacaggttcaatgacattcttatgccttaggaacactatgttcactatcaatcctagtttttcatctgttcatttgctcattttcaattatcaagtgacctatactcataaaaactctacatgctttgaatatcttatctataaggtggacaagaacmtattcttttggtgataaattatgtttggacacctttcaggagaaaaagagtaaaatagtaacttgaattgagtacaatgtattgaatgccaagatcagcacatgttttatcacattttgtcctttattgaattctatgaggtaaggataactattttttcaggtaaagaaacaaagacttggaaagctgaggaatacacacaaggtcacgtggctaataaatgtaggagttaaaacatggagtcagctttgcaagcctgggatgatttcccatcactgtggcctctctccccctctcctc

SEQ ID NO: 954 - DNA, 600 bp, Bovine  MMBT13578
caagaacatcacctaaatcaacagaaaattaaccaggtaggttggatacctcctggaacacctctaaggctttattgaatttccaaaaggaacaggattaaactgcttgccgacttcagggaacacactctttcatgatgctgagcaagaatgtcccagaaattttctcaggacatcaaacacagctccaaatcttatagatagcctcccagggaacctttaataccttcacagaatmaaccacgctatttgtgcctctgaaggatgaagggtgaagcaaccaccccagctgtgacttgmaactggggttctgatgcgtttgggttctggggaagcagggtatttcaaagccagctttgcctttagcctwgtaaaccagcccctctggctgtgttcaracacatgacttgctcactgcacagtgtaatgattatccaactttcaccagagggctatgcaagaacaaaagrctgaatggtaaagaggatttttattattaggttgctgtkcttatgaaacattcatatagcaaaggaattgctttgccgttaaaaaatttttgtgaaggaagctttatgaaaaatgtgcttacctggcctt

SEQ ID NO: 955 - DNA, 600 bp, Bovine  MMBT13296
ttcaagtgccgtggcaggcactggcatacggtacacaagctgtcacatccagggacatgggaacagaaaccccaaggcccaccagagaggaagcttgatggaaactgcctctggggcctgtttccagagccacaacttgacctagcacagcccactgactttctcagacctgagtctccccatctgcaaactataagattgacatctgactcctgcttcgaagaacttaagatttctaatattagggccatctccacatgcagggggatgctctatagggcaggacagagccctttctgmccctaatatctctctgatcacatgcctcagagcttggcattctgaccacttgattcatgtcttggataagggctgtatttttaaaaatgctgctgccagaatatttttaagactgtaaacctgacaaatgattgagtctaccctactttttgaggtaaggagactctgagtaagtgaaacttcagtgaagcaatttgatagaatgctgaggattgagagggtctggtacccagggtgctctgaggagggacaggctctagcaggatgctatggggcgaggacaaagaccttgggcagctg

SEQ ID NO: 956 - DNA, 600 bp, Bovine  MMBT13111
tctgtacccacaagaaaccagatgtgtagctggcatacggaggagtgagcagaaaatgcaatctctcagaatatctgttccagtttctaactctatcagcttatccagttactcacttctattaaatacttgtgcccatcaccacccaggtaactagattacaggcagaaggggacttttggaaagagagaataatgaaaggaaattcaattcagtggggatttgctggccacctagtgtgtgcacatccttgtagggaggtgttggaaaccacggatgcagtgactgatcaactgtccmtaggataacyttcctctactcctagctcacctctgacttccaggaggggctcagggttttcttctgggcctggggcacactgagagcaaggttggggagcaagcaaaaatgacgggcaaatgccaargctgaagtggcgaactcaggagaagtctggacaattgtgctcagatctgaattatggcctgggagctccagcccagctcaaataggtcagattgaaagagcagaacaagggctaagctttcagtgtgtgatatagagatgctgcaagggccaataggctaaagtaggagccga

SEQ ID NO: 957 - DNA, 537 bp, Bovine  MMBT12089
gtaattttcaggccaagaagctgacctcagaaagccaaaactgaaacatactctcctctggataataaacacatgcaaaagaagataaactctctgtttgtaaggaggccatgcagccaactgaagtgagacacttatcagtctcacctgggacatacaaccagagcaaaatacatttaatatgaataaagtagtcccaagaatccaaaactgtcacaaatacctgcctaatctctgtctcaagcagattagctatgcaatagaatcattttagctactggtggcaaaggctggaacaamatgtctcaactagcactgggctagttaagtggcccacacttgttctgaaccgtgtgagggacagccacactagaactgcacagagggtgggatggagaggggacctagggaacggagagactggaccaagagagacagagcgtgagataccgccaacagtgatgcccactcaacccagagacctttcctccaccactttcttgtgccactctcaactcaacgcctttcttccaatat

SEQ ID NO: 958 - DNA, 600 bp, Bovine  MMBT13016
gcaataatattaaagtttatgtactctatttcaaccttcaaaatgagaattcatagggaaaaaaaagtaatttggatttttaacagaggcaactgagttctgctaccttgccaaatactgtattaattattcctctatgtgcttttgtttaaattgatttccattgtaccacatgaactgtctatcactgatttagaatgcaacatccatacaaattttctaaaaccctctttcctacccttctccttcacacagacacacacactcaacacagcacagccccctacaatccaaactacmcagaagtagcattaaatggagttgagggtacagatgccaagaaccccatgtcatgttctgcagagcagaatattttaaccaacacttatttatgataggatctgtacttgttgatttgccaagatgaaacaggctcaacctagaaattggaatctgagtttaatgagaacctgacaatcctttaactaaaacagaaggaaaaaatattgttacaggatcataaaaacaactatatgagtatgcaccccaaagagaagccaaaaaattttggcaatattctccactcacagaacaatttat

SEQ ID NO: 959 - DNA, 600 bp, Bovine  MMBT12924
gcggggtggggggacgaggtttgggtgttgtgggcgcaggagctggtgccygtgtggctgagacaccggggtttggggagggaggctccctcctgtctgctttgattttcctgaagcatggagtgaccatttcccacgtcttcacattttacatcattttagaatttttaatataaactgatggattattgaagatcattccattattcattgggtgagacacgcttaccttttgagagcaagcatcattttctatcaatcctttgaagtgcctggggcttcctggcaccagccacatgmccccacctccaggagccgggagaggagcccttggcctgtggattctgcatgcagtgtggacaggtgccccgtgtcccaggcctggaatccaatcgattcctggggcgatggaggcttacagctgttggggtttcagacagccagctctgtctctcaacagcctcacctacttgcttaaaattccagaatttaatcatcacgctcagcataaaaataagaggggtaggtggcgggaggggaaaatactgatggaaatgtgtgggaccacaggccccagcttgaggtgggaagtgtgtttat

SEQ ID NO: 960 - DNA, 600 bp, Bovine  MMBT12899
aggccgtgtcagtggaaggaaatctaccctcacccccacctcagggctgaactgggcagagcctgccaggaatagggcagagcctgctcggtttaaagaaccgacagaggttgcaggagcagctttgcattcaggaaaatgcattgagctgaggccaggtccaagtctgagtcagctctgtcccttttggaggcatggcctggggtccagccctgggctgggctcagtttccattctgaggggtctgggtggctcctgaggcccctcctgtttggattgtcggtgttgccagctctgtgmgagctgggaatcaagggagaatggccaaggttggcggctaccgaggattccctaacaatggtaggaagaccaaattcccaggggggcccaagggtataaggatggctttctaactaggccaaccaggacctggtacaaggaaggccttcagtcttggccctgaccccggggcaggtctagacaaccactttcattccccttcatcagatgggttcatgaaagtcctttggaaagtcctttagggacggctgtgttgaggctgggaagacagcggggcagggggattgagaacttcagcgg

SEQ ID NO: 961 - DNA, 600 bp, Bovine  MMBT11924
accataggttggaaaaccgtggttgaagtttgtcaaccttacatgtaaagtagattaaatgggttctacatagtatttgcaaggtctttcccatggaatagcagatacatttagtatatgacattcatcctggatactcagaaacgttataagatttagctcatgaagcctaccctgacccccagagccaggaatcatgtctctcgtcctcagaacaccgagagctctttgactgaactraaacacttcctacggcatttatattgtgtggtctgtccattcttttcccttaggaccacmtcgcatctccctactagtttgtacatttcttggcagcatgggctatgtctttttcatggtggtatcacccactgtgtctagcctaacacacagcaggttcccaaaaggtttactttatagatttgtgaaccccacaagtggttacctgagaatgtatctgcccatggtcctttgtaaaaacaggagaagcagtgtgatccaaagagccggtgtggaggagattgttgatgtggaagggccatggtcactcacgtgtctgtcctctttcaggagtggctctgccctggcccaactctatgg

SEQ ID NO: 962 - DNA, 600 bp, Bovine  MMBT12209
tttttgttgttgttcagccgctcagttgcgtctgactctttgagacccccagactgcagcacgccaggcttccctgtccttcactatctcttggagtttaacttaaaaagatgctgaatgaggaccaatcctccaatgtgggaataagagaactagaaactggaagttagtaaaagtcttaaaatattaataggatggtttggctgcattcaggaaggggatgcattcatatgcattcatatgcatatgcattcataacgtatcgtccaaaccggtgggacaggccasgggagcagagcmgagaccactcctggcaaatcaggacttaggctcacctttgtcacatgcaatccatttatctgctattttcggaaaactatctaggctttatttcattaaaacaagatcagttcctagcactgtatctggcatatagtaagtgctcaataaatatctattgaggaaatctaagatttaatttagtttatctgctaaagaagagatccagaggtaaattgagatttatatctcagcataaattagtttaccaagtgctttcaagtgccccatgtttttgagtatcatcttttgttttaaaaa

SEQ ID NO: 963 - DNA, 600 bp, Bovine  MMBT13662
gccctgtgtcttacgcaatcaactgcacaagcatttccaaaactcagcacaaaggcagaggaaatgccgacacacactccacaaggagccaaaggaaagaaacagggcccccagggggccaaccctgaagcctcattatctggagctgtctgagagtcaggaatgaaaggaacctattaaacccaagagaagtagaaacaaaatctgcagacagagggtgtttaccccttagaaaagtgaacttttcaagcagtagctatttggcttatgggtgtggccactgtgaaaggccggcccacmgccagttcattacacatcatccacacgrctattcaagaactagctgcctcctgcagaaagagctgggcgactttgttcccatgaatgactccatcattcagctgcacacccaagtgcttccacacgattcgccttaaaactgtcccctgggccacatgccccaccccatcttcatccttttctggtctggcctcggaattcgagtccctgggaatgtacactctgggcaaatctgggtcacatctgccttgcatggggcactatgcaatatttccaaagagaaaagttcacctgctgctg

SEQ ID NO: 964 - DNA, 600 bp, Bovine  MMBT13677
acgtctctgtacaaggtcttctgagtaggattaagcagctgccactcctccaatgtgaaattcacagccacatcttcaaacgatatctaaaaaagtataatccctgttaaatctgaagtcattctctytgctgaatgtaggcttccttttctacagcaacaagtggcctgaaagctggacccatgatctccaactcctggaaatgtgcttttgtttaaccctcactgccccacgtcctgaatatgggctggatttatcaagtcacttccactgaatggaatagggtagaagtaagggatmtcccttccaagaccaggttataagaggacatgacttctaccttgggaaccctctcctgctctctttgggggaagtccaagggccacatggtgaggcagctctgtgtacaagcctacgtggcaaggacccagaggtctgccaacacccatgtgagtaagcttgaagtgtgtgaccttcataccacagcaattctcaacattttgaagacagggtcgtgtgagattctccactagaaccaaatggggtgagccactggcagattcctaactcacagaaactgagataaatgtttaaacttca

SEQ ID NO: 965 - DNA, 600 bp, Bovine  MMBT12881
tgtaactattcaccgtgtcatgtgattttggggcagtggatgacctcagctcttaagaaaaatatgttcggtactccctgaccgcaagagcacagaaatgtgtaggcagcctacacatagctctctctaaaggggctcagagaagaagtgcttgggtgtttgttgaaggaggaagcttccggtttaaaagagatttcactgtccttgatgttgtgaaaccaatgaagcctgtttctgctcttgtatatcttctagggtagatgcttctgctgttataaagaggttggggtgcatcagggmaggcctgcctccccaggattccaaggggagcccagcagacttgaggggtgctgtgcctgctgagcatagcgcrtgggctggagctggggctggatttcccccagcctgcacccttgctccggggagtgtgttcccgagtgccttctccccctcccctcaccctctgttctctctccttcaggacgagcccagctcaggcatggacccctgctccaagcggcacctgtgggaggcactgaggaaggaggctgaggagggctgtgctgtggtcctgagctcccacaggtgagcccagtggct

SEQ ID NO: 966 - DNA, 601 bp, Bovine  MMBT12464
  misc_feature (1)..(1): n is any nucleotide
ncttcctgagtctacacctccttgataaagcacgtcacctgtctatctaacgtgttcttaaatagtccacatgggaacagtgggttggctgtggttccattacagtgyctggtggcagtgagcccttgcataaattctctgaaaaataaattcaattaaaaaaawaaaaggccttggctgtcgcaatatgatttcctggttgaacgaaatgactttgttgttcagatcctttgggacaaaatgtattttacatgaatttatttcagagattgattacgattccccctccatttggtcctgmggttggtataattggaagtttagatggaaaagacagaaatgactttaaactattcacgtatccccctaaaatttgcagaagggtaaaaatayaggmgactttaagtaaaataggctgcgttagactctttttaagtttaaytatcttcactcttttctgacatccaagcacattgggtttttttttaatctgtttattttgagaaaccaactcaaagcgctttggctgcttgctgttcatttcactttacaatttctgtgcacgtggctctcggagaaacttgaagctgcgctcgatcgc

SEQ ID NO: 967 - DNA, 600 bp, Bovine  MMBT12728
ggaaagatgatttgagtgcccaattcaatgtaaaaagtgaagaaggaaaagtgatatgattatttgattctaggcattttcatttactctaaccactgattatctagatttaccattaattgaaatattttatctccttactatggtcacaattatttaagagacaagttatatgaagttaccagaatttcatttatctcacaggtgttgtcttcagatcacatttagctcctcatctaaggatatggtcataccatgaaaatgaaaattacttgcagactttaaatataaaatatgagmaattcacaaagttgctataagaattttctccccacagtttcaatgccttaggtttctcagaaagttcccaataccttttttctaaatcatgcatcctgttggttctgtagagaatgaaaaagagaaagtgagtaagacttatagtatattttagggccagacttgatatttctgactcaaattcctaaaataaacactaaacaattgtgtcacaaaataatacaaacttgyaaatatctggaaagtataaactttataagggaaaaaaattaaaatcagtcataatcctattgttcaagg

SEQ ID NO: 968 - DNA, 600 bp, Bovine  MMBT14260
gttccgttttgacttttaaaaagacattgccaaggtgatttacataattgaaattctatatttataactacagatgtgccacaaaattcaggctagcagccagattgtcaaaactctcaccagtttcatgaaaaagaaggtttgcccaaattctcactggttcccacataaataaagctgttttgggaaacagagaataaatggaagatctttttatttcaaagcacctgtaaagatttaaagcactaaaaaaaaaaaaagtcaaatagaatacatgaaggccaaaaagatgaaataatmtgctgctattagcctttgatatttgtaaatgttggaaaaacttattagatattttagattgctttatttagaaatcagttaaggagtcattaagaaataaaaggtttaacstattacagttggatttttaattgtggccttggcagctttaatgtctatatcctatggatatgattctttacacacaatatttttagaaagtacattgatgttcttttatttgccacatacaatttgattgcagagggtccatatcatttttcactgggttcactcagtcttcagtgccatttctaagaa

SEQ ID NO: 969 - DNA, 600 bp, Bovine  MMBT12671
cagaaaatcatctagtcttttccaataaacatataagggcacgtaagagcagcaacgctaagagagggaacatcaagattgatctctgcagacttctaaaatgatgcatattactaatgctcaattacaaagtctcaaaggaacttggctgagtcaagtaatgaacatacacatttactaattccagcagcactttattcaagaacacatctccaaataatgatgcttgggaagattaaaggagctagtgtttcaaagactaacattctcagaaaagctttgatatcaaaaattaagatmttcagcattaaaggtatgtgtgtgtgtgcctgtgtataaaggggaggggggaagggaagactgcagttaagcttggttgttcagatacagaaattaggcatagacgttctgtaagcaggactggcaaatatagattaaaaaatagtgtggcttttccatccacagcttcaaacttgcccattttccctcaaaaaccaccacttacactaatgctgaagctccaatactttggctacctgatgtgaagaactgactcattggaaaagacgctgatgctgggaaagattgaaggcaggagga

SEQ ID NO: 970 - DNA, 600 bp, Bovine  MMBT14193
agryctaaaacacaactgggatatcaatttttgccttctctgctgcccctttccctttcagaaaaaaaccatatatataatgtatatgtatctgartgtgtgtgtgtatgagtaatagttgaccactaatatgacctctaaaaaaaccacagcgtagtttgtggtttatcgtcaggaaaataaataaaaggaggaactggatcattgcttttatttagtttcaattgtataatacttctcaaaattctctaagccctttacataaagttacatgcccatactttcacagttgtaaagatmtggggaggcaaaaaaagtttatggttttagtaataaatcacagttatacttggtgtaagaaattgtgtcctgagaattgcatcattcatgtgttgaatttacagaatggtgtttcataatacttgaggtggttgcatatgccctgagaatgactgtagccctttaataatggaatagcagtcttttttttttctggcattgtacaaaaggagtactgattaggtccaactagatgtttaggggaaagaaagtcaagaaaaaaggagatgtcgttaactcatttacaaagaaagaaatgaa

SEQ ID NO: 971 - DNA, 600 bp, Bovine  MMBT14440
gcagccaaaacccaaacattggttctttgacctgtgaaataagatccattatgatagaaagggacaaaggaagcccctgatattacttaccctttactctctttcaggtagtaaatcagaaggaacaatgtagccatgtaccaccaaaaaaaaaaaaaaaaattatgcaactctcaaagagtggctgctgcagaaaacatacagctcacagatggatccatttgatatgttggtacaagataaaaatacactattacactatagcccatgcacgaatgaactacttcagtgttacttaamatgtggtccacagatgaaagcaagctcacaaactgttttttatcattccacaacaagttatatatatgcaagtataaacagtgagagtacacagttgaaaacatttatatcaactttcagttcagttcagttcagttgctcagtcgtgtccgactcttcgtgaccccatgaatygcagcacgccaggcctccctgtccatcactaactcccagagttcactcagactcatgtgcatcaagtcggtgatgccatccagccatctcatcctccgttgtccccttctcctcctgtccccaatc

SEQ ID NO: 972 - DNA, 600 bp, Bovine  MMBT14308
attttaagaaccaatgcaacacctcagaaaaacaagtcaatcaattctgaccaaagtaaacagagaaatgtaattaaaaaaaaaacacaaccaaaaatacccacaatgcattgctttcacaagcagagataatgagctaaaggttaaggtgattggtccaaggtccaagaattgaaaggtgcagtggggatcccagatagtaacaatataatccagagtgggaggagtaactggaagactttaagggttcttttttgaccataagaatattcatggaattctgaaaaatacagttgatamctgaggttctgggcatgacytgttttatttaaatgaataaaatcgagaaggtagcttgattaggaataaaaagatctattttcctgtttagaaaataaatttgtattgaacaacaaaaaaaatacaccattctgtttttaatcctaagtgacactaaactattataatcaagatatagacttcaagccttttgagctattttgtgcgtataatttccccaaaactttattttgggaccaaaagacagaatagcagtagagaaaaaaagataagagtcttttcactaaatcaagatttggg

SEQ ID NO: 973 - DNA, 601 bp, Bovine  MMBT12405
  misc_feature (1)..(1): n is any nucleotide
ntaccaactgactccagctcctgcctttcaacaggggccagawaacagtacttttacttgcttgaaaattaaaccactttaaattccttagctgcaatgacactccaagttttttttttttctctccattatgattgtccagtctttactgcctacttggagaataattaatgaaccacaggaaatatcctttctcatgaatacatagcaagaaatttcatcaggcaataatctctcgttcttggtatctcactataatccaagtagcacagggtttgaaaacataacttctaggtttgamtccaatcaaatcttgtrgcataacactatctcctttccctctttatttttcaccataatatcactttctaacatccactatcatggatttattcatcttgtttattgtctttcttycccattagaatctagaatataagttccaagaaggctgggatwtttgtctatggattcactgctgaattctatgaagtarcacaatgcctgccccatagtcagtgcttactaagtatcagccagacaaatctcactgttacaagcctgtaacatgttggtgcctagtttactagatggtgatgat

SEQ ID NO: 974 - DNA, 581 bp, Bovine  MMBT14141
ataaattaagaayaagaattgctgaaaattgtcttatttcataagcattagggaaagactagtcataataatatatattctttaggaccaaaaaaaaaaaaaaaaaaagaaagatcagttaattttaaagattcactcaacaattaggagaaaaatctggattgcggtccaagyttttccygtatgtatgtgaccttgggctgtttccacttttagatcacctcttaaatcatttttaattgcaaatgttactattctccaagggctcaatataaaaattctaacaattctatgttcacmtccattcattctgagtagcttattcactattctctaatcatgtaattgactttcatatgctcttaaatagacatgaaataatggtttactacagcgattggtcacacacatttgctctgtctggagtcgtaatctgcagaaactcctttttccccttgtctatttgttaaagtgccagcttgcttttaaaggtgaagaaatagtaaaatattctattggaaaaataaacacatgacatcagacatcaaaatttctctctaagcagaaattattttaaataa

SEQ ID NO: 975 - DNA, 600 bp, Bovine  MMBT13117
tattatatcatgcaatgaatttgacatagaatttccaaacccatatttatttgataaatggtgcaatataaactgagtgcttcaaccttctctttgctttaatagattgttgactttttaatctttatattcagaagttccatctagggcaagtgtatacttgctatctacatttagacgcagctctcaaatttcttgtacttggttgcaaaaacagaaatgaagaatggaaatactttattaaggtcacataaaattgcttccaggatgaatctggataaccagactgaaaaaataaamtatggggaacttagaattttggaaatatgggaaattgtacttagaatttttattcttgcataggagaaagatattaaatattcagaactacacaattgaatagtgttatgtactctccactgattgctttgatgacagatgggaggaaggctctggaaataacagaggtaaccaaaaggataggaagtagcctaacacatgcttgcttttgaaaaatgatttaaagtagtatttcaacctataaccctagtacgctaactggagtgcacttttagggcatttattttaattctcaaaaat

SEQ ID NO: 976 - DNA, 600 bp, Bovine  MMBT11587
ttattcttctgggtttcagagataagtagttaggtttttagggcattaaagtgaagcctgtcagggaatcaagtccttaagtcatcaaggtgggagagaaaaccacctactttaagcagtggaaagagaagcagagaaaggatctctagagattcttaaaacgtctttttccacttcattctacataggaacctgtgtcagctaaaaaggagaagaaagtttcctgcatgttcatacctgatgggcgggtgtctgtctctgcacgaattgacagaaaaggattctgtgaaggtaaaaatstagtgcttaaaatgagagactcttaaaacaggaactgtgggtttgggagtaagggcaggagccaggaacaggttaaaagtcatggactgcactgagcatcagttttcatctttctcattgccaggtgatgagattaacatccatgctgattttgaaaatacgtgttcccgcatcgtgatccccaaagctgccattgtagcccgccacacttatcttgccaatggccaaaccaaggtgctgacgcagaagttgtcatcagtcagaggcaatcatattatctccggaacctgtgcatcatgg

SEQ ID NO: 977 - DNA, 600 bp, Bovine  MMBT12660
aggcacaagcagatgatgggccctgcctgcctccagcccgaggaggaaaggcagttaacctccgcctgcctaactggggcccaaggtcatgttcaattgtgttctgaccrggcagctatttccccagctggagagcgaaactgtcagttcagaaacattctccacctggagacaaacgctcctggggggcgcttggcggctctcccttctgtggtgtcgggtagcgaagggcacgcttctygcataccttcgctggatcacagtttatctgggagcgaagccaagcgctccatcctttgsgacctgacccaagaagagagcttctgtgaacttctgctctctggttgggcaatcttggagagttggttgggagggtgtgaggagggagggagtcgagtcagagtcaccctatctatttcatcaccagccacgttagacaaagggtttgtgtctgcagtcctctcctggtggaggagctcagtgactcaggaaaagctgtctgacaaatcctgttgcaatagcttatcctctgaaccccattggtttcatcataattttcctccaaattaatgtccccccagttttccttttgctacatag

SEQ ID NO: 978 - DNA, 600 bp, Bovine  MMBT13060
tgtcctcttcaggctgaaggagtttgaatccatggtagcccaggaaaagaaagagaaggaaaaacaaatggcagccataaagataaacactaaaaatatttcaccttgaaagtttatgcaaatatgtgcaacctcttcaacaacatcttaaagtttgctggggcccaaggacaaattccaggactttagaattgcaaccagaatgaaacaggttagacattaatgacccctttggccgcagtgttttccacagactcatagatagaaacgtggcaaagcacagcttcatcacacaagctstgacrcattccctaggtcagcttgccctttcatctgctctgagcgtcgggatcttgaccatgaccttgagatgagtccagctgattcaggtatatttctgcctacaatctatccaccaatatctaagcttatgtccttttgacarcaatgatataattttttgagaatgattccatccactgctctgtaaataccaaatccagttgactccacagtttttcagactactcagcatccttacatcctcccccatctgtctgggtgtcccaggtagattccaggtggacaggtaaaccaagc

SEQ ID NO: 979 - DNA, 600 bp, Bovine  MMBT13013
ggtcccctctacagtgaggaccctgggcacacacaggtggaggcttgtcggggtcctccatactgtgagggcacggggcacacacggtggaggcttgtcagggtcccccatactgtgagggcactgggcttatgcggatgaaggcttgttggggtcccctctacagtgagagcactgggcacatgcggatggaggcttgtcggggtccttgtagagtgagggcacggcacacacggatggaggcttgtygggatcccctctacagtgagggcactgggcacacacggatggaggcttttscagggctcctgggtagctggttctgagagagctgggactaacccccgtgccccckcarctctgttccccaccccatgcttttctagggcaatgcattaaaagcagtgaaagaagcgaggtctggttactggagaagccgtcatcttgaatgaaacaaaagccgatcgatcgcaagtgtgacaggtggcgaggctgagtcgaggctgagtgatacacaggacacaggagagcggctgcgatgtgtgcttggcgtcccggagcagccccgagtggggtgctgcatcttcccgtcatttttaa

SEQ ID NO: 980 - DNA, 600 bp, Bovine  MMBT14237
ctcattctatgcttaccttctaaagcttttttttttttagtctatttatttattattttttatttatttctttggcagtgctgagtctttgttgctgtgcatgggcttctcattgcggtggctcctcttgttgtggagcacaggctgtaggtacagacgggctacagtggttgcagcgcgcaggctcagcagttgtggcacatgggctcagttggtccacggcaggtgggatcttcctggaccagggatcgaacctgtttcctctgcgatggcgagtgaattctcatcccyagtaccacsagagaartcctctatgcttaccttggttaggtaagcccttgattaggactaattacactaactcacaatttctttcttcttcttttttacctgctaagacaatatatccaatctttttttaactgatgtgcagttgatgtacaatattactttctttaaaaaggaaatctgtccctcctacagagctgtgagcttatccctagcgcctgcttcaggatctggcacctagtgtgtgtgtgtgcctagttgctcttagtaggtgcttgatagttgcatgtggaatgaatgaatttgctagag

SEQ ID NO: 981 - DNA, 600 bp, Bovine  MMBT13079
caaaggaaaccgtatatgccaggggatggaggccaagaatgacaagcctgcctggtgaccgggggaaggtgatgctgaacaggtgcatgaccgggggccttggatgtgctgccaagggatctggacctgatcttctatgcagtagacaacattagggatttgtcagtaggtgcctgcatttaataaaggcaactgtgcaagaaaacagataggtgaagggaaagactagaccagagttatcggtcagcagcataatgaaaccaaccaggagggaaatgttgaaggtacagatacagacastaggagtgaatttgagggacatttcaaagagacagtccacctaggggccgatagactgggaagaggcgttaaaggtgacactttagatttaaagtttgagtrgcttgggtgccttaatgtggacaataaacctctcaactcaaagaaaaayattagaggagcagtgagtttcatggaaaaaacaatgagccccgttttcaatcatctgattttttctacatgatgcttctatcatcctgaaatacatatatcatttcaacgaaatgctttttgaaaagagctactacacatttaaaagaa

SEQ ID NO: 982 - DNA, 600 bp, Bovine  MMBT13917
tagaacccagccatgctgcgggggaagaaggagtccacgacgctctgtgggaggtaaccactgaggtcagtctggaagaacgtgaccaagctggttttgtttggctccctgtgaaaacaaaaacagggctgttaggtatccagaactgagggcccacccaaggaaagtggtccaaacccagggatttcactgggttcactgcccagaggtcccctctggatctgcttcttttcaggatggaagtggatcctctcaagcatgcttccctggccccacatcgatggcaagcgaggacatgcsctgatttccatcacagcaaggtcattcattccctgtgcctgattcagtcaggaaagtcttccagagaacttactctggtgccaggtcctgggagaaagagacatgatgctgccctctgaccattgatggcagtgattctgcgagaaggtctggcaactcttgggggttcctgataccctatcaagggctttttaggtcaaggttattttcctcacagtattaagatgtgatttgccttttctctcccattctctcagcctgtattttattctcacaaatttttcccatggccagcacaac

SEQ ID NO: 983 - DNA, 603 bp, Bovine  MMBT11488
  misc_feature (1)..(3): n is any nucleotide
nnngcatattcaggctatgggtgctggtgagtctgctcatttgggaggaggagaaggggaagagatgggatatgtggtttctcatatttttcagaccactggccttggccctgaaggtcccagctccaaatctcaaaggcaggagtgaggtgatgtgggctgccaggagggaattacagatcagtggtctggcaggaagcttgacccttggccggggcgagccgcagagggtacccaggagccccctggggaggagagttctggtgagttacccatggttgcaccattcacatgcttcccaasccgctatcccaaagtgggaccccacttatggttctgctgctgcctggctgcgtgtcttgtggcaggccactctcccctcaggcctgccaggtccataccagcaacttcactctgccttcctctccaggcggggtctgggggatgctcagctgagcaatgagctgggaaagagcttagctaataatagaaatgaacatcaaaacaatcacaatcaaaatagctcccagcattagggctttactatgagccagaccctccaaagtgctttacctggttcattgaaaggacacaagactcccc

SEQ ID NO: 984 - DNA, 600 bp, Bovine  MMBT13559
ccttgaccctgactccctggagcaggacggggttggggctcagacagtggaagctttcttgcccactgcgtcccctccgtagttcagggactatcttggggcaagtggcaaccaggcctccacttgggagcactgaatgccagactggaggctggaggagttggaggcaaaaggagaagggactctgtctgcccctgtgccctgcttctcctgcccaccctctgcccaaccagactctgggttctgggcatcagggtcttggggacattttccaccccagagagggattggatgatgggsagctggtggtggtgagcagagaagaagctaaacggataaggcagagcaatgcacaatgaaaaatcactgctccggtccttctgctggtcctagacctgagcttctacctggagtagaggcttagagtcctgtgcttcagccgccctcctttatttatttatttttgagttttttttattatttatttagttatttattatttatttatttggctgtactgggttttagttacaacacacgggatttttcagttgcagcatgcagaatctagttccccgaccagggatcgaagcagggcct

SEQ ID NO: 985 - DNA, 598 bp, Bovine  MMBT12657
  misc_feature (1)..(10): n is any nucleotide
nnnnnnnnnnacacacaaacccgtacatacacaccctgaataatattggggagaatcagagtttgacaaggtagagggtaccttcagtttctccacttataaattcaataaaatatgacccagttccagaattgtgcatttctagatagctctaatttaatgaatttttccctcaatacgtggctctttggggtatgtagaaaattggactttcacctaaaatctctaccttcaaagtcaagataaaatttaaatctttagggacttccctggtggtccaatgattaaggctctgcattscyaatgcagggggctcaggttagatccctagcagggaactacatcccatacgccccaactaagatctgatgcaaccaaatgatttttttttttaatttaaatcttacacaaaattggaggtccttgagcatttcaaggactctgtgacatcactttaaaaatgaaaagtatttcttcactgtcagctcacccacgccagtggggtgagcaaattgtaacaccttcaaacaaaggtctcttttgtttggtcagtgccaaagccttcaaacgccgttgcaactggttacaaagctcagag

SEQ ID NO: 986 - DNA, 600 bp, Bovine  MMBT11744
caatccatgaaaatcttagatttgcagaaaagttaaactagaggagattacgtatgtgtttaccaggatggctttgtgcaggaattgcagtaatttgaaaacctgaatcctaggtcaggccctgccacttcctggcataacctctctgcacctcagtatacatctctgtacaatggcaagatgtcaggttatgccatttcacctgtccctcgaggttgtcatgagaatccaatgggccatagactgtaaaccaaggcatatttagaaaggggaggcccctttgatagaaggagaggactsggkcgagggcagaaggccatcctgtccagggatggtaccccaggttgttggggaaccagtccccttcctagtttgattarcttgtgaacaggctcccaccrcagaacaggagccattccaagtcccattatcctgcacattctcaccctgcagccctgctattcacttaaacaccgcagctcccragtacattttaatctctgatcattagttacaagattttcttgttaattctgattcagcagattttgctgagacaacgctcttttttcccttttcattttggtcacgctgcacata

SEQ ID NO: 987 - DNA, 600 bp, Bovine  MMBT11783
ggcatctgactggaacttcacacaccggaaccctcacttccgtaattacctctgtatagaacacagagcattggatattacttcagtcttgcatattctctctcctgctgccatttctcaaccaggactattaagtcaacttccaattatccccaaacagcacaggttgccatttagcaaatgcatccacaaacaaggaatcatcatgtttcaacataacatcaaccccaggaaggttccatcgctgtgcaagacgactccagagtttggagcatgaccttgtaaatttctgtggccctstatggaatggcacarcctgggaatcatagctaaccctttcccagagtgactacgtagctgatagcagatcacagagatttaaacttggaacaggttgaaaggtaccaccatttcacagacttcttkttttttaaataaacaaccctaaatactgccaatggttggtgccaagctctgtctgccaagtgccacccaatttggccaaacggctaaggaagaatgcagctctggacccagttcaatgtactgacacccaaggccccaaaagcatttcaggaggcaagctctgacacgcacctg

SEQ ID NO: 988 - DNA, 600 bp, Bovine  MMBT13026
atgtcagggaacatggctcaattgagggaaattaataaatgagagcattgctgtcattccaggcccagctgaaaccttttacaagcggcactcaccctaggcactgacatttcacccaagctcttaggagatgaggaggatgtactcagtgagacttctgagcaaactacttcttgccatccagttgaatatgggttaaagastaggaccagagcccagagaatccactgacagacaggcctgaaaccagagaaaaggttgcttttgaagctgttaaggccattcatcatcaaggccctscaaccttctaccattaatttttcctcctgcagacactgcctggattctccaggctggctttcctttgcaggaagctcttgaggctttgcatctagttggcagaaatgcagacctaccttttcttgtttcgcgagccaagaatgttatattcccacatgaccatgaaaaattgggccagacaatccgccattcccttaaaaaagctacacagacacacgtgcacattcctatgtatgcaggagatgtttaaacctccaagtggaatgttcagccagatatttttaaagtcatttatgttag

SEQ ID NO: 989 - DNA, 600 bp, Bovine  MMBT14269
gtgggtagcttcctgacctagggatcaaacccgtgtctcctgcatctcctgcatagcagtcagggtctttacyactgagtcactggggaagccctgtcggcaccagtgcccatctctgggtttagagmtgtactgaatctaggctgggggtgttctggagggggaaaaaatggtaactcatcaagagtttggggatatttcagattctgtcttcttacagtctctaaactaccatttgcttttcagacagagtgaaatgtgcttcactcctcattgcccccccagttggagcccagcatsttttatctcatgcacttacttacaacttaagatccataggcctcttcagcttccaaagaggtgcctggcttagtaaggacttttagtcaaaagggatagacatatcaacaatgacttgcaaatcagcactgtgcattcaaaaaagaaccagagcatggaaagtgtcggtcatggtgagtagttttgaatggccaggacctgaacttcccttggcttttgagaccatggcagaagaaaatcacattgtttcattaaacagcattggtagactattaaattcaatgaaactctaagtccatt

SEQ ID NO: 990 - DNA, 600 bp, Bovine  MMBT11702
aactagtggtataaaagaaattgacagcggtgaagctgcctatgctgttatctaaactgtcttcttgacctgtgatgtttatgtaaactataaatgaaggtattttaaattggaaataaaagtgggagaataatataccaggaagaataagaygatgcaagggactcaagtttccgggaaggagtactgatcacagtgggcactcaaagatgctgtatacaattaattttcctttttctcaacagtttctgaaatcctttagatacctctttgtttcgaagactgtagatgagagggttsagcatcggggtgaggatggtataaaaggctgataccaccttgtcctggtccggtgtgtgattagaagctggtctcatatacataaacatggcagctccatagtagagtccaaccacagacagatgtgaggagcagatggtgaaggccttgcggcgactttccttggaatccatgctgatgacagcttgaagaactcgtgaataggaaccaataatcacagagactggaaaaaccagcatcaccacacaacagataaaaagcaaattttcaaatgcagaggtatctgcacaagatagaggt

SEQ ID NO: 991 - DNA, 600 bp, Bovine  MMBT11799
attatttactagactgaaagctcctataaagaaagaactgtgtcctaaactcaactggaattctgagtgtgaatacaaagaaatgtttgttcacttgcattgaatattggagaaggaaatggcagcccactccagtgttcttgcctggagaatcccagggacgggggagcctggtgggctgccgcctatggggtcgcacagagtcggacacagctgaagtgacttagcattgaatatttatgtctgagacagtaactcaagttggttgatagaagaggtgaaccagaaagccatattttstcacagagatttacttattctgcattggaacagaacaatgttaatgatcttattcttatggcatcattcttctcacacatttgtctttttaactctgagaagcattagtaagagttaggctgttgaactagaaagatctgtacaagatcccaacattgctgcttcctaccatggtacccttgggcaagttacttaaacatcccaagcctgtgtttttatctctaaaatgggaataaataatcacaaatacgtaagtgtagtattttgagatgatatttgtaaggtctatgtattaagtgc

SEQ ID NO: 992 - DNA, 600 bp, Bovine  MMBT12075
tcttcattttcaagatgctaagctttttccttgctccccattattaatacacactctccgtagaagttgttcacctgtacagccttcctttgtcttggtggcattgtccattttcagatttactttaccagttagtttgactgatcctgagatacttgtaggaaagagagagaaataatgagtaatttagtagattttaaacgtatctacttctaccaaatctggaaaggaattctgtatttttggccttctaacagtgaactatattggttgatactgttgtgagtgagatggtgaaaswaatcagtcatgtcttactgggatgaggtagctgaggctctgtgttgtgtattgtgaggaaggcattgttaccatgaggcagtcttccagtatccttggaaatggacgccaaaatcttgggtcatattgtgtcaaaaaaggtctttctaaaacttggttctcttcctctagtgtggtagaagaggagacacggcggtcccagcaagcagctcgggataagcagagtcccagccaggccaatggctgcagtgaccacaggcccatcgacatcctggagatgctaagcagagccaaggatga

SEQ ID NO: 993 - DNA, 508 bp, Bovine  MMBT11697
ccccattttgtgtttagatctaattttattatttatttatttataggtaaaataaggaattcatgatggggcatgagaatcacactttcagcaatgacttcattcttttgacttcactctttacttcttctcaagcaagtctggtatttttctcttttatattcaccatttttgttttgactgtaacagaaaatacagtcatgattctcattatccacagggaattacgacatcatactccaatgtayttcttgcttagccatctctcttttatggatatcttgcatatttccaacattsttctcaaaatggttactgatttcccrtcaggcagcaaaactatttcatttgcagcttgtggmgtccagatatttctatcccttaccctcttgggtggtgagtgtcttctcctggcagcaatgtcctacaatcgctatgtagccatctgtcacccactgtgctaccccattcttatgaatgactatgtcagcgttctcaaggctggagg

SEQ ID NO: 994 - DNA, 575 bp, Bovine  MMBT12332
atcaaatgtatttaaaattatgtatactttaatttcctatccagaatataaataaaccttttcaattaatgaattaatgcacaattattgtaggcagttcagaaagttaaattctattacactccctaagtgttaatcaattagccattttcattagctataagtcagaatactggagtgcccccaaagaatgaattctttttaaaaattaaaatatttttataattcaatttaatgaaatatgtcatatctstggctaattttaccttttccttttcattctcactcaaatcctctacscttgccctttgggcatgcacagaagcccagctctgtacatccacacatgacattcgattacacatattcctaactgctggcatgagctgtatactaaatattgtacctatcaagctttacatgttttcattttaaaattcccatttaaatgcaaattctgccatttaaatagagtcytcgtgtgctttattacactataattactatttcccatcttcctggaaccaactgcaagaaaggccataggtcactttaccagccctctaaaagtgcaa

SEQ ID NO: 995 - DNA, 600 bp, Bovine  MMBT12031
atataaaatgagcggtacttagataactttttttcacttccatttactttggagagataagattctttcccgcttatagtttcattttccattggcccccactggggaggcacgataccagtgcatttggaagtaggtggcagggttttcctttcagtgggaatcagtgctggtcaaggcactgggagtagttgagagaaggcttctcttgctcttttagatacagagtcagctactgaaaggaggtgtatgagtaagttattacagccaaactaagcacaccgaatgtgttagcatgasgggcgaagatcatctgattgatgctaacaagatcacatttgcattagtttcgcagagatgctttctacatttgagatgcgtgtgaaaatttgctattactctgacttagttggggttccctcagagttrgatgcgtgacaaggataattaaacartttctttgggtggtgagcccagaaagtaccgatggagaaatggaaaagggaagcgggcagggagaggctgtgatcctgcggctccatggggggcaaatgttgcttacagcctctgaggggaacccggcatctcacatctcacaga

SEQ ID NO: 996 - DNA, 600 bp, Bovine  MMBT13474
cctcttagacattcatgtgcagataccatgtacgcagttgaagctccagggtcaggccagaattagagacagagtttgggaatattatcttaggtattatatagtttttaagtcgagggtctggattaatctatccatggagactcacttgaaagacaaaataaagggacccaggaaaaaaaatagcaggactcaccaagatttagagatagaccctgaaagacagagaaagtaaaggaagaaagtgagaaagaatcagccatgaatactgaggaagggtgacaagctggatggaaaaastaygtwgattatcaggaattacctgaaataaactgccaagcttagggaagctacaaaaggagtatttatacagatatctcatcattaaagcacttctgccttaagagagctatcagatacctaatctgagaacagaaatgagggtaaatcctggagtatgcttattagcctgcaatgtctacatctatctgtttaatattatggctccttaaccttaatataagttaacagagcacactgtgtgcagaagcattatcctaagtgctttttaatcagcagtcacttttttagtcctctcaa

SEQ ID NO: 997 - DNA, 600 bp, Bovine  MMBT13506
atgaatgcaatattaactacctctcaakaatttctgttaactttaagggaaatacaggagccttgtctttcctataacacacagtaacacacattatgtgatcaaaatgtataactgggcaacttttttacttcattaatgttttccattgattacctaaaaaggaagccttcaatatacctttaaatatattaaacagtggtaactacaatctattaggaaagtttcactgaagaggatcatagtgggcttagtgsaggagacggcatgtttagctggactttaaaaattaacaatttsattaagtggaaaaactacagatgtgcagttgaagtaccattcaggagagtgtctaggctgatatkctcaaagtcagttccctccatgtgattcttctagtagcaaagagagtcacatactttagacaaatcattggttgctaatttgggcttttatcaatttcagtataaaagtaattttgagattactatctatagtaagaatcttaaaagtagatttctatactgtgggaaaaaaagggtggaattttatactttgaaaataagcaaatgattaacttgacattttctgatgaatatt

SEQ ID NO: 998 - DNA, 600 bp, Bovine  MMBT13968
aattgagaaatagtgggatttatttttccctttctgtttattacagacatttaattttcaacagctcaggaggtagagatggaaatgtggccttttgtatggcactgattttcgtctctctgtattgttcaagtacattagtcagcatatcttatcaagaatgactttcttctcagtgtattgtctaagtacctcaataatcatatcttatcaagaagtcagcattattagaaaaagtagttttaattgcttgatgaagggctgatcctctcatcacttatagtaggtggcagtttcctsatactaaccctttccagttttgtatcatcatggtgaagcatcttgagggttaaacaggtaaaaataggaaaattatttttatggaaaacatgttttcttacagtagaaataatgctttaaaattttttgttttcttttccaacttgaaaaatgaaacatcttcagacaaaatatttgggaaacaaaatattttgcttggcaaagatgcttttttacattgcttgatactctaaagtgttttttaaatggtggaagaagtaaggttgaaaatgaatgttagcattttttataagccaggct

SEQ ID NO: 999 - DNA, 600 bp, Bovine  MMBT13572
tgttcatgaacaaatgaaagcataactgaaacagttgttattgttgtttacttgttaagttgtgtctgactctttcatgatcccatggactgtagcctgccaggctcctctctccatgggatttctcaggcaagtatactggagtgggttgccatttccttctccagcagatttcctgacccaggaatggaaccctctctcttgcattggcaggtggattatttaccactgagccaccagggaagccccatgaataaaacaagtcttccctaaattttctcctttctgtttcttcatacsgatgactcaagaataagtctactaagacactatggtggatcacagtataggcttacagtctgattttgcctctctgagttcaaatcctggctttacccactaaatagctgtgcaaacttgttttcccttttggctcagtatcttcatccttacaactgtgaccataatactatctcttgcataggggtattgtgagaatatgatgagataagacatgaagggcctacaatagcatgtaaggactctaaaaatagtagctattattatgaacaggtgcttatttctttgcatcacattcaa

SEQ ID NO: 1000 - DNA, 598 bp, Bovine  MMBT12429
  misc_feature (1)..(56): n is any nucleotide
nnnnnnnnnnnnnnnnnnnnnnnnnnnnnnnnnnnnnnnnnnnnnnnnnnnnnnnnagtttatttctaggctctcttgttctgttctacataggcatgttcacatgtaagtcagtagattctatttgtgtaattgccgtaagtcacgtgttatattaccatcagtatctttttatagtttgtattactagtttgatttttatcttttatccacgaagtgtttaactttgtatggctgttgaatcatttttytttctttgttcatagatttacttgtctgatagttgttaaccaagaatasttatcacagtctagatgactgcatatgacagtgcatcaccagtgtgcagtcactgtaggagaggcagagacacacacacccagrcttagaaaactgtcagtccctgttgtgtgggatgtggagttaagttcacgcaccacacagcatccatctgggtcctgtttcacatttacatctgcagctgatgaatgggatasagatatacataagacaaagataaatgtattagaccacgagaaagaacttagtcatttttgaaataaaagctttattgtccatacccagatattaaggaatt

SEQ ID NO: 1001 - DNA, 598 bp, Bovine  MMBT01757
  misc_feature (1)..(41): n is any nucleotide
nnnnnnnnnnnnnnnnnnnnnnnnnnnnnnnnnnnnnnnnntgagcttctgattgatggtttccagcagtgtttactgtgggcattacccraggttcctaagagtgagtatgtattcattcaaatgtaataaatctttaacataacttatctttttaagattccacagttcatataawtggcttttackgagaacgcccactttgcttatctgcactgacatctatgatttggcatctttaatttactgtggttcttataaaaagcactgaaacaagaagaggacacatggttaattatrtgccacttgaagagaaatgtaacacacayggaacaaaaatgacttccataaaggaaacattataatctaattggttccttggaccttataaattagagctaattagcaaaaagaaatttttgcatctcagaackcttatgttgcctggccagaattacatggtcagtcaattggcaagtcaagatttaagcttaagtcttctagtttagaagttaatattcaatatatctgctgttctctccagatgcaataagaagaaaactagaggtgttctgggttttcatggaaattgccacaa

SEQ ID NO: 1002 - DNA, 600 bp, Bovine  MMBT14250
agctacccactctagtattcttgcctggagaattccatggacagaggaagtctggcaggctacagtccattgagtttcaagtgttggacrtgacttagcaactaaaccaccacataaygaaaacttcccacattaaatttggtttttagggagtcaacaatgtcagggagccaggtctttccactttttyctgtgttaatttcatgctcaggttcaactaatggcaagagggatgcccagaagccctcaatctacatttttccaactttaagtctagtggagaagaatgtatgcttcaayatttttctcaagaaatttgtgcctgaatccccagatcgggctctgctttatggaatcgagtctaagagagcaaggaaggaaacaatcccaaactgtgtctgggagaagaggttctcattgtatgatctcagatggcagaggacaatggtttccagggtttgaatgctcatgcccattgatgggtaaggacgttggaataattcctactgatccctgtcagaacaaaacttgtagagcttattattaatattttactcctttaaagaatatttacttattcattcttacttgcggggctca

SEQ ID NO: 1003 - DNA, 598 bp, Bovine  MMBT14270
  misc_feature (1)..(4): n is any nucleotide
nnnnttcaagatggaaagattaggaaaacatttaaggagcagttttcatttttatatctgctcagagaaagtcatttcttcccttcccgctttgtattctcccaactcaaacattgctgatctgtgatactctcgctttgaacttttcaaggtacctaagctggggacccaacaccctgaatctaactctgccagaaatgacgtgtttgccaagttctcagcatttataaaaaacaccaagaaggatgcaaacgagagagtccctcccatcttcctgttttctccatggacctccattcygcctctggtgtggcttcttatgagatgtggggaattctgcctcactgcacagtggggagggacctgtgtatagaaataaggaaaaagtacctcccactctgagcctgcacatgggtttcagggactgagtgcttttctagagattgtccagaaaaggacatttttaggagaaaatcatcaccaccagtgattcctctcccatggaattcagggtgaatgaaccttctgttggtgcttccttcattatgtgattttcacaaagatttttttttaatttttaattaaaaaaawttttttg

SEQ ID NO: 1004 - DNA, 600 bp, Bovine  MMBT13768
ccttacaggcttgaagtgtgggcaccaagaccatagaatgttgctggtcttaggagacaaactttctctccatcctacagagactgtgacaagtcagaacatgtcatctggaccccacatggcctcgtatctgcccaaagcagcaytcaggagagatgcwgtcccaaggaacaacagcatcatgggctgctctgcagagatcttcagataccccgcctctcttcttcactgaaaatgttaccagtaaagtgctggaagtagcacctggcacactattgctcagtacccctggggagatgyggargcctgsggtgggaaactgaggcaagaagcaaagtggtcccttagccacaagcttagcctgactaaggtggtctcatcyctctaggatctttaccctgatggtgggtgagccggaagagcttctgtgctgtaagaaccctgttctagacctctgtgatattggggtctaacttctttggacactggattcttcatttgtagaaagaaactgcactgactgaatatcaactctaatattctgtgtttccctaagtcattgtaggtattgtaaatttcctcttgaaagcatcatttgga

SEQ ID NO: 1005 - DNA, 600 bp, Bovine  MMBT14040
tctctcagtttttaaatattggtgatgaatttaaaacactcctagtccaggaattccctggcagtccagtggttaagactcggcgctttcagtgccacgacccaggttcagtttctggctggggaactaagatcccacaagctgagcggttcggtcaaaaaacaaacaaaacaaaaagtcctgtgggcacaatttggttcttaaactgccaatttgcaatctctggtctcctccaagtctgcctgctctccattttacagatgataaagctgaggctcagagaggcctagtgaccttccyagggcttcacaggtcactgttgggaaaaccatgggtccaggaagcctgtctagtgctccttgcccaagatagcagatttgttggctgagcccaaggtcttaacaagcaattctcaaatgcttcccacgtatctctcgtttgcasagacatgaggtttacaaacacctcataacctacttgattctagcaatggccatgagggagcagggctggcattaatccattttcttttacaggtgaggaaaccaaggcttggagaggctaagtgacttgcaaggtcaacagtcttagagagggctg

SEQ ID NO: 1006 - DNA, 600 bp, Bovine  MMBT13164
gaagggatcaaaggtgtggtggcaattaagctgggccctggaggatgagggaagtgccaaagaaagaggaatgtagggaagttcattctaacggcatttgagtcctcaaacgtttcatccagtgggagctgatgctaaaaacagaaaaaatattgttctgttcacccccagggaataggatcaggaccagcgagcagcagctataaggaaagaggattctgttcaaagggaagaagaactaacagttggggctgaccactggaagggctgtgcagacaaaaggcagagtgtctcctctayggatggtcagcctcttggcacaggtgccgtggaggatgtgatttaagtgtaggacagggagctgttccactgagctgtcttccaactcagggactctatgtatctccgatgcctctgccaagccggctttgcacaacatttccaggagggagaattattttagccctgttacagcatttcttatagaacagtctttgccaagttccctttcaaggctgcgttgcttaggttcacccagtgtgttcaatcatcagccagtggagaacatctctgcacattaggcccacgagagccccttgc

SEQ ID NO: 1007 - DNA, 600 bp, Bovine  MMBT13712
cggctacatgaaaccggtgactgggtccgtacaaacaggatccggtctgaactggtgtgcgccatgcttggatcytgctttaagataattaggtgggcacgcccccagatgacttcctcctactcatcctctgcaaaacaatgagaatggagtagtcccttcaaatccagaaacggaagccatgggttaagaatgtcagagtctcctcactggccctgaatcattcttgtctgagcaataaagtgagagagcaataaatttccatcttatttacaccacagtactgcgggtcttctttgytatarcaccttacctcctccctaaggatcccactgtttgagatccaggaccagcctatagatctatctgtgctttctcagggacatagttccacttaggcattgagagtgggcaaagcagaaccgagccagtttcagagaagttaccacatgaagtattcatttttagatatctgcctaaggaaattccaaaatcagaaaaaaatcaacatggcatgtattctttatgaaactaagaattgaacttgatcaccctgaacaacaatagggcggtaatgaattaagatataggccatctacc

SEQ ID NO: 1008 - DNA, 598 bp, Bovine  MMBT12935
  misc_feature (1)..(98): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacacatacacacatgctcacttgggaaatcatgatagtagagacacagcactgatgtgtgtgtctgtttcgtattcagacatttttttaagctccctcaccccttcaacaaaagcaaccyggcgacattcgctgagttcctcctgtcagccatagttgtccattcagtcttaagcaccatcagcatcatctctatcagtyatcaggacagccttgggaaggggttcctcccatctttcaaatgaaactcagagatattaaagaacttctagagggttccccacccaggtgagattagtattcagagccagagaaaacatatttgatcaaatagttatatgccttcaagaaaatcaggaaacttatatctcaaggtagcacttggaaaagagaacacctgtgaggcagagggaaagtgcacccagggcaagacagacgtggacggaagcaaggaaggaggaaacgacacgttattcttggtcatctttcctgagyrgga

SEQ ID NO: 1009 - DNA, 600 bp, Bovine  MMBT12366
tctttttgagaggattctcatggctgaatttcccattctgcccgcttggattccagtcctgtcttttgaatggcctatttggaatctgccacaggaacctaaaatgcaacgtgatttaaactgacctctgcctttgcccacccaaatctacttctgctccactgatccttcatcaattcatccacatcacaatcttcccaggtgagaattcctagaatcatctatgactcctgattttctccttcacttcttaccccaactaacagctgggtcctcctgacatcatcactgcgctaagaycttcactaacytctcyctttcttacttggattcttgcattattcttctgactcactgctgcccagacagtgtcttcagggtctatgtagagaaggcagaggcatcattctgaatctaaactggcttggtccttcccctttcccatttcaaagcacaattctgtaggctccaatcacagcacsccagagcctggccctaccttccttcaggagtccatctgggtgcgccttagcctcacttttctctgaacatacactaactgttcctaagccagggaaaccctttccttctctgtggcac

SEQ ID NO: 1010 - DNA, 600 bp, Bovine  MMBT13219
gatgataagttacataaatccgggaggcaaagaacctcagcagtgcagacaggtgcggcagagatggaaaacaacaagcaggaactcgtagattcgyctctggcctccaccatcttgaccatctattcagattctggggcacctttcccattcctagagagagggaaatctaaacagttgaaggtagtaaaggagtaagaactgtgatattctcatttcctgaaccctgcagtctctagaccttcagctccttgaaaacagaagctgaagttgcatcttattcatggtcaaatacctcaygctgagcacagtgccaggcacrgagcaagatcagtgacaaggggccgggctttgagcgccagctccgccagcttcgtaacctgagctcctataaacatcctcctttttgtgaccatgtattgagcccttaccatgtgccaagccttgtgccagacactttatcatcaacttcactaagcttctcaacaagcttataaagtaggtattgttgttctccccgtgttgcaaatgaagcacatgagccaccaaaaagttaaatatcttgcccagagttattcagctccaaagagcagaccaaag

SEQ ID NO: 1011 - DNA, 600 bp, Bovine  MMBT13245
gcagctatcagccagcatttggttcccgggggtgcctctcatgtccagaaaacacttcaactgtgaagagaggagccgtggacatttctgcttgtggaggttaagtcttacacrttgcttttttttcccccaagcctgtgctaggttctctgcatggaagagtggaatcttgttagcagaggcatatgtctgccatatgcaaagaatgtaaataactgtctcttcatagagtgtttccttctattcagccagttggtacttaagtgtaaacacccataatataaacaccatcctggtacygttagggactcacaagaagcacatgactgggtcccagccctcaacactagtaaccatgtgaccacatggtatgagagaaatacttgtcaaccaggaacgtagatttttcatgtataaaatgaggtcttgtcttatgttccttgaaactcgaaaaatacatcctttggattgtgacctttgttccctgcagtttgaagattttcacgagtggttatccactctgactgcctactagaattgttgcacattcatttcagtattgtagccacttattgactagagacatgttagtacatcttt

SEQ ID NO: 1012 - DNA, 600 bp, Bovine  MMBT13965
tgcggtctcaattggagagygctttcgtggaagggagaggcccccaccctggggaccttgtatccctcaccggaagggcaggagctcaggcaatcaccctgagccagcccagctggcctccttggaccacagagcaagctcactggctctctcttctctctcccagggcagaaacggaagcagctgaggtgttaagtggatctgaaccctgtatctgatcctagaacctatgcttcctcacttgagggcttttgaagaggcaagatggttctctgggtgacggtgcccacgtatctgtgyggaagggatgagttatgggcgatctggagatgggcataaacatcccactgtctcccatgaccccctgtgttccaggctcaggctgtgagcaaagctgaccagggcagacatcgctgccacgatggggccaggacaggggccctatggccaggggtcccctttctctctgtccactcagttcctcccacatgaaatcctcctgtgatgcatcccccgccctgccctctggccagtagacctgtcaggatggactggtcgacccggagggtggtagacttgatggtgaggatgcggatatct

SEQ ID NO: 1013 - DNA, 600 bp, Bovine  MMBT12682
ttcacctgcccgccgggcacacgaccccgcactgtgaggggggctgggcctgaccgtgcacccagcctctaccctgcctgctaagcacagcaccgtgtggtgagggatcctcaccagtctcctccagctgttccctggctcttgatctgcccccctacctctctctcacacacacacttttaagaaagtcctcacatggggctgaggctctgtcaagacgtaacaagaccgtggactcccccatcctagaggtatacacatgccctcacgcgtgcacctggacacaggaaaaccaacacygaagcctagacagactcacggacacaggcggaaggcactttgcccttggtttgttaaatggtgctggaaatagtttataataggcctagagatattctcttagcgcaagtctatctacatcaatcccaacgtttttctttgctcagactacttctccccaaaaccctctctgctccccaggttggaatcatgtatcctgtatgtacaatctaaccctgcagtcaccctcttcttcagggtccttgaagcaatggctcccaagcagctttctgctaaacgagtaaaggccagagcttcggc

SEQ ID NO: 1014 - DNA, 600 bp, Bovine  MMBT12806
tgcctcccctttctcaccaatcctgcccagcttcttccagatttcccatcccaattcaccatctcacactcatgtctctattctgcccagaaggaccaattttcaagaacctattgattctttccttctattgttttacactttacctgctgctcgttaagctttttctgtatttcttctgagtcacaggaatcgtagacgatgggtttggccagctctgactcgatgtgggctaaccacgtcctcagactgctcatgttcttatccagctgttgtactgcaaccagagtctccttcagyttctttaccctgtgggcagaaaaggagagatgtcaacttcagggagaggcctcactcatgcttccctcaggaacagaagccagagctgggtctaaacccagagtccagcctggttcagccacctactgtctgtgtgattgtgggcggtggcatagcccttctgtgtctctgtttgcttgtctataaaatagagaagaagtcacagtatttatgaaattcaaattaggtgaataacgatggtgccagtacatgggaaacattaaaaagaatattagccatggttatcctcaacacaactat

SEQ ID NO: 1015 - DNA, 600 bp, Bovine  MMBT13316
gacaaggaagatattatgaaactgggtcaggaatttagagcaacacattagacacaggaacccagtcaaaagtctctccttcagtcacgaaggtccttttccacacagctgccctgtttccaaactgtgcaaattataaacacatcgtgactaacttacccagtctgccctgacgagatgaacaggtaaattctgtggaaatcgagaaaggatatttttgttcacgttctagtttttactgtgtgtggtccactagctcatggagtgtttattcaaatagttgttttcactttcttcctyctctttcctcttctttaccctgggccacagacctcaagggccccaaccagaagggctcgtttgtgggacaggaggagcagggctgggatacaggaggcagagagacaggacaagcctggctacagccactgaggatgtgatatcctgtcccatgggcaaccagagcgcttagacgtcacgggaggggagtggtggggatgggagggcgaatcatctctagtgagtacctctcctccatctctcagacctcaggatggagactgcctggttctggtccacaggggaccayggagctgtctc

SEQ ID NO: 1016 - DNA, 600 bp, Bovine  MMBT12754
acaaggaatggataagctgtctaccacacagagccagtaaacaaatattacaaggccctggggacatagggaacaagccagtctctgccctcatggcttttatcctttgggtcatccttacactgctgacagtgtatggcaaggatgaagaatgtgctaacatgcccccaaaaatgagaatctggggggataaagcaactataatgaggggtgaagagaaagaccatagggatggccaaatatcagagcaggagctcctcacagcatcttacaaacaccccacaatcctcagggtcatcygtgtttaagtgcagttccaaatcaagcaggcgtgggagcactagcctcttggaggttcactcaactgggaagggtcacagtgcctatccgctagggctgctgtggaaacgacgacgaacctccagctgggatcacagtgaatgacacttaggaggtcttcagtacatttgcactgattcaacgagatggcatttccactctccagttgaaaaacaaaccacagacacactttaggattaaaaacaaagatacaaggaaccccaggagaacaaagctaacttctacctggcacagggctct

SEQ ID NO: 1017 - DNA, 598 bp, Bovine  MMBT13422
  misc_feature (1)..(92): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtgtgcactgcgcgtgctctgagccacttatctaaccatctatcaccattagacccttaggatcattccacttttttatttttcaaatgctgtgattgataccactttttaaaattttcccraaaagtctttgtgaggagaggatttgcaaagtagaagcatgaacatgcctcgccctgaaactattcacccaagcacagttgygatcatattgsccacagagctgttcgcagaccagaattaaatcctgtaaaattacactgggcagttgtagaagaggaaaaaacgccctggaaatagctcagaagtattcarattagaataattttcataattaaataaaatttaatttttcattcctattataaaagattatatcaggtttctcatttcttggaaaatcagagagaacttaataacaaataccataattatctgcaaagactgaaccgtgattaaattatcaggtggcagctcctcctaaaactacttcttcaattag

SEQ ID NO: 1018 - DNA, 600 bp, Bovine  MMBT13895
catttcctgcaaggatttggcactctrtccctgaacatgtaatatgaagcaacaaagcagaagtcatcaaaattggcaagaaatgggtgatgccattaaattttcacccacttctgatacttgaggacaagatcaaataacctgtacattaccacagaaaaaaactggactatccttgagtacaatcctgccaatgacctgagaagacgagcctgggggagagcgggtagggaggtgccaggggacctagtgaatgaccccatttcagaagcaaacgcggggatgtattcaatamattcyagtagcaccaagtcacatgaatctggatgcacaaattaaccccaggctggttttaaatcatctctaagagactgttacacatttcagggagatctgagaatgttgtgcacatgatcctcgctktgtgcaagaagatgcctgcctcaytgaaggacaggtggctgcctttagcaactttgtaagtagattaaacacaccaaagaagcagtgcagagttctggataccaggatgagacctgcagcyagatggaacagcacaggagctgcgtaaccttaaccaagtgctgcacattccctaag

SEQ ID NO: 1019 - DNA, 600 bp, Bovine  MMBT13598
cactggagaaccagctgaagaaccacccaggcgagcccagtagagactgcaggattgtcacaaataaaatgcttgttgtttgaaatcacatagttttgttacacagcagtatataatgaagcactccccatcacccttttagaagcaataataataatgagtatcattactgtaagaggaaaatggaaaagatctggaataaaaaagacaaacgtcattctaacaaaccgaggatactggacaccaagtctggcatctggccctgsagtgaacagagttctttctatcctcttactgtgytgcattgtgtatcatgtgtactcacattatcaagaggtttggcaagtctttacttacagtgcatgaccaccaaggactaaagtcctttmtactggcagcgtgtcactcacagtgtgaaacaactcagttcacaccgtgagtttctgagaaaatatttctcaggtcttataggagctgatcagcttacagagtcaactgatatcaacaagcacccagttgactcccaaccaatttgcgcaaaaattaagattctcaagtgggttagttttcgcatgtgaggctttcattgagatgctcttg

SEQ ID NO: 1020 - DNA, 600 bp, Bovine  MMBT13461
ggatgttttagaatatgtgcatccacattactgctgttgtgtcatttccttctttcctacttctaaaaaagtttgaaaggttatttaaatgcttttgtgaacacagtttttgaaaaacataggaaayacaactaaactttaatcacttagatattcagtggttcttctactggtccctggctctgttcccttttctgtctaaaattgggacctcctaggaaaggcttgcttgtattttttgaatttgtattttgtttgccttgttgcacttgctaaggcagcctgccaggactctttgtyctgcccttccaaagctccttytgtctccccagtcttggatttagcctggggttagtgtatttggtatatacactgacattaaataagcaccacacaatgtgaatttgctatgagaaaattctcaraattctctatttggagagaacggtaaagtgactcctctctttcaggtaacagatctgaggatgtacagctatatacagatgkgatgagtagtgtataaaaaatgaccccagtctacttwtggaaagtgttaagagatcattttctccatccttctctgcccccctcatccctcat

SEQ ID NO: 1021 - DNA, 598 bp, Bovine  MMBT13413
  misc_feature (1)..(1): n is any nucleotide
nctctggagtgctccatttttgctacttcctgagcgtgactaatgcaatttgtcccttctctgccacctacacagagtccttcccacttgcctcagtgctgccagagcgacctattgtgcaacaggaaatccatgctgatcaatgcggggcaggccgcataaggcaggcaaattacacgaatatgagttagggataactatgattaatcctttggccaggcatggcctggactcccatcatgccctggggcagctccgaggtgacggggctaaggacagcacttctgatggccgcagtgyccagccattcattaccgtgacgtccccatcacccagcctactgatgagattattgatcccaggaaataatcatatgagatgcatcgaggtaarcgtgggccattgtctgtaagcatttattggcaaaggaggtaagcttttcgtcattttagaagagcctcacttttttgaattaactgatggcatcttttcaagctaaacgtcagtacttttgttggaagaaaaagcagaggagagaggagaaaacaggaaggacaaaaacccaacgtgcagggaaggcctagaaaaatgagaagcc

SEQ ID NO: 1022 - DNA, 600 bp, Bovine  MMBT13468
tattgaaccaatgcagtacaacagataggacactctgacagttccatccctgggttttaaaaggcctgaatattccatttttgtcattttgatagtaagcctccatgtaaaatgtgaagactcttcttctgcagaggccacaaagacacagagattcagctagctccccctaattccaacaatcccatctgttgtgccagacaagtgagtgaggctatcacatgtcctaccattcgagtcaacatgccgcagccaataccacgtggagtagagatgattcattcccagtgagccctgtcyaagtggtgtaatcgtaagtaataaattgtcatgtttttataagtcatgaggttttgtggtactttgtcacacacaagtagatacaggcattacacatgtagtctctcttgctagtctcaagaaaacgtccctaatacagcctttcatacctcaaatcattttctcttgttaaactacactgctgtccaaatgaaaatattcatatattcagaagattgaaccaatatgaagatattgtacttgaattacctaaattatcccctcatactccacttggctacaaatgttcatacattcatg

SEQ ID NO: 1023 - DNA, 601 bp, Bovine  MMBT11989
  misc_feature (1)..(1): n is any nucleotide
naagaggcagtagttatttttggggggtggaggaaagaccattctctttttcaattagcacaaaaataattttataattatttcatcagctactactgcactgatttttaaggtgtgaggtttttttttttttttaagcatttaccttaatgctaataaaattaggtccaatgacaggtgaagaaattctgtgagaacaaactatacattaccaaactccgagtggtccccagagtggctggacagcgtctgtactgcgagggggtgtgttgcaaagctctacaaacactcttaaagggayacacgtttgtaggagaaattgcaacatggttggggagggagctttctccctgttagctgttaatgatctctgagacagtcacactcaggaaaggagctggttgatcaaactgtggtgggacagagattcaggaaagctttgactccttctcagagaggaactggagacctaagggggaatgatggtggccaagagctcttagtaggaaagcacatcacagccttatttttcctttcaaaagtgcttcccacacgtggtggaaacgctgcagacaccccctctgcagacctgttgctggag

SEQ ID NO: 1024 - DNA, 600 bp, Bovine  MMBT11818
aaactccaggagacagtgacagacaagggaaacctggcatggtacactccatggagtcacaaagagttggatgtgacttagcaactgagtaacaacaacaaaggttgactttggtgggtgcaattgttttactagttgactgcttwacagaaggttatttgcatgtgttaacagataacttccggagacaaggctarggttaaaagaaggatgccattccaggttctgtgtcagsctgtggggctgtgtgtgagtggctgtggttgtgagaagccctttaaaacactgttcatatcatayccttcaggccacagcctcctgtagagctcatgtcagcccttggagtatatttcagggtgacagtcttttctgcccatgctactggacttggaatgagagagtagatgaaatgtaaattcagatacrtgtgggaatgagcagttgcttcttttgaatagactggcatggagttgaagatacaggtgacaggccagggactggtgacatttataaattatcagattctaaaattcacatgctaacaggattattttaaagaggcttakctttctttggttgtataatgtcttattctttcat

SEQ ID NO: 1025 - DNA, 602 bp, Bovine  MMBT11709
  misc_feature (1)..(2): n is any nucleotide
nnttggaacaaaagctgaccctccccaggactgtgctctgacctctgcaagccctcttttstatggcaccatatttaggcggattgacaaaggaggattttcactcagcaacgtagtcacactgtctgtccgtcagccagcgattcagtccaggcagacttygcattgttgaactatgcagttattttaagatttcactgtatttatagcattttataagaaaaaaggaaagaagagaaaaaaaaagcttatacttggggtaagaaggtgcagttttcagacaggagactccagacaaatayggaaattcttgggggccctgaagtgacacgttttagccacatttaggggcctattggattatggattcaattctgaagggaaccratatagaataagtgtgcaaggtcagagactcctcagcgatgattgcatctaagcagtgacgtgaactcaggggctttgaaatgtgttttatcacaraccaatgcagcacatacattgctggacatgaatgtctcatgcagtttcatgttaaagagcgtggtggtctgttgttcacatctcactaccatttttaattttgcagagtctaagtttat

SEQ ID NO: 1026 - DNA, 600 bp, Bovine  MMBT12035
acacaccattctcccatccagaaatggtttggttattacttgaaattcggacataataatttyttacaatgttatagcaaaggtggagctgtttagaaatcttctcattttcagaggggatgaacagggtttctttactcttggaaaaaaaagaagaattagtttttcaacataatggaaagcaggtgcacaaagaggtactgctgtggagagggtcacgtgaccccgcaacagggaagcgcagtggtgccgccgggaaactcggaaattctcctacaggctaaacatcatcagtgtggygctgacatagcaacagacattagtaagcagcaaaccagaaacaaactgcagctgtgacttacatttcggggactctgcatcaacatgaattcactcccaccaccaccacttaattggacacagcagtcgtctcctacagctgagtcctagctttcaactcaacctctccacacggatcaaaacgactgctgaggacgtgaacggggacacatcacttaccttgtctaactcgctgcactgacctcctgctgcacagagactctaagcccctacgaaggtggccagggccgcacacggctc

SEQ ID NO: 1027 - DNA, 600 bp, Bovine  MMBT11768
cccgtacagaactgccgtgctgtgcgtgtgccttctgggaacggaaagtcacagcagaaacattgtctttgaaccaaagcagactcttgagtcctgacccatcatcctgcccccgaggactgaggacagacagggaagaggctcgagtccatggagatatgcaaggaggtagattctgggagggggtgagagcctcggaggcctagaggagaccaagaaagatggcagaagcacaacatggagcttatgaatgtggcttgggttgtttgtttcattatttaaagttttcattcctgtggycttgttgttcctcagtctgaaagtcccccagactcactggtttgtagccggatttgagatggttaattcggtctttctccagaggaagattggggaggccctaccggaaagactaaagacagacagacagacagacagctggaggctagtggttctgttcagcagatcctcataccctagtggcatgatcatgatccaaacagattttcagtcaagctcacagggctgagcttcttcaggaagttggagtcatgctaaccaaaatcccaagagactgatggagaagccggaaggtggtgg

SEQ ID NO: 1028 - DNA, 600 bp, Bovine  MMBT11482
agggagacacagtagaatctggagctaacatttggaytyacccgtactggcggtggtgcctggggaggctgccccctgattcttgcaacctggacccctggcaacatcttctttcctgtccttcttgaggtctggctgttctctcctgagccactccgaggcattctaatastgtattgttattattaatttttcttgcttaagttagaaagtgttggtttctattatttgtagctaaagaatcggaactgacacaaacccaaatgcccagcaatcggggcttaaaagcatgatacagcycacgatggagtactatacaccaggtacagcaacgagacacaggcacagaaaagatgcttacaacatatagtttagtgcagagcagattctaataaaacaggatgccatggtatgatacaatgcttgcaaaatacactctgtaccatcatagaaaaaggtctggaaaaaaatataacagtatttattctggtgctgacatattcagtatttccctgaagctgggaaatactgacagcaaaaagaagggggcagcagaggatgagatggttagatagcatcactgactcaatggacatgaat

SEQ ID NO: 1029 - DNA, 600 bp, Bovine  MMBT12254
tttcgccggaaaaaaaaaaaaaaaaaaccctccatccacctgacttctgctttatccacttgctttgggatgaaccaggtcagaatgtcaggaaaagagggtgctatgtaagtcctctccactgaatacagactcaagtgggtgatacagaaccatttatacttactgaatcgctaggatatgtcaggctctatgccagactttaaggatcagaaggtaagtaagacactgtccttattctcaagagtttacagtctagaggcagtcacagctgtgcaaataccagccagggcagactcygataaagatgataagaaagatgcagagaaacgggggaaataggaaataggctgaaaggcattaaggaatgcttctggagggtctgtcatttgcactgggtctagaaggatgaatgggactagagagatggcggaggggggcagggggaggggctgtcaggaaaaagcactgtagttagaacatccctgctgcagggggtacagtacatagtctggagtcactagtgggcagatatataaagagaagagtaggaggtaaggcttgaagagaaaaagcaggggccaggccatgaagggcacc

SEQ ID NO: 1030 - DNA, 600 bp, Bovine  MMBT13964
acacaggagggaattggtatcaaggaaaaatatccagagcatggttaccagagaagggatgctgggtgtgagtcaaacataaaagattgctaagctcgcatgagaaaatagccatgaaactctttgtaaactgggaaactctgtgtaactttcctaacttgctagctatttttattcttggtctggtgctccaagctgctgatacatctgatttcaagggccataaaatgccataggagacacctccgggagcgtgtggtcttgagatgaatgattcaccactccattttctttacccayggcagacatsgctaatggatcacagcactctcccatagagcccrggaggtgctcacagtccttctcccctcagctgtccaggcaggcactaccaagtgaacagagaaggaatgaaagatggaatcctttagttatccttcatctagcccacttccatcatgaaccagcatgggaaaaggtccagagaagggtgcgactgccccacttcactgagcaagtcatcagcagagcttggggacacctcgagtcttccaatttctaattaatcctggtaatatccaagatgactcatatggaggg

SEQ ID NO: 1031 - DNA, 600 bp, Bovine  MMBT11837
gaactgtttcatctcttcctcctcctcctcttcctcgcacctccatgtctaattttctcttcctcttttcagctctagtcccttccacacagggggagcaattaagacttttggatgctgatatgtgggcccaagagccacccctgtatccacatgacaaattctgttagcactctcagaggtggtgcaggtgagtgagaggcacagggccttggagttccgagaatgtccatcccaccactgttctttgtccctgagtgacttcagtccttcaaacacaagagatgtagcaggaacctygtgaaggcttcttccagttctaacctctcaaagtgcaatgcttctgacaccaacaggtctttaaaatacagaagcataacactagtagaaaagaccctgatgctggggaaaattgagaacagrgagaagagggaagcaacagagtatgagatggacatcatcaactcaatggacataattctgagcaaactcaagaagatagtgaaggacagggaagcctggcatgctgccgttcatagggtgacaaagagtcagacacaacttagtgactgaacaacaagagctcatggtggagttcct

SEQ ID NO: 1032 - DNA, 600 bp, Bovine  MMBT12695
ggatgaggagggctgctcacatgtgcaggggaagcccctttggggaggcggcgggaagcggcagcatggacccagccacggagcaacattctccccggaatcggyctggtgggtgtggctggtctgaaagggctcagacccgggtgtatgaggtgatggaagacctccttgtttggctgagctgsggtgggggccccggagggggtggggctgagctggtgcaggcagagcacttggctgtttggttgaggttgtgagatgcagctgtcctttgctggacactcccctctgctggggtcytcacagtcaagaggctccccagrcctcctcaagaccccatcccaggartctgtacttttagaggttggggtctccatgctgcctgtcgggggcccctgtggcttctggcaagctgagcggcctagggtggaggcccctggagctcatggttctggatttgattaggattttgtttgttcaaaagttactaggaacagtcttttttgttgattcaatttaatatgcatacgcatgtgcctatttggttttctccaccagaaatctggctctgcagagctgcgttggtttgtggccccacct

SEQ ID NO: 1033 - DNA, 600 bp, Bovine  MMBT12362
gatctaaacctgcacctcctgcattggcagatggattctttaccactaggccaccaaggaaaccccatgtatgttgtataaattgcaaagattgtatcttgctttctgcaaaagttaaagaatcatataagaggtttattaaagaagtcaatattccagcatgaaaataagagagttttcctaccaggtgttattattagtcaccttgacagatgagaaagatgaaggttgctacttgcatggggtcataagcaatgtgtcagaagtcactggggcagatggactcatcactgaggaaaygagtggagataaaggcatgctcttgcctcacaaaattttcacggctactgcatgggtgtttgtgagccaggttgactgcgtattagcattctttttcgcttggcagttcccagaagtaaaaaggttttttattgcactaaattctaaaaacatcatctaatgcagctggcggagatgtgggagagccacagaggaacaggacttatttgggggttttaatcagcagcaggtccagcatgaatcagcagcgtgatgcaactattaagaaacgmatgcaatcttgggctgccttgccatgta

SEQ ID NO: 1034 - DNA, 600 bp, Bovine  MMBT13610
ctgttaggagagacatgatgcctttcctaaaagaacctgtggtctaatgcaagagagtttttatatgtggacatcccacttagaaggggggtggatagaggagcatgcctaggccagatctatgagagctgtcaaaacatcactggacactgaatgagatggaatcatatctcctctaagcgagagtgctgagtgtgtttgaaaggaatagtttgccaagtccctggggtgacaggaggtgtaggctcttcacaaggatttaactcaaaaactaacggctctcccagacgtgtgggtcaygtagagcattgttttactgagtggaatttgcaagagsggtactgaaactcatggcccatctttttccatgcagcactcaacctctctcaaaggatactgaacaaatgcttcaaaaataccttttacctgggctataaagattaattttatcattgttctttatactacatatacagttttcactttatatggtacacaattaagtgatcattgcctgctttaaaacagtggcaaattgtttaaaatctactaattatattggaagaaaggaaatcctgtaataaattcaatatataatac

SEQ ID NO: 1035 - DNA, 600 bp, Bovine  MMBT12020
ctgcaatgcaggagacctgggttcaatccctgggttgggaagatcctctggagaaaggaaaggctacccactccagtattctggcctggagaattccatggactgtatagtccctggggtggcaaagagtcagacacaactgagcacctgttgggaatttwtcataataaaattacaagacaaagtgtacaaattcactgtcactcctcaggagagcccttgtgcagtgygcaacctgcccaaccatcctcagcaacctggtgtaccacatactctatgtaatgccacctccccacaccyggccctgccccaaataccccacatgttggcaaatctctctctcaggcatactggcagcccagaggggagagaagagaccacggcttacatgagctcttgtgttcccttctccgcggccgcctccgccccattgtggtccgggggctcatgggctgggatccacgaggcagagtgctggggttggtgcaagaaaaggtgtggttcacggtcggcgaggagaagggagatgaggataaggctggggagatgagagcagacccatgagcccagcagagccctccaccccaccccagggagaca

SEQ ID NO: 1036 - DNA, 600 bp, Bovine  MMBT12868
gatacaataactgtaacatttctcccaaatccttataattaatcactcgaattaatgataaattaagcactcagcttcagttcctagtaaagatcattattgactcatgtgttaaattcatcataataatctatttcccctgctttatctttcttagaaaaactgttcttgaagaccacttgctatttagtggtacatatatttggaccagacatcacaaaactgtgagtatactaatacattcatctgattcagttgctgggacatggtgggaggtggggagaaaactgggagatggcyggctccatttccagccggatgtacttactgtacacgacataagtcctatctggttcttgttaatagtagaaaattcaaacctgactcagatcgtcatcctaggcaaaggctctcttcaaattactgtgtggcaacttggctcagtttctctccaagggccgtttggaagaattttgaccaataatgccaataaatggggagatcctagtggctgggactggatgtctgcccccttctcttgggctttccctccactccctcctggattctcaggccgtatgcttctcagggtcttctctt

SEQ ID NO: 1037 - DNA, 600 bp, Bovine  MMBT14065
tcatgcttaatgactaaggccttctgagacacctcrctggaaagctgccctatggtttgctaactgaacgagcagggtggcagagaaaaggcctttactgttctttttagatggcctcacacatttaccctcagctcttggtaaagaagaatcgattcatctcacaacctccgctgttgccatggcacccacctggmtgtagctggagagaagcacccactgttcttgttcagtctctaagtcacgtcatactttgcaaccccatggaccacaatacaccaggctcccctgtccccgacyatctcccagactttgctcaaattcacatccactgaggcggtgatgccatccaaycatctcaycctccgccaccccttctctttctgccttcaataattataaaagcttacacatrtcaaccatacaggaactatttgttaataaatgatctgtcctaatacttacaaatgcaaagcataactccatcctggtaaatcaagtctgggaagacatagccgttggcttgaatttttgaggaaggttttgcggagcttgcacaggtcttaaaggaccatacagattgcgaacagtgcagcaaag

SEQ ID NO: 1038 - DNA, 600 bp, Bovine  MMBT12261
ggtgccctgcagaggcactacttcccacgctgactacccagccctctggccgctgactcatgagtatcaccacagtcccaatgcctgcccctcctaccctaagtcagtagtgactccctggaggcttacgtgtgggcgcctttcttcctcaccctggttgaggtggtaggggctgtggtaatatatttccaggagaaaaagcaggtggactggcttcatcgtcactgccacccctgtgcagctacagccctgttgagatacacgaggctgaacaggggctcttctctgacgtgggggacyccaaggtggtacatgcctggcaaagtggctaccagctcaagcgaatgcctcgctggtgtgaagacacgctctgacgaccttaaccggatcttcagaagcctgcggcctggagcgcgcaaggccgagtgagctgcggcttccctctgctgcttgtacgcatccagcgccccctgctggatactgggtgtcccttcctcctcccacccgttcccagcaggatcccaagcagccagcctcaccctcctacccccacatcacctctctcccctctaggccttcagtcctgtgggctctaagctc

SEQ ID NO: 1039 - DNA, 600 bp, Bovine  MMBT13367
aagatcagagtgagacaaggagaaacagagtcatcattcttactcttaaatgggtgaacactcctgctgaactcccaggctattgatcctctacatgggcactggagaagtttcgtgaagtccttttccagggaaattttgagattccttgttatgcaaagaatgtagtcccaagccaagaatactgtccaggctacttagaattcaagcctttctattatcagctaatgttgttttaaaattcaaaaccatttttctagcctctgctcttctccagtctccttctgcttcctctgatgyggtgtcccccaaatacttgcttgttcctgactgtgtccttcaggcttcgagcctctaatcattgttcatgtggttctcactgcttgaaaggtcctatgtatttcttgaaatttcttgaaactttattccatttcttaaaattgccattccttcagagaccaggttttacagtaaaactgtcttttatgcctcccaggagaataaaagacatcaagtcttttattgtcataaatctctgcaacaagcctttattatcccccttcttatggtttgcttttgactctactgagcctttctcac

SEQ ID NO: 1040 - DNA, 559 bp, Bovine  MMBT11696
gagactggcaagcctgttgctaaccaacttggcaggagacctttcaactgggcaaaatgtgctctcactttgttccaggtcagatgggtaaaccaagctgaaagtattgtttaggcagtcagacatactgaattactaatgaagtaaaaaacaggagcactcgggattcctgaagctgaaatactattggaatatcctattagaaacagtggtgatattctctactctttcctcaacctttcatgtgcccatgagattgataactgaggtcaaggccattctatgacaaccagagttttytattccatgaaatgtattctatttgtgcttttgctgacttctggatcttttagtctgttgacaaaaggccaaattttagttgacttgttaaaagatagggagtttataaatattcttgataaaggaaatacactctttaaaaaaaaacaaacaggtggaaagaagtacatgctttgccaacaaactcggggaaaaattggaaagaaatatttgcattctcagagttgtttttcacctactaaaagtttaaggaaagtaa

SEQ ID NO: 1041 - DNA, 602 bp, Bovine  MMBT11691
  misc_feature (1)..(2): n is any nucleotide
nncttccaaaagtctttaaagtcagagctgaattcatgccagataccgaagaaaacgtttggggacacttccttctctccaatttttggtctcatgaagaaataggctgtagtctccaaaaagctgtgaaagcacacacacacacacacacacacacacacacacacacacacacacacaagtgtaaaagctataattactttccaatatggggtattctttctccatcaaaaggctgatttcattcaggcagttactattaccaagaggaytcaactcctcaggagttctcttaaggtttyatgttacgagtttttggacacagatgttagcagcgggtaagagtcctccatatactatccggtaactatccaggtaamtatccctggtccatccaatttcartattaatcactatctgtctgacctatttcagaaatgaacctgtaatcaagttgggacataagggaagttgtgggtctatacctagactctaaacaaatgaaatatcagccctctgcccctaaactaacatgtawctatacgtgtattgtactgcttctatactatctgacttcctatattgctgatggggraaaatca

SEQ ID NO: 1042 - DNA, 600 bp, Bovine  MMBT12204
tctgttcctaatttgtgatgtgaccccaagaaaccttttgccctctttaagcctcaattgttttacttacaaaatactattgtgaaagcatgctgccctgtatcttggctctggcttccaacactctatcttttgtaatgtcctttaattaatttgttcatctattcaacaaatatatattgagcatcttccatgtttaaggcactggggcagccgctttgggactctaaaggaaattaagacattatctggaacttaaaaaayagaaacaagagctcttacatgtataaaaataactayacaataagccactatatgttaagtgttattgaatggtgcaaatgatataccaaacaaattctgaggatttgcttctggcaggctaggttagcagaaagagcactgaacaaagggtaaaacctcatctatagatccaggtctgccacctgtaaaatggatgcaataactgcagaactcacaacattgttgagatcataaaataaaatattataggagaaagcactttataaatgttaaggtttgtaattgcaaccaaagagaccagagaatgcttcaggcagacaacactcagaatgatct

SEQ ID NO: 1043 - DNA, 598 bp, Bovine  MMBT12531
  misc_feature (1)..(44): n is any nucleotide
nnnnnnnnnnnnnnnnnnnnnnnnnnnnnnnnnnnnnnnnnnnnccccgaacacatacaatttcagtcagctatacctcaacaaagctgaaaaaaaatttaaccccctccattattcttgcctggaaaaccccatggacagaggagccaggcaaggatcgaaaagtcattccatgtaagaaatacaggaaaacattagaaaaagtacaggtgaacaacagaatgaaaattagtacattcagtgtatgtctaaaccatgcaaatgctatttttatttatatgtaaaacagaatcattatcyaggctagaaaacaataaacaggtgatttttttggtctacataaccgtctggcagtacagtccatcctttagccctacccactacatgccacgtgcgcccccaaacagaaggggaaaaaaaaaacaggccctgcaaatttcyaacctgtcccaagsgggcagcactaccctcactgagaatccagcgagaggaaaggcgkggcagggacwgacgcttgccttcgtccgccttcaccaccaagccttggaggcaggagaacataaaaagcacgaggagacatcttcttacttctttatag

SEQ ID NO: 1044 - DNA, 547 bp, Bovine  MMBT12537
aagatggggaagcagttgggagacatgtggaaagaaagggatttgcaccaaatgtgaagtgtgtggaaacccattgctgattcatgcacatggtaccaggacagagaataaggatctcagcaggctttttaaagcacagactcaatttagtttctaggaggctgagcaaacaaaataaatgtattataaggagctgttaattacagaaaaggccaatgcttgccatgagttttaaagtagttccaatggtctgaagggtaaagaatgaaagaaaacaccctgtactgagagtcaataaaycctgccctggctttgccattaatttattgtgtgaatttggggaagacatttaacaaatctgggtctcagaatgatcccttcgagctcacatttccctgctgttataactatgaggaggataagcatcattgttggggaccatctagaaatcaaagagctaagctcaaaacaagcacagaagactatttgatctcaacagctgtttcctccccagttacatttagaactgctctataacagccatcat

SEQ ID NO: 1045 - DNA, 600 bp, Bovine  MMBT12569
ctgagatttcttatcaccatgatctatcaccaaaagttcaaatccacccaggatctgattacatagatccttccttgttttcactcactggaccacttttcaagttattttttaaaatttggtgtatggtatagtttgaggagtttttgctgcttttggtacagaagctggagaatattcttgtgtgaaataagaaagaacattttaccacatgcctgatgtccgatttcgtgggagacaatataggagatcatgatctttttttctgttagtttatcatttggttgcagcaacaataaygactcgtcaaatatcaagagtccccagttttccattgcacggttgtcaaaagtaggcaaagcaattatatctaagtggatttaaatggagggaaaatgaatcatctctttctaaagatttgagagttccagatacaacatctcaaaatgaaatcataaaattaccgaaataaaatgcaaatgaatatctatgacttaaggggcaggagaaaggcattaaagacatagagaagacagagtcagaaaacaaattgctttgactgtatgaaaattaaatagttttgattaaggacctatatcc

SEQ ID NO: 1046 - DNA, 600 bp, Bovine  MMBT11729
ctctcaagtcagattgaaccattgatacagaaaagtttgcaggagtatcttagcatccttgccaaygcagagggaagggggaaagagaagattacagagctttctaccagtgctcaggaagtaattaaaagctgggctgttgcagtgaaggaaataatttctgattaccaccagcagttcacatataaactacaggagttttcagaccagctctctgattactgtgaaaaattcatctctgagtctaaaagattgattgacctgtccattcaaaactaccacatgtttctgaactatatyatggagttgctgaaagagctacaatcagccacaatcaatgacatgagcccctacataaaggttgctccaggagagtttactatcaccttctgagtttttatagcaattcttcaattagactttcacatagtagggaaaaaactcaaactgtatgtattaatataacttttgaccaagccagccctataacagttataggcagctggctccaagcagaagcacgtatgaactggaccagcactgaagctggcatcagttctctgaaggtctctgaactctggggaatgacattttttgcaa

SEQ ID NO: 1047 - DNA, 562 bp, Bovine  MMBT11737
catttttatgagagcgtattatactgacagtatgtttttaaaaaacaatgatatcattagaggtttttaagtgaataggctgtccttaaaatgaactcatccaggatactttaccttaataatccttctgttgcttttgatagttcttttctatctactatacaaacatttgtctcattttgctatatccagtgacattgtaaattttaatctycagtcatacattatacacaattatctaaatgaaaactaaagatgcttctatagctcatatataaaatacagcatgtagtccctatyataaaattcagaacctctttctctgggagggtggggttatttttggtttgtgactatgtaccaggtggttgaaggtgcacaaaatctgggacatacttccacctaccaattcataggaaatgcagaggaacatgttaaactgtgccacgggaatataatcaacagaatctagtctgtggtaattttataagacaaatagatctgcttcttccatcataaactgcaaatggggggggggggagatggagaaaactgacaagtt

SEQ ID NO: 1048 - DNA, 600 bp, Bovine  MMBT12626
tacaggagagtggagagaggacatcatttggttaggatgtgtccaattttgacttttttaaaaaagaaggaggtatagaaaaaaaagatagaaagagggatggagaaagaaagagctgacagtaacaacccttgggtttcagcatctcagtttccttccgtattcactcattgggaatttcctctgtactttttctcagttgctattaatttttgcatgtcttttactatctcagttttgaataaatactgtctttttgcagaagacaaagtggtaaagaaatcgaggtcacactctttycccaacagattatgggttgtttaaaatgcarttactcttgctattgtggttagatggaaacacttagtarggartggaccccaactgtctcytaaagtgrtaaagggccttcacaacgctattcttgggataggcacaaccaaatttcagttctgtcatttttttggcaagcttttaacaggttattgaaattcttaaagaatatcatcacctctttttaaaaataacatttcaatctttaaatatgttcataatcagtagtactcgtttcttgaatacctaaatgtgtgactagaccca

SEQ ID NO: 1049 - DNA, 600 bp, Bovine  MMBT12078
ccaaacagcaggccattaaggatagtctcaatccagtttttcacttcattcccaagggtcctcttccctcggtaccaccagagtggcatgaggggccaggcctccgggacttttgtcaggacccgcctcctgcctcctgagtcaagggcgagttgaatgctagcagcatagaaaccttggaaagcactcttgggtaattgtgaccgtttattaaggtacaatattaatgcattgtttcacgaaatcctgagagcaatcttataaaagaaaaactactgtctttcttttagagatgaagaygaggggttttcagtgggcaagttacttgcccagagacatcaagctagtgaatggtgaagccgaattcaaatccagatccagctgatttcaaaccccaaactcaactgctttattacactgctttcggccagggactccacttcatgctgcctcaagaaaagcatggcttttgccttctttacatgagttgctggaggcacgtgggacattttggcatgctgaagggcagctttgacactgaaatcccacctcagcaaatggcagggcatttgcacattcaaagaaacattccagtccctg

SEQ ID NO: 1050 - DNA, 600 bp, Bovine  MMBT11743
cccgagttgggaagatcccctggagaagggaaaggctacatttctgagttgggaagattccctggagaaggaaaaggctacccgctctactattctggcctggagaattccaaatacagtccawgggctcgcaaagagccagacacttctaagcgactttccctttctagtacaaagtacaaaattcttttagctccactttctatttgtaaagcctccaggcctttttttctctcctaagcctctgtttgcccaraagcaatccaaagcctcattttctaggtctaatcaataccaatycactttatagaacccttcctatttcagtctcattgtcccatttttgaattctcataacactcatttcataaattactaatatttaactgttacccttcatttccctatgccttttyactaaaaatsattagtttctagagaaaagttggcaatttctttgcaatttccttctcatctaacacayaagtatgcaacaaacttctagaaaaagattacaccaagacacttcgcatctggcaaatatgtaccctggatacactgcatacattttgggtcatctttgttggaacacagcagcta

SEQ ID NO: 1051 - DNA, 598 bp, Bovine  MMBT12713
  misc_feature (1)..(91): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgaagttctgagaaacaaagactaatgagtactgatgaggaggaaatgatcaacaaaatgcaattctgctgatagatcacatgaaatgaagacataatattgacctttggatttagcaacattaagggcattrgtgacattttcttaatkttatggagagatgaatgtgaactaagyagagaatgrgagaagaattgaagacaayataaatagcaattcttgagggattttactstaaaggagaatagtgaaatgaggctgtatctcctagggggacatttatctttctatctgttaaaatatttagcttgtgtgtgtgtgtatgaaaatacagctattaatataataaataaagggcaatcagccagagaagagactttataagagtcaaaaatgggaatgccaaagacttctcttctaatgtgagacattttaatatggttttggaataactaggttacagtctaaacaagcctgtgtaatggagagtattagataaggct

SEQ ID NO: 1052 - DNA, 600 bp, Bovine  MMBT11800
attaaagatatagagatacacacataaatacacattacatatatatgcataaacatatatagagaatatacatatatacatataatatgtttcagtaatatatacatacaaagtccctaaccctaactattcccctacttcaataaatgtttctttacttggtgtagaaaggctacaggtactaagtataaatgaaaggtactaagtataaataataatacaaactttattatccatgaaacagacatggaatcaaagaccatgtgtacaaaagctctgaagtggcccttttaaaaatgytaaacaagtaacaaragtgraatggacacactgctaaagatgtattactcgatccaaaactgcattatctagacaagtagacacttgtttctcagtaattatgcttaaaatcacttttttaatgtaagaatgctccataaggaagacattttctcatccttaggtcttaacctgagcgtttgcagtttcacacaacttcttttctttacaaagaacacatctatccttgttaaaaaatccacacagaagtcataaacgcatgtaagagtcattaaatggtttcctcactatttagttttt

SEQ ID NO: 1053 - DNA, 600 bp, Bovine  MMBT12733
tcaacagcaataagagcatccaaaccaacaatgaattctgcagctaaagtctcaatgaagaaggggagagattccccttttcataggaacgttcatgggaaactcacaatgtgcaattgtgaagaagagcaacaggaaacagtttggttttttcatgggaggggttggggtgcagatctttgtttaaaaattaaaaacttacccttttagtcaggaggatatccctgatctttaaccagaaaagctttaaaactgtaaggaaaaaaataaaattcatttgagggcaaaatattctggtaytgtaaagatttacattgatccagtgggttttatctgtaggtctagatctataaaggcacaagcctcacttcayaggaatgtggttcttcatcatttgcacaaagaaaggatggattgcatctaattgagttattttatttatttgtattttatttattttcacataggcagaaaaagaatgcacacacatatgcagaaacaaatagcataaattttcacttttcatatatatatccgtgtgtaaacacagaagcaccctcacatacatccagttttgtagcacacgtggaagacacagta

SEQ ID NO: 1054 - DNA, 600 bp, Bovine  MMBT11625
gacattctggaccggtaagtcgccttgcaagtgtaaggtattccgtccttacacttgcacttaaacttgtgatccttcaaatgatgacgaaaggctgggcttcaggtcaggcaatgtaggttcaaatctgggcttgacttctgaagcctcagtttccttgcctacaaattaggcataacagctaccttgtatattgtaaggattaattgtgatggcacasacagcaatgctagaaagcaataattttaattattgtaggccaagataatctgaagggattcaattatttctttccctgcygtaacccatgaagtacaaccttctaactctgattaatgcgccaccatcagttttatgagagtgggtttagatctgataacaaagtgggctgtcttcattccatttatttctgtgaagtcttgagtttaaatggttgaggagggggtgttgggaggggaaaggccatgttcttgttttaaaaaacgttaattttcagttgccaggctgccagaagtgagccagagccttctattgtactggtcaccgccagcaccagaggtagggatggcacacggaatagaaaatagaaaagctcagttc

SEQ ID NO: 1055 - DNA, 600 bp, Bovine  MMBT12759
gattcagaggtatacatttagcctagtcaacatagctcatagagcaaaaggaamcaaagaaggccaaccccaattaaagactcaattttactattgctattcattatcctaacagctatatttatgtaattactaaatgcaatattcttgcccatctgccttttcaaagaattctctggcacagcacagatgatacgaaacttttactgacctctccacaggygtaacacatagcagctaaactgaacaatttcaacaaagctcccattctgacatgctacacagaagcaatacaacacygtaactagtgccagcagtgataggaaatatcctaacacaacaatcaacattttcactgtggcacaacagggcttgttcttggccccttttctaatttgttttttattcatttatagaccaccatgatttttttaacaaccaaattgtatggttttattttctcaattgcgagtyaacctgaacagactattggccctaattatggacagaattaagaactggaaatcaactgttttgtaatgaaggaaattattactgctaaatatacccaactttttaataatatatggtaattagccc

SEQ ID NO: 1056 - DNA, 600 bp, Bovine  MMBT11977
atactctggctgcagagtcccatgatgtcacaggccaggaggaatcacttacaaactcctgggaaccagagttgttatattgatcagctttttgttttaatattagcaaagagttgtttcaaaagcaaaaattaatatgagggagcaaaaataataccattgcagaatatttccctcagcctatctctatggattttataaatgatttttcctccaagtcataacaactgagggtctgctcactcttcttccaagactataccttgatcctttattcagtcagtaaataaatattcattygatataaatgtattaagcatcgatcaaatgccagtcattgggcctatctgtgggaataagacatgaccctgaccacagggaagtgaacaatctgtttgaggaaactcaaatgccaagaaatgataataagtttagaataaagggtaaacaaaaaggttggcttcaggaaaagtggtaatgaccaattctggttggagacttaagtaaagcttcacagaggaggtaacatttaggtaaggtcaagcatgattatatcaagatagtgggagagagcattcccagcatcaggaacagcgtgta

SEQ ID NO: 1057 - DNA, 600 bp, Bovine  MMBT11971
acaaatagaaaaccctgaacagcagaggttgtatattctaaattagcagtgggtcacaagattcttttctcttttctagatgaaattatgctgtttggacgcttgtctggggtcatctattgcatgtctcaatttagtgctaattgctagaccatcatttttgtgtctattgtaaatttcctgaagattttggaaaccaattaatgctcaatcctgagtgttgtaaagtgttggtttttattttgtttctgtaggcagtcaggaaggactgagcaggkgattttaacagatggcattttygaaccgaaagaagtgagaagactgatttattagccacctgataacacagtcctttgttgctgtttagttgctaaatcatgtccgactctgmaaccccatggaaggtagctctctaggctcctctacccatgggatttcccaggcaaaaatagtggagtagattgccatttccttctccaagggatcttaccaacccagggatccaatccccatctcctgctttggcaggtgaattctttaccactgagccactagggaagccctggcacattcctaagttatacaaatgcctttgtatct

SEQ ID NO: 1058 - DNA, 596 bp, Bovine  MMBT11967
cttgctaatgagcaggaggggactgggcaccttggaggcccctgcaccatgtgtttacagactcagattccacctctgctctttggagaaggctggttcatgctgctttctgagaaactggagaagtaaagtcaatgctatgattattgtctttttttttttttttttaatacgcagagcagagccatgaaagcctgaactggtttagtcctcttacatttaatgttggtcaggtaatccagatcacttttttataactctgttgtatagacggggagggtcaaatatcacagtgaataytacagaccacatttacttcagatatgtccttggagattgttgtgattttctttggagaatgagcttataggttgagtgagctgtggatatgtggtctttctagtacagatcaccatgccccattattacctcactcaatggtaaattgaagtttcaggatttcgtttctcttccttatctgaaatttggctgtaaaaaatccctctttgaattgccttagcactttttcacaagccacatctcacatataactctctgtgtcttctcacagacccaaaaactaggtttgagtcact

SEQ ID NO: 1059 - DNA, 600 bp, Bovine  MMBT12809
tgcctgggaaatcccacagacagaggaacctaatgggctatagtctatggagtcgaaagagagtcggacatgacttagtgaccgaacaacaacaactgccctgaccccactctattattaaacattaagaattcatagatggtgtttccagaaatccctcaagtctgagaagaggtgaaaattatgttgcatgggattttttagagakttgaggattaaaataagattttgatgactttctggytaatcctgacgatacatgaaaatcaattttagtggcactattataactyttcttayattatacagtttgttgtatcctacaaacaacttaggcaaataaaatgagctaacattgtggagatatataaggcttatggagatggtgggtgttatttgaatctaaatakatattccctaaaaattgatgttcctagttacagccatacctttaaaacattcataacaccagttaccagatgcattcatatctgttgaccaagcactggaatattgactctgtcaactcaagataaagaagcagagataagarttatctgtctccaattattgtaactattgcatctttatttcctttcc

SEQ ID NO: 1060 - DNA, 575 bp, Bovine  MMBT11675
ttcccccacacctccccacaggaaaccaaaacctatggatgctcaagtacttttataaaatagcgcaacctttgaacataaccgacacagaccctcccacatatttcacctctaggttacttataataccttatacaatgtaaatgctaagtaaacaggtgctggcatgaagcaaactgaaactttgctttttggaactttacggaatttttctcctcccaatattttcaaaacrcagttcgctaaatctgcagatgcaaacccacagatttggagggctgactgtacaaattcagtgayaggcatctacagctggaacccttaataggaaattcagtctgcagaaaaaagcattggtgtacttaaagacaagaaggcacaaagaggtccaacctcccagaaaccaatcgtacctcccacttctccatttgctaattcatctgattcacttcctcctttattttgatcctcagattcagattcacaatctaaccgattcaactgtgtaatgcaattagtcaaagcctagaaaagaagcaataggatatttattagaaacagcctctcaatttcaa

SEQ ID NO: 1061 - DNA, 600 bp, Bovine  MMBT11957
ttttagaaatagtgcattcagttttcttatattttgaaattttgttggagctcagatctgtcacatataagccagtaccaaagaaactattctggcaggctgtcctagattcaacaaaaatttactcctctgagtcttgaattccttgacaataacaaggatgttaaccacaaatttggaaaaggaaacttattcatatttcactccatcatcaaatatgttccttggcttaaaaaaaaaataccagaaaatgaaaacatggtacttccttgtagtaggaagacaccttgtacctcacayggaaaggcttctgaaccttagtgctcagaaagtgaaagctattgtgctaaacaacaatgccaactctgaggatacagattttaagtaaaaggttagcaatatctcttttaaaaatgtcagagctcttttgagtcaagaacatttctcacagaatgacaataaaaatgccctgtgacttcctgtactttcattgagacttcactaccttgcttccacccttttgccaattgctagacaaagtgcttctaaataggaccctactaacacaaagcaaaagggtctgacctttgattatctgaa

SEQ ID NO: 1062 - DNA, 598 bp, Bovine  MMBT12870
  misc_feature (1)..(40): n is any nucleotide
nnnnnnnnnnnnnnnnnnnnnnnnnnnnnnnnnnnnnnnngagtaagagagtcccagctgtgaagatgcagtgactgcatccctaggtacacacagcactttcagggtcttacactggttctaaaatgatataaggatgataggagatgtgttatatgaatttggacctcaggtttctccatttctataaagaagaaatatcttttcctttttcattgccgttaagataatatgtttcctgcwttaaaattaggatttggatacgtaatgttttaagtattacagagcacttttacttcycctcttataatactgatgtgtcaggttctaggaaatattttataaaattagcattttaacaatcagaaactatcttttataatttatgaaatcctgttatgctctcctagcaaattttaattgtgatggcattagtaaagtaaagtggtttatttaggttcactagagcactaatctgattagggtatgttcaattctgagttaatttatacaaatatcttttattcagaatattgtaacttggtcataaaaatgtaactcaggggtaaatatgccaaaaatatgtcctagtcttttg

SEQ ID NO: 1063 - DNA, 600 bp, Bovine  MMBT12040
aactaatgcatttgtttgggttggttgcctgagagcttttaatgttttaagatagaagagattttcaaaactctttcaccagtgttatcttatctgagttgtcacatgttaaatattttaaaatcagcagatataaatgaaacaaaacaaaacacagcaaaatacttacaaatttagtactgcaaaagtttttcaacaggcattatatattcaggattctaagctctgtttcataaatcaagcttttagtaaaaaaaatacttataaatgcaaatgacagaatcatagaaaagcataaayaaacccaggaaaattacaaaattcagaatatgaggggagcatttgggaagatacatgggacttcagttcttctggtaatacgctatttctgaagctgggcgacgtggacatcggtatttgcatatacggcttttctcatgttttaaaaatatttcttaaaaattaaaagcttagtacttgccttttcccagctctgtagtggcacataaaaaaggattaccactctaaagcttaatgatcacatctgaggggtttcacgtgccagaatatttggcagtcgtcgtgtgcagggacttggag

SEQ ID NO: 1064 - DNA, 600 bp, Bovine  MMBT12356
tggtacccattaaataataactctctatgccctccttccctcagccacggcaaccactatgctactttctatctctatgaacttgactgctctaggattggcttaagatacgatttttttgaaagttaagattataactctcatacaaatataaaaagattatatgtcagaggttttacttacctcattaattaatgaggaaaccagtaagatgttacagttagatcacagaagaactcaacaaagcacacagataggcaactaagaatgctggaatgaatttagaaaaagatagaaaayggtgcaaccacaggaaggcaatcaactgtatttcactggacacaattcatttccattcctaaaattgtttacattattcctcattttctacaacttccataatatgtgaaacagtccaaaaacaatggaaggaaaagaatgctgttgctgtttactcgccaagtcgtgtccaaggcttttgcaaccgygtgsactgtatgtggcctgccaggctcctctgtccatgggatttcccaggcaggaatactggaatgggttgccattcccttctccaggggatcttcccaacccagggattga

SEQ ID NO: 1065 - DNA, 600 bp, Bovine  MMBT12913
cttgcctggaaaactccatggacagaggagcctggcgggctacggtccatggggtcccaaaggaggtggacacgactgagtgactaaacaacagcaacataagatcagacagttcgagtctgctacttcagagatgaagaaaccgaagacaaaatgtgttaagtaacttgctcatgatacwtaggtagttgcacagtcttcatcacaactttgctatatggaacttcacctctttatttcttagcagcctgaaagactctacatacaattggatcagtaaggatttgggactttcrcacycagtcactcactcactggttcaacatgcacagaacagctatcatgtgtcaggcacagtgctgcgtactgggtaggaagacccgagctgaactccttgtctgtcacaaagtatgtgtgtgactttggacaaaaatgtctttagatcccagcttcataaaaacttcttaacacgaagacagtaacatcaacttctctcacaatggtgaaaaattaaatgaaatcactcaggaaatgctgaatgatgtctccaatttacaggcaaccgacctattacctaacgtgcaaaccatataaacaaat

SEQ ID NO: 1066 - DNA, 435 bp, Bovine  MMBT12919
gccatgaccttgggccagtcacctcacctcataggcttgcagcaactcaaaagcacaggagttgaaatccagagcctggtatgacttatgactgtgggcagaactctttycagcagcagactcttctgtcagaaggatgacgtcagaccagaagttttctaaatgaaactccagcattagcattcttcatttcgagaattagttaacaccagagttattttccaggtggaagtttttttaaatttaattgttttgaatgacacctgtcccttcattcaccactccacttcatggtacttyttytgggatcattgaactgactatcccagcacagagaaagtaaaagtattagtctctctgtcgtgtccgactctttgcgactgcatggattggtagcccgccaggctcctctatccatgggattctccaggcaag

SEQ ID NO: 1067 - DNA, 600 bp, Bovine  MMBT11864
ctagattttgtaattctcaatttcttggtttgatagtaatttgtaaaagttatctgcctttatttagtctttccaggatcttcccaacccaggaatcgaaccaaggtctcctacattgcagatggattcttcaccatatgagccacmagggaggcctaaagtatctgacttagttgttcttaaaatatctcagtatcttccttttctacattcctgtttggatcatttatgtaaagattaaattaggtaattaaattaagtacagtttggaaatgttccccagctgactttgrtaaagayttagcttttggtaggaacagagatgagctgcaggagaagttggctcctggtcatggagtgagggggtccttctgtggagctaaagctggaatgcagatttagattttccaggggtctttaaattaggtcagctatagggtcctgctgtattacatgttactagttggagttgcctaattgaaatttttaaaatttcaaggctgtgattatgaatgctacagttcaccagttatgtagtttaaatattacattaaaaaaagaaaatccttgcttctagtgttattgtctgaccttgataag

SEQ ID NO: 1068 - DNA, 600 bp, Bovine  MMBT12945
tgaagcaaatttctattagacggagattattttccaggtatcaattcagctaaactattagttccttaatggttctttttaaaaaactaaataattaaatttaaaggacttttttgaatgttccctcaaaatgtatccttattcatggtgacctttgtacatctgccaaattactagcataaaacacattggtctttcattgcattgaytcattttccttccttaaagatttaggggaactcagtgtataaatattttaaaattatttcctagaagtttccttggccttctagtgataayagattgcccttctgggtcaatctcattccacccataggtcctagataacattaaaaaaatacaatactctcagattgttaaaaaaaacaaagtcaccatcctatgtccaacacagcataagcactttctccttaaaccacacccattactggtagaataccatagtttgacaaagaaacaaataaatttaaatgcaccttatctccatcccttgtttaatttcattatcaatgcaaaaagtctcaaagcatatgttcagaaaagcaagccattaaacaaagagattcacacttttttttt

SEQ ID NO: 1069 - DNA, 600 bp, Bovine  MMBT12958
tggaacatatctgtactatgctatgacaggaaaatatctgtcttacacagacacagtaacagagcatgtcaaaataattataaaaatatggaagcttcttagaccatggctaaatgaagttttaactcatattatcctcctaacaccattttattgttaactgaacagccctgttgaacacactggcaataaagcacagactaacaattcatagaaaaatgaactcatgagcataattttgttttcaaaagggagagagaattcataaaagctaattatttacaatggtgtaagattttyaaacmatagagaaaagagaatgtgttttgaactgttttcagttgtgcatgcttacagaaataatggtatgcttaaacattacaaaaataatttgcttttcaaattatttttatcattaatgaatttaaatgccaaactcttggtaggaaaagttagactgtcattaaatggctgattttgtttgtacaaaaccttaagaaaaaaaggagttggcacttatcatttaagtccataggaaacctgactcaggaatgaatgggaaattttatacctgagatattacttagattcaaattaaac

SEQ ID NO: 1070 - DNA, 600 bp, Bovine  MMBT12959
ttgcacaagggtttgcttgagtctaaagtcatcctgaatcatggaaagggtggttaccacaagacttcataaaaatcttgccttagccctcttagcctaagatcatctgggacatagctgtagtccaacgagatcattgactcactgcagtgagggtgaccacacactagaggaaccattcatggtcttcctcccaatgaaaggaaaatagagttacagaattttggaggaggagggaattcaggtgaaatttaaatgaagtaacattttgataggttcaaagcagaacaggactgtgtytgaaatgggtcaacatgcctgcaaagtggaccatggtcctatttcctaggaaactgcaaaagttgagagcagtgtggaatgttgtatccagaagcctctttcagaaactctgcaccggggctgtaaatcaaggtgacttctgtttgaagaacaacttayatcttccaggcaagaaggaaaggcttcattataactagaatttcaagcagcaaagtttctgatagtttgattttagagaatgaggtttctccatgaggaagaagaatatccttgacaaaaatatagcctcctgtctgttac

SEQ ID NO: 1071 - DNA, 600 bp, Bovine  MMBT12961
ctttttttagtatcaatacatcagaaaagtttaatcttaaaatctaaagaaattaatggacctacttctgacatttcatacagaattmtttttaaattattccctaaagctgaacattacagtctaatatatgaatgtacacccatttgttcaagcaatactatgccttttagtatcttctttgcttcataaataatattagctagtcacccaatgcattagtaaaattaaatagtgaataatagcttatgatttattattgtctttaaaactctccaagaacttaattacagtagttayattagctacagtagtattcattacattagttcttatataattttaatcttgaattgactgcttttcataatctttaatgagatttattccataatttatctcagttttataatatcctgtaagttcatatttaggtaatcgtttatgtaaactgaaaaagagaggcagaatttctgacagaagtgaaatctaatttgactgactgtgctgtctttgaagatatatatgtaagttcacttgctcagtcatgtttaactctgtgaccctagtccaccagactcctctgtccatgggattctc

SEQ ID NO: 1072 - DNA, 600 bp, Bovine  MMBT11782
tccattcaactcctttggaataattttcttgaaggggatttcatgcaattgtgttttattaaatttcagggagtattcccatctgaaagaattaaaactaaaagtgaatccaggtaagtagaaagtatattaaaaatatcaccagtcaatcctaggtgaggtaaatcctgcttcagttttgtttgttatcgacagagaaaggaatatagtggcagtagagatggtggcattttatttgctttttgggtttttttwaaattaaattaytttaattcacctaatacttttattaaattatcyttcttagaaggtaaacaaacctggctcttaaaaaagaactggtccagggagcacggcttctatgyatgaaagctatttaatgatatattaattccactggaaatgttagcctatttatcaaagagaactgaaggacaaaaaaaaaaaaaaaaaaamcccgaataggaaggaaatcacatcaggaatgcgatggggtggaggcagtttgcaaagggatgtctcagaaagaaaagccacagtcactggtgaggcctcctttagaaaatgcagcagccaacccaagcccttgatcttccgcca

SEQ ID NO: 1073 - DNA, 600 bp, Bovine  MMBT12986
gattattcatttttgaaaattgttcaggggtatgttcattgttaggaccttggactttggagtcagtgcctagctatgcattccaggtctgccattttctggctgtgaaattttggacaagttacttaaccactttaaaccccagctttaagaagtaaattaaccccagtaaattaagaagtaatagcagccacttcgtagagttgttatgaggctcagatgcagtgcaaatgtgtataaagtattcagggagtcacctggtatactataatagacactagaatagttgccaatattatyagcatacaatctgaggattctgtcagccaatcattagcaatctgttgtttgttgggacatgccagtgttctccagttgaaatcartagcaatctaaaaatggatagattattcctcatttaaatagtgtgttcatataagtgattgcttggatccttatcagaagttgctgttactgaaaaatgataaggctgactaaattgtgatagttgtcagttactaaccaactcccagaaatgaataagaggaacctatctctagttcctagtagaaggtatggacaaaatagtaggtgaaaaat

SEQ ID NO: 1074 - DNA, 600 bp, Bovine  MMBT12995
ttgatactctaacataccagcattgaatgtgaggctccttgtgttccaatgcctttccaattctgtaaccccctcactcctcctatagaagaatattgctccttcctaagtgaactatatgctcccaagcctctggatctttgcacatgctgtttgttctaatcagaatatgcttcatcatcttgtcaacaaatgttctttacacgctgagctttcagataaaattagaaactgcatgttctgttattgaaatgctctacatgggtgggatgttgcaaataaataattatcttgttgttytgcaccctgaaaatttcaatgtgtggaaagaagaagcacatacaagattggtggggttaaattaaaatcctataaagttctgcatttgaattagaagcatcactattgtcatgcaagtgtatgctcctcaggttttgtctcatcacaacaaagatttggagtgacagaaattaaagccccctcggcgtgtcacagctctcgggtcttggacagaccgtgttatagctgtcaggtctcaagcggaccgtgttatagctcttagacaaatcagtgttacagctcagtgttacagctctattt

SEQ ID NO: 1075 - DNA, 600 bp, Bovine  MMBT11817
ctcactagagtggatgatatttcaagaaattatggagcattcacacttctggttattttatctctaaactttaagtttttagttttagaagtcacttaataaacattgagtggcatgcatcattatgcaaaagatttccaagcccctctcgattctttcactttccttaggtagaatcttttattgaggctgttctgtacttatgctttacataacattaagccaaagaacttggtgtcttgatcatgaaaggccatagacagattgcaagccttttctgaaagggatgaaaataaatgyattttcattcatttgtgctgcctgctgtggacaagaacatcctgcagataaaagaaacaatatttttgagctgcagacttagcctcaaatgtaaaagcattactggagtgcaatgttttaaagcaaaaagaaaaaggaaggaaaaataagcttttataaaacttcagcataattttttttcttttctaagaatatttttttcactttgtgttaacagagttactggaaatggacaggattgtaactagaatattaggagaataagattaatgtgaaaaatgcaacagaaataaaatagaa

SEQ ID NO: 1076 - DNA, 600 bp, Bovine  MMBT13028
gacaaaccttgtaaagttatgagaatatccctagtctgtgatgttgagggcagtgtgtccattcttcttgtctgaatagagcacttataacacctgtgtttgcatattccaaaccaaacatcaaccctgaaaatcctccgaacaattttaaaaagatgttttcgtacaaccataacacattttaaaaaataaataaatcacagggtttaaaaaaaaaaaaaagattccaataaaggacgaagaaatgaggtgagctccatctgggacatgaaccattccttggccaaatctgatttccaygataagggtctacaaaattgcttgtcatttttctcattttcagcatatcttgagggtatcaaagtggtgacctcccttcctgtgtttctgttgtaaaagggatttgttaatctgtctggttatcactggtatcattctattttgtatagacgtggttgcctatttcacatgcaggctgctccatgcagtgcaagtgggcatttggtgatgatatcacagcctcagagaactgccgccctcactggtgtatctcaccaggtctgcttttgcagtcggagcaaatgcatatgttatccccag

SEQ ID NO: 1077 - DNA, 600 bp, Bovine  MMBT11794
atgctacatgtgcatcatgatgcttcacattaacataatttaaaaataattacctacaagtctggacccattccctctttgtttttcatgttcaaggtcttttatgctcatgaagaatatatatgctttttctatgcacatagctagaaagtaaattgcagctctggtttggaaatggttaaagatkatgaatgggtaagttaatttgtgtgacatgccttgcccactttccctacctcatctaatctggattgagattttggaggcatgggtcytctctctgactctgttactatttaygcattgtaagtaagccactcacatttcctcaaccctggttttctcatctgtaaatgtccagaggagaagrgatcatctttatacttctgagattctaaggctctcatttggagagccaggtgaatattttgatggcatacgagagataatgtcaatacataygccctggaacagctctaacctgttgataacatagtgaaatcttttgtatcactcattaaaatgaccctgctggagcttccaagtaacctcatgctccaaacccactcctttcaatgtccctggcccttcctcctggat

SEQ ID NO: 1078 - DNA, 600 bp, Bovine  MMBT13049
gcaaagagtcagacacaactgagcgactgaactgaactgtcacatctgttcacgctttattaaccatgtcatgtgttcaagyccaacacgaatattctattcttcccatgccaggagaagggagagagaatatttgctagacaagaatagagtctaccacagaggatgagatatgttttagagaatatttcctcttccaaaggagcccagtggaaataatctttcctaatatcagaagatcccagtgagtagctaaatgtccttcatgtaaattactctayaagcacaacagtaagttayacgtacctattggaaaaacataaagggcaagcacataacagtacataaatttcactttgtatagagggctgaataacatacagttcaacagagaattggaaatcagtttgaattaccaagaaaaaaaaaaaaaaaggcaacgagacagaatgaaacagatgaatttcacatagatctgggaaaatctgattaggtaacccataattcttcctctacctgtgttgccttaatggaaaaaagataattccagggaattggactgggtttatttgaggggccagtattggagtgcacaggaga

SEQ ID NO: 1079 - DNA, 600 bp, Bovine  MMBT12216
gcgggagctggggctgcctttgccgcagcgcacgggcttcttgtcctgcggtttctcatctctcggtgcgsagcacaggctctagggtgtgtgggctttcgtagttgctgcaggtgggctcagtagttgtggccacgggcttagttgctctgaggcatgtggaatcttgtcagaccaggggtcaaacctgtgtcccctgcattggcaggtggattcttatccattgtaccaccagggaagtccctatattcatatacaatttgattcacgtcaaaatatgagttgttctctacaagataygattacgtgttcttgagacttcatatagaaaaagatggtatccctgagccatgtctaamttgtctcttttctttcttaattgttatagttccactttacaactatgatacattcagcattaaaattcatttttttcttaataaacctgccccattttataaagaaatatgactatctgattagtgactttcactgagactattacagaaatattttattaatagaagtaaagaaacttattattacctggcctaatttttaaccattttgtaacatttgcattctcctttttctgcctct

SEQ ID NO: 1080 - DNA, 598 bp, Bovine  MMBT13813
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnntttttttgatatgaccattaaaatatgacttggaagattaagtaacttgccccaaatcacactgactccaaaatccatgttcttaaccatggatgttttctgatataaaatcttagtctgataggaaggattaaaatgaaaacaaatttattcacaatcagggaaactgtataggatgctacagatgagggcacattagctggtcaagaaacacttgagtgtctayacaatagtacctggtactaaggcattctttggaaaacattatgccaaaaggaaaaaaaggacacataataatatatagacttagaactcagagccacaggaaaaaaaacaaactgatctataaaattaagaaaataatggcagcattaatagcatacaaaggctaggtctacagaatggcataaatgtaagcatagagtggattaattcctgaatttggaatgaaggcaaaaagagggattaaacacggagtccactgaaaacagagcagcaatccgatattctggactgttgtcaaa

SEQ ID NO: 1081 - DNA, 600 bp, Bovine  MMBT13104
cctgcctggaagccagagggcaaggagacttgttggtgtagcccatacggatcaactacctagggggaagaggatggaaaaaaaatctgggagggcccccaaactaaacccccaaatgaagcaagtatgatacaatttcaaaccagcaggaagacaaactggaaatagtgtttccgctgttgccacgtggccctgccatttcagctggtaaatagcactcttgcccccgagccccccaaacggtaatacctacctatctgtggttgcgatcgcttttgaattgtgtggattttgaactaygagatgcttttaggaaacatgctttccatcaacttccctaattcgtcttcttcaaaataccactttgctttggagtctcttgtagattttaagctgcaaattatcaggctacagaaagaattctggcttacctycctttatgcagtttctgtgctcatgaaataccaaaaaattaagatttttctaaatgcaattctatttttattttgaggcatgggacacatycagttctgtgcagacttttttcttactgtagaatcaactgatgctccaagaagttaattttgaacagaatgaaca

SEQ ID NO: 1082 - DNA, 600 bp, Bovine  MMBT13739
aaatgttttacaaagttaaaaagtattctttttttgctcacttataactcaaaaatcactaaagtcattctgctgaaacacgccaagaaacccagcttcttgccatatgcctgcataatcttatcaaatctctgctattcacatgcacattcttacacacacacacatacaaacaagggatgccaaagactaaaaatatatgttttacagaagcttgaattgagaccatgacctcatttgaacacagaatgtggcctatttctagggctattttaagccagcattaacaaaattacatayrtgttttttacttggaacttcctggtacccgctgtcatttcatcccagtgattgaaataatctcatagatgcataacttatttctaaattttatttactgtgtacaacttgcttaatcagttaataatgttataaaataaaagcatgcaggaagcaccagataagcattagctataatataataatatatttagtatttaatagtaataactataattaaaacacatgtataaataattagatacgggctttaaattagtgtctaaagctcttaaactctattaataaattgcttattaa

SEQ ID NO: 1083 - DNA, 600 bp, Bovine  MMBT14054
ttttttttggtgttagttctagaaggtcttatgggtcttcatagagccattcaacttccgcttcttcagcattagtgattggggcatgagctagcacatacactggtgctttgatctccagtgggaaccatttttgtacagtgcaacagccctggtctgacaaaggtacaaccaggagtttagtcatctcagggtgaagatctggttaccctaccaatcaaacaacctagactagcttagcagaagttctggttcaagataagagtaatctagarcaggtggtatttagataaacatgaygaatatyatcattaarcaggtttrcatgraatgctgccagtgtctaatccataattctttgcctttatcactttggtgtatggtagtagttacctgtattccytttcttaaagtttctttctttctttttttaatttaaattaccaaagcttggtttgctgtctctagtgtaactcataagtgctagggaattactgtcccttggaagaagtcttcaaccaatgactgatcctagtcagagtataaacaacacaactgtctcaaacagtaagtgggaaagtcactttatacaattctttt

SEQ ID NO: 1084 - DNA, 600 bp, Bovine  MMBT13220
cctggaaggccaccagcgtgtaatgggatcaggtatcattaataattataggaaaatgaaaggagacagtagctaaaggaggaatttgagctgaggcaggcagcctgaagcagctggaaagccaagttattatatgtgcaaaatcgaaccttccggtcagtcttcaggagactcacttattgccaagaagggtttaattcaattagcaaagagctgtggggaaaaggcttgtgcaaccttgaactggctggatatctttagctctaaaggaaggttattttgggaggatcatcataattygcttgcttcagcacctgaacccatccaggatgtgctccctgaaactcaaagaaatgctctcacatccagtatttcagcatttatttatttttttwaattttattttatttttaaactttacaatattttattggttttgccaaatatcgaaatgaatctgccacaggtataccctgtgttccccatcctgaaccctcctccctcctccctccccataccatccctctgggtcgtcccagtgcaccagccccaagaatccagtattgtgcatcaaacctggactggagactcgttccgtat

SEQ ID NO: 1085 - DNA, 600 bp, Bovine  MMBT13729
aaataactgagagttattttgcaaaactgctcaaactaaaatcactctaatccgtgaaagacataataagtggttcactttaagcgcatgtggtttctctgcttgaattaccctagtaattgtagctatgcagaatcaagctaaacgcactgcacatgtatagtactgcatgatttcagtaaaacgtagaatctctagaatcacactcgcaccactttaagactctaactgagaacaggacagaagcagcactcggagtccataaaaataatgggcccaaagcaatcccatgaatggttyccagagtgttacacagaattataatgaaatcatattggataaatgaaatggcataaagaatttaaaagggtgtgaagcatgaaactcaaacgtctagccacttaactataacacagcttttatgtgaacaaatatcgataattccaaattcatctaaatgaattctggcacacccgcacaggcttaaaaattcaacaccacagcaaaagtgggggaaaacccaaatgaggaggtgaggaagagaaggagagaaaccagtacacgggctatgagagggagagtccgcgagagcatggatca

SEQ ID NO: 1086 - DNA, 600 bp, Bovine  MMBT13930
aattagtactccccaaatcttgaggcattatgcaaagcagtcattttgatcttacctaatgtcaccttataaatacatgaaactcttcatgaatttggaaaattttgcgatttgtccatgggaaatttgggagacttttgctttcttttcatttgctaaagtaaagtcatcaaagagaatattaaaagtggattttgtcaaaacttctttaaagtatgtcaaccttgcgtgcagaatcttgtgttgtcaataagatgcgtggctagactttgtagtcctgaagataaaggactattcaaytaatcaatacaccttgcacatgaaggagtctggagacacttaagtttacgctgagaataatattcccattaaattgggattcatctttgcttcatttccatgccactttcttaaaatgcacctttcatgtgtgtggcagtaaaataaacgtattgatttacaaagaagatggaataaaaccagaatgcaaataaagacaccgagaaagcaagagcacaagaaataatgacgaggacaaacccatttgatttaaaaatgctgagtggacttttaagaacattgcaactagttaggcaaaaa

SEQ ID NO: 1087 - DNA, 600 bp, Bovine  MMBT13927
gaatactggagtgcaaaaatagtcccggtggtgaccaggatttctttttactgattgattgaggtatgtttgatgaacaatgytgtgttaatttctgctgtactgcaaaaatgcctcatgtatgtacatacataccttcttcttctttttttttaaatcttcttttccatcatggtttatcccaggatattgaatataattcccttgtgagatatagtccggatttctatgttaactctgccaagccaagcagattcaggagtagttctttgagcttttcttgtctttttctcattagaygcattaaagtgacttgcattttgtggactgtaaggagacttgagtggagggagggaagaatgacatttggtgctatttgcacagagaagcatcccccaggtattcgagcatattccacagataaaagaaggtgagtgcacttctgaatgctcttatctttcttagccttatccccagggctcaaatcaaacctgagatggcggagaaaatgcctctccacccggcggggacacatgctgtcaccagccccactctctgtctagcagagattgtcagccccctcctgggagctgttttcac

SEQ ID NO: 1088 - DNA, 600 bp, Bovine  MMBT13613
tagttgaaacaaatatgccactctggtggggcgtgctgaccacaggaaaggctacgtctgtagggaagcagggagtatatggggaatcgctgtaccgtcctctcaattttgctggaaagcaatcttaaacatttttggaaaccaccaagaaaagtaaattgttccaagtttattctcagagtgcttagaaaagagcctgaaaaattaagcctgaagtagaatgaatactcattgcttgtatttcaaatgtgaagacagaaaagcatggtatagcagaaagtccagctttcaaacaagaaytgttgtrtctgtgacagagctccaatctaattatgccctagccactgatttttctatcaccacttcccctttgtttcagagacagcatccacgaccttctgtccatgtggtggaggaagaaattgcttcccagaaaggcttagcccactgcattttactagataaagaaaaaacaaaaagccattcgactctgacaagccgattattgtctatggaggagtaaaatgcctcccttaggactgcaaggtacaatatgttcaaacctttaaccactgctctgccatgagctgctatacgtgc

SEQ ID NO: 1089 - DNA, 600 bp, Bovine  MMBT13618
aagttgttgcagtaaagtggcatgaatgagagcatgaagtgtaggtcttcacacctggaccacccaggatgatgcagacaaggagattccagggctggatcatgttttcccaaccacacctttccctctggtggttagaaccatttccattctaattcttatgccagaaacagccaacataacttgagctctccaaagagtaggctgtgattattggcagaaaggacttagcctctaccttattggtagaacaaaaactaaaacaatttaattaaaatattctcttttgtaatacaatgytgtcactctaagatttgccttcttttagattttaaaggagctgcaggagagttaattgttttcccttttgattatatttctctttccccttgtccaaggatataattcaattgcacatcagctgcccctctgacaaggaggaagaaaagtccacaaaggatgtctctgaaaaggaagacaaggacaaaaacaaagaaaaggtcccaaggaggatgctgtctagaggtaaagacttttcccccttgctcatctgtcctagggcctggttctgcagtgccctttccttccatcttcccacta

SEQ ID NO: 1090 - DNA, 600 bp, Bovine  MMBT13410
aaaagtattcctttgagttcagtgttcatttacttttcattgtgagcatctgctctatggttaatgtctaactatagcatttgctcctaataatagaattaggacagtagagtttttgaactgcagctgaccccagacggcatatgttccaaccaccttattctgcatccaaggacacgacaytaaatgcctttctcaggctgctggtggcagatctgggctggagtatggttccacccactcccttttggccttcatttctcgacaccagtgctattacttttcacttaatttcctccyaacttccccaactgatgaaataaaaataagagttatttatgtatattttaataaaatcctgttcgatttttcaacttacagctggttttgtctgtattattcaacctatgttttctgaacattgagcagaggagaaacccttgaaccagtgtccatagtagaaacatacaccagagcagttttaggagtcttgtgattttaacccttcagaagataaaacgtagaatttgggggcatgtatttatatccatcttcagtttcttaaaaaaaacaaacctaaagtcaaaacagtaagtaggt

SEQ ID NO: 1091 - DNA, 600 bp, Bovine  MMBT13369
catgaagctttctgctagtcaagatgaacagttaccactgtgaaggattttagtgcttttctccatatgaggagatactactgggctaataaaatcagctcctgaagtatctgaagacctgttctgccagtgccccccatacccctcacaccagcatagagcacctcatttctgtgcaccctcaacttttagtgggtgttgaaaatcagcagctccaacagcacatgacttagtccttgtagagacacatggcaagtgccaatttgtagttgacgttctatttaccataccctctgttayacaactctggatagcaaaaaggtccctttaatctaggtgatatacaggtatggttttccatttttgttccttaagccagtgcatgacctttggagtattcaaactgcagacatataagcaaagaaaacagaggtttgatcaaaacattcaactgtattcaattttttcttcagtttaaagactttctatatcaaattacttatctatgcatcctgtatgagatcattaaccgacagtgaactgtgcaaacctcttctagtcctttctagtatataaaaacttgtttgcaactttttaatg

SEQ ID NO: 1092 - DNA, 600 bp, Bovine  MMBT13643
aaagggacataataagtaaagtatatttgcattgcattgaaaaaaaaaagagttcattttttgtcttatagtaatttcagagtaattttttaaaaatacttaattagataactgttttaaaaaaycatgagtaatacaacatttacattaaaccggtagtttaaaaaaaagcaattttgctaaattctctgtatcaagtctaccaaatctatattgaatgcaagtgaaagaaaacacctccacaccagaagctacttcattagaatctaggaaaacagaaaacaaatctcttttggagaygtgcaagttccatgtaagaatcacatgggagaaatataaagagacgggagcatgccctatgctgctgtggcatgtttcttagcaacacagaaaaacatctctctgctaagaaactctgtcaagtaatatgtgttcagggatcataattcagaaagtgaattccaaatagaaccaggaatatttacattcatgataacactaaactgttaagctgttttcatatttatcatgtcaattttataaaacaattattaagataaactacttcagtcataaaaaatatgtccaaatgaaccacag

SEQ ID NO: 1093 - DNA, 600 bp, Bovine  MMBT13669
aaaggacatttgccagctgcttatcaaatgttccaccaaaacaaccactcaaacagaatgtattagaccaaaaaagacagctatttctgatggcagataccaaaatccttcttgctgacagaaacttgctgtccttagaaagcagcagatgacggatgcagactcgaccaatcctttccacatggagctggctcgcaccttaaaaattgagtgttattcactttaaatgcaaaaatgaacacagaaatgcaaaaaactagcyccagggaagaagttagtggtctcagcgacacacaactygattgttttctatttctggcaggcacaacataccagggtgttctgttgggctttttttttyccccagaagacttacttcctaatatttagaggaaaactaaacaagatctccccacttcctggacttgtgtggacagctgtgccaataacaagcgttattcctggcatcaggggccttgcaattcctggggactcagggtggagacagagaggggtgaggagcagaaggcaagatgggacccaaacagaccacaatgttacctgtctctgaccctcatctcctaaaagcaaggggcttgt

SEQ ID NO: 1094 - DNA, 600 bp, Bovine  MMBT13456
cttggactccctcttcccataataccacttagattagcattaaacatattttcatctctaactttcctttttctatgaagtcatgtgaaccaatttctcctttctgaatgctatgtaattccttcagatctgttaacatatcttattagtctatgctatctacctggaagccatcctgcttttcaatatatatttgctcaatactattcttatctattasatattgacttagagtttaattctcaagggcttattttcatgttcttaggggagaacctcagaaactctcgattcacagaytacagytggatgatgattttacattaacaatatggagatttactactactaactcaaagcgttgttcattgtattttacaaggcattcttagcaagacacaagaacagcagaaatttgcttgacattttattacctctgcccaacaaactcaatctccaaacatgagaagatagttgacctttactattagtcaccggcctttaaaggatttttattattttcttttatgatcacattcttcattccatgaacgccaatttgtgcaaaagaaggtataaggtgcagaacaaaaaggttcc

SEQ ID NO: 1095 - DNA, 600 bp, Bovine  MMBT12815
gagcgggaggccgtcggggctcaccacgggagtccctcccagatctgaaacaaaagcaaataaaagctgtgcagccaggtgaaacaatccagggaagtaaaaagcaagtggaaagtatcttctcaatgtcttatattctataatcaataaaaggcaaagaaataatgaaaaggataccagctgaggtcacagtacctgctactatccagaaacttctgggccttttatattgtccattactctgcactagcttataaaagtatataaataccgcattacctgcaataactctaagtctcyaggaaggaaagtgaktctttccctgtgcttactcctaccactacggacttaagtgttactttggaccagtgatagcaaagttattctgcaaagagccagagagtaaatattttaagctttgtgttgcyactattcaackctgccactgcataacaaaaaacatagacagtaaaccaagaaacgcatgtttctgagttccaagwaaccttcgtgtatggagagtgaactatgaatgtaatataatcttcacatgtcacaaatattattctgtgattttttttggcagtcatttaaaaacat

SEQ ID NO: 1096 - DNA, 600 bp, Bovine  MMBT13178
ataaaaattatcaagataatatatatgcagcaaaggatatctctagtctttcatccctgayttgtcattacattgcttgaactcagactcagttcccagaaggattagacaggtggtctatagaataatatatggcatkttttttccataattagtcctctgctctgagtccaagatgactggtctaagcttatttgagcttagcttatttgagcttcttcttttagctgagttttctgctaggagatttattgcattatgaacaaaatatgaaggcagcatcataataaaataaaaccyttgttggatattgagacataagcaacactactttgaaaacttccctaaagaacataacccacagaggataatcattcttgtgttcctcacatcagaacaccaggattatgtcttcctttttttcataaaaaatgacaatgtctgattgcagggcatcattcatgatacatgccctgaaaatgagatgggcccaattcataagcagtaacaatgccaagaagtggcagcacatttgctaatggaaacaggaactgagaatagggggaactgtcctagaaaataattgccaaattggaaaaa

SEQ ID NO: 1097 - DNA, 600 bp, Bovine  MMBT13172
ataaaatttggtatattaaatgcttatttactcacagttatgatgatgagaagcaggaggaggaggaatgttggtcttatggaaaccatagtaacaagttttatctgactgccttcaaatttagagccaacttggttcacaggtgatcagtcattctagggaaaaacaaatactgtatgatctctctcatatgtcaaaaacaaaacaccacaatttcatagataaccagaacagataggtggttgccagaaggggtgggggtagaagtttgagaagtggatgaaggggatcaaaaggttyaaaaaataaatgaaagtgttaaactttgtcgacctacatccaactccaattctaatcaattgaacagasagccttgctaagtctggacccgtgctcaccacttatatttgaaaaaccataaccaatcatgttgcaaaccacaaaaattctttataacctatggttaacatttcatcccttctttgtgtgtctggaaatgattgaccgggcttcagactattttctctgatgtactgcagcctgaaatccaattgttatcttggttcaattaaactcaaacttattggtttgtaggacaca

SEQ ID NO: 1098 - DNA, 598 bp, Bovine  MMBT12932
  misc_feature (1)..(69): n is any nucleotide
nnnnnnnnnnnnnnnnnnnnnnnnnnnnnnnnnnnnnnnnnnnnnnnnnnnnnnnnnnnnnnnnnnnnncatgacaaaggaatatagcataagaggagtagctctcccttcatcctccaaggaggtattccagcagtttgcagcagctccccaagccggaatgaattggtgagttcagaccagtaataggtccccagaattcactacagaaggtggcccaggctcatgaagatatcattcacagcagtggggccacaggaaaaatgatccttytcttaaatcactaatccttccattgayttcctgtgtaattaaaaggtttcctaacttagttttatgtacactgcatttgctctgcttagcaatcrtttgattcagtgagtttcttctatttaaaaaaatatttatcttaggattcataggcgttggagtgcagtttattttacagctgggaatattctttatgccttctacctctcatcaaggaatagtgggaaataggatgttagtggtcacttggcattggaggacattrcagaaattcctaaccratgcttatcattaattccatacctttgactaaarcatgctaattcaa

SEQ ID NO: 1099 - DNA, 600 bp, Bovine  MMBT13730
aagatgaaatatttaaatttgcccaacacatctaaagaatcaaattataagacaagggaaatatatggtcccaatattctttacaaaaggtaccagtggtcatcagggtagatggaatgggagaaagctggtacaaatcactgggccactggtttagaagagattccagggtgaaaaactgggtgaagaattttagctcgtgtacctttctttcatatctttccccttctgggctctactgaacccatctgtcttgctttgggttctaattaattatgtacaatctagagactttggatytataacaactggagagaaaagaaaattcaggacagggtttaagactttctcaacattacacacacacacacattaatatacacatgtattgattgaatgaatggactgaaagttcagaaaatattttaagatctttctgttctgtccccctttcagtcagtcatgatgataaaatagacttgcatttggatttctgttttcctggtacctcgctgaaggacaatataagacagcatagtgcttatgtaagcattatccttgctgacattccaaatgagcagatcaaatgccacctaatca

SEQ ID NO: 1100 - DNA, 600 bp, Bovine  MMBT14118
gactatttgaccaaatattctattttttaaagggctttattaagtgttttgtgtttgggaaaaaataagagacttatttaaaaatttgtatcataaataccattcacaacctcttgccctcaygttcccccaccccacaacccacaaccaccaaattgaggcaacaggtcaacagtcaagtcaaaattgtacccactcctacatgtaaactcatgcaaaaagtataagtgcagatgtacatgcagagtaacatcacctacccatggaaataacttgtctgaaagtcttcatcagtaggayatacaagcataaacttgttatctggcttcattcttgtatcttccatatttccaaacagcacaccttatagcttagctcaaatttagtattcatcataaacaaagacagyaatattttcacattttaattatacttaaaatkaaaataaattatcactgtcgtttttcatatctaatatattcaaacaatgacaagtcagtactatataaactttaataaagttaaggaaaggtgtgtttttccaattttgccttccaacaagaaatcacaattaagcatcttgtgtcccaaggtcatctc

SEQ ID NO: 1101 - DNA, 600 bp, Bovine  MMBT11961
tttgagccacatgctctttttctggatcccctctcccctacacggaatgcccaccacagactcccaactgtcartcatccctggacaagccctccagcccctatacctcatctataatacctagggatgggggctccaggagaggagagccttgaaaaggacacacacccaggaaacagcagagcgaagagtggaagcagaatgtctgcccaggygtgggcacttaaacacaaccttattttgccagggaagctctagatttttataaacatgtcttcttcgaggcaggtggaaattctyagggtaaggcagagtaarcggtcacatggataactagcaaaaaatgagctctctggagaccatgccattccaaggtcaaccttagcccagccacccacygctctaggaagcgttgaggttgcagccctttaagacagaaatcaacagtcctctcatttggggcactctgtcgtatctttaagtaaaagggccttggggtgtccttgtaatagtgataatggtattgaaaaaagccaaaggatttggcaatagctctttggaagtctctgaaatcattaccattattgatctagagacact

SEQ ID NO: 1102 - DNA, 600 bp, Bovine  MMBT11730
aagagggggaaaggatctggaccgatcctttctactggctttttctaaccactcaaattcatttatcactagcagtccttagatttgttccaaaatagaatttaattttaaatgtggtccagggaatacagtaaagggtcattctaaagtaaatgtataggtacccactaaggaaacaattatgacaaattaaggtgatttaaataataatgataacaaaaacaaatataygaactactaacctttatggaacacttatcacatcctaggcactatgctaacatattcaagttgaaccayatgaaaatgacaatttcataaggtagggcctaatatattttytcatctaatccttacaactaccccaagagaagagtagttttccataattgcagataaggaaactaaaatttagaggacttaactttatttcctaaagaactaggaaataaaatggggactgaagcctaggtgcacatccaaagcccagggtctcattacctactgcacaatgtcagtaacctccatgtcttgaaaacctaacagaatgagagtgtaggtgctcaagtactctcacacactgcttaaggccattataga

SEQ ID NO: 1103 - DNA, 601 bp, Bovine  MMBT14059
  misc_feature (1)..(1): n is any nucleotide
ngatcttcctcctccactttgagtgaatggtttttgcattaataattcaaagccagtggcttaaaattccagaccccaaatcaaaaacacccaaataatttccccttattaagagtccagaccaaaatggttttctcaggccattggagtaaagaatacgagaatggaagggatgtttaacacgaggaccataaattgcgcaacacctccccctagtgtcggtggggagcattacttcccttcttacgggtcacgtgcctccagtgatcttctgttaatagttcctacaaagttgagacaytctaatgatttctttgggaaattttggaaacgtggatcacttagatggccttttggatcatgaacttaatttggggggttccttttgcctgttacttggactgtggaatgatccaagtgcttaggytgcctctctgtaaggatcttttaattatttacrgtgagcaaagaaactgaaatgataaagaaaccaagtgattcagaagcatttttaagaaaacatcaacctgttctgtttgaaatcctacagaagataaaaagaatctagatgtttgaggagttggctgtagagtttgtgtgc

SEQ ID NO: 1104 - DNA, 461 bp, Bovine  MMBT13716
cacccatggtatgaaacttcagctgcactgcagtaagttactaaaggtaaaaattaccartggaatttagcagtggtggtagattccaactcctgaaaagttggcttattggatctgtaaggaaatgaaaaataataagaagcatgccaactatataatcccttggttattggtatctgtaatagccaaaatggaatgaagttctgggtcaggccttgttgctggacctaactctgattttggatggtctgaactttagtcactagtcttaaagcttccctcaaagagaaaaattatgcyagagcaayagaaattagctgtaatatctctcgttgccaagaaagtagtcaacacaggggtttcagaaactcctgaaaccaagaggtttaatgtgaaggagctgtctcattttgtagatcagtatcatcagccttctgaaaaacctttactaaaatggatag

SEQ ID NO: 1105 - DNA, 598 bp, Bovine  MMBT13714
  misc_feature (1)..(47): n is any nucleotide
nnnnnnnnnnnnnnnnnnnnnnnnnnnnnnnnnnnnnnnnnnnnnnngagccagagaaaaagagagtgaaccttatagaaatcagtatccagaaatagcatattagccatcttgagggaagggtgctagttacaattataaatatgcctaatgctttttgaagagaaatctgacattagaaaatattttaatcaggcattaagttactcaattcaatcaaatgtcaaaatgtgtgtgaaagagtttcttttcaaaattggaatataggattacgtaagagttgatgataatacaaatacygaaaatatcacagccaaagcrgttcttactagtaatttattgtgtaggtgtaagaggatgttattaagatttaccaaatatgtactgcagctgatatttataataaaaatgctttgcttgttgaaagagcccaattcggaagcaatggcactccttttcayatcttaagtgartaaaggaagaaaggagatayataaatatttkgggaggagtgttgattatataacttgtcaaaaaaygcatctcttagatgcttcatctactgacatcatgaaggtcaatcccaggccttggacat

SEQ ID NO: 1106 - DNA, 600 bp, Bovine  MMBT13020
tacttgctgggaaagctaagccttatttacccttcagtgcaaattattctaaatagaaattttgctgtggaaagccacatgctgggggcagtgagaatactttgttgtttgcttattgaagtataactgactcacaatgttatattagcttcattttgtcttttatttattgaagtataaatgactcacaatattatattagtttcaggtgtacaacagaatgacttgatatttttgtacaatacaaaatgatcaccacatggagaagcgtactttgaatggaggactctccaggcatayaggttacagctctaatgctaattagtgctcctgcactgcaatccacttttggcccrgattcctggcctgtgcaaagccattctccatggtgtaaagaatccgggcatctttgccaggcaaagctcatttcaaatcttggctctgtcacatcctggctctatgacttgggtgcattactcaaattaaagagagactattttttcacccataaaatgtgagagtggtttggtggtaggatgggaggcctcgtggataccagtcatgtacagcacactgtggggccctgaggtttgatcagct

SEQ ID NO: 1107 - DNA, 600 bp, Bovine  MMBT11978
cactgggttagggggcttatatgccctcccatgtaatattctccaatattccaatgaggtaggcacgattatcatgccaattttagagatgaggctctaaaagatcatttaggaactgaggatcacgaaaattaaataacacacttgcttgtggataccagctaggaaatgacaagggcaggattcaatcctaaatctcaccctcttcccatgatgcctcagaactttcaagatttgaacagcattaatggaagtgattagttgctgcagtccatggggtcgcaaagagtcaaacacgaytgggtgactgaacaacagtgggagggagaatgaaaaagaaaacatgattttagagagatgtgcctttataagatactaggagaagttgatcaactcctgggcccatcctgagtttgggtgactatgggatataagtgtgactgcctcctccactcaagctggagatccagttctacattttggggcagaggttgggattatcaatcagatgataacactgtctgaaagtagacagatgtgtatagactggaaaagaaggatttcacacaagagtaacaagatgaataaatgaatgaaaag

SEQ ID NO: 1108 - DNA, 600 bp, Bovine  MMBT12833
tgccctccttccagctgtgcagcaggagcaggagttctacgagcagaaaatcaaagagatggcagaggtaggaagatgtgtttgtatgtgtatctaggatctgatttgctggtggggctcagtgtaaagctgtctttgaagatttgccttttcttttaagtgattaatgaataagccatgaagtttttaaaaggaaaacaaagctaggttttgtagtaatactgactaaaattcatagtttcacaaatcagatttacgttattttaattggcacttagtaaacacatctgtttcaccttyttcgccctctactgggagaggaataaacagattccatttagctctttaattcttccaaaagkgaaagtcaaagtcagtcagtcatgtctgactctgcgaccccatggactatatagtccattgaattctccaggccagaaatgtactgtcaaatgtgcaagtcagctggaagatacaaatttggttttttaatacagacagacctcagagacattgtgggttcagttgcaggccagtaaagtgaatatcgtagtgaagctcatcataagaatgctttggcctcccagtgtgtaggagagt

SEQ ID NO: 1109 - DNA, 600 bp, Bovine  MMBT12614
atcaagagtcttttccaatgagtcaactcttcgcatgaggtggccaaagtactggagtttcagctttagcatcattccttccaaagacatcattagggaatggtaaatagattgaaaattttcatgctaattctaattggaagtggctgcctggattgtgtgttaaagaggattccaaggctcagttcaggctttatagaaaattggcagtaatggccatgggatagtgttattccacttgtcatatgtattactgtttccataagtcattttgtgacttgaaacgaatgtcttcaaaaygtayagtagattctcagatagttgtgttgagtgacctttaagcatcacttaggttttaaagctttgtgattatatgatgcaatgattcaattccacgtctttcaaaaacatatccactttaaaaaaggatttaaaaaataagcaatgtcagtagcaagcatgcacagtatgaaatatttgagctggaggagtatataaatagctgtggtcgatgatcttgccttgttcttttctaaatacagtgcttctcagtgctagcatttaattatgcactgtacttgggtaaaaatgggcattagg

SEQ ID NO: 1110 - DNA, 598 bp, Bovine  MMBT13175
  misc_feature (1)..(25): n is any nucleotide
nnnnnnnnnnnnnnnnnnnnnnnnnaaaaaaacagggggagaaagaagggagggaaagagagaaagagagagggaaggaggaagtgagggagacaagaagttaaggagaagcagaagatcctgtgggaactgggagatttgaaggtttggttcagcttggttttagaaaaatacgtatgtgcatatgtgtgtgaatgtacatactatacaatattattaagcattatatgtacacacacatgtaacacaactatgaaatataatacctatgattattgatctaatttaaagactatcaaygtctgattttacaaaagtagtcaaatgttgccattctacataagaaattacattaacagcattcttctatttaataataaagaaatagaatatcctgaatatttcatatagttataaaatttcttgagagactgggaagacaaggtctgtttcagtatttacatatattatcactgaacttctgatgtagaggatcataacaaacctattatctaattattatgaaaactctatgtgtagtagaaaaagwaaattgttcaaatatacactttaggtagttaaattggaaactgcagtt

SEQ ID NO: 1111 - DNA, 600 bp, Bovine  MMBT01739
ttcaaattgtagggattttgacaaagcatctaagtttcctgacaggctcatgaaagaatgcaagggaaactttttctaataggaggttatagactccattgtagcaaacacaaactgtcagttgcatcccaaataagatcctagtctttgtgtcatagcttaatgagcgtctcatagcttaacagtgctttgacttaatgtcttttagttaacatgaataatcatcaacatttagtgatagtgagaggaaaatattggcttcatgttgttcatggtcaacgaatcccttttgagatcacrattgaaaagagcagctagtaccttacttgtgtctctacatatattaagcctgatttctagttcatgggctcattgccttttgcagtactgtttcattagcgtccatggaggcaccacacttaccatcttggcacaccaacatagatgatgccamccattgttttctagtactcattcatgacttactccttagcaatcatgaagccaaaacaatgtttctgactgttttatcctttctgtgtattttgttccctcctggtatccatttgacccttcatcttttacactaaggaagttgct

SEQ ID NO: 1112 - DNA, 600 bp, Bovine  MMBT01318
tccttgggtggcaaactgccaattactaagccagagaatactcctataaaataatataaatctacaataaaagcttaygaaaacatgttagaacttaagtggcaaggatcataacccagggacctgggagcaaaggtagaaaatgaagatttgcagcaaccactatctttaaaaatcacctgactttacaattttacgaagtacacatgcaagtgtaatacaggaaaattgcttctcttcctaattttcaagtgaaattgatgctccacgagaatacaatcccaagatgaacactggatrtctctacattgctcccagttcgcaattctatgactcaagatctaaggttcaagtaagagcactggatcagcagtcaatgccctcgactctaatggccacaactacttcactggttattaaggcttcggtgaagtcagttaaacgttcttagttctgactctcaagtttttaaaaatgtgactttagggtatttcatagagtcagctggctaaagtgagagcatacgagtaaatggatactgaagcctgtaagaactttttttaatgcagcctgactctttttcaaggaggcctccaaaag

SEQ ID NO: 1113 - DNA, 600 bp, Bovine  MMBT13004
gtcaaggcctgcctgtctctcaccctcggaggagagcaggacccctccaggctttcttgctgttcagctgtcttcacctggtcttggagatggaggagttgcatgtgcttgcattctaaccctcagctgagagcagagacacacrgggcttttcctgagaacatcttggagcccagaggtgggttgaaggcagtaggagaccaggaaggtctgaggccagccccaaggaaggcccaggaggctggtcacaagcagagacatactcccaaagccttgagacaagtgctgtcggcctgggcycayggttggggattttaagtcctgcagtaatccctataaaatcctatatctttaattatccaacccacagaaactcttaaaatagatgattaaatgggagataattaatgactttccgtgcaaacctgcacgtttgccagtggaagccatcagctggaagctaccctrgtgccccaccctgccggccggagggtctgcctgcgagccttctgaaggcttgggaacccctgtgtcygagatgcccaggggcccaggtgccatcctctggctcaccccttcctgggcgctgagactgggctc

SEQ ID NO: 1114 - DNA, 600 bp, Bovine  MMBT11918
aactttagctctttagctgaaataactcatatgggagttggggaggcggggtgcaaagcacctcctggaagaagtggcacataatgcaaaatggaaaccatctgggggaattgctagattacagatctatccaaatcagttagaattatgttcatccatgagtaaaaagaaactctctcagattcacagctaacaatggcttaaataagatagaagcttatttctcttccttgtaaaaggatatagaagcaggcatccaaaactggtttgctggcttcatgtcactgccagggagctggyctcctcctattaagctcctgctataatgtcttcaatatatctcactgtatagtgcrtgatagctgctcagactccagccatcttacccacattccagccagccgaagaaggaaaggaagaagaacatgaccattccctttaaggctgctccctggaagctgcacataatatcccactggccagactgaaatggtcctaataactgcaaggagggctggaaaatggagtctttattctaggcatccatgcatttagctattactaaggaagaagggaagaatggatattggaaaagcaaac

SEQ ID NO: 1115 - DNA, 600 bp, Bovine  MMBT14239
agaacacagaaagttaacttgcagaattaatgaagacctcagggaaaagcaagagttgggatgaaatgccagcctcacgctgtgttgagtgtgattggtgaactagaatctgtggctggtgtgatctgaccacgctcccatcgcagctgcccagagcttccacctaccagcacaagcgctcaggaaagtcctgctgccggtcacttcattgctggtgcaagtggcagctgtgtggctctcctccttcaggtgtctggtctcccgaggcagagtggaaggtgttggcccagggtgagggaygctcagttcctgactagcagctcagagagggkttttaggggcatgagatctccctggcgtcccagcagttcctcactttctctgtattggagtcaggctgaccttggagaaccctgagatctgggccatgacatgtctcggggatgatcttcaactttcagataaaagaagcaagtctggggaggagctgcactctgatccaaatggggcgctcgaggctcatttgaaagctccaagcacagccacttgaagctcagctggtttgctcagctgcatgtaaaaagaggcacttttatgaga

SEQ ID NO: 1116 - DNA, 550 bp, Bovine  MMBT11601
gtatagttgctttacaattttgtgttagtaacattgtatgttgagtcttttactgacttgaaatttttctcttcagctcttgaggtaggaggtagatgggcaccctccacctcactcccccaaggtaaagcaattggagattcattccctataaattgaaactccactccaaggcaatagcaggacaattaagggaggaggctgggccctgttcaaaccatttctcactctggaagtcaggagacctccccaaccacacatgcgcagaaaggctccttgcaggcagaagcagggagcaaygccaagggatgctctacccataacgcctcttcagtagaatccaccttggctaagagatgtgtgcactcatctgagagaatcctgatataccacatatggagtgtgaaccagacaaatcaaaatgattggccaaaggaaaccaacaagaaatgcctcataaaagtaattcaaactgcttcgagggcgcatgtactgggacagtctgcctgtgtgcctatccacatgtattatactcttttttctcttaata

SEQ ID NO: 1117 - DNA, 598 bp, Bovine  MMBT13295
  misc_feature (1)..(52): n is any nucleotide
nnnnnnnnnnnnnnnnnnnnnnnnnnnnnnnnnnnnnnnnnnnnnnnnnnnntaattttgacattagcttgtataatcagagatgtaaaaagacctctgtgttccaaacataatttcacaccagcatctcatttcatgaaactattagtcaagacgagagcctctgaatgaatttacctttgattcgtttcacttatttaagaatgctgaataattaagacagctgaaacacgaggaaagcgaagcaggcacactgggcagtgctgcagccgtcggccccgcccgctcccgggggacccyggattcagaaccatcaggactgcgagtaccttcyaggcggagccacatcagcctccccttcacagctatgacggaggccacacagagctcgccygggttcctggggttcacggcttcaagcttcatgttcttcgtgaatccccgactgaacgatgtctggaagagaaagagaacggacactgagccagcagatgccacaaygagaaaacgctcagcgagagcagagccagctggcgcagcagaaatgcacacacatgcacacgcaatcaagtgcacacgcatatatgtgcacatgcat

SEQ ID NO: 1118 - DNA, 600 bp, Bovine  MMBT12840
catcattaaagcctacccctgacagcagaaacccaaggttttccctttcctatttcatgccccctatggtgtgggcaggctaaaaaatcacactttaagcactgcaggaaatctgaaacatgaggacaagtatctttattttgtaggggggaaagcagattctcaaagagactaggtcagttttcccaaggtcatatggctagtgagtggagggggcgagtcccacgctggctgacggtggagtccatgtgctttcagtatacattccagtacctgtgatgccaggcatttgcttaagaycttgctaaggaaagtacaggctgcagatcagcatcacygatgtctcctgggaacttgatggctgtgtggaatctcaggtgccacyccrcaatgctgaatcaggatcttcctttttactaaggtccccaaatgatttgtatatgaatcaaatcaaagtttgagaagcatagacacagggcataataggtagctattaaataaaggcatgatgagtataaaagtaatttttcaaatatgtaggagaggtcaagcagttctgaaatcagtcacttgggagttctagaagaaaccaaaataatg

SEQ ID NO: 1119 - DNA, 600 bp, Bovine  MMBT13850
tcccagaccagggattgaactcatgtcccctgcattgacaggcatattcttagccactggaccaccagggaagtccattaattagaattttttaaagttttcttcttcccgatgtatctgttttctctggagtcagttctttgttcaccttgsaacttttcctctkaatgattttccttcaattactgataatccttggttggtctttttgcctgtagtatttagaaagcttccctaaaaataatagagaattactagttgtccctgttgaggggtgatgtttttgagtacttctagatycttagtccatcaggtttgatagtttttcttctctgatagcatttttgtaacaactctagtttgtaatgtagataaaacttcataagaataaaaaaaaattcatgccattcttaatgtccatttcgcagtaccacgcgtgtatcttatgacttatttttttccctactatagtaattattttggattgtattgtaagtttaatgatgcttaaaatattacatttattacctgagaaaaatatctggcaataaaatgaattttaaatgttttttaaaatgaagtttggagtggagaaattta

SEQ ID NO: 1120 - DNA, 600 bp, Bovine  MMBT12690
ttttttaaaaaatataataataaatggttgggggaaaatgatgagttcagatcagcagggccctgtgacttgtatcctttgttattcaaagaattagtaaaatatattgatagagcaactattacttactatttttgagatgccatgaagcacacaaaagacagctgtaggaaactagagaatagcttctggatgaccctggtaattacagatgtcttcctattccagatagcaaggaagatattacaacatatcatcaaacaatccacttaaaatgagcacctagacaaacactaggcyctgaatagcaatgactctgtttttwgcaaatggtaaattttgtcagttgttaagtctcctttagtgatagacaggccatgaataaaaagaggagataataaatgtaacagctaaagcttgrtgaaactttgggggtwttcttagcagctacattgacaatattagtttctttgtctggtaagtttgtctatgagacaggcattatgcagaacactacagatatcagattgttcaatcttcacaacagccccatcaagtaaatactgaagcattattcccattttatgaatgaggaactty

SEQ ID NO: 1121 - DNA, 600 bp, Bovine  MMBT13318
gactgggagctgtgggcgtggttgggctttgaggggtgagaccactaggaagacattggctgaagaggaggtggatccaggagtagcaggtgggagcctttcctctgtcagtgatggggagctacagaagaattgttagamagagaattccatgatatacatgccttttagaaaggttagtaaatggaaaaatcagaaaatacagagcagcaaaaacgacaggaaatcaactgcaatccatcctcactgttgaaatccgagtccatcactcaccagccgttttttcctacaggtacgtayacagacatgcttttttaagactcaaaatgatcaaaagttgtacacacttattttgaaccattttmgtttattttcacaagcatcagagtttcataagcattctaaagcttcattctgataagcacactgcaatatattatatcaatgtatcatacagactcatctttaagagtataggctactttaaaatgttcgctattataaataatgctgtaatgacaacttgaagatcctcttatttcttcaggataaattcccagaagtgaatgttgtggctcaaatgaaatatgaattgtaaga

SEQ ID NO: 1122 - DNA, 598 bp, Bovine  MMBT12453
  misc_feature (1)..(41): n is any nucleotide
nnnnnnnnnnnnnnnnnnnnnnnnnnnnnnnnnnnnnnnnnagccgcctccacacccttcctccatcccggcctcatcctgggttgcgccccgccacgctccctctgtaaacacacaaaagccacagagcctgcatccggctcctagagcttcatttttttaaaagcgagaatggaaaggaatttttttaaaaaagggaaagaaagactaagaaggtgatgcaggagataaaaggcacatgtgggtgacaaagagactatgacatagtcaaattttattaatggctcgccatatgcatgyggaggataattaactattcacaggtgaaattagctgataggggtggctgtctcgagcaaatcgaatgagctccgattatatcaatagttaccaaccagtgtccctggttatccaagcatcaaataaatttgtccactcttcttcctttggggggagaaactttaattatccagccctggcgcctggcaggtcattaataaaacctagttatcggggccgcagcttccggrgttttcctgttatccatcttttatctaaataaacatttgggaaatgtccttaaaattattacagacac

SEQ ID NO: 1123 - DNA, 600 bp, Bovine  MMBT12559
gtgtgcgtgtgtccatacygcatccatacacacgaggaggtcagaggtgaggccagccatgggagtacagcacagcaggtagcctcctccctacatcttgcagtgactccttcaacttcttcttttttgtccactcccaacctgttcttgtctcacattcagtattgtgccctgtataatatccatagtcccaagracagattgccagaggggctctgaccaatcagggtggctggggaagctctgccaggaagggaagaattcacagatcgggaacattcactctgagwtaaggcctgytctcaatcccagctggctatcagctaatttctgcaaaaagatgcctctttttccagaagcatttacatgtcaamtggaacttccagaggatttctasggttttaagataatcttttttttaattaaaaatcatttttaagaagtgatttatggcaatactggagaaggaaatggcaactcactccaatattcttgcctgagaaatcccatggacagaggaatctggcgggctacagtccatggggtcacaagagttggtcacgacttagtgactaagccaccaccaccacatagtaatac

SEQ ID NO: 1124 - DNA, 598 bp, Bovine  MMBT13761
  misc_feature (1)..(14): n is any nucleotide
nnnnnnnnnnnnnnggaaactctgttcttcgtgatcttcaaatctcccaccggaaaccccttaaacggaggagggcgggtcctcaatgctgactctctcgtgtcggggaaggtccgacagcctccagygcccctactgacttctgggcatcccccctggaccccaccagctctctctgctccagctctctctgctttgcctgagctgagaacctctctccttgtgaagaagttttctttctcccttgatgtctttaacttaaaaacaaaaatcagagagttgcaggattcccaccgggayggttatgcaggaggaaattattcccattagaacctggtgaatttcacatgtatccagaagtgcttttataataaaaaataaatgctgtataagtgacggtaccgggggaatttcgccagttctgacacgcctggctgatttgggctcagaagtcagtttttctgtctcctctttatctgtcatctgcctgagtctccaccccttacactgcagcttcattttacggcacctaatacccgatgggtgttctcggaaataacactattggtggctttaacatggcttcgtttagataggt

SEQ ID NO: 1125 - DNA, 600 bp, Bovine  MMBT14035
gaacccctgttacttgatctgagcctcagttttcctcatctgtataatggggtcagtggagggatttaccccataaggttagtgtgagaattaagttagcactktgcctctcacaagatgaatgctcagctattattcatttagacattctctataggacctaatgtggctttcatggtaatggaaatgcttagtgtaatcttgaatgcttttcaagatattcttgaaaatatcttttcaaggtattcttgctgcttgggtgaagygtggtacagagaagggtccagctgaggtgtgcaycctgggaaagtttaggatagttataaaatgtaaagtctgagtatcttcattttaaatgtgatggtgagcttggaaaatggcccaaatcaaaaaagagttagtgggagaaaatatttgtgaaccatgaaaccaacatctcccaaaatttgcaagcaacttatgtggctcagtttttaaaaaaacgaacaacccattcaaaaaatgggcagagggcgtaaacagacatttcttcaaaggagagcctttggtttgtaagttcctctctcgttctgctcctttctgtcccccctctctctttgt

SEQ ID NO: 1126 - DNA, 600 bp, Bovine  MMBT12414
tccttatgtggccgtccctggatctgtttctctcacctctgtccctggggctttgttcccactgcagtgcaaaaagggagcatgtgtgcattgtgcgtgctgatggctggtcttgttttaggtctcagagcatcagcaaccccaatgtgagaaacttcggccgctccctcctggcaggatactgccccacgtacatgccagacttggtgcttcacgggaccagcagcgacgagaagctgaagcagtgcctagcagccgacctggttcacacggtccaggtgagtgatcccagctgggagyttcaggctgctgaccagggggtgaaggaggggcagccaggcgacgtgggcagtcacaggtatagtcatgggattgttgctacagatgctgccagggttacrggaaccagtgaggctgctgaggcatctggggacgtgyggagctggaggctgtgagcaccacaggacacagcagtggggaaaagaagagggtctgcctggttgtcggagcacgatggggtgggggaacccccgacctctcactcctccagccgctgagctcctacagggcctcctttgggctaagcccagctagaagcct

SEQ ID NO: 1127 - DNA, 600 bp, Bovine  MMBT13672
ccacctgggggttgcggccgggcccccggcagggcggccgggctggccttacttgatcagttcctccttgtcattctccacgtcgggcttctcctcctccttctccacctccttctccttctccttctcatctttctcctcctggctgctacggggcatctgctgctgctgctgctgctgctgctgctgctgctgccaggccccaggggagggcagggggcggtgggggagagagggacacagtcaggcaggcgaggctctgcacctggactgaaagagctggaggggatggggagtccrggggagcccccttctccaacacctgcactgtgarctgggcagaaagccccacaatctggggcactgggaggcaggagtcaaagggcaaggtatagaaagtgttcgtgtcagacgcctggcctctggcacttkgtgactgcgtgaccttggatgagagtcttaagctctctgtgctccgattcttccctttgaaagcatgcctacccctcagccaggcataggcaggctgaaacgagagaatgcttacagagttggcatctggcaccagtatttaagcgtggtgggaaccccaaggcatga

SEQ ID NO: 1128 - DNA, 598 bp, Bovine  MMBT13454
  misc_feature (1)..(79): n is any nucleotide
nnnnnnnnnnnnnnnnnnnnnnnnnnnnnnnnnnnnnnnnnnnnnnnnnnnnnnnnnnnnnnnnnnnnnnnnnnnnnnngagaggagaagtgtccaagggcacagggaggcacagagccagcctacaagcctggagtctcgatgccgaggcccaccttcctttcatggcattggatagacctcgctggcccagccgcatatcagcggcatcatctggcttatcctcaatcaacacgtgcgttccagaggaggcagaaattgacgaagaggcagccagttcctggsgctgatggcctaacraaaggggaagcttgagctccagactccttccttgttcgagtatccctcgctggccgaccccatctttcaccttccggctcccagggacctggacagacccttggcctggagggggcagcctgtcccagtgccagctcagcgggcttggcccttgtaacaatagctggaagggccttttggagcaagtacttcctgaagtgcccagaacagccgctgccgtcctggggcrcaggaacaatcacagtgcacgccagctcccgccctcctgggagcctcagggactgagacttcaggctcc

SEQ ID NO: 1129 - DNA, 598 bp, Bovine  MMBT12072
  misc_feature (1)..(119): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaactgggtgtggataggattccagtaatttggtcaccagtctggtgagtcagaggctgggcaggcggagccggggcagcctgtcccatgaatgggtagacacttgacctggacagagccaaggcccaggggactgacgcacccttagcggtgcacatctcgcctgagacatgcaatacrtgtccactggtttgtcaartgaccttggccgcaggtgcaggcattgccttcctctcccaaggactgcctggctccctctcccccagttactagggagtcagactctcaccctggtccccgcccctgacggggaggagtcacggtccagggaaagggaccctgcatctctgacgccccccagcgtccaaagggcgcaaatacagagaaggcgtcggagtctgacccctcttcagacgtcagtcagcggcggggcgcatgcgccacagtcgttggccggaagcgccgggaagaggcttgc

SEQ ID NO: 1130 - DNA, 600 bp, Bovine  MMBT13668
aaaattatcttccttcagatacaatagagaaactccaagcaaaaaaggaaatgagaagcgtgtgttggagtaagtcctgttgtgagcaccaggtaaacactccatattcagtcccttaagaacaatggatttttggctcctttgcctgagatatccttacagggcactggggccaggtcacagaaggcattagaaacactcaacacaaagaaatctcataaacaggacagtctccccttctcccctaaactcatgcccctatggagggagcaaatactgaatcacattagaaaatgtaartaagatgggaaaactgaggttaaacagctaytgaacttgtggacatgacagagaaggccccctctctctggccaggttggtgaaatgctctgggtgagaggtaaaaagatccatgggtgggcgagagggcaaccctgctgagtggggtgcagtgcccacaggctaagagccaggtccagtacaggcctgagacggtggggacgggggtcaggcactcacagctcccaacgacctctggtctgacgggcccgggcaggccctgccactgcctctctgtgcggaggaagctgtgctaagccg

SEQ ID NO: 1131 - DNA, 600 bp, Bovine  MMBT12081
tcagtgacatttagatcttcctttgattacctaggttcttacaccaggaaagggggttagaaaccttaggagcagtccttcatttcacccctaaaacgaagcattgttggccctgttacaaatgccacataggagcagggagcagactgaagtctgctgaactcagactgcctgctcggcactgtcgctgagcactgtcctcactgacgtcctttgatgtaacaggagcagaccacaaggttcacagacctcggtggtctggccctgtgcatggcctgcaaagctccttctaatgatttractttacacagcaacagagaagggygtgaagaccatcgcagcagaaggtcacgtctgtctcccactctatacacagctgtacctttattcttttccatagatgtttgcttatctgtaaacattgtgcccgagacctggagccctgttatgtctcaaggatggagattcttgtcagcgtttgacactgttgacttgggagtgtttttctccttcaggagagaaagagatgcagctagagagtttatgtcctaatttacagagaagtcccagttgtagctttaaggatctgttttagcccac

SEQ ID NO: 1132 - DNA, 600 bp, Bovine  MMBT14226
aggctccaaggagtgatctgacgcattgagatcacatggctagtaaacagtaaacctctggaccaactccagtaccagtgcccatgaccaacatataccccagagcaaacagggtcttacggtattaacttccacaaagaaccagtgttaatgagccaaagtataaacaaacccaagtctccttggaaaagacacaattatccagaccacaaacttttgttctgaatactatgtccctagaaaatataaacgcaacttatgaagcagaagttgacttctgggccaacatcagtgactacrtggcccagccagaccacagcscccyggcagtgcagcaggcagacccrtcyraaggatatagcgctcatagatggtgcgggcccggtccacctccttgtatctcagctcgaagttgatgtacgaatgccaggcctgctcctcyggccgccactccatccagcgctcgaacacctgccgggcaccagcgatgttcccgagcatctcctccatgtacgtgtacttgtaccttcaatagaaccatctggaacttatcagtcacggtcaaaatgacttcagaaaaaaacggtctttggcaatctc

SEQ ID NO: 1133 - DNA, 600 bp, Bovine  MMBT13756
tcatgctcttctgtaaaccctttccacctcctctgtgcatcccaacctggtttgggaagcatgctcgctccccagaaactgagcccacagtcacattgaagattctcaatctgaacacatggccactaaccccaagtggacccttaatgctggcagaccatgaaactgtgcagatatatcccagccattctgttactcttccagtggaaaattctgtgctgttccttcctcagatttccaacacagcttcccctcatctgctccttcagtctgaggtctgattttgctttatcaatgagraaataggagcaatctgaagaggatgccctcaactcccacaggttcatctccccacccaccagcactgttcaccttccctctgccgtctctcctacctttatgaaccaggatccatgcccagaagatccacccctccactcctgcactgggtcccctccatctcacctgctctggagtattctggtatgactctcatgtccctctcatgttcctctcatgcatcatcgatcaattttccatctccactagacccttagcatttagcatataaccatgcaatgaaaccttaaacctttaaaa

SEQ ID NO: 1134 - DNA, 598 bp, Bovine  MMBT14224
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctctgttgttgcggaaaccagtactggagaaaccatgcaccacactcggagagttggatagtcaggtttattacgctggcgggcttccggaagagttaacactccaagctctgagccccgaacaaaggggttacagagctttctatacacagacaggcatgattaagcaggtttgcaggggctagrgcrattgcaaagagcaggacaagggtgagtgagataagctccagttcctagtattctgagtccccactttctgagacctatgtgatccagactttgtaaggagcaagctgggttacagaggcagaaggagcaggaggtaaaatgtctgtaaaattttaacttttcctcttcattatggtgcctccagaaaactaggctgtgatgggtccaccccctccctctctgaaatcacattcattcccttaatgcaagtgtttcattgttttatttcacctaatgccccataccaccttatctccac

SEQ ID NO: 1135 - DNA, 600 bp, Bovine  MMBT13419
tcccaggaacagccgctgaggcatccgtgtccctcggaggaggggacgtgcattcgctggcaggccctgagcggccacgggccacgtgggtgccaggttgggccaggcacttgggggtggaggcatctgtaggcggtgggaccaccccggggtctgccccagacggacagggaccctcccccccgagtcagcccctctggcctcctggccatgcccccacgggtctccagatacccagttcttgacccgtgggctctgggtgcagagacccgcaggctgtggtcggcatgctgactcagragagacgtgacggcaggaaggcctggttcctcttaagtgctccgggggctaccggggacccgcggcccctgtggcaggagggctgccgagccgggcgtcatggttggagggagggcatgcaggcaccgtggcatgggcagatggtgtcctggggctgaggcccagccgctcgggtgccatggcggggtgggtgaagctggggcggctctccatagccagctgcccccagcggggcagaaaatcttccttggccagagggcccctgccctcagggaagcaggcatcccgagtccattccag

SEQ ID NO: 1136 - DNA, 600 bp, Bovine  MMBT13406
ttggtttcaaatgtgcaaggatatttgttattttccaaaatgtccaattttccatcatttccactttttatccactttaaattatgttttgagatgcacattagagattctctacatttaatattattttacagagaaaaaaagagagaaaaggaaggttctgactttctatgccagagaaatgagctattggtttttgtcttcagacatctctgattaatactcaaaaaataaaggtgttctcacatgaggaactttgctagcacaaagtccaccagtgtgatcagcagccctgaaacrggaggtggtgagagtgggatatgggggcagggaggactcatctggtaccgacgcgcgatgcagggattgttttttatggaaagcctgttttgtccagcagctggtgaaattcaaaatggtccccaaagcctgtctctgaagccagcaattcagaaacaggagagccagttagcctccgagcttgcttccccattcagcgacaccccagcccagagagcctccaaaagcaagacttttctaaccaaagggaagctgctgggaggggctgggttccaggatcaacagttttttgcgttaaaa

SEQ ID NO: 1137 - DNA, 598 bp, Bovine  MMBT13825
  misc_feature (1)..(57): n is any nucleotide
nnnnnnnnnnnnnnnnnnnnnnnnnnnnnnnnnnnnnnnnnnnnnnnnnnnnnnnnnggaaaaaatacaatactctgtctgcaaatcctttctcatttcatgtcaatatccacccctcccatcatcctgtgttgacaggactgatttgctaaaggagagtttaacattacaaacaccctttcatcagcttaaaaattgaggcgagtcaatatttacatcatgttgctgatcttgaaagtacataccctgttttctgacctaataaatagctgtcactcttgcctccatcagagcttagcrgagagtgggtttgcctgctcaatggtctctgcattccgggaatgatctaatatttcargtctctcctgtggcagcaggtcgatttctttctctcgctctttcttattggtttccaatgacagacctcataaaaccatttaggtctgcttagagaaaataaaatccataagcatgctgggtttatctttcaccagaaatgcatgaaatctaatgctccatgagtgaagataagcaggatatgtgttatctattttgcaatgcaatgttcaggacatatttttagcccaaaacactggat

SEQ ID NO: 1138 - DNA, 600 bp, Bovine  MMBT13108
gaaaactgaggtccagtgcagtaaactggcttgcccagggtcatcccaccagtagaagacagggctgctggacttaacatctgggttccttccatgatccccacttataaacgactgtaaaaacaaagggataagcagagttctaagacaagctaactaaagcaattccaaaaataactattacagaccaagcaagaagtttcgtttagttctccaagttctcaaattgaatttcagcaaggcttcccttattggacctgagttgtaagatcagtwcattttctagagtgacatcttggrgaaggggrtgggaaagaaygcttgggacaattaataagaagaccctccccccaccatgccttgcccccattaccagcttacctttatcagaagatgagaattaaaagtgatgacacaccagaaagcttacaggatgggaaacctaactcaaagcatcagtttcgattctatgtgaaccatcggctctctctctttactctttccatctggctttctggtctttcatgattgggtctttcctgaaggaaataactcccaaaaggaagtagaaggctcacatcaagggaagatacaggactg

SEQ ID NO: 1139 - DNA, 600 bp, Bovine  MMBT13655
aaggaaaagtttgcagagcctgggcataaggcctccattcacactgtgcagagttcaaaggagtcaaaaaagggtaactattgaagtgggtttttctttcttttttttttttttcaacttcctttttcttagagcagtattatttatgtggatatgcgttctattgaaatctcttcaggccctgctcctccacaggaaggagctacagtgactggtggggggcagggggtggtgcagggagagtggtccacagggcaaggctaggcgcccagcagctggccgggaagaccaatgcacacracacagggcctgcagacaggcggtcaccaagagtgacagctcatacatggcccaggaatgkaacattctgaggaggtttwaccttaagggaaccagaaacgccagccttaggtggaggtgagaggaggggctcaggaagagcacacacagattgggttaccaggcgctggaaagtaagctggccaccacagccgccaggcacggtgtgggagccctcacctgcatgtgagcaaaaagaaacagtctctatgggcacaagtgaaaatgccaagcaaaccattctggcactgcatgtcctct

SEQ ID NO: 1140 - DNA, 600 bp, Bovine  MMBT13046
cctggaggaggggcgtggcaacccattccagtattcttgcctggagaatcccatggacagaggagcccagcaggctacagcccatgaggtctcagggtccaacatgactgaagcgacttggcccacaggtgagggtgtatttcccccccccccgccaccccgggaggtatagtgattgtttatacaagatatcatattctttgaagagttggggttttttttgcagatttttcttgactcaacagactctcgacttcataggactgcaattgcaaaggtgaggctagaattccagatagracggtcagccagcttacctgcctgtggtgactcatgctgcttgcccctactcagataatggcttgtcatttcagccagcacagcccccgacttgcagcaacttcactggaattcacttttcctgtttttttgtgtgtttttttttttaggtgctcctcctagttccaggaaggtaactcagaaatcatcaccctttgccttttcccacagcaccgttaaacagggacgagcaagaaatggccaagtttgactggagccagcccaggacagagaaatgttcctcttggccactcatccctg

SEQ ID NO: 1141 - DNA, 600 bp, Bovine  MMBT13851
tgccaaacttaaaatgggattcaaatccacatagtaaggaatttattcatagcagctaccctgatagagcgatctttcactttgctctattcaactgtcttaaaatttcctgtttcaaacagctgttatttgattaaaacaatgttaaaattaaaaaaaaaaaagtgaaattatttattttattagatttcacagctgaatgcatgtctttctaatacttgctaagtgaggagtacgtgtaaggcatttctgtctcccccgtagggttataggttgaggaaaaccacttcatagcacacrcaaaaggaacgtggaacgcgactttacttaagaatgcctgagagacacccagtggttctgaaacttgggtgtttggcaaacagcttcttgaaaatgaatgaagtgaatctgtcacttccaggaaaacaattgacagtgtttgttgctaatgataaaatttgagcttgcaagtaaaaatcacaattttagaaaaaaattttatctgccacttaggagcttgacagctacattaaattacacacttaagatcttttttgatgagactggtgggtgatgtaaataaatgtgatttctttgatg

SEQ ID NO: 1142 - DNA, 600 bp, Bovine  MMBT13545
gggcatggggcgggtcttgtattcagagaaaagacagaataaagaatgagctcacagccaacacccctcgcctccctcctcctcctcaggagcacatcagtgctgtctgataacctgcccacccgcagagacagcacctgagtcgactcttgttgcgggccacgcgggtgagcgtgtagcggttgatggtgtagaagtagtcgtgatacggtacatcgtgcgtgaggacctcggcgtcgatcacatagcactcgctctcctggctcgccttgtacatggtctgcagggaagaaagggtgrggggatggggctgaagaggagcaagacgggagaaacccctccttcccgacgacctcccccagcccgctcctgacttctgaactgggacccagaaccgagggaaacgcagcatctaagcactgtttcaggctgaacatcactcccgcccagatgttcatcctgacgtctctctcctgaatcctttacagcagaacagaggccgtgcccgcccgacctcagctcacctgygtctccctgacggtggcagttttgggagctagagggttggtaagggtgatggtgtaaaggatcactcggctc

SEQ ID NO: 1143 - DNA, 600 bp, Bovine  MMBT13614
agattctcagactcccttccctggaagcttcaggtcaggagagggcccagagcgctcaggctttgaagagatggctgatgggggttgcgtgggaagaggggtcctgggagcagccggtgctggggtggaggcagaggaggcgagagcgggagggaggagaggcaactcctgcttctggctcagggaggaggctggggatggcgggggcaagcgcttatggggagcggggaggggagtgtggctggctgcagccttgggtgctggggttgccgcaggagctagaaggtgtctgtctgtgarggtgttgggtgatgtcattttgacctttctaatgcccagagctgggtgggtgactgtgggtgtctgttgcttgtgggtggaagaagacaacgtgtgtcgctcgcacacggggcagggagttgccatgcctgctcttggagcccttcctagaatgagtgagagtcagcgcctgccctgtcccagcccttccccgcttgcatgtgtctgtgcaaggtgtaaatgtgtgtgtgtgtgcaagcgttcacatccctgctgcagtcctggcccactggaggagcagtggctgttccacgtggtgta

SEQ ID NO: 1144 - DNA, 600 bp, Bovine  MMBT12931
gagtagacctgaaagacactatgaaccaattcaacataatcaagatttatacaattttcacccaacagcaggatacaaattctaytcaagttcccataaactctaaaccaggagacayggaactcaagttattttttattttaaggcaaargcattccaattattataataaaggtacatgtagaaagtggtgtacaaagctcgacaccctcctgcttgcctggtttcatggctaaatgtttgggctctgaatgtgaatcacggctcttctacttgctggactgtgtgatctcaggctarttacttaacrtcatcttcagcatctgtgaagggggactgatgatacctctagtatttggggggaagatgaaacaggctcaccgcaatgaatacttcacagttcctggtccaggggaagaactcagttaaactgttaggatttagcattatgaaaactgaaactggattcaagaagttaaagggattcttctcacagctttgagatgtgcaaacaagagtaggactccaacggatgttctgctgaacttatttttctgtttcctttgctgtctcacaatcatgaatcatgttgaatgtggg

SEQ ID NO: 1145 - DNA, 600 bp, Bovine  MMBT12925
gctgttcaaccactgttttgtgtttccagctggttctataaccacattaaatagaactagtattctttaaatacttttgattttgacataaaacattagtgtacaactttcacaaaataaatcagcaataaaaaccgtgggaaggataacaaggatagcagcagtacttaaaaacaaaataaataaaaatacattataaagtggttgagagacaaaaataaaccaactttaaaaatccatactatgtgttgggaaggctgccgtgcagcaacacctggctgcagccggggcgtcttctcrgatagctyggcctggacgaccgcccgacctggactgggaccctgggctgggcgagccccgggcctcattcccaggcgcttctcccgggaggagtcggcggacggctggcagccgccccgcagcccctccggtcttcctaaagcactgaggagcggtggttggctacatccctgagggtcggctgatggccgctggtgaggcaagccttggaggtcgggccctgaagcttccgggcagaggcggggggacggggttcgtctgcggctcccgggaagggcagggggcggggggctcacccgg

SEQ ID NO: 1146 - DNA, 600 bp, Bovine  MMBT11787
taaatggtgaacttctccttagcatccagttcagattacatattggttgaacaggataagtaacaagaaatcaactcatttcttctacttgtggtttccccactcacattacctcatcacagcaatgtctcctcttttgccatcagtcaatggtgctgggagcaaaatcaaacactgacctgtgctggaacgttctcctctggatcacagccatgttcccctaggagctgtgggaaaactggctttactccaggagaagtcagcctcccctcactgctgctcactaataacctttcctcrtttttgttcggatcttaatgacctcaacctttcacaagaggtttgcctcccctttttttttttttaatttttcaacaggaacacaaaatagcagataacccaaagaaatgaatataatttagatggaaaataaaatctatctaccactgtgtgtatgcagcctgtgcgtctcattggcatgcaccagattggactaaatggcaagaatttcccaagggaagacaatctccagatactgctacaaaagctttattccccacactctgcaaattatttaatttaaacactgcttgatatgac

SEQ ID NO: 1147 - DNA, 598 bp, Bovine  MMBT12811
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatccttttgaaaattaaaaaaaaacaatttttttttatgtggaccattttttaaagtctttatttaatttattacaatatcactggtgtttttggccatgaggcatgtgggaatcttagctccctgactggggtgcgaaccygcactccctgcattggaaggagaagtcttaaccactggatcrccagtgaagtcctgaaaatttcttgctttaagcttgtatttcttccttgggaaaagtgatgagtgagccrctatttcatcyctcattctcagacyggtacatactattgcattctgaactgtatctgttgcatttcacgataaagaattacgttcatcttcacctgagttcatagagttggctgtattttatagcacctgctttcattaaagtctaagcacatgcaagaaaatgcaaatacagttcctaataagcgctcttggatgggagaggggtttttaacaaaatttctttgtct

SEQ ID NO: 1148 - DNA, 600 bp, Bovine  MMBT11769
ttccatccttgaatatattcataatggctgttttaaagttcttgactgttgtgctagttatcaatttattgcctctcagagctaaatcaacctttcatgatctgctcttgctaatggatcagaccctttaatccctattgttgcaattacaatgttaatttttgccagtagaggaagctgggggtactttgcaggagaaagttctatcctggttccagcgctcctgttcttgttcgtttgctcttgttgtatgtcttaaccactggactgcaaaggaagtccctaaggagctgcattttrgtttgggttttatttccagcacctggccctgtccttggcatctgtaaaagtagtgaactggatttcattccatagggtgactcctaggaggaccaggccaaagacccttccccaagagggtcaccagcaaagaaggctctccctgacctttaatcttygcctcttcctggtgtaactggcaggttaacctctccagaggcagccaagacctccctcttatctcctgcatcctccaagtcagcatggaaatgaggtctcccaggggccacagctgcgatgtatggccctcagttggctctt

SEQ ID NO: 1149 - DNA, 600 bp, Bovine  MMBT13970
ttgggtcccctgtgctctcagagcataagaggacacgggggaaacagcagatacagaataacttctgtccctttaaggaacatcttcactcagctctttgtcaccatcccaaggcgtcttggcttgactgagtcagagaggctaatgggcagggacttggaccatatattgattgaccctgcagcatctcaagccctttacaggggcatggagggttctcacagaataagccacacaaatcccacagccttgaaattctgctttgcctcacccagtaggggtcccggtcccctggagtcrgatgcaaggactgcattccctggctctgagcttaagctggttgttattggatgctcaggctggtgtctgcatgataaccccggagctagcatactcgggcaaggggcagatgggaaggtccccaacatgagtctgttgtcagatgatgactaagctgccctcatcgccaccgggccttgtcacagtggaatcatgtttgtcagacatgaattgtaaccttgaggttatcacatgggtccaggggagggatgcagacagtttgcaccaccacctttgatcacttcttctggaggcgtggag

SEQ ID NO: 1150 - DNA, 598 bp, Bovine  MMBT14192
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggaaaaatgtgggtaccccaggagaactagtgccagctctggggtctacgcctcaaggtgctgcccctctggacaccgcttctgtgttttctgatacatagtctagcattcagaccccggacacatgtctcctcacagctgattcaggcttgagggaggcacagacrtcctgcatggttgtcaggtccccagaccacagtccctgaagccttgctggaccttgattggagcttggaccccttgagaaccagggggcatcggtcttcagccaggcccaagttggctctcctgaatgctgagttgcatcatttaaagatactgagttgaccacgaagatccacacaggacagaagtgcgtgttgacatgtctccttccctgtacaccatttgtgtctgcacatgtgttcacagcgttgagaagaggaagttctgaagccacagctatcaatctttctgcatgtttgc

SEQ ID NO: 1151 - DNA, 600 bp, Bovine  MMBT11739
cctctggaggccagtagaacacaggacctcttctcatatccccagtttggtcctgtcgaagtcrgcagatgaactaaataacttcttgctcagtgaggtggttgaaatctagggttctagagggacacctgttggaggrtgaatcctgaatttccacctattagctgtgtgatgctgggtaaggcacttaacctctctaagcctcagttttcccatttatgaaatgagaataatacgagggcctgcagcgcagggcttggggtggattcagtgaggtgctgggtgcgcctagcacagagrcagtgcccagtgccagcccacagctgtcattgtcgttaaagagactgttsctgtcattattaatcatcacacccattctagttcttgggtggaggcttctgtcacatgcatcctggggccctagtccccacactcctagcagtgtagacaccctttactcagaagctcatatatgagtttgtaataagctgcctctaatcttttgtgctctccttatggacaagtatcaaatccaggcaagatctgctaccaagctagcttttaatgagggacttagcctgaaccactggaaccacggga

SEQ ID NO: 1152 - DNA, 600 bp, Bovine  MMBT12057
ttagggtaagtgggtgtgtgtgttcagtggggtagtattcttgccctttcctctatggccccatttaaaacaaattcattgtaaaccacaacgttatggcatcaggaactttaaaatactaaaaattatataaacactaaaaaggcaaataaaatcatagctatggtacaaatcaatcagtttgatgcacagaatcacaccttctttaaagtatagctgaaaccctaccaccctgccatgaaaactgtccttacaggtttgggayrggaactcaatacaggtcagagggtcagctacagrgagctttgctctccactgcagaagaaacatttccagtaaaccaggaaggcaaaaccagaaggtgctaagtccccttactcacctggacagatgcctctcaaatcctctgcttcccagggatcggggtcccatggagcttcccctctctccagctgggagatcagatcaggtctggggaatggagacactactccaacaagacagagagacagacaagttgaggggagacatccagagctgttactgagagccctctgcccaccccaaggcaggcgagttgagttggggggagaaggggac

SEQ ID NO: 1153 - DNA, 598 bp, Bovine  MMBT14248
  misc_feature (1)..(90): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgccttgtcttagaacaactctctgagatacatacatgtcatcaccttcgttgagataaatgtcatcccctttattctaaagatgaggaaactgaagcacagagagttcagtcatttgtccaagatttcacaaagctagaaaggaatatacacaggcatggagttcgggcagctcaccggagaccattctcttacccaccacccacraatacggcgtatttatttaggacagcacctggcataaaatgctaaataagtggtgattgctattgttgacatgacagatcttcacgttcttttgttatttcctccagggaccgaagcggatgttggatgctcaagtgcaaacagaccccgtgtccatcggaccagcgggcaaatccaagtaaacaaatcttcacggctcccatcaggttccgccaccggagatgtctcctcccgactctgtttccccccaaaccctctccatctgtatattttttcttctgatggccatcccatgaaa

SEQ ID NO: 1154 - DNA, 600 bp, Bovine  MMBT11738
gtctgaagcamagttggtgtgtttggtgctcaggcagcgagcatggctgcagcttagtagtttggggatgtgatgtgagtgagcacaagggctcccctggttctgaaatgaccttgaccccattcagtgagaaaatactcagaagagacagttgtgtggaatttgtcatcactaatactgagaagcagtcttggtctgactgggaaagagaggtgctgctgggaacccagcccccttgyaaggggctggaagctctgtgatggaccactgagccctgtgtgttcagaacttgccaggtgrccccgaagctgtggatccctccctacctttctccttgaagactataaatatccacatagatttctatgggatattattcttggagagcacttaggactccggaggattaaatcacgtcctaagctgaattcttacattgagcgtccatttggcatctgtgtgactctcggtgacactgatgccacgcatgcagtattgacacattcactactgcagggtcaggattcaatagctgtggttcagccacacagcttgttaagtaagtcattttgacagtcccctgtatgctcttaatattgc

SEQ ID NO: 1155 - DNA, 600 bp, Bovine  MMBT14261
gaaccctgatgcctaacaccacattaacctacgatatccagaaaattaacctttttgatagtttcgaagcctcacggagaggtaactattttcacacttgtaaaagcttctttgggtgatgtttctgctcaagtcaccttctctttgctacctgcccttttgcacagcagacatctctgtgccaagggtttgcyggcgatctcagcccagcatcatctgaaccctcctaatggacgttgcctagttctgttttctgggcctttctgatcagcttgcccttcagtgccctccactctatgrttaactggttcagctgtgaatggaaaatgtcaagcttgatctgtttttccttcctgaggctgagataccaccatgaaattgtacagtgcagtcaaataaaactttgtggaaggtcatacctactgagcatgtggaaatgcccacaacacacagacttcacaacctgaattctaagcggccatgagccactgggtttacctagcatcctctcaaatattaccttattccctttccgcaagatcagagaaatgtgaagattatgaatattgaatcattatgttttacacctgaaactattat

SEQ ID NO: 1156 - DNA, 600 bp, Bovine  MMBT11802
aggcctccctgtccatcaccaactcctggaatttactcaaactcatgtccattgagtcagtgatgccatccaaccatctcatcctctgcyatccccttctcctcctgccttcaatctttcccagaatcagggtcttttcaaatgagtcagttctttgcatcaggtggccaaaggtggtgtctcttcaggcccccactatggctgctataggaggacctctccagtgtttatccccaacccgagaaacacaagggtctgtatgcacaacaagggctygaatggcagcgatgctcagctcarggatttaccttcatctggatttggctctgcaggcagaccctccactgagactcactgggcaggacttccggatcctccactagcttcctggtctctgtcacaaatctatcttggtctccaaccaagtttgtctgaactttccccaaggaccctctcaaacctctgtgaccctgctcttcaccttaacacccttcttctgcttctgcctgatgaagctccatgcccccctcaccccaggggaaaggcttcccttcctttaataaccctgtttagaaggaacaatctgtctcttgagccttt

SEQ ID NO: 1157 - DNA, 600 bp, Bovine  MMBT12592
gtggcctgtgcagaaactttggtctgtaaggtcctcagcttggggtctgtctgctgcttgagggaaacctaattgccatgatggtagtgatgtcattactagtaaccacagttatttaatgaacacctactacgtgctggttactttctagaagttatctcacatcagccctgcctcagtcctgtgagggtaggtcccgytgttcttcttttataaatcagggaacattaaggtttggtgaggggaaggtactgactcagggacccgactgggctccagttggtaatcccttgcagaccrtaccctcattgaaacctcacaaccagcctcccacctcacccagatccacctctcataacttttaataagaagtaatagcaccaagcagcgggcataggcttcatttttaattatctaatttacatttaattttccccaccaacgtgatgcagtttattaatgttttacctaagagcatatatttatgggctaaaaatatgtttacaaaactaatgggcaacacttctcttttggagtcccctagttcagacccagggactccagctggagccttaggtcctatgacccagcaaccaacat

SEQ ID NO: 1158 - DNA, 600 bp, Bovine  MMBT12753
tggcctactgatgtttgctggtagattatccttgtaaaagttactattgtcaggtttcattttgtaaaggtagtgaagactggcaattcacataaattcctcagcctcattgctcgtgatggtctaacaactaagaacaaaacagaaagataggctcattttaaacaaatcttcttgcttcaaataatatactaaacagacawacagcacccccaccccccggcaaaaaaggaaaacaaaaaaagaaaaaacaccttacagttgaatttactgagctgaagaggtcaaactttgccagartcagggactggtaactgacatccagttatccagttcagggattcattttcccttttttcaatagtgaatgaaattccctttttaaaggcttataatttattgtctaaaactggaactgggacaaattcaaagcaggatgaaaggaagtctccaaaacaatagcattgaaattctcccagggctgtttcaattgtgagaacttagagcacctgaatggctgcatagtggtgaggcagaggactcaagagagtggcaatgtgcccaaatgctgtatttttgtggtggcctcctttgctggat

SEQ ID NO: 1159 - DNA, 600 bp, Bovine  MMBT13728
tctactgtctgagcctctgtcccctggtaaagagtaagccccttgaaaacagaggctgttttatttgttttcacattctgagcacttagaacattgcctgatrcatagaggtaattaatatttggtatgagtacaagtgaatgamtgcatgcaatacaattaactttgcattggcgtggaaattctaatttacctctttaaattttctccatgtgtatttggagtgtttctttctataatagcyttggtcccattctaacatcctaacctgtcccttctgattgttttctakttccattrcctggtaactgctgtctctagcaggacgtggctttctcctggagcaaatattatctgccactgaacactgttttctctactggatcatgtgttctttccttgtggagacaaccaagagtttactatggctgtagtgcaattggcaactgtcagaatcaaaactcattaataaaaaaatgataatgcttcaaagtacattacattactccttcaaaggcctttgtgaacattatcttattaatcatcacaatagctcaggggaagataaacattgttggttatcttacctagatcatattt

SEQ ID NO: 1160 - DNA, 600 bp, Bovine  MMBT13683
actccgtttatccgattatcaccaacatgcataactaagcggcrgattttacgtgtatcaacataagggctgtctccagattttctgcagactctttccctccaggaaatacctggaagagctttctattcatcagaggacacgagcactgctagctgagtgagcaaagcaaagctccggcacttaaaattgtttgcctggagctaagcgtcatccatgaaagaggaaggaggaacaygcctgtgtgtaaaatgaggtttacggctgggacaccctggccaggaaactgacgctggaaartcagtgtcacaccaaataaartgttgtcagataaagagggaaagggcatagtgtcctctgattggccatctcagcgaagacttgccacttctcttggacacgacagtaactagacctggcctgtgggactcacacggtgggtttgagttataaattgtcctgtgaacacattatttcccattaattgtgagcgaaactggaaacgtttcaaggccacaaaattaaagctctgaacctcctagcttcagctttatgtgaccatatggtctccattcacttagaaataaaaccctggaaggc

SEQ ID NO: 1161 - DNA, 598 bp, Bovine  MMBT12630
  misc_feature (1)..(103): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccttcccctgaactgaggggctactttataatctggtcaggcactggcttattcttgaacctcgggtgttcatccaagacgggctggacagtgaaacactggatgtctgcaattcctgtagttaagagctcacaacatgttggtcgggggtggggggcagttccaagcacagcaggtcccagctgagaccygccrccccccaggacagtcctctggggccaagtttttaatgagtgacaaacctcaagatcctaggtcctagtgaccacttagcagtcaccgtggtccttaccagagctgcaaccctgtccgagggctcagcctctgytaacagttggttagtattaatagyccttaatctttgctatactattatcatgaacaagagtaacacstaatgyatttgtagctcttgattgattgcacagaatgtctcccctcrgtctcctttcatctctctagttccactgaccagcactgttaacgttaatca

SEQ ID NO: 1162 - DNA, 600 bp, Bovine  MMBT12420
ggtggttcttgatcattcttccacgatgcatctgatcccctatccctaggggaacaaacaaaggtcaaagggtcaaagtacttattaagattctgttaagtgcttataacctaatagcatggaaaataaaaaagcaaaagacctaagctcaatcttaatttgcaatatataagacaataagagaaaagaataaaggttcatttctctgttctttatttaagaaaatgtgggaaaagcacacatatatattaggagtggagaatcagaatgagaagtcgacaccaygctgtgcagggcaargtggttctgcaattcttcagcagctccaggtgctctgactctgactgatactctcgtaatacctgagctcagctcataaacctccttcagtaaatacctatccaagaccaccatcagacgttcaggtgccaaggacacgaaaagggaatatgaggtatttccttatgtaagacttyacaggttcaacaacagagatcayaacatgaaatgcttcttcctcaattcacctgagaattatcagtgatcctccatgagtaagcaaggcttgttccaagagtgactctcagagcagagggtaga

SEQ ID NO: 1163 - DNA, 598 bp, Bovine  MMBT13407
  misc_feature (1)..(19): n is any nucleotide
nnnnnnnnnnnnnnnnnnntataatgaggagggcaatgaaatggcattccgagagtcaatggaggagaaccctttagttctctcctcagggaatagctgaacaagtgattgttatcagagaacattctccagagttcccagccatgcaggattactcacttcccccctcatcaacacccactactcggtgcacatctctgaaagattttatacacgtgtcacatagacccttccccacatggcaggtacgccgcacgaacacggtcatacgcatctcactaaccagccacccaaacccmrccggctctgctgctaccccagtcagcacaggttagagatcccttcaacaaaaycacagtgagtgttggactcagatgtctctcatctcctccccttcaaaaaccatgttggaccccacttagtctctactctctgctcttgacacacaccagccttaaccctatgcatttacacctttctaaccatcctatttaaggacataattttaagatgtgtgtgcagaggtaattaccagggtgttcttcaagccttagtataatattgaaaacgcaaaacatcttaagtgcctagcattaat

SEQ ID NO: 1164 - DNA, 600 bp, Bovine  MMBT13597
ctttctctttatcacagagaagtttggagataggcagtccagatactcagtaccgtttcttaaactcacagatcactttactgctttggggcctgcacccctacatccttattccttttttctatggagcctgcctctcatctactctggattagtttcttctcaactatcaggtagcaattaaaatatcactcttcagggacatctccctcaactcataatccaagttacatcatccttccttcccttcctggcactcgtctccgtttgacactataggtacacatagtgtgtttgccrtctgtgcccctcactcctggaagacaaggatggcacactcgtttgtttcactttcgtgtattcactcatcaacatggtgcctagcaggaagcacacgcatgaacagttactgaagrgctcagggttaacagttattgagcccttaatctgtgccagacacttttctaagttttacattctcatttaaagctcagactctattaggtagaactttcttttatagatgaagacatggaggaagaggggtgaagttacaaccaaaattcaattcattcttccaatgttccttgcacgcttcat

SEQ ID NO: 1165 - DNA, 600 bp, Bovine  MMBT14127
tcaaccttaatccctagaaatcccgtagagtgtgtcaaattagaactccattcccacaaacacttcttcacgttgctgtgcagtgaattcaatacattccttagaatttaaggctcttaagcatttttgctgaagtrgatcgatgtcctccttgccccctgcttttggctttcctctgcttcttccttcccaccgtactctcctgatatatttcaaatccttatactctacatccccccaaattctattggtttcaatttatgaacgatctctgtaacatggctcccctggagaaggaartggcaacccactccagtattcttgcctgggaaatcccaygaacagaggagcctggcgggctatagtccatggagtcacaaagagttggatacgactcagcgactaaaacaacaatgacaacaataayatggccatcccctcttttatacaaaacctgatgttttggctttgkatgctgtaaaacttggacaccaagaartatgcagaaatccaaagtctaacaacaaaaaaagttactagatgcggatatatagtatgctcttctgttggttatgaaagtaaattatttccttttctttg

SEQ ID NO: 1166 - DNA, 600 bp, Bovine  MMBT13949
cagtcttctctttgaaagctgtcaagagcttctcgtggcatctcagccagagtccaggtaccttctcaggatctgcatggccctgcctgtctcatccctttcccctctgccagatgagcgccaccagggtggccattctgaacacaccctgcgtgttccgagtctttgcgtattctgttccctctgcctggaaccggcaactcttcccctacctggagtaaaccctcygatttcaccattgcttcctgctgatcactgggtgtctgctcccctgtcctgtcctcagagaggccttccccraccgccttgggggtgggtgagtctccagcagctgtgctttaccttcctggcaccgaccaggartctggtttgtatactatggattgcctgagcctcctgcttggctgtgggcaccactagggcaggggtcctgccttttttctctgctgttcaatacccattgcccagatccagggtcatagcagacattcaatacaaactcgttcaaggatcgagtgaattagagaaaaaataagctttgggaacgcagagaacacagaggactgtgtacaagaggctgacgttcactgaagcaactat

SEQ ID NO: 1167 - DNA, 600 bp, Bovine  MMBT11637
ggcattgaggaaggtcaaatccattagacacccagggagctgcctaccttgagtcagctgcagtgcttcctgctgtagtcactcaggtgccctgaggcacctgcatcccaagcagtgctggcacctggcagggggaagagagagggcttcacactggaagttgctcagaagtgaygtttatcactcaccacccatctttcagaaattatcacattgcactgatcacatgaaactggtagggccaaaaaatacagcccactctgtgtccggaaggaaggagaatcagaaatattccagggrcagcaccaggggccatagtgagtcctactgagagagaaaacaaattgtcatattgctctcttcccttcaagaaatggagrtggaagaaagttctygatggmtgttatcagggctcattccatacaaaggaaagctcagagctgagtggaaagaactmagctcatttattttgcttaataaaggaagtgaaatacaaaggtgagaaattcttgagggagagaagctaagcctcctgtgtgtgagtaaatgacttctacaaagagagaggaagagagagacatctaatagttaaaactgctg

SEQ ID NO: 1168 - DNA, 600 bp, Bovine  MMBT12196
gggctctctctacctaacaggctttcccaggactgaggcaagcctctcttgagtattcctctcagtrccccagaagtaagaggttttccagtcatgttggtgggaacaggaactattctcaattctrttatgagctctgaggattgttccttttgatcatttcaagtggttctctcctggccttgagtaatttcttcacaagcatatgccagtcattactcaagggagctctcacggggagctcggcaagtctccagctcactttctcygtgcagccctcttttctggtaccctgccctrtgaagtctaaccaccttggcctccctggacttgcagctccatctcctcaattcagagagaacgctgggggccgcctgggtccccctccctggacgatccccacacgggagacaatcttacagatcaccacctgtttcctctctttcaagcattatggtctttctttccttgggyttttgrttgkttttttttttacctttctaatcactgacctatttatttattttttgaactctttattgttggagtatagccaattaacaatgttgtgaaagtatcaggtggacggcaaagggactc

SEQ ID NO: 1169 - DNA, 600 bp, Bovine  MMBT13838
tattttattgtactcaaacttcacaatgactctcccgtttttgtgacagaagacacaggctccaagaggttacagactcgcccaagtttgcaccgcacataacgaaattaaaatttagtccttggtgattcttcaagctcttggcagttttagggtggaaattccctgacatagcacgagcagaaaaacactctccaacacggatatcgacacaaagccactgcgggcatggacccaatgtcacgtgtagatccaccgtgcatttccagtgctcagagggttgtaacttgatcctcttcrgtgaggacaaccccgcaggcattatcagggctgagcgggtatcagaggcccctgggccagcagtcccttgrctgacttccagcccataaattgtcctaaatggcctcctggttttggctgttggtggagggtgggagatggagaggccctgagaggcagtatctttcccatctgttccacattatgatgctgttaaatatttcatgctctccattgtcccaacaaacacaaacagaactaatctctgtgcttaagcttccttgactgacattgctggtgattaaacaacgtacttatttt

SEQ ID NO: 1170 - DNA, 600 bp, Bovine  MMBT11502
ttccaagaacccagcagtgcctccttggagggtgacccctgggagccaagactggtctaggatatgctgcaaattatccaaaggtttatagcagctttggcggcatgacaggtatacagaggagctcaaaatcttaaaaatccatctgggtaaataaaaccaagttcttctgcagctctacattttaattcaacctgaagtttctgaacagtgctgggtcacgagcctgacctgtcatcagtggacagctttgatgacaatccattcaacttgtctcctgggaggagggtgtgcttgccrtgtgcagtgaggcagggaagagaggctcctgcagccaagacccaggcagacttggaytcggccatccatcttcctgctcccgacacagttaagagctgaatttggtccagctttcttaagaacttagctcaccctgggttaaagcttgggcrctgggcccttcaggaatcccaggggattctagatcaacttcattctctctaaggtaaagcctagggctgatgtgatccagtgtgtttctgaagctccaggcatcacatccccaatatgacagtttascaagtagaaaggaaggggcta

SEQ ID NO: 1171 - DNA, 600 bp, Bovine  MMBT12873
agaacctggtcctgggaggactcacttggcgcagtagaggaagtggtccctccagtccacctgggcggtctgccctgacagcgtctggttggctgtgagcagcagctgagtgcggttgttctggaagtactgcaggaggctgttgacgcagcagtcrgacagactggcgttatgtgggttgaggggggcgtagcaggtgtcccgcagggagacgttccgctgctcctctggcgaccacacctgcagatgccgcagcctctcctgcaattccagcacctcyagcagcagatccgaggacargatcccgctgaagttcttgggccccagcagcagggagtcatacctatagctgggccggtgaggtgctgtcatgaacacctggctggttcggaagaaggggccgaaatacttgtcgtggaacgccttctcacgtcgggctaggctgttgggggctgaccacaactccacggggtccgtggtcagttctataaaagccaggccccctgccagggccaccaccacaatcacagataccgccaggatggtcagtggccatgaggccacccaagtgccccagcactggaagcagcggctgaggag

SEQ ID NO: 1172 - DNA, 600 bp, Bovine  MMBT12058
ctgaacacaggcccaggaagacctcaaagacatttttgcaaaaaaaagaagtaacacagagcccttatatttcaggagaaaagagttcctcctggtttgtcaacatttcacagatctatgcaatcacacttaggtaccaaaataacagagcaatggaaatagaagtgctgaattgtaaccaagacagaaagtctccatgctttaaatactggacactgaacaacttctgcctgtaattcctcagctcagatacgaggaaatggtcaatccagtgtgggtgtgttgagacagatgtggaarcagggtcttcactttgaggaagtgagaggaacacagaaccagggcagtagaggaggaggaggtcccagagcagaccttggcttccctctcaaacagatgcagcttctccttaasaaaaggggtgaggaggagccactcggttaagaggaggaaccacttaactagccactagtttaggagccacttaactcccaggggagttcgtctacatatattttgtaatttgcctgcatctatttatgtattttttataagtactttttagaaagtacttaattaaatcatttcgttttggctgcc

SEQ ID NO: 1173 - DNA, 600 bp, Bovine  MMBT12938
aagatgaaccagatgtcaagggagcaggtctacaggcagggaagtcacagaaacggcagctgggccccaggaatgtgcactggatactgaggtggaggttgcctgaatgtgtgctccttgcatgccagaggcccgcccctggggtgcggagaatacaagatgctgggctctggcccccaagtccatgggctccacaggtgtgttctgaggcccagatatgcacactttttgaaagttcccttagtgactctaatcatcagctgggtttaagaatacctygtatgtttctcagagaggcarccaagctcagaccaagyaggcccactgggtacccctagaacccagaacaatggcaggtgggagctggggcagggctgatgatgactgtaggagaggttcctgtgcccactgaggaatgaggtagacatgggagagaatgcacttcaacagggtccctamaccctaaagacatccttagaaggcctttgaggttgtcagtagaaaacatgcaatcagyaggttcatcctgcctaaggagaagtgacagctttgggaaagaccagatgacaaactagaaaacagagctgcagtggcatagct

SEQ ID NO: 1174 - DNA, 600 bp, Bovine  MMBT13066
gtgatggctataaagggagtgaccaggagcagcggagccacctgtccctcccatatccaatatatgtgcttcacagaaaaacaaaaaaacaggtccacaaaacacaacagctaaaattacaaaaatccattcatccaagggcggtgggaggcagaaagggtaaatggaagggaaatggcacagggagaaaragtattcaaatcagtccaggcacggggctggcaaatgctagaaaagagctgcagaaaaacctgtggtcctttcagactcaccagtgtttaaaatccatactggtcgcargaagattctgccttacgtgcaccagagacaaaaatctggattcctcagagagaagggaatgtgggcagggcccttggcagggtgggccctgccttccctgggagaggtggaggtgaaccagagaagagccgccacagcatccttccgatcccacccggcccctccagatggcgggtgaccaactcagcggcctgtggcagccttcagtttggcaggagacgggtgtggcgagggtaatttttctgcagaagtggagctgctcagggccgactgtaggtagaccgtcttatggaagagtct

SEQ ID NO: 1175 - DNA, 600 bp, Bovine  MMBT14285
cttcacagtctgtgtttgtatctagcaggtactgtccttcaccccctraagcaggtccaaactggagggcacgtctcctggtcagcctgtctgctttgaggcactcaggtcagtggtagctttttatctttggggaaacaggagattgaatcccgtgagcttggtctgtaatacgtcttttccatctgtcaggtcacgtgcattctttctgtcccgcccagggcagcctgtctgtgggtgcacaggggtcagcgagcccctgatggcccttcagccttcccaagccgtggccsaggcgcrtttaacaggacatgagaagcccttctgggacactcgagccttccagtgtgtgtggtgttttttaaaggatttactgttatgaayctgttagagtaaatattactaattataggtaaatagtataaaattaaaccaatattttgaaaacttatcttaaaaagtgattagaactgcttttaggtagagcacttttgtgtttgaataggcttttgcgttagtgtggaattccccggccccgggatctgctgagattgtgggttttggtcccgttccagatccttccacaaacaagaggccgtt

SEQ ID NO: 1176 - DNA, 600 bp, Bovine  MMBT12955
tatatgcatatttaaatgctaaaatkatacttatttttattgtatactgcaagtaaaacaatacgacagcatatattgtttcctctaaatccagtcttactgccagacctacctaatttcaagggccaatagagtatccatcttcaattctccccacattcctacatatagaaatgtacaaagtcagggttatttttagaaaattgaaaactgatgctaagcatattttacattttaattttcaacacatgctcctcttaaaaaatmattgaaatgtagataattcatttaatatttgtrtaaacattcatggtatggatatattaatatttactcaaaattttcccttattaatgagaatttactctttttgtttttktcattttttgtataaaaatgtggtttaaataataacccttaaattcatcttaaagyactgctacattagtatctaaagtgtacattctctaaatgagatcgttgtgtcaaaaattatgtgtatcttaaagtttctcatagttttacccagtgtgtacgtgctcagtcacttcagttgtgtctgactctttgtgactgcctggactgtagcccacaaggctc

SEQ ID NO: 1177 - DNA, 600 bp, Bovine  MMBT11674
cttgaaggaactctctaacacttcttgttgggcgggtttagttaaataatttctccggcttttctttgtgggaatgtcttaatttctccttcaattttgaaagacagctttgtcatatatggaattcttgtgttttttttttttttttttttactttcaatgctttaaatgtatcagccttgtaacctrcaacattgctgctgagaaatctgctgaaaatctcactgaggatccctgtgcagcacagtcacttttctcttactgctttcaagattctctttttgtctttaactttcatcrgtttgactatgtctgtggactcaatctacttggaatttgttgaaatttttgcattacacctcatctctttcctcaaatygggggactttttaaccattatttcttcaaataagcttcctaccctttctcttccaatctctctgtcccttcttatgggttcccgtaatgtgtrttattsgtcctttggttggtgtctcatgtctcttaagctctcttcactttttttaattctttttttttttaatctttttgttcctcagacactatmatttcaaattatctgtttctaagttcatttat

SEQ ID NO: 1178 - DNA, 600 bp, Bovine  MMBT12984
ggggacaggttgcaaaagtgatccaaagctgccatctgggtgctggaaagactggaggtgattggrgatgggaatatttctggcactgggggtgcgggggtgatgaamagcagmctggggggtacaagaggggggccacaggatgattctgcaaatctcaggctatagatttttcagtgctcaccaattctgaatttttaatgttgaaagtttcttgattaggcataaacccacaacttcctgctcaaaaccacacacacgcatttagcaaagcctcttaaaaatttaaaaattaccaarctctacatttgagagtttttgactgtcaacttagggacgtcagctatgattctcttttgtactgtgatatgaacattgtcgggatttgtctgggcttggaagccaaatttttttcagttgttctttctaacattaggctaaatcatatgcatttataacataaataaactgcaccctcaaactccatttaataaaggccagtgcatacaaggaaggattgctgagttagacatttgttctggcttgaattgtatccccctaaaagatgtgttgaaatcgtaactccacagttcctcagat

SEQ ID NO: 1179 - DNA, 600 bp, Bovine  MMBT12282
tgattcattggaaaagaccctggtgcagggaaagattgaaggcaggaggaaaagaggacaacagaggatgagatggtcagatggcatcatcaactcaacggacatgtgtttaagcaagctctgggagatagtgatggacagggaagcctggcgtgctgcagtccatgggttcacaaagaggaggacccgactgagggactgatttgaactgaactgagggcttgtcatatttgtctttgtgactttctctctcttatctgtacctgtccattacctagctcactgcctggcatgttacargggttcattaaatgttcaccaatggaaatattaaaatagaacttcacagaaagaactgaacattcctgctatttcatgagatgtttattttcttgagatggagccagcacaattatctatactagcatttctcaaagtgcattccttgcttcagcagcttcacaagactctatgtgataaagaagatcctatgaacagaaaaatttgggaaatcctccctccacagataagaaatgtcctgggagctccctgaatatgatcgccctggcgtcctgatatacctctgaagcaggttgacct

SEQ ID NO: 1180 - DNA, 600 bp, Bovine  MMBT12871
gactgttgcgtttatttctcagaatccatggaaattactactataagcagtaataactcattataaataaataataaataaatgtttttaaaaattgcacactaaaataaatgggagtgtccagccatgcaaacacatttctgtattcagaaacygggcctttggtgaacatagatgttcaggtagttctacataaaagtttcaaaacttctgtttcaaaaacaaaaccaaacatcttctgctccttgttccacacaggagaaaatgtcccacggagagcggattcatccttggagaagrtttgctgcttaccttttgctaccagtagaattcctgagtaattggagtcaggagttttttttttttttctttccttggagcttctgatcaaagctgtttccatccaaatgaaggcaggatggagctctgggaggccagtgctcagaggccaggaggggggtgggcagctttttcagttcaggagatagaagcttcctccagggatttttaaaaagcccttttgaatgggctcattgtttataagaacagctccttaatggaaaaacaaaaaggcaagagggtctggagcacgctttctgc

SEQ ID NO: 1181 - DNA, 600 bp, Bovine  MMBT11791
tggtaaatggatactacagtggcaagatgttgttaggggtgagatgttagctctgcctatgaattaatttgagctagctcctcttcacgtccagattcttcactakgaaaatcagccatatttttttttctgattttgcactaatctgggatctaccacagctgacatcatctgcacttagcttatcatcagccatgtgccctttgtggtactgaagctgaatttagtgatgctggattgccaagaagcaaataattcatttccagttstctcccaagaaagtgattcctaagatgcttrtgctatttgggcagcattcatttcctctgaaatatgttctggatcttcagagtgtgaataggcatgtagcatttgtatttgattatctgttgatgacattgactgttaaaaagcaggtcttttcctgtttcattgcttgctaataggccttgggaattcccttaagcaaaggtctgcttgactttctgtttcaaagatctgtatcacaactacttttaagaggattttgaccatgatcttgtttaagggcttcagttctgcgagggcttctgattgacctcttggcagagctgccagctg

SEQ ID NO: 1182 - DNA, 600 bp, Bovine  MMBT13097
tagttaatttttctaccttgccaatttaatgtctctgccttttccatgkcccctaattcagtgccacttcttcctgctgcagtgggttagttattcctagactacagatattcataaaagtatggttcagatacaaagtcattatattcttaatttaaattgttaagtatacctttatttactttttattttgaaattattagagattcttaggtggttgcagagtaaagaagtctcatgtacccttcacscagtttctaccagtggttacgtcacatataactatagtaccatttcaargccaggaatttgacattggtacagtacacatatgtagtttgtagttctgtttcactttatcttgtgtaaatttctgtggctatgatagcagtcaagatacagcactattctatcacaacaaagataccacttatactatccctgcatagtcatgttcaccttccctccatcgtccctaaccgctgtcaaccagtaatctgtttttcttttctataattttgttgttttgacaatggactcatacaatgtatgatattttgagattggctttgttcatttagcataaggcctttgagatcc

SEQ ID NO: 1183 - DNA, 598 bp, Bovine  MMBT13114
  misc_feature (1)..(109): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatgccatggtgttttgttttgttttgtttttaatcaatgaaaaaactccacttgggagattatggccaagagggtgactttggaggttgtgactaaataactaagagtttgatcggataatatttaaagatgtttaggtttgcagaagcctaaggagtgaaagaaaaaaagactccataaaacttaraggtcttcagaactagatggaaaaggcatttccatatcctaacaaccagagaaatgstccatccaacagagatgtggggataggaacttgatggctcctgttagattgctctgtccttttctttctgttttattacatattatatttaaatctagttaaatttactttttcccagttttattcagataataattatacagtgatatataacacaatatgtagtgacatataacaccatacaagtttagagggtcaagcataaggatttgactttcatataggcagaaaccaacatagt

SEQ ID NO: 1184 - DNA, 600 bp, Bovine  MMBT12189
gcttatactctgacgcttgatggatttctggcttcaaatgttttatcaagacaatccaccttgtagccatctccaaagaagactgtgtggctctattaagtctgcaatttgctttttaaaagtgactaaatatgctttttcacaacaacgacaagtcatctccctcctggagccaacagagtttgtcacccagcttcaccggctkttcaaagccagccatcaaaaagcaaaggaaatgtcatgactttggagcggtcagaagctcttaagtcgcagtgcaggctatttctccttttgtgrcacagaaaagagtggacagacacaatgaataaataatcccattgtactyacacacgagtaacaatccttcaaaatgaggtgaggaacaaagataggagatagcggtgcagccctggtcttaacagaacagcttgcaattccagggcctaaactgcttttgcaaacaaacacacatgcggtgaccctgagaaaataaaatttaaaaatggcatccgattcagaatgccaataggctcagcctaaatggccttctgcataattcactttggacatcttcaggctccgtggctaaaaggcagt

SEQ ID NO: 1185 - DNA, 600 bp, Bovine  MMBT13170
atcaagatttcaatagaaaccaaagatgaaagcattcatgcataaaaggcaactgtgataattatgatgtgcagacaagataatggaaaatatacgaggctgcttttcatattatgtatcaagtgctgccttgacctagacatcctataaggctccctcacatttactgcattattttatcattttaattgtttaccagaattcaattaatttgtctgacatctgctcaggagatagaaatcctccactgtcttatagggtctttcccctgaatcatttctcaaaataatgctgcaaaarttttcaataaacacgcaattgagtctaaagttccttttcaaccttcaagtttattaatctcttactgattaagctaatggcatccatttttctggaatgtcattttcaggcagtttatatcaaagtgtatacagacagtttacagcaaaaaatttaacatgtgattccataccgcaaagtttacattgctccatttgaaaacttctggggcagtgaggtgaacagaaaatggtagaataattatcacagagaacagaagagtccacagcatatagatttagcacaaagttcactgcctgt

SEQ ID NO: 1186 - DNA, 600 bp, Bovine  MMBT13183
aaaatatgttttggagattatgaataattagcacccatttaacaaatacaacttgatattcagtatgtaataatacaacataaataaaagcaattattacttcaattatttaaaattatctcaactgccattaaaaatacaaataaaacagttacatactgatcacttgtcattttaatcataaaccatcattccttagataagctgaaaaaaaatatttattcaacacacaattactgaggacctactatgtgccaataagcaactcaggaggtacacaaamaaagcatggtcactgcrttcagctctcaggaagcttaaggactaaagaagattaggtaagtgtgaaataaatgttctagctctaaaatatctgtaacaacatattatggaagascagagaaaagagtaattattttcrcctttaaaaggctttaaaaggtgtcccaacagaacagyrttggaatttaacaaaaacagaaggaaaatacacagtttacrtttgactgtcaataaattacaaccagtattactgttcacaggcacttcacaagttctatttcacctaattatctcaacaacccttaggaccagtgttca

SEQ ID NO: 1187 - DNA, 600 bp, Bovine  MMBT06947
ctatgtcacctctgtcaaagtctccatctcttcctggttcaactgccagggtcactgtcatggacaagcccagcaatgcatgagctttcccctcgtttaggtccctggagcagtttatggcagccaggatacctgaagatctttgagcctgtcttgtgaggagatgacctccatcaattccaggatctattccaagccttcaataattttttttagtcacggagatgacattttttggctctaaaaagttcttttctgggtcttctctgtcctttacgactggcagctctttggggctgmaaaacaatgctatccgtatactgtctggccagatggaagggctaattccccaggcaatggctccagccacaccttctgtatgtttcagttcaagcgaagcctttggctcagatctccaaaagcacatccttctagattcactccttgttctcaatacgaggtgtattccatgaactcccctctcactgcatgtcatgtcctggtgggctggatcataggatcgtgcattttgtgcaatgaacaaaggcaggccaggatggggcctggtgcctgcctggcaagctgtgccccggtgagggc

SEQ ID NO: 1188 - DNA, 600 bp, Bovine  MMBT06696
tgatagtaactgaactgtgaacaagatttttcatacacttaggtattttctcayatttcaaatcccattagtaccttkgttgttctttggataaattaaatccttctatgttcacaatscatcacacttcaagaaagactttggcatggattattatttgttcttcacagtaacttctgtaggaagctacagaatgcattattattccttctctaatccactggcatcccctagaggaggttcagaaagctgaaactcacattccagttctgactctgaacctgggaacttttcctcccmmaaaaaycagttcttttccatttccccccattattttgctaataatcaccaacttaatcatcctggacataaatgttagaaatatacagactagtgcgtgcatgtgcactaagttgccacagttgtctccagctctttgtgaccctatggaccacagcctgccaggctcctctgtccatggggttctccaggcaagaatactggagtgggttgctatcccctcctctatggaatcttcctgacccagggattgaacccacatcaatagttgataatcaatcaagtctaagaagcacagag

SEQ ID NO: 1189 - DNA, 598 bp, Bovine  MMBT13411
accccatctgggtcccacatccaaaacaaatttcctgcrgtcctcagcctcctgtgggccagctttccagcacccagctgcgagcctgctgggtttcctgtcctggttgttctttggagagctggctgccagtccccgcaggaggggaggcgtgggagggccagggcacctggcccagagatctgggagaaatccggagggtgtggagtgtgttctctctccctctctctccttcgatttctcttgctctctttcagactcaaatgctaagccactggccatccctccctgccaggcccmaaaaccctcccmaaccctcaagaaaycccatcaactgagcaaatctccaggtgagaggcacctggctatttgccaccctccctaggggcaacccgtggtggggacattttgatgccaaaatgcgcagagctagcaaaaacaggactattattaggcttcccccagcgtcgcagtcaccagccacatgactcaaccctttgatgtcacagtgggggcttctgcccagctctcactaatatggtatttctgcaaatgctggcccactggcacgtactatcattgtgctctcagcaattat

SEQ ID NO: 1190 - DNA, 600 bp, Bovine  MMBT13356
tggaggaagaaatagcaacccactccagtattcttgctgggatcatcccgtggccagagaagtctggcaggctacagtccatgcaattgcagagtcagacacaattgaattgagcacataaacatactctcaggctccaaacctttgtatttcctgacactgggttccagaggtggccttaaagggtggagcagaaggataatctcccttctggtccagggagggctcctccaaggacagagactcaggtgaggagctaggagaggaggaagatgttcagtgggaggcagggcaccccgmaatccagaggcaggaatgtgcttggtgtkaggtgaggaggaccacagargagccagagcrggtggtgacggggacagggagcctggccgaaggtggcctggtggctgctcttcctgggcagctggagaaggcactggccctgagcccagagcagggagtgaagaaggaagtcagccactggctctctgcctgtgccttgatcctcaccgtggagcccagcattcccattttgaaacccgtggagcggtagttggcattaaaaaaaaaatgtaaatctgacagaagactctctcgtcaggg

SEQ ID NO: 1191 - DNA, 600 bp, Bovine  MMBT14088
atattttaactgttagaattatatccagagtcattgtgatataatctaattttgtaagaaacatgacactgggtgtttttttttaatcatgataaatgtgcacataacataaaacttaccattggtgacatttagcgcattcagagtgttatgactgtcaccaggatctaatgccagaacactttcctcacctcaaaagggaaacctcattcccattaagcagtcattcctcactccctcctctccccagcccctagtacccactaatctgctttctgtctccatggacttgctgactskggatatttcacataaacggaatcataggatatgtggtctttggtgaccggcttctctcactgagcgtacataatgttttcaaagtctgtccctgtcgtagcctgtgtcagcatttcattcctgttcatgcrtttctgttttaaattgtactctttggctcagaaatcttgcatggctctgcattgcctgtccaggagaagtccaagctcttccacatggcatttgctcttctgcagaatcccgctgcccatcttacctgcaccaacccactctgctttcttagttctacacctctgccta

SEQ ID NO: 1192 - DNA, 600 bp, Bovine  MMBT14136
tgtgacacttgcccttcaaacctaaaattaagacaagattcagctcaaaactaaatgttcccaaaccatggcctgggcgcttaacaaggaggaaatgctgtggattcttattgccgtagcagaaggtcagattcctgataggctgatcagagatgtgttttgaattgtccactttatcatcatataatatctaacttcgtagtttcacttggcaagttctgatgagtagagcatggtgctaatgagatccagggagtgtcggccaaacggcctttaacctaagtggtataattctgactkgatatcagaattacgggtccagtcatcacccagatcagttgcttcatatgaaccattatccagtggccaaaaatacagccctgaccctggagctgtcatttgcagccrtgtcctttgtgacaaaggagagctgagagcacgtctacataaaacatgcttatcaccactttaggaaaaagcagttcacttacggccatagragatattcaatagcattaacctcccaggtttatatgagctcatctgagtggtaaacattcttttttaawggagaatattttaataaaatgttgcaaaagt

SEQ ID NO: 1193 - DNA, 600 bp, Bovine  MMBT13865
agtcttcccacatgtcctgttttctaaccttatgagctcataattctacagcttttcccctgccttgatcttgcaaaacaagattctttggctattgtctctctctaatgcctggaaggatttgccctgaggtgtctgaaatatgagactttttatccacaagtctaacaatctgaaattgaaacagacccagagaggcagggtgctggcaggaatgaagggcagggcaatgtccagtaaagtcagagtagacacgggccaagaaagcttgcctctcctgctcccagctccaagccatckccctctcctccacaagtgctgccagggacactgtcaacacctggaccaaactgatacatgacacagtgagcctgacaagacagcctgggccacgkgtatcactcttccccacccccactgcaggaccactgacacagctcttacctgggagagtcacaaacccttgctgtcccccaagaaaaagacaggacctgagtaaggaaggagagaaacaaggaccatggcatgtggacaaggaggactctggcatggtgcagaggttcttgctagccacacactaggatcggcagtggagcttat

SEQ ID NO: 1194 - DNA, 600 bp, Bovine  MMBT13937
tacagtggataagaatctacctgccaatgcaggggacacaggttcaattcctggtctgggaagattctacgtccccaggggcaactaatgccggcactctagagccctcgagccggtatgcctagagcctgtgctccgctgcaacaagagaagccaacaaagagtagcccccactctcagcaattagagaaagcccgtgtgcaacaatgaagacccagtgcaatgaaaaataaattttaaaaaaccctccaagcttccattgcacaggggtgtgagtttgatccctggtcaggaactagkttcccatggttcaagccaaaaaaataaaagcaaacatgactcagagcagaaatcctagaagccaggtcagaaattcccctggaaagatccagtcgttgttatccagaggccaagaaaacacacccatgcgtgtaccaagcccctcctgctggcccaccccactcactggagagttatacaggatgatcccaatcagtagtaaattaatacagacatgacagaaaaaaggggcactaaaataaaagtgtttatttcctctaggtagtgggaggtatttttttaaatataggtgattttatt

SEQ ID NO: 1195 - DNA, 600 bp, Bovine  MMBT13017
tggtatgcattcccagttcaggcgttgatgttttcccaaaggctcaggaccttccaagtcctaagctccacctagacctcgaagatactactcccccccgccaacatcattcctttattaatctggtttcaatttatcaaatactcaattcacagcttatctatgggaacaaatggccttcccgctttaatatttcggtttaatatccctttctgcaagccaggagatgaaatttcagccaagcctacaaagagaggaattgtcagggggatcctttcctggggatcacccagccgtccktctgtccatccatccgtctgtcaacgtaagtgcggggatggggcgcctttgtggctcttctatgggtttgcggccgccacggggcccagacagagcaggagaagtgactgccagacctaaagcttggcacgaagaaccagctgtcagccagataatgcactgggccagcgacatgaaacccaatcattaagtgttggggggattggtcagagagagagaaagactctttgtcccaagtgtgtggagcagatgacggcggagtgcgggagaagggctgtgactcacgaagccacgaggttt

SEQ ID NO: 1196 - DNA, 600 bp, Bovine  MMBT12858
aaacactggtacactctctctctctttttttttaaacaactgtataatctcctggagctctcctagtgtctcagtagtaaagaacccacctgcagatgcaggagatgtgggttcaatccctggatcaagaagatcccttggagaaagaagtggcaacccactctagtattcttgctttggaaatcccatggacagagaagcctggcagtctacagtccatggggtcatagaagaatcagatacaacttatcaactagacaacaacaacaatcatctcctaattggcttagaactaaacakaaaatgcagaagccacagccatcaactgtgtatgatacaaagctagtagagggtattaatacactgggtgaggaaccagtatccaaaaaatcttggcagactagcatcaaggaatccaataagagaaatttaatgaggggtcaatgtaacatattatgcttggttaacataaacaaaagcaaagcacaaaaatacaccagcactgtccagtgaaaattcaggggagatgtagcttgttagttacatatatatcagaggatgtagggatttcatgtgactttgtaaagcacagctatgtaa

SEQ ID NO: 1197 - DNA, 600 bp, Bovine  MMBT12433
tgtgatggctgccagtggagcagctttcagacagactttagggattctgttttggacatgatgactctgagctgtttctaagatactcaaatagtgctgtcctgactattgaatatatgaatctggacttcaggagagaagcctggatcagagataaagattttggagttaccatatcttctgggcagaattgtgccctgctcccaatttatatgttgaagccctaactgctagtactcagaattatgactgcattcctaagtgatgaataccaagaacgctttttgttctaatgtttgktcttcagccctgtgcctgatgcaaagctcctaagcctctttgcgtatcctaggtgacagtagtgtcttttgtttgaatgaggtgactttgggtgggctcctgcatgggggctggtccccagaaagaacaagatatggttagaactctgaattttcagcccctcctcttcattccctggagaggggagaggggctataaatggagttaataatggatcatgcctacttgaggatgccccgaaaaaatcccaatagtatggggttcagagagcttccaggtcagtgaatgtttctagtacca

SEQ ID NO: 1198 - DNA, 600 bp, Bovine  MMBT11453
tgaatatgccaagtcagtaaaaaattctcctgaaattagtgtaaattgaatctgaaccttgatcatctctgaaaccttaaatttttaatttgaccctttaaaaaaattttgtggcctcttaaaaatacaacctacaacccagttaaagttacactgtcatgattatggaaagaaccaattttgagttaccacagggaaataagtcaggtgtgtgggaatatctgtgtatatagtagtgtgtgttacttatatgtgtacacgtatgtatatatgtaagtgtttagtatagacttcagtttkcttttacccatctctctcctctctgcctcaggaaatggggcacattttcttcagttgaaaacagaaatagaagcgacggtcttgacccactttacacttatttatttcaggctctcaccacacacttgttcatgggcgcggcgagaagagggagccacagagccggagccgggagggctgccgctggagtgagagctggcagaactcgtagggagagcacggccatgctgccagcgccatgtctggcttcaagacaattctattagtgaattaattgtactcaaaacccgacattaattt

SEQ ID NO: 1199 - DNA, 599 bp, Bovine  MMBT13068
  misc_feature (1)..(4): n is any nucleotide
nnnnctgaatgagcagctgactaaagacctctcccacatgcaaggtctcacaattttacttctgtgcaccttttctcagggaactacttgagggtttactccaccaaaagcgagtatataaaccaaagaagaagaaaaagaaaacacaggatccaggaaatcagtacaatacagagacaaagggcaaagctgatggggagtaaagatcacaagcagactggagcagctctgaagatccaaagacaataaagtaaatgaatatctgtgtttgaatggactgaaagaatacttccataatttkaagagagtctggatttaacttaatgatgagtacagagaaaacaaagmaaataaaacagaaagtttattagcctttaggggtcatgaaatactgggcagcacaagaaaagccaattttcataagaaatgattcagttcaaaatagccttgtagagttctaatgatgttatatagtatgttgatctaatcagagctataacataaaaatgatgaaaggagtagagaaagaattatgactatatatatatatagacatatatatatatatattatgactatagagaacaggaacaggagtg

SEQ ID NO: 1200 - DNA, 600 bp, Bovine  MMBT13185
gctaaaaagaaagatgaggttaagtgtagtatgaataatctaaggattatttataccataatttacctttattagtaaagttaaattaaaattgacagaaacatatctttaaggattctttagtgatattcttaaaatattctttaagggtatctttaaacatatctttaaataactcaacacatgttttcatctttaataaaatttataatcaccttgagtttacactgcaattgcttcatttccaaatccatgctccttgaagggccaagtgatgtaatctgtatccgtggaactgtkacctgggcaacttcttcagtcaaacatgtgatttcagatgaagactctactctctttagtaaatcttctttttctttttgaagctcagccaaatccgaatttagcttctttttaaagaaaataartataaatttgttataaaagcaattacagttaacctaacaactatcatgtcaacaaaggtccatctagtcacagctatggtttttccagtagtcaggtatggatgtgagagttggactataaagaaagctgagyacagaattattgatgcttttcaactgtggtgttagagaagac

SEQ ID NO: 1201 - DNA, 600 bp, Bovine  MMBT11871
tgggatttttcaggcaagaatactggagtgggtcgccattccctcctccagggtatctttccaacacagtgaccgaaacctgcatctcctatgtctcctgcattgcaggcagattcttgacccactgagccatcgggactatagcctccaatagcacaaatccactctagtcttttgaaaccagagtttaaaagttttggtgttgatgggaatatgagtmcctgattagaaactttctgtccaaataaatcaaagcctaaggtggggaacaatatggaaatacacttctcctttgrtggkaacaaagatactaatgttacttcagctccctttggagaaaataggccttgaattattctccaaaactcactgaaataatcagccttgttggaacaataagggaaaggaagaaagaactagtcttccagggaaaatagtggctccttcgtgccccatgtgagctgaagtagcttggctcwtcttagctctggggtgatttgtgagagcttttggcttaacacattatctctgaaatatcaccaagagtcagagaatccctgaacagtgggcaataatctgcttggagttttgaaaatattt

SEQ ID NO: 1202 - DNA, 600 bp, Bovine  MMBT16787
tatctcatatttactaggtagagggccctaggggaataacataacctctcaatttcatctgtaaaaaggaaatgtgtacgctatagagttgttgatgcaagggttaaatcagataatgcatgtgaattacttaacacataacagtatatagaaatatacccaataagtactaattccatcataatcatgagtaacaaaccagttgctggtttttgaggatttgagcatttgaggattccagggaaaagaatggatttatgcatatcatgaggcaaggtgaacagctgccctatccaatgwacctactggaccccagtttcctgaaggatgatatctrtctgtcctcttttcttttcctactaatcatttcctccaagcccccacccccacccagctggttcaggcttcagaagactcttcgggatctttctgcctttcccttggtctccaggcgcagtgtgtggggtgtgcccagtaccttaacacctcgctgttcgctgcagcatccccagccggctgacagatacgatgacttcagccttaagctcgcttaacgagtatcctcattggctttcatycccaagggcttttttttttttt

SEQ ID NO: 1203 - DNA, 598 bp, Bovine  MMBT16873
  misc_feature (1)..(68): n is any nucleotide
nnnnnnnnnnnnnnnnnnnnnnnnnnnnnnnnnnnnnnnnnnnnnnnnnnnnnnnnnnnnnnnnnnnnttttaaaaactccaatgaatcccttgtattaacttctttgcctttaaactcagcttacattaaatgaaaatattttgaaattgtcataacccaggctataaattaagatcctacctttggtcggtgccatctgcagaattgcaacagactggctagactgcagaagggtagctgtgtctccttggctgtattatactcaagcaggcatcattcacaacacacaacagagagwgaagggcttctgctagacgtaccctcctgacsctcagattacatgatttaacgtgtgtatgtgtgtattatgtcagacatgcacatatatttaaacatacaatatagatttctgcctatacctaactgaaatgattatagtttttttttttttttttccagagtccatgattttgaagaaatgtgacattatttctagggaggtgaggaggggaggtttcttgcctctttcactgtcccagtgaaaatctcgctcggaacaatacatcttctgtgaaacactcggcacagaaagtcgt

SEQ ID NO: 1204 - DNA, 600 bp, Bovine  MMBT17997
gccctatctccaaatgaaatcactttgagaattagggcttcaacatataaatgtggtgggggaggggctcaattcagtccacagcaaacccttgccaatgttttcttcaattctgtgagttgccatttcactctgctgattgtgggttctctgatgcatggaagtgtttaattttttaaaaaattattttctatttgcttgactttttgtctgcattgggtcttcactgctgtgcataggctttctctagttgcagtgagcggggactactctcttgcagtatatgggcttctcattgcwgtggtttccatgctgtggagctaggctgtagagcgtgggctcagcagttgtggcttatgagcttatttgctccatggcatgtgggatcttcccggaccagggattgaacctgtgtcccctgcattggcaggagaattcttaaccactggtcaccagggagtcccaagtgtttaattttgttgtcatccagcacatcttgttgcctgtgcttttggtgtcatatttaagaatccattgccaaatccagtgtcgtgaagcttttcccctgtgttttcttctgagggttttacagttttggct

SEQ ID NO: 1205 - DNA, 600 bp, Bovine  MMBT11715
gcagttacttgtttataacttgggagttaggccaaagagcaattgtttcctttcttaaatatatatttttaaagtatttttaattctcattcccctcttctggttttcacgtatccaaacctgtgggagagaccacaaagattatccagaagtctgtatrtagaggtatgattgtcagtgtgctcatttgtgatcaaagccccatttaccatggtgggaaaataactctgttgacttttaaggtttattgacaaaagccaaatatggaacatctaaaacttcctgacaaagtcaatatawgacacaacacaaaatcattaaatataggacatgccctgtatcggcataaactggacattttgtcaatatattacttatttcaacatgagtaatcacgagtataattagctaaaatgttaagattaggtatgattatttaatagagggagttgatgcagctcttcatctatctctgtccatcatttcagtctcttacttggaacttaatgttttcacacttcatgtttctcctgaggcacatgtgtttgagtggaagaattccaacatgaaaatctccaagatgacactcaacaatctcac

SEQ ID NO: 1206 - DNA, 600 bp, Bovine  MMBT13786
ggaagactgttccctccagcaatcctcttctacagaagcgtgcccccccacctgtttctatgcttcatgtttttcattctagcatttctagctttcatttagtttcagttttattaagactacacctaataagaacctgaccatttctgaatgttcaaaaagagagaaaaataccgtaattaatcattttccaatagcatgaaaaacacaggctattcttaaaaagttgcttagatgcagctgagcaacttctagatttttagaaaacctgctatgaaaacaaaatccaatagatacttwgtgtgaatttatcatagctgagaccaaatattccagtgaatgcagagaatcttctgttcatggttcatattttttttaaagctacatgctcagtagtcttccttagtatcagataaaaccaacaaattattccttaatccaataatgttaawaaaaaaaaaagtcatttaaaagtcagatattcaaaatgctacgctagtagcactggcccataggaaaaaatgttttaaaagtcctgttagaaaaatggagtttaaaagtgtaacaacttctaaatttagtcgttcatttactgtatga

SEQ ID NO: 1207 - DNA, 600 bp, Bovine  MMBT14749
ctaaattattttctgaatggtttgaattttactacactaggggactgtcctctttcctacaccctgacaacacagaaagtcttttttaaattctggcaatcttattctaccaaaggttgtagcaaagtgctgtctccatttggatatatgtgactgaacatggttttcatattcccagttgtaatttatcaatagtatatccatattttgctcatttctctattagggcatctattttctgtattaattgtggacagtttttaattgagtagggatattagccactggtcaaatgtttcwgttcatttttccaaccaattctttttattttattattattaatggtgttcatagtaaaataaggtaaactagtaacacctactgaaatcaggaatatgaaaaatcatcataatgttacttattacagccattacatccaaaacactcctaaagaatgcaacatgacatgaaaatagttcacattaataatatgtgaaatgaataatcaaaaaataaattatatatattatgaccacaaagctgaaaaacagaaagtagatttaagatggtatggatatatacaaaaatattgcctcctat

SEQ ID NO: 1208 - DNA, 600 bp, Bovine  MMBT11773
gtctctctcaccaccatctgttaacccttcggtgagtaaagaatgacaggctatgccaagacagaaagaataaggccatgttcaagttagatttgaattccttaatgtaaagaaaaagtaaagaaaaggaaatgaaagaaatggaaggcattcaatagaaatgggttctrtagaggaaaaagttaaggcagttcctttcagctcccagaggggcatccataaacgtaaaaatatctatcattgactgagggctaaccgtggaccacatactatgctggcccttcacttgcattatctaawtgaatcctaccaataacaatttcatggagaggccattatcagcttcattttatggatgagtaacagtgatttagagggattaagtatcttgcccaaagttgcagaactaacaagtgatgcagccaggatgccatcatgccggttggattctgaagcctgtctaattaatcatgatgctccatgccttccagccacrtattcaactgaggaatgcctgtgcgtagttgcctttcgttgagaggacaggatgtgaaacacaaagcagtgaatagagaaatgtcgratgattcagtcagaaaa

SEQ ID NO: 1209 - DNA, 600 bp, Bovine  MMBT11953
ttttccargcaagagtactcctagacctggtcattcttttgactatcgactcacatgatcaattccagttgacagcagagtgtcatcattttaatttatatttatattaatgtatatttataatttatattaatatattaatttgtagttacattttaatttctgtggaattatttgcactctctatyctgaaatgtcccttcctaacatcaagttacctagaggtgagtttaatcagaatgctgattgatgagcatagatraaaattgctttgggaggaagttttatgtaaactttagwaaagctcaatgaaatatccatacttcaccactgaaaagatgatttgatgtccagatcatggaatctccaaatgtggtactctttcaccatcaaaagtatgagttctctcagtggagtagagaaagtggtaaggaacaaaattgataagctatatgtagcttatcagaatagtcccccccaaagatgtgcatccctggagcctgtaaatatgctttcttatatgacaaaaaggactttgcatctgtagctaagattatggacatggaattttctaagtgggtgggatgaaatcacataagc

SEQ ID NO: 1210 - DNA, 600 bp, Bovine  MMBT16269
ttctggaaatttataatgctgtttatcaagtttatgagcaaattaattgctttaaatctattttgaaattcatgtaattacatcagttgtattgaagttttctgaattgaggactttatcagcttttaggctatcttaaaatttgttcattatctcaagtgagaaatttccacattattttatattactttttgcataaaactgaaaaattgagaagtccaatttgataaattaaagttgcatgctgatscccacaacacatcttgtggttggatgacagtcttccattaaggcaagtgwcctgtataaaattagcattgtaactaatatataggacctttgtggggaagaaaaaaattattactcattaaacagctttgaatgaatggaaatatatatgatgctttggatggaaagtactaatattaaaaaacatagtcactttaggatggataaataattgttataagcctttaaaattaagtgtaacttacaatacatatatgctaaaatatgcatatatgctaaaatacacaaatcttaaagtayacagttcaaaagatttttataaattgagcatattcatataaccatcagaca

SEQ ID NO: 1211 - DNA, 598 bp, Bovine  MMBT12761
  misc_feature (1)..(19): n is any nucleotide
nnnnnnnnnnnnnnnnnnnacttgttctatgaaaaacacattttactcaaaattttcataaaatgacaatgtctgccaaatgtacagcttgttacatccagtttaaggacttgaattctgtttatattgagtattcaaacatcacaaaacattgtgttaagcaacatttataaattattgtaatatgctgagtattggccttccaaaaacaagtcctcacgcttggatatttaaatgttacctttaaaaaaaaaaaaaaactttgcaaatataattaagaatcttgagatgaattcagawgtgccctaaatgccatcacaaagacatacacagagaagtcagtgtgaaaatggaggcacatattacagtgttggagccacaagccaaggactgtcagttcagttcagttgagtcactcagtygtgtckgactctttgsgaccccgtggactgcagcacgccaggcctccctgtcaccarctactaaaaccaggaggagaagcatggaattctccctcagaatctccagaaggagtcaaccctgtcaactccttgatttcaaacttttggtccccagaactgagagagaagaaatttct

SEQ ID NO: 1212 - DNA, 600 bp, Bovine  MMBT17067
gcagacagcattgcagtctactgggtagatattaaccactgtatttacccaacataagataaacattttattcaatttacctgggaattaggtggaattaattgagccacagggaatcccctgccccagccctgagtagagaaaaattcccttcagtgacctcagcttttctgtttagctgcacacatcaccttgctagtggggctgtgtcatttttaatcattcatctcatcacttgtggttattgttaattagttttacttttcctactatgactcttttttcttgttacttacatgwccgaactaaataaaaattaaacttgtaacctagagtggaatagaaccggatcatcaatattctgtccaaaaatgtggtttcaccatctaccaatcatctttttggaaatcaaattgtatcatatcatcccttctaaaagagatgggctatacagcatttaatatcaggtgacaaatttcaatagaaaaataacctgcttgactcttttttattgttttccctgatttttaaccaatagatatatatgttttttccaacattatataaaggtataaagataaaagaaccatcatcccacca

SEQ ID NO: 1213 - DNA, 600 bp, Bovine  MMBT17755
gcatatgctgcgttagaagaagctgagcatacagaactgtgggtagcattgacttcactggaatgctacgtatacatatctgaaatactaggcttcatatgtgaaaaggaaattgatgagcaaaaatagaatttttatggtaaaacaactaaaagcattagattgttaacttggaaaaaaagactaattttgaagacaaaaagcacgatgactaatttcaagtggttaatggcttctctgcagaagcataaagagctacctttgttccaatacttcatagaacgggactaaaaattaatwacmaagctagagaatacatttcagtactttgttgtcactgctgtttagtcctgagtcatgtcggactcttttgcaacccaatggactgacagtagcccaccaggctcctctgtccwtgrgatttcccaagcaagaatactggaatgggtttccatttccttctccaggggttcttcctgacccagggatcaaattcctgtctcttgcattgcaggcggattctttaccattgagccaccagagaagttcctggtgtgtggatcacaacaaactatgccaaattcttaaagagatggaaat

SEQ ID NO: 1214 - DNA, 598 bp, Bovine  MMBT17978
  misc_feature (1)..(88): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnncccccataaaattaagcccctaaagcacagcttttgatcacatcactgccctgttacaaaatgtaagagagctccccatttactatgacataaaatccaaattccttagcatattattcaagatactataagaagcagttctaagctatttgtcctggtatcccatctcctcaacttcaactaagtaatctaagctaaaggcacataaatcwagttacgyttcccaaacatatcttacttgtgcattagctgttcagatctmtaatctaggtctgtggaaatcctatctttaggggtcaactcaagtacaaggtctctatgaattatttcctgaggacccaggtcagagttaaatctctcctcttgtacttttataataatgatagctaatacttacataatacaaaccacatgtcaaatactacatatataataacacttaatctttacaaccaccctttaatcaatgaggaaacactttaagggagagttttgtggttttctatcacc

SEQ ID NO: 1215 - DNA, 598 bp, Bovine  MMBT18223
  misc_feature (1)..(45): n is any nucleotide
nnnnnnnnnnnnnnnnnnnnnnnnnnnnnnnnnnnnnnnnnnnnnaaatctaaaggcaaaatttctctttgtcattttcgttttttcattcatttgacaattcccgcccccccaatcttatttacattgcttatcatctatataacacagaatcatttaagagttttctctcttcaaatatatttgcaatgttcttgtgattagcagtaatgaaaagtttatagcgcattaaaaatgagcacagaggttctgttagtattaaaatgaaggtacttgaatgcaagaaaaatgtaacccacwttatactctgtaattrctctgctaaagactttgctgtttgtgagccatccagtttgtgtagacatgagaagaatgtggttacgggtgactgaaggtccaatctctagtcaccggtgttggtatctckgtcactctggtgcctgagttgggatgtgttattaactcggtacaaacaaggaactaagagggatctgaaattcagttccacagaagtttactatttatttaccaagtgcaaggcagagtagccacaataggaaccccaaagtgaatgactcaatgccagccttccacccct

SEQ ID NO: 1216 - DNA, 600 bp, Bovine  MMBT12842
atttgcaaaaatatgttttaccagcaaaattaagacaagaataaaccatagaagagtgtaaatagcgttaaataaggcaactgggtgcatgaataactttaaaattaggatacatttcctatattgcaataatcaacaataccttgcaaaatgaacaaatgcaatatcttggaagataaacagctgacatcatagtatgcaaaggcataaagaaaagtaattagaaacatgcaagaataatagtgttactgaataaaacaagagttataaagaaagcaytgtgaagaagaaaaggtcttwtgaaacagtgagtttcacatttgagtagggtttgagtagwtgatgaatgaccaggaatttatagaatataagtttggaatgatcacttccaaccctaagtttctctaaaatcaccttaaataattatgcaatttgttcctaacacaacatgactcatttatctagaatataaaccagaaaattcaaaagattagcaagaaaaaggataatctgtaaaatgcattatataatcttmgaactttttgaaaataaaaattcctgaggggtaaatatgggaatcttctgaaaaacaaatgagag

SEQ ID NO: 1217 - DNA, 600 bp, Bovine  MMBT15970
tgaaagacagcactggttctattcttctctacttttcacacagtcttgagttatattttgagataatgataaacatagggtcctccccatgttagaacagtgctcagcacacagtgatatatatatgtagatgaaattagcaatatgaatgtaattaaatctttattctggtttacaaatgaattgattccatacgaaggtttgaaaataaagttgatcattatctagcaataggaagtgaccggtttttcagtactttgctcattaccaaccaaaaatacgtttaaaatgttgcatctwttttgagaatacacttttcaaggctatttttccactctactccgttaagcttatttgaatatataaattgactttcaggtatgcaaatatacatcacaatctgaattaagtttcatatataatcaggctggtagtcaaattgttgtttttattgtatatttactttatttttgctaacagggtgtattgcttaaggaaagayatttttggtgtttacaaatgtgtctgggtctgcatacttggaaaatattgcaaccaaactcagttcgattagtcaatatgtattgatcacaatcagag

SEQ ID NO: 1218 - DNA, 600 bp, Bovine  MMBT17822
ctgcctcttgccaagtgggattccccaccaccttgtcctgggcaaggcttctcgtttacagattcagaaaaaataaaaaccagcagggagggtcagggaggccagaaacaaaacttaatcagtacactgaaacagtgtgttaaaaaagaaaagaaaaaatacatacacacacacacacaagaatcaagaaataattaggccaaaccatcaatgctgattatcttggaacgaggtagtatggtggacaatctttgttgtcagtgttgtttctggccccactgaatggcttgcgggatcttmgttctccaaccaggcatcaaacctgtgcccctctgcacagtcctaaccgctggacaaccaggaaattcccacttactgtttcaaactcttttmttttacaccatatttcaaaagggtagcaaagggggcatctccccccaccattaaaccaagcaaacaaaacaaaaaaaaatcccttcctcttttgttctgtgctgtgggcgacagagcactggcttgtcacttgacctctatgagcctcagttacattctctgtaaaacaatgattaaaatgcagcacttcccaggaggactttctgc

SEQ ID NO: 1219 - DNA, 600 bp, Bovine  MMBT16245
accatatagacctagacataccacgtcattagaactcagttggtaagaagcattcttctcacattgtccccagacagcattagctgagaagtcagtggttttgaccttaccaaatgtgtgaccttactggacacattatctaattttactagcattttagaatctcacattcctgatgtgtatattagaacacttttaataatgtatcaaatatttgcatggccttttgcagtttacaaagtgcttttaattgggctagggcatttgtgtaggtcctagaatgcacatgcctctctctcmtgggcatgttatayattccacccctccacagacaccrattttgggtttcttggytgttattctgttgtgtacccctttgagagatccacccctttcttttcacctccattccctagttccaatgcattgagctctgtctttgcttcttggacatgctcatccttgtgaaacctcctgccagaaagtgccccattatcttgctttgccctctcccttgctgtcatttgtccagagtcctatgaaattgacttgcgagcatccagaattccaacccagtcttttcatgatgttgagcaaggt

SEQ ID NO: 1220 - DNA, 587 bp, Bovine  MMBT15932
cagagcattggggtgacatctgagaaggagagagtgtgacatggatcaaggcaaagcacaaataaccacatttcaaaatgaatactaattgcataatgacagtttccaaactattagcctactttacaaaaaaagttaattcaacacaagcccagaactggctgtggcttacrtgttgtgctgccagttggcaggcacagtttcgccaggggattgggggaaatgaaggttattgtagtggaagcacacttggccttttgtgaggagggtacaaactgcatcactctctcaaggtcctamtgttccgtgttcaagagtggacatcaggatactgcatactttcaggggaggttgcttacttttcctagaggtaaaatggcccagtaccaaagcttgggaaggagacttgagttcatagtcccttgaaggaaaagagttctgtgcagaaagaggtgatgagcatggaggaggtgaacctggacttgcgtgtgctgcccttggccaggaaatcctgggcccggggcaggctgtggccacccagaggctgaccttctccagcatgaactgtgcatgctacccaaggtggg

SEQ ID NO: 1221 - DNA, 598 bp, Bovine  MMBT14818
  misc_feature (1)..(23): n is any nucleotide
nnnnnnnnnnnnnnnnnnnnnnnctgcagagaactcatttcataagtcagctctgctcgcctttctgtcctgctgacgtccccgagccgcactaaccccagctctcagacacaggcgggggtcaaggcccatcgttcaaggtccttcgtgagccagatcctgcccactgctcctgtgtcagcaaccacccaatcacccaccttacccaatcactctgtgtggacgaaacgatttctctccttcacccacgcaatactaccattcttccagcctctctttttgaagttggaaaatcccgamttcaggctcaactcgggcacctcctcctccaggaagccttccgtgacctcctcccagcattgcatcaggcaactcctcggggatcccacctgccagagctggacagacctgggcccaggatcctggggatccatctagaaccacccatctcaaagcatggtccagcctcatctagaaacttgtgagaaacatggcttctcagtctccaccctggaccttcygaatcaaaactgggagcayggcccagcaatctgtgttgtaaaaagcccctcatgggattctgaagctcaagtttgag

SEQ ID NO: 1222 - DNA, 600 bp, Bovine  MMBT16194
aaagccatagtgtagagactcagagctctccctcaccatatgttacaggtttctcacgggctctctctccatgctttacagagaaagcagtcaccgcttcagacattacccctcccgttccagactacctgctgacctttgtgttgtttattttctcctccaaattggtgcgtgaagcttattttaattcagtttcacctggatacaaatatcaatgggactaaagccctatttctggacttgaggatgtgggtctttccctccattccagatctagaacatgagggccagtagagacgmagcaggggacrctttgctctgactgagctttccctagcaactctcgggtttgctccggccacctgatcaagtctggagttccagggtttcaccttgccacctatttcagcgtgagcttgataaatccgcatgaattctgagagatgaccatgtgtctcaggtattcagttactactagggtaagaggggggaataatgttcttcttctctcagggttgttaggagaatctcaagctaagatattggaaagtgcctgacacagtgcttcttaagagtttggcttttgtcagctttgctttg

SEQ ID NO: 1223 - DNA, 600 bp, Bovine  MMBT17476
tgcttttcccttgaggcactgcctgtctcagtttattgtcacgcccttttcgctcatacataatgcagcgacatcaatccagtctttgacccacttattaaaaattctgaactgatgaaatctaaatgaaagcactttcttcgtgtataatatatgaacttattattcttatcatttcgtaaatacacacaacagaacacgcactgaatataaaaaatgagatcaacagatttggttccaaaattcctgctctgccacctgttaaacactcaggacagtttccacaacatctccggggcmtcagtctcctcgtctatgcagtgtggttagtagccggtaataggtggtggtaatagccaccagccacatggggtggttttgggaagtgagtttayacctggaaagtgccacgcacaaggccaggaagttagaacacatttaccctcgccagtcctcaaagtgttaaaattctacaaccaagatcattatatccatcacctaaacataattcagagaattagaataagttagagaaacactaagcgtagtgttctttctttaaagccccctgtagtcagggaacagctgtaccagtgattt

SEQ ID NO: 1224 - DNA, 600 bp, Bovine  MMBT11788
ttcacaactatgatgaggcaggactttatttgcacctcgaaaatgttttactactgttataaaggcaaaggcaaaagaaggggaaatatgtttaattaacaataattgaattttcataatactgtttaatcttctagatatgcttatgaagagatgggtattattattttttttctactacagatgaggaaaccagcctgagagaggtcaagcaatttgcctaaacttgaaatgattttaagtggttgggctgattcaaacctaggttagtagcctcygggccatttcaacaataaatamcattagagagactgcattaacatcctgcgaagtaagacgaccactaaggsactgaggagtgatgaaagcatatagcaatgggtcatgaatcaggaaaggcttccagaatgaggkaacagaaaatggaggaaaagcggrggaatgcagcactgaaaaacagaggatccagtaartggagcacattaataaagaaaagaaaagacatttgccattaagtctgtagaaatatttccagttggtttccagtctcctcatattttctatccagccaaacagcaataaaggtatgtrgttatataa

SEQ ID NO: 1225 - DNA, 600 bp, Bovine  MMBT16210
caaacccagtgccatctggggcctcctgtccacattccaccttctccgggagcttcagaggaaygcccgggtcctggtgggcttggccctggactggcggcagcatccctgcttgtcccgtgcagggctgtgccggacctgtgaggtgttcggggccgcggcgctggtcatgggcagccttcagtgtgtcagagacaagcagtttcagcacctcagtgtttcagcagaacagtggcttcctttagtggaggtgggtggaaagtgcatgattattaaaattttcattcaccagactctttmtagtactctgtcttcacctgtccatccttttgcagtagtccagcctgtcatattttaaaaataatactaaaaagtaaaatatagcccactctgttctcccattcttttttttatctctcacactattatatttttagaaatcatcaataatgtagactttttagyaaaatgtgtcctgttgtaactcactctggttttataaatgtatgtgatgttgggagcattcttttttatagtgtataattctgtctttttcctgttaacaaatttcagtttcatcagaagttttttttttttttt

SEQ ID NO: 1226 - DNA, 600 bp, Bovine  MMBT15917
ggtagtgaatttattacaaagtaaatccctagtgacctactgtttttcttttctagtgaagtttctccaagcataatcctatcacttttgacttgaatgaactagtcactgtctccagatgtgaattatagcaccacatagaggtttaattttctttttgtttaatttgaccttgagcaatcataaaaaggcaatatgagctccagttctaaactttatgcatcttgtaactactccacccagaatgattcccaagagaccttgtgaagtaaaagaaaaaaaattggccaaattttcctmctctacttttattaccccrgatattttggcatctctttcttcctmtcagtcagtgcctctcacactctagtgcacaacctagatggacaaccctatgcatggggagaaacttasaataataaatcccaacatcatcttctggctggattccctgctctaatgcttaccacaatgcctggcacatagttgacagtcatgtggtattggttgtttaaactactaactcaatgaattaatgaacagaactgccacccaaaagaaaaacagagtgcaccttccactgtcatttgtttggagttc

SEQ ID NO: 1227 - DNA, 598 bp, Bovine  MMBT17224
  misc_feature (1)..(205): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgataccgtggatttagtgctccgtatcaaggtatatttaactaatacctctgcctcttttgacgtgtaaaatgattttggtatacataactgmattttatgttagaggcaaaatatctttatcttaaaacatggtaatttgagtaagcaaaaatgaccattttattgctaaggcaatattgtgatcataactaaattgcagtataaaagttagttgggttttatagcacactgtccagaataaagaatattataacctccaaaagataatgtgtaacatgtaatatttatctttaagaaagtgyttcagcagtgggacatgctacccaaacatgtaccacaaaacactgcagaaaattctgaacagagtcttcatcaattgaaatccattt

SEQ ID NO: 1228 - DNA, 600 bp, Bovine  MMBT17168
gctgccttagaaggatggatgggtaccgcaaacttgtgtcctggctctggagcaaacagcatctagttagcatcagatgtgacaggcgcacaaacagagaaaaaccaagaaaacaaggtgttttcctccacttcactgtgggactgaggtgcacacagtcaacccaagacattaggaagtccaattgcaaggtgactttgcatgagatgccattgtctaaaatccaaacactgatacatacttgagaargattttatagggtaaagttgattaataactggaaattgagcattcccaaamcagcaagatcaatcagctgtaataatcattgaaataactccagtgaaatatcactgccgggtaatggagcatattgctcgcttttcacaaatgactccccacacaaatagctagaatgaaatcagctgggttctatgaatttgtaacttcggaacactaccttgagcactcagtcacatcagacttggctgtgaacagctgctgcagaagcccattcagtcgtactgtgaactcactcacgccgtgcagtgctgtctcttaaagtggctgctcaagttaacattcagggaccatcttcag

SEQ ID NO: 1229 - DNA, 600 bp, Bovine  MMBT17008
gcccagtggcaaggaataatgtcttcagccaacagccctcggagaatctgagatctgccaatagccacgagtaaacccagaataggaatcttccctaaatcaggttttgagatgactacagccttgtgagagactctgatccagaggactagctgagctgctctggcttcctgacctatagaaactatgatatggtacaaatttgttattttaagctgttaaacttgggggtaatttggtatacagcaatagataattaacacaaattttatgagaagaaaagaaactaaacacataacmttgctagaaatatttggaagcatcatgatttcaattactgtttacaacaaggagttagatctkcctattttgggagttaatcagtttggtaggaaagggagttccatttggcaataggaaatgatcactatattargaaatactaagctatcattgtgcaagaaaacacagttattgacttacaattaaatcataagcatgtataagacacctacaatttgtgcaatactactttagatgacagaatgaaaacaacataatcaaaagattgcccctaccatttattgaactagagtctat

SEQ ID NO: 1230 - DNA, 600 bp, Bovine  MMBT18207
ttacacagaatcatatcctagctttcataataacactctgactttgaaccacgaatttaatctctcttagactgtgtccccaagtgtaaaatagaatgattatagtaactacctctgtatttatactgcaatactgtattatatgcttcaaagctgctaagaagctagatcttcaatgttcttaccacaaaacattgaaatggtgattatgggacacattggcaagtgttaaccaatgatatggtggaaagcacactgcaatgtataaatgtatgaaatgaaagtgttgcacaccttaamctttaacaccataggggaaaagtgaataaagggaacacaagattcctctgtattgcttcttacaactgcagacttatttcaaaataaaartgttaatttaaagaaaagagacatatgattttattttatttaaccgaaaatgttttatttatccaacatactttcatcttagtctattaaatgasataaaaattagtgagatacattacttttttttcatactgtccatttgaactggccgcattccaagttctcagtagtgatgtgatagatgctactgtactggacaacacagatgta

SEQ ID NO: 1231 - DNA, 600 bp, Bovine  MMBT17365
tcaaggagtctggcctccactaggccagtcctttccaggatggaataagatggcacctgatcagagtgcactttctgagtggaaaaatcatccataatctatataacgtgactttggggggcagagaaagtcccatgagcccatatttaattctgtattctttgtcttctgctggaaattgcaccattcagtgattcctttctcagcacatcagaaggtgtggtgatatccacagtgtggccaggactctggaaagggcaggaaggtggtgtgtggtagtctgggctggctcagaatggsacccagaccgattacattgcacatcaatataaattcaccttttatgaagtctgttctcagcagccagtggaaccagcactaggctggcatggactgggattgatagtaacctgctgtgtgaccttagggaagtcaccagacttttctgggcttcagaggcctttcagcatcatcattcccatgagggtgggttgatgagggccctcaagtgaaaagagaaagttttcatagaatgagggaggggaatggtaaagaaaggggaaacaagacacttgtgaggacaattcagccacctggtat

SEQ ID NO: 1232 - DNA, 600 bp, Bovine  MMBT17390
gttcatcagmaggaaatacaacattcaattcctcagtcacacctaccacacttcagtgctcattagccacttgcagctggcgagggccatgctggacagggaggatccagaactttcctgttattgcagttctgttgggcagcgctggtgaagacctttgkgggagcctagatttctratgtggccaagacctctgcgatctttaaaagagcctctttgcattgaaatgattatatttatgacccatgagttagctctcttgtcaaaattcaaatctaggcctgacatgagaagccttcsctgcctgtgccacgtggtccctggtccctccgtctcctctgccatctgatgcctgcaggggggccccttgctgtggttgtctcgctgtgctgcttgccacgctgtgtggttgcaccctttgtgtgttctccagcacctaacgaggggtctggcacatactaagcatttggcttaggctgggtgaccctgaagcaaagtcagggcatttttgtgcaagtcagttattggggaggtgctcctaggagagggagtgatggaaggatgtgtgggtgggtcaagctgagtaaggtggtggtctca

SEQ ID NO: 1233 - DNA, 600 bp, Bovine  MMBT18015
cccgcccgattcttttcctcagaatccctttccctttctctagcttgatttctccaacctcaaggctgactgctaccggcccggtctcctcagagtgaaatcatgaaggtggtgaacctgaagcaagccattttgcaagcttggaaggagcgatggagtgactaccagtgggcagtcaacatgaagaaattctttcccaaaggarccacctgggacattctcaacctagcaggtcttaagtgaagtaggaaggaaggatgggagggctaaacccagaaatgttgtaacactgaggcttcstttgttattctccttgcagaagcactactggagcaggccatgattggaccttcccccaatcctctcatcctgtcttacctgaagtatgccattagttcscaggtaaactcttctatctattccagacaaggtttgaaggtgaaaggcttggaatacagttgtcagctcaaatttttaggtgaatttgtttgaacacatcatttccctgagcctcagttttcttgtgaaaataataatactccagtggttatgatgaatattacattaatttgctctatcaataaatactcacatatgccc

SEQ ID NO: 1234 - DNA, 600 bp, Bovine  MMBT17442
cagcctcctttttgtctaccccaccccgccgggacattgttattgaaatagaggacaccaagccattactagcttcaaaggtaggcttagaattgatcgttcattgaatgatgttggctttatcttccaggtatctaagcattagttgaattcagtcgaacaaccattcaatgcgactaaagataacaaacgaacttatcacggtaaagaacctggctcttacattcatcagtagctttggtgacattgtgtgaactcctgtcctctcccctcagtcaccaaggatacttaaaataatasttggaaccgtgctgcactctgcacgagggaggggaatctagacagcartaagttttaaaatctccccaagtgawtctaacgtgcaggcaggtgtgagaaccgttgatgtggatggtctgagtggtatcatttgcaagagcaatctcaggaccgaatatacaagcatcacaacattcagaagagagattcatggactaactcaccagttcttttccccctaaatgaaacagaggagtcatggatttttaatgactctatttgtcagtgtatgggatatccctgacttttatattcactgtg

SEQ ID NO: 1235 - DNA, 600 bp, Bovine  MMBT15473
agctcacatcaggtggccaaagtattggagcttcagcttcagcatcagtccttccaatgagtattcaggattgatttcctttcggattgactggtttgatctctttgcaattcagcttcattatcagtccttcttgacatctgagtcaagggtaygcaaaaaatatccrtaagataaacttgatatgtggtcacattgaggggacagaaaagtgtgtggtcttttgaaccctggctgtggtccatgatgtatctgaaactgccctgcagctctgaatgggagatgctgttaccattgggsaaagtcttaaagtgaattcaattgcaaggtccacatcctgcctccaaggaccccctagagtcatgcagacagtttcatatgtggttctgaggcataatggatgggcattagagtgtggttggcagtgcttctcagaagcaagggtgtcttttcttctctctacttttacagcatgttgacacatgtccactctcatcaataaatgttcccatctccactgatctgtttggaagaggcaagaaattcatgttggggggacaactcatttgtctttagaaattgaaaargcgagtgcttcag

SEQ ID NO: 1236 - DNA, 600 bp, Bovine  MMBT17837
gagagctccctttgctcctgcagtccctctgctcctgcggttactgcctttgcacacaactgcatgggaaccgcgagggaccacccccgtccctttaaaacctaagggggatgtaggaagcacagacatgagatgcagtactggctttaaaaaaaattttttttaagagagtctctgcaggttggtttgctttcaaggtttggacaccatggtactcattggaatgatctacattcttacccartacagtgggcgaaaacctgccctacccaaattccggccacattctcactaaccccsgaaactaagcgtccaaatataggagcagcatcgactcagccaagaagcaccatctcagagggagggaaggggtggtttgctaacatctagtccaactaggactttcaacatggaaccatccccacagaacccaaagcagccattgcctctgtatgtgttctgtgtgtgggtgtagggatctgagtaagaaataacctgtttatagtgtaagaattcataacgtaatcaaatgaaacctttactgcaattgactgcagatagtaatagcttaaaattctttagtctaaacaccatgtaaaa

SEQ ID NO: 1237 - DNA, 598 bp, Bovine  MMBT16951
  misc_feature (1)..(109): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaatgtcaatgaaatgattacagttcatgtgaaaacattccccacttcaaagtttaaatccccacttcaaagtttatcactgtgcctttaaaacacttgtttgtttttgaaggttgctctcactagttcttttaatgcaggtttgacatcttatatggaccagacatcaagtacatcgttgttcatgstgtcttactacactctccggaaccaagayggctttggttctggcctctaacttcccaggtagaaaaaaattgccagtaatactaaacacctttataatctgaaacagcagacagaccatcttgtctaatttaaggttaaacagaaacaggagctgtagatatatctgttctttcagggacctatgataggatcttgagraagacaaagagtttggccttcatctttgcaactgggataagaactcacaatatttataaggaacagctaataaaagcagaaaatgttgtagtttttagg

SEQ ID NO: 1238 - DNA, 600 bp, Bovine  MMBT14648
tcctcaaagcacaggagaactttggagatgtaatcacttcattcaacataaagatcagcttctgaggcctcttcctcacagcacagctgcagggggcaacacagggcactcacaacacatacacaaataacagacctcgataacgcgggggaagagccctggccctggaatcgtaacacccgggttcaagacctccatctgtcacttactcgccccgtgaatttctgtaacacagtaactacacccaaaaatgagaatcccatctaactcacaggattgttacggggatatgaacactasttgacaagaatttctctttttaaaagcagaagatgagatcaggcgttgagctccattatgtgtcaccgtttggaaactctttccgtgcaacagaagggaagaagtgaagtgatgtcactcagtcgtgtccgactctttgtgaccccatggactgtagcctaccaggctcctccgtccatagtattttccaggcaacaatactggagtgggttgccatttccttctccaggagatctttccgacccagggactgaacccgggtctcccccattgtaggtaaacgctttaccgtctgagcca

SEQ ID NO: 1239 - DNA, 574 bp, Bovine  MMBT15541
gatttaggctctctgctatatgcttgacccactgaagggagttaagagataacgatggacgaagattactgattaatcattcatgatgttattttcgtgagcacagaaagatgtgtaaggcaacagaaaagactgtccccccccgtcttctgacagaagaagaataccggctacaaggagaggtggagacccgaaaggctttagagcagcttagagaatactgcaacagtccagactgctcagcttggaagactgtttctcgaattcagtctccaaagaggtaaacaaactcttggccasaagtaccaggcatctgtcagggtaatcatgaccctagagttttaatagagactatatttctataatcattttgtatttgtggctttgttttcttgttcttctaggagtagtcaagggaaggttacatatatcatatgtttagccgtagccattttctgattcctcaaggaactatttactctaactttgattgtagcattgaaatgagaagattctagtacaatattaagtttctcctcttacaattttgtgttgctctctgaatgtttaatat

SEQ ID NO: 1240 - DNA, 600 bp, Bovine  MMBT15482
gtatttttytctcatatctaaaatctattttactgactcttatttagggtttgaagcatgattataaaatatattttccctttagtgatacagatataaatattacagcttagaaaaaawttttttgtaataatggaaaattaytcaggctatattaatacttttatttaaaatactgttttaaatacttaaaaattcaaaaacatccatgaaaattataccagatcaaatttcagtcctatgcaccttgacagagtccctgtttctgtttagagcttggttttcattcctcaagtctgstctttaagaaattcktttttgtccttacttgttctcttttttctaccataatccaaatatgttttatgctcatkatagtaaaaataggtcatgctgtgatttcaaatcattttggcttcagctagtactagcttcaaccttttctatttactattggtatttaatagctatttgatcataaatacatacttaaaaagaatatgatgtaatatttaaagttcttcctttcagtcatttttcaggtacatcagtttttttttcttttgtgtagcagagttttattaaaatgcaaagggacag

SEQ ID NO: 1241 - DNA, 600 bp, Bovine  MMBT17018
ataaaaagtggaatgatacataaaaatctgcccctgcccagcacagcagactgcccgcacttaattccagctgtattctagactcagcattattgtagcccaccaaaaagtgtcctatgttttggatgggaggagtctgcaattgattttaaccaccaaatgaaccttttcagtacattctcagataatattaatgctaagattacttaaaaatcttagacctgggattacttggtaagcttaaataatcttaggatcttaaagtactttctttttcctcttaagtattattggtgagtsttygaaacattatgaaactttactaaaggtttgatttctcggctttatttttgtaaattgttataatattgccaccacacactgatcatattaaaatagttatacttaaggaaatttcttaagtaaactygtgttagggttacactcttcatgatgtcaggaatgcacccccaataattgtcaatttcttattttggggacagctcagtgaggagactaggagaattaatctgtaacttaatatttttaagagtgtcttattaggtgtttaaaaaatcttatgttgttgctatcattgtg

SEQ ID NO: 1242 - DNA, 600 bp, Bovine  MMBT14646
tttaccactggagaattcttacagtctagaagaccatgagcacagggctggggatgaggcggggtaccagcacaggaaaggcacaactgcaagccgccatgctgagcttaaaaccatcatcaaagggggctttgggagctcaccrgctgcaaaggttttgtattaggctgtgagtccactgggagsatgggagcccctaaataatgatgtcaaaagagtttttacatgcccaagaagctatttcaagctaacaaaaatctacatttgtttctaatggaggttaaggcctttagggattasagctagagagtgtagatggccattatctaaataaacttattattcccagtacaagacagtartatattcctaaaaaggaatatataatattttcactgtaaagcttcaaagaaatgtcagaaaaaaagcttcattttgaaaattattatgaaagtgaatttaagaattaaaaagtgactactggaaaattcccagaagaatttcattaatggaacactgctgcatcatagttgaaagctttttttattacagaggttataaccatgattagttccatataattttgataaagtgaaatta

SEQ ID NO: 1243 - DNA, 600 bp, Bovine  MMBT17915
aacagtatgtttttgtggtttaatcactaagtcatgtcagattccttgcgaccccatggactgtagcacaccaggctccattgtccatggaatttcccaggcaaggatactggagtgggctgccatatccttctccaggggatcttctcaacgaagggatggaacccatgtctcttgcattggcaggcagattctttaccactgagccaccagggaagcccccaatcaaaatagaatagtagttaccaatttgctactactgtattaaacaaacaaaacgaagggaacaaaataagtccscgatggatcatattttgagattccaaatagtagtgattactatttctgttagtattactgagatcacttactgattagctactatttgccaaaccctttcgtgtgataattttaatccttacgacaggactcaatgaaattgatagtttgtccctgtttggcagatatgaaaactggaggctcaaggttattaaatgatgaggtccaaagaaactgagcaaagctagagatcaaaactaagcctgaaagtttcctaaaaccatgctttgccagctactctatctgagcttaaggattcac

SEQ ID NO: 1244 - DNA, 600 bp, Bovine  MMBT17909
acagagatccaaatgtactggctcccaattctgtgctcttcctactgtttaccactgtctctgttcaacacattctggatttcatccttgctatatttcagtcctcttattggtttattttaggtttaactgataaaagaataacatgtcagaagtgttaagactgatgggtgtcattacttacatttataaatcacctgacgaatataccagctctcctaggatgtagctggtatgtcagatatgaggatgattgtaatcacttggctttatgattatggtatgttttagaaaatgcastaatccttgctgatgtatttttgcttatctcagaaagtgaaacttttgttgtaatggtrcacatcagactgtaatcagtgttacaaaatcaatattctatggagaatgaaaaaataaagcactacctggaggcttttgctactttaataaagcaaaattgtttgttatgcatacagaagtaagaaaacaatgtactcttcccgcaagacagacactgtacctttgcttaccaagctggtagcttgcctgtcatgtaagctgattttgtttgtccccagggaagagaccaattttaaattc

SEQ ID NO: 1245 - DNA, 598 bp, Bovine  MMBT17013
  misc_feature (1)..(196): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttctaaataaaatttaaaagaatttgctcatgaaaatgtctgggatctatgcctttaatgggttatttcttggtttacatttyccccccgtaactgtcaagstactcaaatgcactaattctattctggtcatttatattttcccagaaaactgtgtatttcagattcttaatgataaaatatttttattttgtattcttacaatattttaataataccaatgatattaatactacttctagtaagtagtaatggaactagcactactactaagtaaatctttactatctgcttcttatgcatcagtctctagtctaacagttgtattaaatattacatcatttgatcttcatagatcaaataccccatacctatgagataggtactattctttttacca

SEQ ID NO: 1246 - DNA, 600 bp, Bovine  MMBT17581
catggacagaggagcctggcaggctggagtccatggggtcccagagtgggacacgactgatgcgacttggcatgcacatacatgtggagctgattcactttgctgtacagcagaaactaacacagcattgtaaagcaactctactccaacaaaaattaattaaaaaaaagaatctgtggcttcactaaggagggaagtaaggccagtggaaccttcctgactaatacttgtagcttcaggaaattgaggggcatgggggagagggtcaccttattaaggagcttaaaaaataaacayacsaaatcgcaataattggcttttacatgggggattaggaatactgatttttgcattataaaactgtgtgtttgttcctatggtagctggctgaagcagtgtggggaagacgagaagacagagaagtgatgaagacagttcggtttggaacayagggacggacgggcaggacgagaggacragaagagatgaagcctggtgatgggcaagacacccacttgggaagcaagataaatgrgagcagagaaaaagagaaaacacagtgtcccttgtcacggggaaccgtaaagccaagtggcagca

SEQ ID NO: 1247 - DNA, 600 bp, Bovine  MMBT18364
ccaactagaactaacaatataataaaaaactgaaaggaatgcaaatatccaaattcaaatctcattttaaaaacttctaccctttcactgcttcagggcatggtcagagttagaaaatatgagctggttggagccaagtggtattttagtgaggccaaacaaaatacacttctctctttacacaattctttttttaagtttctattattttaagaaaagaaaaagccatcagtatttgtgaagaaataccaacctcaggctcaacaaatctaagtcacagaagtttgaaattgtttccasttaacattttgccaaaccaggaatccatattaaaagaccatgtaaacaaaataaaacaaaaagcacttgtaactatgctacagaaagacatcaratcttctttctttccctaaaagaacgacagtttaaagattagacgtgctacatactgaatctgttctaacttctactttatcaactctataaaatattaaaatgctcaaaaaagttaattgtaatctaatttctataaagactttaatttactcacacattctctcccttctaaaatataaatctcctctcagctcctggtcccct

SEQ ID NO: 1248 - DNA, 600 bp, Bovine  MMBT17093
cacagatctcaaatctcttgatccttccccctgtcaatacacttggggcctcacatcctttccccacccagttgagactccatgactgatcacgtaaagtaagattccctgtctccttacccacttagcctatgtacccccaacatgaaaaaaaaaaaaaaaaaaaaaatcctcatttcactgccctacttggcttaaggagaaaaagtggctggtacaaataccaattcatgctttccagccatgttctttcaacatttgtctttccttcttttacactatttctattgtaccatctcscagtctcctaaaatattccaaattattgaggttacccttatcaatgttaggaagttatttcagcaagcaaacaggatgcagtagaaaatgccctcggcttcaagtggagcttgatcacacatatcctatgttctttttccctttcastctcagaccagtggagtgccctccagttgcaactcctgccctgactgcctgatttttgtcccctccagcccccatctacaacattactactcgttggcctttccctcagactatagacacttaaacctcttttctcataaaaaacagacaagc

SEQ ID NO: 1249 - DNA, 600 bp, Bovine  MMBT17321
agttccttaaagatgatgatttccggggatgggcctgtgaagaggagggcacgtttgagcagcaggatgcagggaggtggccgtgatgaaaacgtgcayggtacaaggcatgtcagcattcccctagtgctctccctcctgtgtcctccactcttcccgacccacagggctgccccaaaatcaatatgcactctgtgcaggcagagtaactgccccaagacgtccatgtcctagatcccagagccttaactatgtgaccttacrtggcaaaagggactctgcagataggaccaagttaasaagctttagatggcaaaattattctgcattacataggtgggctcacatgagagtccttgtaaggaagaaagggatacaggaaaattagaattgagaaaaaaatatgtgatgatggaagcagagatcatagagatggagggagatttgaagaatcagtgctgctggctttgaagacggaagaagggaccatgagctaagagatgcacgtggcctcgagaacttaaaaaggcaaggaatctgagccttcggaagraaagtagccctgctaacccatttcgagttctagaastgtaagaataa

SEQ ID NO: 1250 - DNA, 600 bp, Bovine  MMBT16604
ttatcttggctcagatggtaaagaatctgcctgcaatgcaagagacctgggttcgatacctaggtcgggaagatcccctggagacaggaatggcaacccactccagtattcttgcctgggaaatcccatgaacagaggaacctggcgggctacagtccatgtggttgcaaagagtcggacacgactgagcaactaacactttcatatttaatatcagatatttatgtgaaaattatggaaatattttgagacttaaatgatattagtttcctccagaaatgatttatagtttctttttcscataagggtaggatcagtctcagacctccttaacgtaactgtgaaattgagatgactggcagctggactttagcaaaagagtmtmtttatttttgctttgcttttcccttactcctaggacttaactttttggagcaccttccaagacctgtgaacttatcagtacctttctcccaaatggtaagctctaacgtcagttttcagcctctgagtctattgaggttgttgatttatttgttcaatttctcatcctctcagtttcctctttcagaaaaattgcactaccagactcacctatct

SEQ ID NO: 1251 - DNA, 600 bp, Bovine  MMBT15626
cctttttctggtacaagaggatgtctgcatatcctttcaccacatagaaaaatttaagatcaagacagttacctagcaagaaagcttgttttgaagtgtctaataatcggggttccaggtttaatgggcaattagctcacatgctaaagaactagacaattgaatgtgaggagacagtagaaataagtacctcttagagaaacaagatctaccccacattaaaaggaagagataggatgtgaatggtaacagaaggatgaggtaagtataaggggccctcagaagtctggaaacagtccsagggaagttgtccaagaaagataaagggccacagtctcataaaagttgagcaggtgtaattaatggactttaagaaaactacttcctttgcattttatctctgtaaaacaagtattatatttccctttmataaayactccttaaaagttttcctgaaaatatatgaatataagactagaggaaaattttcttattccactctactattcaattttcccctcttctccctaaaatgaaaagggagcaattgtgagaggacataacaaactgaagaccctgtccaattatggcaaatatttt

SEQ ID NO: 1252 - DNA, 600 bp, Bovine  MMBT17629
caccctttcttcctctcctcctaccaacggaatagatactcttacccctgggagtcaggggtccatctcagtgctgaatctcatctcttcctgtcttcagaggaaacttgctccatctagtatcctctcaaactcagttttcaacttctttctagttattccttcctgtctctctgataacctagatggctgggatgaggggagagtgaagagaggtccaggagggaggggtatacatgcatacatttagctgattcactttgttgtacagcagaaaataatacarcattgkaaagcaastataacccaataaaacaggaaaagagtaaacatgcttacatttcttcattaacccacttcctcttctagctcttgtgttattgtccccctttcttttttagagccamatttctttaagatatgatgtgttttcactctttatttcttcatgtcagctgttctccttaagccacttcagtctagattttttatcccatgtccctttcttttttgatatataaatttatttattttaattggaggctaagtactttacaatattgtactggttttgccatacatcaacatgaatccgccacg

SEQ ID NO: 1253 - DNA, 600 bp, Bovine  MMBT17023
taatagaaaggggttttaacacctgatttacatcaatggacagatgacagtgaaaaaatcaataagtaaacacaggctttagataacacactagatcaagtggaataactgtgttgataaatatacactccatcagtggtatatgaaaatacttgaaaattttgtactattttagtaagatcttctaacttgaggatatataacaatttaatgtttaacctttccctttgcaaagacatctagaagaagtttctagtaaagaaagtttaagatttacacttacaacctaacttcaaggascattccttgtgttattaagakattggtgaggtcataatactttcactgtaggatattcaagaaaacagcactgctgcagggcaaccaagaacttctctacccaaataaaaatctttactacactttgaaccaaacaatagtctcagtttgttccactgtgactaatctgttacaagcagaaatatttttgttgttttttaactaaaattaaatcagacaaaatagtttaaaggtagctggaacagaatgtacctggcacacaataggattgggggctagcaggttgacctcaattcaatt

SEQ ID NO: 1254 - DNA, 600 bp, Bovine  MMBT11985
cgaaaactgagcttaaaaaaacaaacagtactaagaaaaaaaatgataccctatttccttaccaaattcccagactggttgggaggaacgtggatttcccaccacatgtggaatgaagccccagacaattttatttgaatcttgaaagacagctctcctcatctgacatctggttgttcagtctgtctgtacctgtgagtttatgtatgtatgtatttgcatatgcattgacgcaaagcttgaatgagacatttgaaactatctggaatgactatttcaggaggaagagggtattggagsaggagtttcatttttattttataatcagttttaaaaattcctgaagaacatgtattgcttttgtagtaactttagatccacacagtagatacattctgttctggaaagtaccttttcggttttgtggcaacgtctggatgtggatttcattgtggaatgactcctcattgtcctcactctctgcccagtaaaggaaaggaagagcagaggggagtccagctgttggattttcaattgtctgctcatgggtggctttctttttacaaactgagatgccttatctttaaaaagacagcccta

SEQ ID NO: 1255 - DNA, 600 bp, Bovine  MMBT11623
gcaggttgtgacagtaatggtagtctcatgtcagtgagaaatgagaaatttgctctaggctaccagtttcacagaagtctacgaagtttcacaaaagtccatgactagagactgagttagacttcctgatcctttgctgttatgtcataacttgttctcttgtttctctctcttggaatcctttaaatccattctatacctagagtttcttaaaatattatacaaactggtgccagagcctctttgtgcataaatgattaacatcgcaatccctaacacctcctatctgacccttccctscaaaaaaaaaaaaagtttgctgtatctggagcttgtggttgcagatgataatatmgtttctggcttmctgaaaaagtaagcaagtgatcaaaagattgaaccatggactcaaaatatgtcagctcggaaagttacgttttaaagcctatattgtgtcctgcagacccctgctctaatttttaaagctccagcatagctgtcgcccaggattgagttgtaacaaaaccgtttgttgtttccctgaaataatcaaagaaattatttagagaaaggatagaaagaaccgtaaataccttgatg

SEQ ID NO: 1256 - DNA, 598 bp, Bovine  MMBT15356
  misc_feature (1)..(240): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagcccatctctcaccccagctactgctgcagagaccagttccaagagggcattaacyatcctgcaccgagccttgcttcaggtccatgctacattcttccttctgttgccatccatgtgatggcatggaactgccagtaaacgcccttggcactcaggcatccataacctgaagtgtgtgtggaggggttacttacgggacagatraaccacagggacagaagcaccctcagaaggtcttgtgcrgagggtgccatgtggcagcgttgaacttaataaaaacctattgtcttacygactttttatccttctctgtttcactccacctgtccttccctcctgcttcctgagatcac

SEQ ID NO: 1257 - DNA, 598 bp, Bovine  MMBT17337
  misc_feature (1)..(73): n is any nucleotide
nnnnnnnnnnnnnnnnnnnnnnnnnnnnnnnnnnnnnnnnnnnnnnnnnnnnnnnnnnnnnnnnnnnnnnnnncaggtttggagaccccgcatacagacggttcagcagtggtggggcctaccccaacatccccctctcttcccccttgccgggagtacccaagcctgtttttgctacagttgacggacaagaaaagtttgaaaccaaagttaccacactggacaatggactccgtgtggcatcccagaataagtttggacagttctgtacagtcgggagtgagtactgttggtggtgtygggggtggtcctgtttgttgcaaaaygcacacacctcagtcgactgtgagttgtaattagggcatagttaataaactgtgtcctgagtgaaaaagcacattatagaatctgaaggtttagcagctgcagaatgaacggtagctgtctcggtggtgggtttgttttccctctttctacctttctgttactctaaaaattttctacggcgagcataaagtgaagaatcctrtaaatactgacgtgtgtgtacccgtgaagtgctcagaattgagacagtggacatgctcatcactctcac

SEQ ID NO: 1258 - DNA, 507 bp, Bovine  MMBT16070
actgtctgtgtatttgcagagtcggacatgactgagcgacttaccctccacctggggtccgtgtggcagccacagcacacccagcaccggcttcctggagacgtacctcgtctgtcctcgtctcagcttgggtaacagtcctcagggcagctgaagacacactcagttcgagagttgggccgaaagtgactgtgcagcacggcagccgtaggccggcgaggagtccaatggcctccgggaatcagactcagagcaagtagactcggagctgcagtctgcctttctttggcttgtgcttcyggaagatcacagagcctctgagactcactttctcgactgcaaaagtggagtaaaaatttcagtcttgatgacagtctccatcacatcgcacaaggggatgccattcacgtcgtactcgaggcgggtggtactcgctgaagttgcagggtacacgacctgtgcagctttccatggcagctctgcgtggctcaaaggccctggcgcatg

SEQ ID NO: 1259 - DNA, 600 bp, Bovine  MMBT18200
tttgtgggaattgtgtacagttggaccatcaaccttaggtgcatgtgctcagttgctcagtcgtgtctgactctgagaccccttggactgtagcccaccaggcttctctgaccatgagatttcccaggcaagaacactggagtgggttgccctttcctcctctagggcatcttcccgactcagggatcaaacccatatctcccacatctcctcatctcctgtgttgcagacagatgtattaccactgagcccttgggaaagccatcaaccctagacttgaagctattctaggcttctgaygccaattatgtcacactgaggaacatcagcttggctgggagtttgatcatgacgttgcattctacttgatccatggaagacagcacagtcccctcacgcccctggccaagcctttcttattccttacagaggaatagcttccatcaaatgttgaattgtgctattgttctgttctctgctggctctgcagtgcctagaacagtgcctggcaccttgcagacaatgaataaatgaatactcaccgtaataggcttcccgggtggcgctagtggtaaagaacccacctgccaatgcaggaga

SEQ ID NO: 1260 - DNA, 600 bp, Bovine  MMBT16238
tgagctcaagaagatgcagttgcagtaatcattctgcattcaacctagctgtcaatatcctccctacaatctttataggataggtgtcaatgttattcccattttacagatgaggagactgaggtgcagaggtgatgtgacctttgataagtgacctggcagagagcctgcactcttccgtgatgtcgtgggagacaaaggtttcctgggagatctgtgagagacatttggaatatttaagttggtgctggaaaggcccgtctctgctccctggaaatgcaagtctgttgttactatttygagtgcagatgtgtgtcctcccagagtcccagggctgaaggagaggagatgaaagggaaactttaacctgtgacagaggtaggaagtgcatgtaaaaccagtctcatttctctgaaagtgattttccaatatgtattgagagccttcacatgtccacatgtgtcaatccactacttcggttgttacaaatcagcctaagagaataaccaaagtttaagaagatttttctaacaatatagaaaccacagattctccatattttcaaattatacaggaaattttcaaaataacctacacaat

SEQ ID NO: 1261 - DNA, 600 bp, Bovine  MMBT15902
caacagccccgccccggccaggtaagacacgagaccttggctcactcggcgtctctccagctggactgacgcgtcacaagataaagtacagatgctcacaggtggcttacaactcattcttgaaacatttccagaatgttgatcttgatgttaactttctttcagtgatctttgaaaacgtgtgtcgcatcagacacttgaagagaggaagtgcttatctcatgaagaaagtgtcagtcctgtgtggcagctgctgtgtatggaatgttgagtctctttgtgacagttgcatggggtttytgtgttcagtgttaaggaacaatgcgtactggttgcttgagtttggtagtatcacggtcaggacagagtgaggtgtcacagaggtgcctgagggagattggacgcagcaagggcttcacaggatggaaaccctcaaggggtctctstgtttcgaaagtcatttctaaactttgattatatttttttctacgtcagagatgataatctccaaagaactgattcaaggtaacccacttkgtgggaggctgaagcttaaatcagaaaacccsttctttaatacagagtgagaagtggaatctc

SEQ ID NO: 1262 - DNA, 600 bp, Bovine  MMBT17745
actctcaaatagcccttggggagttgaattgctgggtagcaaacagattaaagtttgcattgaaagaaaaattgaattcagaggtaatcaatagcataataggggcagtgagtggtgcctgctgcctgaaatgaaattaccatatttttaatcttaattttccactctgtttatctgacagtgtggatgtgcaatccaaacagataatgagagagtgggatattgacactgctgtcctctggagtgcttgttttcagtgattaaatgctgtgatctgtgattactttgtgcaaagatgtyggggctgctggccagaaccatgggaggggcactcactccgcagctgcagctcccgactctcccaggtcctaatgtctgaaattcatcttccaccggcaatatagaaaaatacaggttgcctatttatgtgtatatttcagctgcacaaattacaataattaatcccgttattattcttgtcctgctcaaaaacrtccaattagattaatatggagtgaaccctctaagttttctattaatgaacccacaaacttgcttcttacaggaagatgtgggtcgcaggaaatgataggctgggag

SEQ ID NO: 1263 - DNA, 600 bp, Bovine  MMBT17299
gtgtacccttaagacaattcattttcttaatttcacgttaatggaaagaatggaagaggtttatttctggatcagaaacaacatgctgtggtaaagttgcacaggccttaaaatcaaactcaggtttgaatccagcaggctcactggcaatgaccttggcataacctccttcaatctcagtttcttgatctgtaaaattagaatcatccccctttccactcaagtgtgtcataaacgctcattgatatgacctgtgtcagtttccttgcacggttgcagaattttaggtggaccrtaaayagacaaagagagaccacaccctctctmaatttatgttcctggcttatttagcccagcatatggaagccgggtatcagccagcaaagcagatgcagcagatgactcttgtctttagctcctggggtccctaatgaggggtgmtcagctgcctgtgacactagtcaggtctcactggctcaagaagcttaattttgtgctgccccatagcccagttataattggggctgacatcaccactcgcgaagaacttacagaaacattctctgtccttaataagaaatacaggcctcgaccctgtat

SEQ ID NO: 1264 - DNA, 601 bp, Bovine  MMBT14563
  misc_feature (1)..(1): n is any nucleotide
natacatgcttagaattaagagtgaggttttcagaaagtttggaatatraaatgtgaaggagctcacatttagtggaagtcaattcaagataatgtcccatatgtgactgtggtacttttggagcaggaaggctccggacaactctgtgaggagcctccaagaagagattggtagaagaaacctctggaccatggtctatagtttgaccaaatcaacagcagtgtgattcttgggctgttcagtatgagaatcgtactggtgtgtggtgctttctgggcagtcaagctctacatcctgtcycagcttccctgagagcagacacgaccagactacacagttagggcctaggaagaaaaactaggtgacttcgagtcagcttagaagtctgacatgtctttgaggttctgtgtccatctggtgatgcagggaccacagactgtatgagcatcctgtatgacagataagaagtaacttctcaagataagtgtcccttatcccttaaggatgaaggtccttaagttcacaggggcctgaaaccctccttggtctctgaaggtcttatcttcagggagctgcaccctgccggtaggctgctcacaa

SEQ ID NO: 1265 - DNA, 600 bp, Bovine  MMBT17490
tggctcacttaaaaaacattttacttacaatcagtttattaaaggatatgataaggaatacagatgaacagcagatgaagagatatacagaggaagcctgggaaggtcccaagcacaggagcttctctctctgtgcagctggggtgcatcaccctcccagtaggtggatgtttgaacaacctggaagttctccgaatcccatactttggggatttttatggtggcttcttcatgtaggcatgatcaatcattaactaaactgttagcccttctcccttttcaagagaatagcagataaaygctgaaagttccaagcttctaatcatggcttggtccttctcctcatccaggaaccatccaggagtcccccaagagtcacctcatcagaacaaaacactcctaccacccaggaagttacaaaggtttcaggagccctgtggcaggaacccaggatcaaagatcaaatattagaacaaaagatgtctctagtatattttgacttaggaattacaagggtttcagaagctctgtgccaggaactagcggcagagaccactttgttgttcagttgctcagtcatgtccaattctttgcaacctc

SEQ ID NO: 1266 - DNA, 600 bp, Bovine  MMBT15081
tcttttaaattagtgaaggctagagaagaagaatcccattctctcgcataataaatatgcatggaactggggagccacgtgcattctaataaagccgagtcctggctggttaatgcgttataggtccacaacaataaaacacaataattactagttaaagagatgccagtgttggccttttaccaacatccctgaacatataattcataataaatttagtaaggctgaagtcggcctgttaattaacccattttctacaatgattgggatggaggaagccacgatgtaatccgccaaggygccctcccaaaggtgcacagctctcgctggttggactctgcagtttggacccatgcrcatcaccacaggatccttgcttgtgctcagacaggtgggaacactgggggraaagcgctaaaggaatatcttactctgtaactaccatatttgagaaatgaaattgcaggacagtatacacactgactggtgggtttccggggccttttttagaaccaacaatttaggcaaggaaagctgaggagaggggcttagcaactcagggactggagtaagatggtggacagaagacatacgtttttc

SEQ ID NO: 1267 - DNA, 600 bp, Bovine  MMBT17011
tctctgctcccacccgattaggaaaatctgagaacagaatttagtcatttgcggaggggcaccaggttgggggagatgggtcatatgggaaatgaactgaaaatgtcatgctggtccaacagggatgcaaggacaaaaatccaggtgggctgtgactctaaaacctgtgttctacacttctctggtacccaaaccagaaatgaaagagtcatccttgattctgccttcctcacatttctcatcagttccttaataaatccccttgggtcaacttccacagtagatcccagatttgtctaytttcttccactcccactgtctctcgttaygctatccaataaaccatcatctctccccaggcccaaaacagcctccttcttcatccctctgcccccatatttaccatctaagatccttcctcctcaggacagccagcatgatattttcaagacacagatcgaatggaaacagtcttctcctcaaaaacctattcacagcttcccattcctctcaagttgaatccttacctctttggccatctacaaaactctgagagggcagaaaccatatcagcttgttctcagsgtgtactcacagctc

SEQ ID NO: 1268 - DNA, 600 bp, Bovine  MMBT15606
tgggaagtcccatgtacagaggagcctggtgggctgcaacccatggggtcgcaaaagagtgggacacgactgagtgactggaccacccaccaccacacctactgacgggcaggtcttgtccttgtaggttgagcatcccatcacagaatgcatcactggcctggacctggtccaagaaatgatacgtgttgccaagggttaccctctcaggcacaaacaagccgatattcccatcaacggctgggcggtcgaatgtcgagtttatgccgaggtaaagygaacactgggaggagggatgaygggaggaagggtggtgtttgtgtcccgagtcatgggaccacgtataactaaacaacaaggtaaagtcagcgtcctgtaacttggggtcaagtatttgattatgtaattcagagctgaaccagaaaaagaaaggttagatcattttgacataactcaaaatagttttaaaggattgagtttaattaattttcatgtgttgtttctggatggaagaatagcttctaatcagtttaaggagcgagaaagaattagtttaatattcttgtgcttgaatggaccgtgggttttgttttgtttgct

SEQ ID NO: 1269 - DNA, 600 bp, Bovine  MMBT17246
cttgtcaggaagtccactttttaagcattctattgtcatttctgtccctgttcatggtgggtttacctaggacagaggctgcaacttcaacagtaaagtgtcaagacacaggcttctacattctatagcaaattcagttgatgccatctcagcacaccgacactgctcgcttcctaagggcatggttggcagacacttttattagcaatcaactctgccaccttctgcttatctacagatttaaggccacataatcatcctctgcgtcacagagagggtggggtggaaactaagagtctytaaatccctyctaacacttgcttcttccctaccagcaagattaaagcagtcaacagctgttggcatatgtgcccagaacagacaggctggactgggctgtccagagcctgaggaaggccagttctcagggcaatgctggggaccccaggtctgctggtccaggcctttctctctgagacagtagagggcacatgaccaactcctaggggcagtgagcaggctagggacccgaccacggccaggagggcaaagccagggctcccattcctccagctatgctgaaacagactgagaggagac

SEQ ID NO: 1270 - DNA, 600 bp, Bovine  MMBT17441
ctggtacatacatacccaataaatatttttcaataaaggaaaatatattgttacagggataaccagccatgactttcagaaagtatttgtgggagggaaaaaaaaacccacaactcttgggaggtttgaccaataaaatgacatttagcaagagtgatggaaaacaatgctctgaataattctgtattctgggtacaagagagaattagtacctgygccctgccctactcagtccactatctgcttttttctgctctattctgtgtaccaggaggctgatccctagggattgtattatcytcttcctctgaactctcccttagaccatgtggcttctggttgggtttggtcaatggaaattagcaagggagaggagaaagragtcarggtatttcttccccgctcctattctgcattagaaccctggttctggtagagattccacccctctgagtctgtggctcccaccagctccctccaagaagtctcttacattccctgatctccactracactggtccctcttcttccccctttaggcccagaggtggtgatgaatgcccactgctgctagtctctggtgcctcaactttcctcatg

SEQ ID NO: 1271 - DNA, 600 bp, Bovine  MMBT17895
ccaagggtccacagcatgtaagaacaaaaatcaatcttccccaaaatatctgaaagtcccagaaggcttacctagtagctcattatgaaatccagcctggttcaacttgctcagttggccggagaggtaacagagaccagagaaggggggagtgagcatcagctaactaaataagaacctcaaagccaaggggagggcagaaggcagcgctccacggtgattggtaccttcgggaagaggaacactcacacatgttatttcaatgctcccttggtgtttaacacaggcctgtggtttccygcaaaaatggtttctgctgctttgcagagacctacacggaggagagagctccgaagggctattccacaggtgagaatccagccaccagctgcatcctgttacccaaaggaaacggaactgtgagctgccaggacgcccagatagaggagagcaagaccgtaaattcaggagtgctgacaatcttatcactatggtaataagaataaactttaaatttagaaaacttcgcacacacacacagctgggttttatgtaaattaacctcagcaggggttaaaagagacatcctgtaaagagact

SEQ ID NO: 1272 - DNA, 602 bp, Bovine  MMBT16541
  misc_feature (1)..(2): n is any nucleotide
nngctatgtcgcagatgttcttccaaggagcaagctgcagtctatgatgggaaagagtaatttgttacggatctgaatcgtcaggtccagtcatttggcttgaaggattcagttgactccactgaaagcacatggcaagtatagctcctaaatgacagtaagaastccctcatttatattctctcatgtctctatctcatctaaccctgtcgggtgaacccctgctgccctttaaatgcaaattccatccattcccccatctgcatggagctgacaacccatcttccatgatgcttcrgcaytctgtatgtacttctgttagggcccctgcatgcatatcagagatttgtgtttccattcttgtgtccctcactggagaattacgtccttgaaaggagaacctcatttcactgtcgtttgattccccaaagtgaactgtgttcctacctgtggagtaatgtgttttgcacatttgctgaattgaatcagaatttcaggtttggaaggaaactttcccatcattctaggaagcctagaacagtagaaccaataacatctgtggcccgtccacccctcatttagtcgatggggttacagggctg

SEQ ID NO: 1273 - DNA, 600 bp, Bovine  MMBT17238
aacaggacgtaattaggggcaaaattccatgctttctcctgctctgtgaccccctgactgagaagttcttgccaaatttcttggctgctctatcaaccttctgacccccatgcagtcagcaggatgaggcagaaacatcgggggtgaataaaactcttccactgctccctgaccacggcccactgggcaagtggcttcatctttcagacctcagatggcccatctggaaagggggataagaagtcattgcccgcccagctcagtgatccaacatgtaaagtgagagtaccttcccaaaaygcgtttgcctggctcctcggctggcaggtgatagaatgcccattcgaaagagtctaggcagggacttccctggtggtccagtggctgggattctgctttcccagtgcagggggcccaggttcgattcctggtcaggggactagatcccacatttggcaactaagagttcagatgccgcaaataaaaggtcctgcatactacaactgagatcagagatcccacgtgccgagacagaggcccagagcagccaaagaaaacagatacttaaaagcaaacaaacaaaaacagaacaagaaaacc

SEQ ID NO: 1274 - DNA, 600 bp, Bovine  MMBT15604
gaagaaccttctagaaatggaaaacaggagccctggaggagtccaggccgatggtcccatgtctgggtctaatgtggagatggtagcccagaggactctactcgctccaggcggggacccaccaactacagaaacgacaggtgttctggaatcacattcacgtttgtttgtggtatatatatttccaggttagggtctcattccttccttcattccacaaatatttattgctctatgtcaggtgctgagtgaagggcttgckaactaaaagatgagaaaacataggctctgctgcctccyttccggaagcctgcaatctagtgttgaagacagatactagctaaacagcgacacagacaaatgtttaattacaaatcatggagcgggttctggagaaggctgagaggaggaggagggagagcgttagaatggagacgggtggcaagcgagggctctgaagaagtgacgtatttaaacggagacctgaaggatgagaaggagcttggcaagggagtgggggctgaaatgtgtgtgcatgtgcgtgtgtgtgtgtgtgtgtgtgtgcatgtgtgtgtggagggggagaatccaacatgagag

SEQ ID NO: 1275 - DNA, 598 bp, Bovine  MMBT17470
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnngcagcaccattcttgctaggtcatgttgctcatacccttcccagcctgccaggaaacccctgacgatgtgctgggcttgcagtaaggtgagtgagtgacaactctgataacaaatgccaccagctgctaaacattcctgtaggccaggcactgttcagatccgagaccaaaagtaacaattttgttaagacctttcttggcctttagcgtcaacayagacccgggtctgggtgcagartttgtctctgctcctttctagcagtggtcagtcatcacagagatactgaacacatctaggccttagtttgccatctgtagagaacgggctgtgcctaccttttccagacaggattctcaaatgggttcatggagatgaggtatggaaggagcttaacaagattgacatggcagaggaagctgtcaggaagtggagctctgagaaaacgatcaatcctcccaacaatgatatgagcttactcttatccccattgtgcagataaggaatctgaggcct

SEQ ID NO: 1276 - DNA, 602 bp, Bovine  MMBT17222
  misc_feature (1)..(2): n is any nucleotide
nngtatattaatattagagactgaaatccaaaatgattatcagccaagagattgttcttataatgatttattcaagtctttttttttttttttttttggtcttgtagggcttttaatgcacagtcaatcttttaaattagacattggccaagtgttagctcacaatctatattactaagtactaaaagctggcccagaattctggcaagaaggatgaactgtgaacagtgaggcctgacaaccaaaatggtatgaagtgcttagatcaccttgtggggaaatcttggcactaatactaatcygtatttcccagaagattcctctaagtgtcacacagtgaggaaaccattagcagacacactgtgagaggattttgattgctttgatacgtacgtgctgcatcttctggatatttttttactgctttcattacattaacttctctaaatagttattgaaaacttagactctataaagttatatagtcacattccttgctctatttaccccataagatatggatagaagcagccctggacattattaattgcgagagactatgaaaagcactacacaaagggtatgaacagtgctcagagttt

SEQ ID NO: 1277 - DNA, 600 bp, Bovine  MMBT17815
tgggattccccttccatgcagacaggctctttcacttcatttacttcccaaatttcactccccatccccaggcaacaaggtaattaataccactgctctggggagatgcacaggccttccaggggcccctgtgggcaagggatttggggcatggcttgagcaaccctgagtctagtctcctggtaggggagtggagtcactgaagggtgggtgggtgccctgacagctgggtgccagatgcaagttctcaaacagtcctgagcttcccctgtggtcatcaggttgaaggagaggaaaacygtggcagggagggccttcagggccagaagggaagcaagtgggggaaaatacctgtggtcactggctggccagaacgctgtacagttccaccctctcttgctgtgggtgtcccccaggaaagctcccagggatggtccacctgccacttcccaagtcacgtaataatcaggcactcttcacagtactttccatgtgttaactcagataatcttcaaggcccatttcacagatggggaatttgaggcagagaaaggctacaaaattagcccaagttcttacggttgtacaaggtagccgtcc

SEQ ID NO: 1278 - DNA, 600 bp, Bovine  MMBT15738
tatcattcgaaaaggagatcaaagtatatgcagccccctcgcccccgcaaaaaaaggaagggaaagaaagtgttatagatgtggttcaggcagctaattagtaaaagtattatgttaatttgtatatttagtggtgtctgtctattttccaggttttttaaatctgccgtttcttttctgaatactattgtaactgtctttgtgttcagattttgaagtaattttcttagagaaggacccctaaaccgtatactgttggagcccagaaaacctgtaacttcagaccaaccagaggtcacygggggtcagactgagatgtgatgctccagccgccaagctcaggctcagagcctgtcagggactccagctgaactaacaaggctctgacggtgggatggcagttctgggggcctctgcagcccgtccgctcattaatattccccggctcaaatctatgaagtcgacgcctcccacccggagctctgtcctggagccaaaataacatgctctaagctcggatacagttgaaagtgaaaccgcatgttttctaaaggtttaaaggctcttttgaagaagggcatagggtcaggaaagaaggag

SEQ ID NO: 1279 - DNA, 600 bp, Bovine  MMBT18374
tccctccccaaaacacagtgcagaagccacacaagcgagtagtaaaaggtacttaataagtaataagggcaaacactgagcacttactatatcgtatcactgctctagttactgcacrcatagtgaccaattgataccttacaacagtcctacagggaagcgtttgttattttcatcctcattttgcagagtgggaaactgaagcacagagaggtcaagtarctggcccaaggtcaccctgcacgaagtggcagaactggatttgaacccaggcagctgggcttgagcatcagtcccttyaycacgactctggtgcatctttacatttacaacagacaaaccagaygttgttgttgttcagtcgcaaagtcatgtccaactctttgtgaccccaccaactgtagctcaccaggctcctctgtccataggatttctcaggcaagaatttccttctcctggggatcctctggacccagggattgaacccgtgtctcctgcattggcaggctgagtctttaccactgagccacccaggaagcctcaaattaaatgacttcggtgggtaacagagttggggcaaatcccctgtttaatgaagcc

SEQ ID NO: 1280 - DNA, 600 bp, Bovine  MMBT14635
cacagaaactggaggagttgtttaaactggaacaatggcctttagttagaactttctactggtttgctggcctctcaatcagctggtgataagctgatgttttgttttgttttgttttagactcacggaaagagacaaaagcaagagattacgtgctaggtgcaaagctggagctgaataaatactggttaatcaatgtagctctgttaatttgaagtctcatttctcagcctattgataaaatgcagacaggggctgtgtggagagcaagaagcacccaccagcagagggaaagaggayggcggggagagaaacccatccagttaacccaggggggcaactgactgggagcctaggatttagaaaaggcagaggaaccagagaycaaattgccaacatctgctgaatcatagaaaaaagcaagagaaaacagaaaaaacttctgcttcattgactacaataaagccgactgtacagatcacaataaactgtggaaaattcttaaagagatgggaatgccagaccaccttacctgcctycaatgaaacctgtatgcaggtcaagaaccaacagttagaactgaacatggaacagtgggct

SEQ ID NO: 1281 - DNA, 598 bp, Bovine  MMBT14657
  misc_feature (1)..(91): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcatcccccggctcctcaccccagtcacccaggcaacgtaactcaaggggtcagcagttcaagcaaagtggggaggggtcgctaaagcacaaccctccttgggcaggtgactgccaggccctcacacacctggacccggggtcctgctgtggcaacttaccttcttgagtttcttggttttgacctccacctcttgctgcagggaygtgtaggtgccccggagctccatggtctcctcatcccggagcatcatctcttgctgcatttcccgctcacggcgtttctaggccagggcaggggacagggctcagaggagcagcacatactggcaagacccaagggagctctgcctgtcatggaacctggctccgtcgtggccacaggagccaggaggacacagagagtttctyacagcccaggtccatcactcccaccccatcctcagtggaggcctctctgaaccttcttctcagctcacagggccgtgcttttgcaggcactgcc

SEQ ID NO: 1282 - DNA, 600 bp, Bovine  MMBT18404
taagtggcccagaataatggcttagcatggataatgtcttggtttaattggtattgtgaaagccgatagtttctagcgtggaatcccttgtctctgcctttcgaacaatccctcccaggctccctgaatcaatacagccgtcacgtggggctggcgaggagcctgctttgggatggccaccacactgggaagcagctgtcccacgggactgcccagatccctgggttccagctccctgcagcacggggttcatgtgagtgttcctgtggaaggacgggctagagactttctgttgccaaytgacccctgcgagagtctctcccggttaagttggaggggtggagacggaactgacaaaggcgagcagaaagtgaccccttttacagaagcagagccccaacaaggccctgaggtggggatgctgctagaayggaggacggcctttgcagaggaaggtgacatttatatctctaagaaaaacgagcctagatgatcctaattcccattacggcatttctttccaaggtcacgatatttctcttaagtcttcctaaatcttttgaccttaaacatatttcgctcctgtccttttttaaggtg

SEQ ID NO: 1283 - DNA, 600 bp, Bovine  MMBT15753
aggtgaactcttgcacattcttcaagatccagctcataggtcacctcctccaggaagttttccwtgccctccaggcagagtcagcccctttcccwtgctagctgtgtagaagtatacgctacttctcccagcctgtaattatctgcttgctggcctgggctccaccgtcctgttgttcacagatattccctcctcctctctggagaaggaaactacttccctgactcactggcctcactcaggcttgaccatgtgacttgccctgggctgtgaagtggaactcatgagtcagtgaggaayagaagcttccaaggctaagtatggttcaccatgctctcttttccctttgctgcaaaggatggcaatgccccatccagaaaccgcgctgccagcctggcactggagtaaaggaaagtggaactgactcatgacatacatgaagcgtgagagagaaatgaacttgactgtgatgcatgaggcctctgggaccatggaatcatgtgttactgcagcataaccagctgatcttggcttctccaacctttgcctctctgccccagctttaccagcacaaaatcaggaatctcatcttactcacat

SEQ ID NO: 1284 - DNA, 600 bp, Bovine  MMBT17271
acttgccttgggtgatctctgccttgagctcatgttcagtgaagtagatgtctttgggtaggttgaagaaccaattctgtgtccttgaaagagtcaagttccctcaaagggttgtagagttctagggtaagcccatagcttgtagaccaagctgaattagaaccttgccttaagagatgcatgacttccaagttaatcaccattactgaggttccatttactcccctgcaagaggaagaaatagggcttccatttggctcagtggtaaagaatccacctgccaatgcaggagacatgggytcaatcacctatctgagaaaatcccacatgctacggagcaactaaccccactggccataattattgagcctgtgttctaaagccttggagtcacaactactgaaycccatgtgccctagagctggtgctctgttctttgttaagaacccactgcartgagaagcccatcatcaaaactacagaaaagcccatgcagcaatgaagacccaacacaaccaaaaataaaataaacaaataaaattatttttaaaatgaagaaataatattctaatgattaatgccaggtaattaccatttttt

SEQ ID NO: 1285 - DNA, 600 bp, Bovine  MMBT16209
tgcttgctatggagcagcttcccctctgaagttcactgaaatattcaccagagatggtgggaggcagtgaggcagttggagggccccagagatcagccagctcaggactgtccccaaccacagggttagagggggwagccagggccagacagggagagactctctgggtcaaggaggccccaccagagtctgcatggactctgagccactggactcccaggcctgyacctgtyctgctaaactgggcagcccggacctctgcagggccttcccatcctgtctcacctcatcaagctgggyggaaacatacagtctgcgtcctaggtcatcaccttgacattycaygtatgaaaaacaggtggaaaaggaaaagtggctcatgccagaccacagctggtacctgacctrgcaggtttggggtccctttgcctagggctcacttcaccacatgcctgggtctccctaaggaaatgccccgagtctcagcccaagccaccccctcgtttccctcctggaagatgtgcagagcatccaaaggctaacccagaagacccctgcattgccatccctagccctggaggctgaatgtctttaccttca

SEQ ID NO: 1286 - DNA, 600 bp, Bovine  MMBT17922
gacaaacaatgagtaattttttttttttttttttttagctcaagaatgtcttgggcaaggctgataatatatcacaagtctgcaacattcgggatattacttgctgtttatctgaaattcaaatttaactgggcgtcttgtgtttttatttgctacagctggcaactccactaaggcctctctctgcccctgaattcaccccatttcagctccatcttggcagcagcagaagcaaagggcatatccagggccagaacccagccaagggcagagagccaggctctgggcacaaggaaggcytctcatgtccccagcctcagtttccccgtctttgtaactcagcaggaaaaatcttggctgctcgggccttttgcaaggatgaatcgtgtgatgtgtgtgtatgtgggaaacatgttttgaaagtgaaaaaggtgttgtagaaacattagttaccagaactcattgttatgaataacacaggtcagccagtggaggcggcttctggcagctgggttctttttttgaaaattcgtttttcgaaaccagcaattgctgtttgttcttaaaaatgttagaagtggaaagtagcaaaagcagaag

SEQ ID NO: 1287 - DNA, 598 bp, Bovine  MMBT17982
  misc_feature (1)..(83): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnncactcagctcatctgcatccctggcttccttctgccctgtaaaggcatttgaccacgagaaagccacttttgccctccctcacatcagcacctggccattctgcttgagcttggggtggggttctcggtggaggcatttgaggtggtttggtgggaggtaccagggcccccatgggcaggagtgaggggcatggggtacacagcactctccaaggcytgactgcttgtgaggtttgcaagagagtctttccttcctctcttcccaactctccaggaccttaaagaacacccyagaactgccactggctcatgtggtctctaacagctgttactgacctctgaggcctggagagactggagtaactgcccgtctgagatctcctggagggaaacagagatgaagaaggatctgtaacagtgctggttatttacacatatgatactcctctaaactcctacctacttctgagatttctctcattctgagaacaagctacggataaattctgatagaa

SEQ ID NO: 1288 - DNA, 600 bp, Bovine  MMBT17131
atgccttctgcacgtggacctcagggctcaggtagccactaaggcacaggctattcttcccatcccacagaaggagagaggaaggtcctttccacagtgggcaggaccaacaagtgcaggcatgtacgtgacaagccagtcaaaagctgcctgccaatctcgctgtggacaaagtccggcgctggttctggctcccccagagtccaggcctcccaccagcctgcctcagtctcctaattgtgccctgggagaggactgtgggtaaacacgcagaccggacattgatggagagcagggcayggggatagggaggtgggcaacatgaggatatcttggcaagaggataaacacaagtgcatttgatccagaaactccacttccaggaatttatcctgtggatgccctggcactttcataaaacggctcacgtacaagcatagttaatgtggcattttttcctgtaacagcagaggattgggaaaacaacttatatgttcatcaatatgggactattattaactcaatgagggtgtgctgtgtagccataaagaatgaaaatcttttatacactgataaggaattctttcagagaaagcactg

SEQ ID NO: 1289 - DNA, 600 bp, Bovine  MMBT17019
cctctgccaccacccgggccttccgaagtagtgctgactcccctctggcctaagactggtccccacctggctcaggttcctgcctcgttcaaggccgagcaaggtggtgggatgagggtcgccctgtcacctcacccctgccccggtgtggtcctcagccagcagagcggtggatgaaggcacaggatgtcacagcctccctggtccagacgccactcctctggcaactctggaccccagaagctggggctgtagggagctcttgtcctaagagagtgttcggggcggctggtgaacacygtctgcytctgcagggctgagccggatcctgaagacccgtggggagctggtgaagaacaggactgtggactgggctctggcggagtacatggcttttggctccctactgaaggagggcatccatatccggctgagcggccaggatgtggagcggggcacttttaggtaatggccttggtgttcttgtgggcccttcagagtggaggagacacaaaagaagggctgtggtgtttgtcttccagaagaaaatcactgccaggaagcagtcattagatcccattgtctcaggcccagaagcac

SEQ ID NO: 1290 - DNA, 600 bp, Bovine  MMBT17769
ggagatgagcgctggggagggcagggatgcacactttgcattttctcttggatgccattggcagtgaggagcaaggcagggtaatgatgggggccacccaatgacgagggggcctgtctatggctgtggtacccaggctggcctggctctgcgcctgagaatcaggtagctcctccctccctgaggtcaattctaagtgatactcattgctacaccacagcctcccagacctctgatggggcgtgtgtgtgtgtgcacgagtgcacrtgtgtgtatgtctgtcccactgttttcatgcaygaaaatgcgttctccacatcctgggggtggtgatgctacattcactgtacatgtggaacattccttytgtgtgtgttgtattcgttttaaacactgagcacatcgaatgtgtggtatgaatgtgctgcatctttcatggctgttgtctggtttgcatcgtctgtctayctttgcttgacggtgcctgtgccctgcgtgtgggttattgttcatgtatgtcatgggtgctacactcctrttgaatgtatatggggtatgtattccacatattcttgggtaccgcatggatgttatatgcac

SEQ ID NO: 1291 - DNA, 579 bp, Bovine  MMBT17749
aggagaagyttaactctacccttgtattaactgttattttctgagtcctatattgtttcctcctgtgtatttcttattttgtttaaagccgttagtcattggatccctgctggaaaccgtggtggcttgttccagtagacagacagactgttgtacctgatggtgtctggtgtggggcttctaaatacaagtttcgctctgatgacctaggtcggcttgtattgccattagtgtcagcatggaagctgagaaaaagctgacaaataatctagtgcagagaagaatttcttaaatagatayataattattaaccctttctctctcttttttttttttttactgaaggccattgaacacccagttcgaaccaatcagattccacgtcagattcctgaacagtctttctacacaaagccattacctggtattatcatgggagggattttgccctttgggtgcatctttatacagcttttcttcatcctgaatagtatttggtaagctgagcactaagtcctcttattctcgttcccattgtatgtactactagctttctcttttgtttatagggcttactgt

SEQ ID NO: 1292 - DNA, 601 bp, Bovine  MMBT17924
  misc_feature (1)..(1): n is any nucleotide
ncaagctaataaatgacaaagtgaaagcgttagttgctcagtcgtgtccaactctttggtgacctcatggactgagcccaccaagctcctctgtccctgggattctccaggcaaaaatgctggagtgggttgccactcccttctccagagaatcttcccaacccagggattgaacccagtctcctgcattgcaggcagattctttaccatctgagccatcaatgctgaaggagagaagcaaatccaggtgggctggctcctaacctccatcttcagtatcagaaactaagctaaataaatygtttcctctttgctytttgttatagtctgactcattcttctaaatgactactatcatattgttttgtagggtttactatattttattaagtcttcttccttttgataggcattcagaatggttctcagcctctctctgtctcattctctcatctgcttctgtgtccttctacaaatgaacctttgtacaacttttatttctgraataggtacttccagaaaagaattgctggccctaatggtaaaaatatattgaattctaataaatattgctagaattatattgcaaaagacctatgca

SEQ ID NO: 1293 - DNA, 584 bp, Bovine  MMBT15265
aatcgagctttgtgtaaaatttcagcttctcttaagacatcactttctttcactaaagaaaaaaaaaagcataattactttcaaaataatgaaaaatacacaattatcatgcccataataaattaattctggatttttccattcattcattagcttttgatctcatgtaaattaggcaacttttcttagtttcttcatatttaaaggagggataatctctaccttacatattccataggtctgtttagagaccaaaataacatataaaccactgacagaaagaagtgctacacatagatyaaaactgtacttttcctaggaaaggcaaagaacacaatgtttgtttataaagtctatttgtattaaaaygataggtgcttgaaccaattacataagtttctgttgtattaaaatgataaaattttattagactgttacattaaattttacggttgcatatcatgtaaaaattttctaaatatcctgaatattaaaacacttaaatgttgtagattttaatgactagatgataatagtcgcataagggtcaataatactcagaaattataggctggaactcagga

SEQ ID NO: 1294 - DNA, 600 bp, Bovine  MMBT17683
ttcccctattttaatttctttacaaatcttgaggtaaaaagttagctaactgcttcaaccatcagtccaaagagaattagggattttagaaaataaatattactataaagttgcattaaaggataatgcgattgttgatactaagaatttgtcagataagtatggcgtcttaaaacattactcaaaaaaaacattactcagctaatggaagtagcacagttttataggttaacacaatgtaatattgtcagagagtttttaagagcaaatgatagagataacagttccgtacattatagytcattttacttgtatgctcatgtttagatttatctactcttaaataatggtcggtaaggaatttagtaacttcagattaatgtagcctgttggcagaaatcccgcttttttggtatgaagtgataatgtgtaggatcatctgtccctcccccctcaggaatgtaagctccagtggtggccaggttcgcatctgttttacttgttggcgtttctcagccgtcctccgagaggtgcctcactcagagagatgctcagagaaaggtggtttctccactgaaagactgcacagtgatactttat

SEQ ID NO: 1295 - DNA, 598 bp, Bovine  MMBT14982
  misc_feature (1)..(27): n is any nucleotide
nnnnnnnnnnnnnnnnnnnnnnnnnnncagtacttaccagtatgtggctcataccgttattatcctttttcttgtttccattatctctgacaagtgactctttactggaactctaaatgagagctgatttctaccaaaaaatttgcagtagcctgttgagttactattgaaatgcaacagactgtggctaaatctrctgtctttgtgtctgtgggaaatggagtttcctgaagctcataaagttaacattactcgcagtaagatgatttccccagagattatgcttcaatatggaatacyctagatttatggcacagttccaatctaggttttggattctttctacagataccctcataaatttatgaatcaaaacacacatttagaaattaatggaagcatgaatctgaagataacaattccaaaagtcagcttggcttttagtgtygtgcagaaaaaataaattactctcaatkggaatttagtttaatttactgctyaaatattcaattgtaagcattaagtatactttaaatggattctttcaaaagtagttcataaaaaatttgttgggatattgctaagaaaaattgataaa

SEQ ID NO: 1296 - DNA, 578 bp, Bovine  MMBT17722
acttttactttaattgcatttatttttcaataagcagggctgtcacattgttgaaaatgtgaaaaatattcagtaaagtctccccgacacrcacattccccaagcattcatgccctgtctatggaagccatcaatattagcaatttcttacatattcctctggagatattctatgcttttatctaagaaaatatgtttctttatattattcctcctactttacaaaaacaaaagctatcatttcataacactgttctctttatttcacttagcaagactcactatgtaatgagacataayagtgtttcctccctttttaaaagcagcagcatagtccaggccacggacgcacaattattttattcacccagtaaatggaatgcttctgattttactctctttctcctcaaaagaggaggagtaagaattagttgattcattcattggcctgagaaagcctgttctctactctgcacatttgggatcatcattctccaaggtctaagtctgggcaggaggagcatcacctaagtatgtcatatcagtaatggtgttgctgccattcacgatcttcttat

SEQ ID NO: 1297 - DNA, 600 bp, Bovine  MMBT16952
agaaagggattcaattttctgttttgactgggtagcaactgaggaatcacacgcaggcttggggaaggccaggggcccacagagctgccctggtttcttattggcccttccttttctccctcctcaagcatcactattacccccaagtacgctcctgacccccctaaattcccatccagacaattttgattgcccacattcttgcctaattgaatgttttgccgttttctccgaggttgagttctacaatccgagtctgacaataaacacaaatttgctacctggaacttatttcagtgyttgcagagttcacaaatcttaaaatcaaatctgtctgaagggcagacaacaatggaactgcagaggtaacgccatcccacctgtatgttatttttcatttacaataaccacgaaagctaatacttaacaagctggcctctatcaggaaaaagcaaataagctgttccttcctggttacactcgccaaggtactggagaccgcggctgacggttcaacttccctctaaaccacaggcgctttggaatcaggccggtgttttcccaccagcttgtgatccgaactcggagatgggtgacagt

SEQ ID NO: 1298 - DNA, 600 bp, Bovine  MMBT16334
ataaaaacgatacaaatgaacttatttgcaaaacagaaacagactcctaggcagagaaaacaactttatgattcaccagagrgggagaggaagaggaataaattaggagtatgaaattaacagatacacactrccataaataaaatcaacaacaaggatttactatagagcacagggaactatatttaatatcttgtaataacctataatgaaaagaatatagatataaacttataaatacatgtaaccaaatcacttttctgtacacctgaaactaacacaatactgtaaataaactayacttcaatctaaaaaaaagtcagctatatgccatcamatgcactctttgaacaaatcatttgcccaagacttttgccctctgtctaaccatactttactcaaagcatattttcccatagataatattcttagatgtgtcttgtgacaaccgcttacactgtctaaagttccaaagcttatctaggttgggcaaatacagcaattgagaacattatttgcaatatgttgaaagattgtcaaagcattaccccaaagacattattattctatcatcaaaatgctcacaattagaggaggttt

SEQ ID NO: 1299 - DNA, 600 bp, Bovine  MMBT16941
tccaaaatataaactaattttatcaaatttgcacaagagaaaaataaaatgatactggtacagccgtatgacacccaaatgtcaaacacagcaaagtatctcactcaaagcaagagatcactgccctgcctgctttatttttctaatatatggtccactcagtacttctaaaaaagtatataaactcttctttccaactgttatttacaaaatatatatatatgtatatacttggagtaagattaataaatccttkaaagtatatatatatwttttcatgatttaaaggaccttaacaaygccctagtcaatgcagttacttgtgctgttgctgaatctcactttatgatcctctcatataaattgttcatgaggggacttcctcttataggctcttgaaacaagaatgtatcttgtacatttatgttacgggtttatgatgatagattgttcttgccacagaactggaaactaccaagccagtttataaaatctgttgataaaaatagtgctcacactaaagcagactcatttaccaagcaacccaagccttctcaacaaatattcaatttcccaaataaaattagaaatgttctgcta

SEQ ID NO: 1300 - DNA, 600 bp, Bovine  MMBT17245
taatgacattggctccaccaatccatccacctaactgtgcaatacctatcattcagcattgctttccaccaggggcaggtaattgcaagcagagatctagggacacaggagcccacaggtatctaccctcaatgggcttgcatctgagtcaagaaccagtactcatcaacacagtgttggcagacgaagagtcaggagtgacaaaactgctcttcatcttaaaataagtgatcacttattttaacactgagaatgagtcagtgatttgaaaaccaaaaagatagtcctaaactgcaatcygtctatgatgtgcaatactcagtgtgcctaaatatttatctacttcacaactggtttgcccaactctttttcagggacaagactccacatgtggtgaaaaccaccagctaagacttgtcaggaaagctgtcagtggaaactcagtgagggcagggccagtgtcttattcgttttggggctctagagattaaggttggtgatcagaacataagagactaataataaatatttgctcaatggccttggatcacaactttcctttgtctacgtctttctacttttatgaaacagttctacata

SEQ ID NO: 1301 - DNA, 600 bp, Bovine  MMBT16169
aaatctccatactttctggattaaagtcaaggtggaatatcatgagattgccaaaaaagcgctgaaaagtctgctttcatttccaacatcctatctttgtgaagcagggttttctgcagcgacagcaatcaaaatgaaattacagagtagactggacatcggcaacacactttgggtatcactttctcccactgcccccggatgggaccaactagctgcagaaaaacaagtttaaggctcaccaatcctgcattgtagtgagttgtataattgtctcattatatatcacaatgcgataayagcagaamtaaagtgcacagtaactgtaccttgygtaaataatccccaaaccatctccaccccagtccaaggaagaattgtcttccttgaaatcagtccctgctcccaaaatggatggggactgctgcgtttgaygatcataaagagaggtcaagatggcagttgaacacgtgtggagggtcaggactgttgacatgactttcatcatcatagacatgtagattccactggaagtcacagtgccagatgaggtcctctgtggagaggatgcagacgaggactgtggagggatgcccactt

SEQ ID NO: 1302 - DNA, 600 bp, Bovine  MMBT17253
gaaataggagaacttctcatgaaggaacctacacaccaatcatatttcattttgacaactggaatcataaaacttcaattttaaataataaatcaaattgttgacattttacctaaatcaataatcttctcatttcaaagaaaaaatagatatgcccttaaatgaaattaaacaatttattgcttaaaaagaagagcaacaataaaaaagaaatgtcgaaatttctatattttataattaccctcatatattatgtctttatatttctgacccaggtttctaatttcattagattctgaytttcaaatttcattgtaggaaatgaattgcttccatgtacttatttttaaaaattcaatacatttgagccactttatgttttctttgccaaacttttagactaattgaaatgcactttagacattcataagttgtatttcatgcaaaatgtgattcggccacacagcatatggcagtcacatttacagtggtaagcatttaaatttttatattttatgtttaaaagagacaagtatcttgaaatatatatttaacaattttttgcccatagtgttgcttctataatcatgcttcttataa

SEQ ID NO: 1303 - DNA, 600 bp, Bovine  MMBT16970
cacttgtttaccaacatagcaattgggatgtttaagaaagcaaaatagaaattccaaatcctctaataagttcacagctaaaaacaaatgagatgttagaatcttcagcatatatttagcacattacactgaacactgtaactcactttgaacagtatttatcctcttaagtaaatttgaatctgctgttgtatctctgcatggaaaaaaaatgaaggcacaagggtttgggtttctatggaaacctgtactttgattactgatggatttcaagtgtataatttttcgtcccactggtayaatgttcgggggaaataaagggaaagaagactgcaaaattatcaggaatatttcctyagatgctaatattttcagaaccatagattgaaagatgctggaagacacttcaaattaatttttaactttaatcaataaatagttattgagttcctattagatgccaagaacwgtcccagtggctattgcagttaataaaasagataaaatttcataaaaaagctttrgatataactttaccaagaaacttgagcaataattaggtgtttgagttttgagttatttgaattttgttattttttc

SEQ ID NO: 1304 - DNA, 600 bp, Bovine  MMBT16321
ctgaaatctctgtgctttcataaaagcctatggtgatcttaaaaatttgctataaggcagcatgaaccccatatttagggattgggggagctgaagtaatattatttgtttctcagataagggaattaagccatgcacaagacaaattataggcaacataaacctatatttgtctcaaatctctacacattttacatgaaaatttttttttttcagcaaaatttgtcagggaaatttycaggtttgccgaattttggaagtcactgcctttggcaacacttgcttcaagtactctttaaytgatatttcataagatgatgtgcatatatcctgttgattaaaatcacttaatttcttctttatgtttctggaccactgccaaaaataataattactaaatttaataagccacatataagacttgcagtaactggtagaacaagttgagatcctatacaacgtgacttggatagaacagattatagtgggttgtaccctcttctccatttaagaaataaaaactataaacagaagataaataggacaatagcatatatagaagtgggagccagtatgaagacttaactcaaggaactaaat

SEQ ID NO: 1305 - DNA, 598 bp, Bovine  MMBT17742
  misc_feature (1)..(174): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgcagcatgtaaggcttccctgacctcaccaactcccagagcttgctcaaattcattccaccaagtcagtgatgtcatccaaccatctcatcctctgctgttcccttctctaagtgtaaagtyatctcatggttcattgccccttatgtcagtattagagaaaaacttgagcttacagtgattcagaaagtatcagatgaccggttttatttattaactgatttttttgtagtaaatgtgttttgtacacaaacaagaagagggaaaaaatcaaatatactccattcttaaaattatgtttttttatgagtgaggactattagtgaatgtaaatagtaagctatgcaaactcaacagtaaatattcattaattgataagtaccaagtgcaatatatcttgtatatatagttgtacgtttca

SEQ ID NO: 1306 - DNA, 600 bp, Bovine  MMBT16868
acctgaacataaaagcactgaaaaaataatgggaattgtttgcaaagtccaartacaaagsaggtaaagcagttttggagaaaagcctgagagttgaaagcgttttcaagttgttgtaactgtcggatatagttctcacaatgactttaaataggactaggctcacaaatgggttgataataatctaaccatttgaaggagagactaatggttttattttttggcaaaactacaattaggttgaaaactgcttgatgaatcagatgccgcaaagcaacaggtaacggggtagtttgttgygatatttaaaatcctgggccctgattgggcttttattcatgcactagtttatatacgagaggcttgtataaactgaaacaaatacaaaaaattaataagcatgttgtttagatggaaagtattactgccttctgtaggtgttgtcagattctattagccatccctgtcttaatgcagaaagcaagtaaatttgaccatcttccactctgaggctcttgtgcaactgtttcccctttggaaaccctcccccttttcccattcatctgctactttatgctgaaaacaacttctttcaaatcc

SEQ ID NO: 1307 - DNA, 600 bp, Bovine  MMBT16900
ctttgacaattttatttaagagtccatttaagtaaatatcagcttctcttttttctatagccagagaaaacctatcctgttaaatttaatggcaacacttcaaattaatgagccatcattcctctgatgtgaactcactgtaatatgccactggaccttcctaggagcttgcactcagaactgcagaaccaatctctcctcrctaaaatatatgcaggttctgcactggggaacgaaggcagtggaatggattaagcggtatctgaaggctgctggagatttagagagcaaacacaacaygtgtcctggtgtcccttttcttcaggtaaagttgcaagcttgtctgaaaaattgraattgcttctgtaggttacataattaaaagtaagctggggataacaaagtttgccttgaaagagctagaaaaacccatagaataaaaggctggtaactgataggaagtatgaaatcaccccgagagtccaactaatgaaaaggaaagaggttttttagattggagccaggttctaaaacttggattcaaagccactattcaactgaaatgtggccatctaactgtggaccaaccatttctccctc

SEQ ID NO: 1308 - DNA, 600 bp, Bovine  MMBT16737
tcatgtatttatattctctgataaaattaagtctgatataccatagatattaattctactattgaagaataaggaaagcttttttcacaaataagaaaagaatttttaagaatatatatgaaagtatagtttttttcagtttttattgggttcctttgsataagtatttctagactataatcctctagtcactagtgaaaggactctagtttgtgctctggtgccatcagtctgcccataattctttactccaaacacacgagcagatttctcccttaattctacaaaactttgcttagyccaagttgtaattctaaaccaaactttagtgaaagcttggagatagcaagaagaaattatagctctgaaaagaaaatgttagcaacagacaggggccataaattctcctggacaccaaaaacgatgggtcttcacacagtgagtatttttggctctttcttgccttattgcccattctcctactgtcagatggcaagggccagtttatttccctcaatggtgatgtttgaacctgaattctaccttcatcttctcagattatggcggtgatggaggaaaatattattttccactcccagg

SEQ ID NO: 1309 - DNA, 600 bp, Bovine  MMBT16079
ttccctgcccagttcaaatgtaattgcttccgtgaagccatcctcaccctgttccccagaaataattaatcaagctctccactgcttcaatagcactctataattcttctgttagagtacccatcccatattacagttgcaacagggatcaactaggagctttctaagggaaagtactatctcttaaatcctcaggggctgagtagcactctgtcaaccaccatcaattcttcataaaacactgggtaagcagacagaaagataaacagaatctgctaagaaaaattctctaaggaataycctggtggtccagtggttaggactgtgcactttcactgtctagagcccagattcaatctccctggtcagggaactaaaatcccgaaagttgcacagtgcggccaaaaggaatatagttcttaaaaagaagaaaagaaaaaatctttcaacaataaaaaggttctttcttattcttgctcattatgaaggaaaaaaaaaaatcagaaaaaaggcaaggtaggacaaaagcactgggaactagtaagaattaactttgacaattcagactccttaatggagctctgtgtcaggtaggccagg

SEQ ID NO: 1310 - DNA, 600 bp, Bovine  MMBT16901
tcagtgctttgtaaaggctcttttttatttgtgtaaaaaaaaagtagcaacatgaagaagactttttataagtgtgaagaacaaaaattgcactccttgtatcaaaattaagttactgaaaaatgtttttgtgactctttctgctcattctcaaccatttcaagaagggacggtcctagtatataagcatcgtattcaaagtattttgtcaccttgcatattatgttactaagagctatgctgttagttaatttatttctgttttagtcacatagcagccagtctcttctgctcatttayscaatgaataaggtttctcttgtactcctctttcattttagaagataaagtaaatgtggcagatttcaaaaaactggagtggcttttcccagaaacaacagccaattttgataaattattgattcagtatcggggattttgtgcttacacttttgctacaacagatggtcttctccttccaggtacgtcattggaaataatactgttctcccttctcgaatttttttttatttaaatgaaatgtgcttattgtcactcattcactttgtaaaactttatggaatctaatgttgaactaag

SEQ ID NO: 1311 - DNA, 600 bp, Bovine  MMBT16410
aactagcaagataatactgctatattttcgtacaaactycccttctcctaactctgtcctgaggagtgggctaccataacttcacctgggagatcacaccaccactttgtattatatgtaaaaccaartcatgcttcataattagaatgatgtgattattaaaatggcaattgtttaaaaatatccttttataacaatgccatggctcaattcttactatatcagaatcccttataaactctgttatatattaaaatgtgttactggtttcaaagatgcttctttgagaagatgtagacyttactctaacagtgctactcatgatcaaagtgtctttggattcttgttgtaactgcctagtttatttattgaagtatagttaatttagtgttgtgttaatttctgctgcacaccaaagtgattcagttatgcatatatatatatgtatatatattgattttttggtaatccttccattatgctttttttgtgggatactgaatacagatctctgtgctctatgctaggaccttgctgtgtatccgctctgcatccagtagctgacacctgctgaccccagcgcccagtccctgacccctc

SEQ ID NO: 1312 - DNA, 600 bp, Bovine  MMBT16206
cttttggactctgtgggagagggagggaggatgatttggggaaatggcattgaaacatgtaattagcctctaattaaaataaataaattttaaaaaagaaatgatagctgtatatagaatagatggaaatgaaaagtagaatttttcccaccttgcaagaaagtgtgatcctgtggtgactgtatcaagggtaagtgtgactctctatcaaaggtaagaggggtcaaagtttttaaatatatttttataatattcagtttttcaaaaacttgaaaatcattgcatttccatttgatcctyatttcttatatccgttataggtagattctgaacagaaatctctagcctctagagtttattgtttatatttattagttattagtttatattctattatatgaacagaagtctctaacctctagttatcaatttataaacagtatatattcaggatcaggtcataaaatattggctctggcctttgcttctaatttcttttccttctgtcatccatcatcttttctagttctcattcttcaaccatttcaccagagacaagttgaaagttaaatctaccttaagatatacctcttttacaat

SEQ ID NO: 1313 - DNA, 600 bp, Bovine  MMBT15087
ctmtgttactgccgctgacctgagtgatcccagtgatgagaattctcctaggccctggccagaccgtggattttgagtcctaattgtatttgggagtgtgtacagggtcttaattggattctaactacatgtgtgatttatacaatgagatatatactgatattactatttcccagatacaccacttatgtggcttaaatatgtgtcctggaccaggtgctatgaggaatttaaaagaaggaacggcctcaggacatttagaatttaaagtgttcctgggacaaatacataaatgaccayttatattagtgtatagttctgaaatgtatcaactttaatttttagtttcatgaagtcagaaatgaatttattttctctaatatctaacccatggttagatagtattacatatttcttttctagaaaatgtagaatatttcaagtcccttgcagataattttttcaagtaagaatattaaatatattaaatatttttcataaaatccaaaaatattaccatacatttttttaattaagaaaaaaacagtattctgactactgtcaaatttggcaatgaaataaaagcaaataatgtatatt

SEQ ID NO: 1314 - DNA, 600 bp, Bovine  MMBT16118
tttttttggcatgaactgtgctcttcaaattcatggaatttactctcatatcactgccaagttggacagattcttgtcagagccagatcaagttttgagtcaagtccaaggccagttatctcttggatggtagcccatctcctccctttttacccatcatgacctccatccatcttcctgagggtctgggggtgatagtgacatgctgcccctcaccaccctctgaatggtgactttgccataattggatttttcttttcttttctttggttattatattccagttcgaagtgaaaatgygatggagtaaacatgttctggatattttctcctttcacttacccccacccctcattttggattaatttcttttcatagctgttcatattagcatgattttcagtaacctaatatttcctaacataaytgaagcagtcagaacaacaaatgccatagtgggtgtgatttgaaagacacttacctgagcatggtgagagtagtcaacatgcctccacaccaaagaaactgtgaagccaggcagaaggattgtccytttttatccccaaagctaggggttcctggaagggaggttctgggtac

SEQ ID NO: 1315 - DNA, 598 bp, Bovine  MMBT16280
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnncaggttcagcgtaaaaacaaataactgctagtatcttgttaaaaccatgctctcaaagtttaaaaatgattatttccccaaatgaactagtcactttgtaaggcattcaagatgctgccttaaatttgtttgtttttaaatttgcagtataatttacactgaataagaatacaagttaccaattttaagagtacaatttgatgaattttgacaaaygtacacacaagcaccactgaaataatgaagcagaaggtttccatcacmccaaaaaggacctgtgtgcccctctctggtcaatgccttcctctgagccccaggccctggcaacaactgatctgcattccgtccttgtagctttgcttcttttctgatgtccttcatttagcatgatgcaattgagattcctccatgttgtggtacatatcagctgtttgttttactgctgagtgtcactgtatgaatgcacttcattttgttgattcattcatcagctgatggactttcggttatttcc

SEQ ID NO: 1316 - DNA, 600 bp, Bovine  MMBT14429
caaatccagacagacatttgtacaaataagttgtgaagttgccagtgaacctgaaaatcatgtctaagaagaaaccaatacccaaaactcataaaacagtgcgagtgtgaataacagcattagccctaactggtcacagcgaggttggtcaatactgatgaaggacacctcaggtcttaagacactcgccaaaggcaaagtsaccataccgccctgtgtgctctggaaagtccctggaatgtgtyttcaacattgtcagccacgctcagacagcctaaactgatgaagagaaaagcagcygaagataagataaattggctagttcctaattttgctgtgggaaaatcttcttccttctctggtttttgatagctgaagaattcaacaaatatcttttgtaagacatcagagggcaaagaagttcatccaaagtgaaatgaatggtttgcttctctttttccagtctgttcttacttcttcagtgaagagactggattattgctgaaaagagttgtgggaggagaaactcttttataaactgaaggatttttgtatgatttcttggtagaaaatatctgatcagttgtcttcagcctccgt

SEQ ID NO: 1317 - DNA, 600 bp, Bovine  MMBT16905
tgtaattataataccagtttacttgaattctgaaaatatccttcttctaaacccacgctgcactgaaaatgacgtgcctttctcatccctcctcccgaccccagcagaccagatgagcagaagtgcacttccacagtgttcctctgcggtggtaatgtggacaaacatatgcagcaaggttcttttcaagaagattaagtgaagggggaagtttaacacagaagctcagcagttctgccaggatctcacttgcaaacagtcattaaaaaaaaaaaaaaaaaaaactaygtaggagggaaygggttgatgcttgctgtttgctacagggcatctcagaaatagcaaaggaaaccacagaccaggccaaggattgctgtgtcttaactagcttccctggggaaagcagcccccgatattatctgggaactggatggaaaatggcaagcacatgacactcctttctaggtatagagtgtttttcatattcaaagctctttaatgcttccctcaggagccttgtgagataagaggggaagtgattatatcctcagtttgtgaaagggagaatcaaagctgaagggtcaagcaatttgcacagaa

SEQ ID NO: 1318 - DNA, 600 bp, Bovine  MMBT17135
gtcttcactttcacttttcactttcatgctttggagaaggaaatggcaacctactccagtgtccttgcctggagaatcccagggacggtggagcctggtgggctgccatctctggggtcacacagagtctgacatgactgaagcgacttagcagcagcagcagcaggctgataggaaaataattttaattagtatgaggcatcaagaggcaacttgatgcatcgaaaagttgaattgactttttagccaggtttttatacagtagaaaaggacttcaccccaggtggagaatgagtgagygagactattccagtggaaggtgtaacaggtagaaaaacataaaatgaaagagtattcacagactgtgcagggcagactgatgaaaggttagttggctggataataaatatctttccatacgttgctaagaaatttgaatctgatctaaattcaccaagacatgttctacatgctagtggaaaccagacacatgagttctcggattggctttactgtcaagtatacaaattctgacctatcctttaattctgcacatcctctaaattctgggatgtcaagatgacatgaggataaatatca

SEQ ID NO: 1319 - DNA, 600 bp, Bovine  MMBT17817
aatagcccagggctctagtctttctcctagaatgttcctctcccagatatccatgtaacttgctccctcatttccttcggggctctgctcaaaatgccattttatcagagaggccttctgtgaccaccctacataaagtggaactaaccacccccagcactccctatatgctctaagctgctgtttaagttttctctgtaacactgttactggacatattacatatatatatatatttaaactttttttcccctattcactctccagtatatatgcataaaattcttttcctcttcccayccaataaaatgtaactcacatgaaggtagggacagggtcttttttgatcagtgctgtgctcctttccctgggacagtgcccaacacatagtagacattcaataaatatttgtttaatgaatacatggatgaaatcatttttattttactctcccacagtcagcaggatcccaggcagccaacttttaatgttggaaggggcccagcagacaagcaagaaatgccataaatgaattcctcagggcagttatgtgattctagtgtgtgtgaacacttaaacggtctgactagacggcagtgg

SEQ ID NO: 1320 - DNA, 600 bp, Bovine  MMBT14647
gaaagtgcttttgttttttaacaatctgatttttggttttccttggtggctcagacgattaagaatctgcctgcaatgcaggatgggttcaatctctgggtcaggaagatcccctggagaaggaaattgcaaaccactcccagtattcttacctggagaattttaaagaagcctggtgggctacagtccatggggttacaaagagtcggacgcaactgagcaactaacactttcactttcatctatattttgttatcatcttcaaccattttttcctcctacgtgactgagatacctacytaaatggtggaagaaatggtctcacactttttatgcagagaaaaatgcaatgttaggggcatgactcagaaatcagtgaccctagtgtaaatcctggctttgtccctcctggctgtgaaactctgggcaagtcagttagcctaagactcagtttctacttccataccatggaactaggaatataatttttcagttttgtrcatcagtatagcacctaactcatgggaagctctcaataaatgtgagttctaataattattataattgtgaattttkcaaggagacattaaagaaatgtat

SEQ ID NO: 1321 - DNA, 600 bp, Bovine  MMBT16065
atcagtgggccagtggggtcctaagagagctccctgaggtgtgttgaagtaaaggggtgcatgacagcagtcctgggggccatgaggacatgacctggtcagggagggcttccctgcagaggagacatttaggctgagactagaatgctgagagggaccaaccaggtgcagggacaggtagaaagggcagcaatggtggctcaggctgcaggatggcttgtgtgaggctccaagttgggaaggagccttgcaggttaggtaaaggcccagaaagttcttattgctgctgaaacaaatacygtkaactcagtgtcttagagcaacacagatttagtcccttcagtttagttcagttcaggtgctcagtcatgtccarctctttgcaaccgcatggactgcagcataccaggcttccctgtccatcaccaactcccagagctttctcaaactcatgtccattgagttggtgatgtcatccaaccatctcatcctctattgtccccttctcctcctgccttcaatctttcccagcatcaaagagtcagttctttgcatcaggtggccaaagtaatggagtttcagcttcagcatcagtccttc

SEQ ID NO: 1322 - DNA, 598 bp, Bovine  MMBT17227
  misc_feature (1)..(92): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcaactgatgggcttataaagtagataaagttgctaacagttggaacattgatacagaaaattagaatccctttccctgtgatggaatctattttttgtcaattatcttttattgtttaaggaatacatattcggtgtctttaaatggtctaagtgccttaacagtagtttctaaatcttccactttaaaattgtgttgagcacygaataagatccaagtaaattctcatccataaatgattccttatcctcttttattttctcactttacctcttattcctgaaatgtgattttgatgtgggacaggcatgctgattttgaaatagttgcaaccctgaacatagcagtttacacagaatccatagaaaatatctctttaaatagagatacacaaatgtgataaatttgtgtattcatacttaaaaccracaaattactcttcttaacataatcctaagggggttaatactagcgaatattatggcaatctcaatgcctgtaa

SEQ ID NO: 1323 - DNA, 418 bp, Bovine  MMBT17680
ttccaggcaagaatattggaacgggttgccacttcctactccaggagatcttctggatccagagatcgaatcctcatcttctgcgtctctgcattggcaggtggattctttaccactgcgccacyaagaagacccagggaggtactaggacatgcttaaattagggacttgctgagtacatcagccctgactcgggcattcaactttgctgccagcctaaggaaggcaaacagacatgaggacaggcgacctcaagaccactgacttaaacaaccaaaaaaaaaccatccccaagaggcygagactttgcaccattttgctgtttatttcaagtttacagagaagcttaaacatttgtggaaaaacactgaaggcttattttttaaattcatgtacttttcaggataaatacacagta

SEQ ID NO: 1324 - DNA, 600 bp, Bovine  MMBT17203
gtgggattaaaaattcctgctttacatgaaaacaaaaagatgtgagaatgaagttatttgggataatgtgagagaacagagagcctgtgaacttttgagcaatgtctgtaacagcataagtgataattatgaattgcaatgaatatctgattacaagtaaaatgtatgccatcagaagaatttttaatcccagagacatgggacttagataacatacgtaactgagtgtttaaagtgaaaaggcacagatatgactcaaagaaaatgctacctattttctrcatataagaccaagcttayatgatcaatttagaaagcatctcttaaatttaaaatatagttacatttccatgattttttwaaaaaggacgtcaaagtaagaacctgtaaaatatagtaaaaaataagaaatatatcagatcattaaagcaaatcagacaaaataccaaaattcaaggcatagaagatcccaaaaatattatattaagacactgaaatagaccttatgaaggagttgtgtaactactattttctttcccagmtccwtatttcttatgttggataatagcaaaaccctcttcccttctaccagggctccaa

SEQ ID NO: 1325 - DNA, 600 bp, Bovine  MMBT15054
caggctgaggcagtggctcccttccagtgggatataggtgtgcaggggctcctctggccaggacttggagagcgggttaagaaatctctgaggccacatgcccatgggtaccagcctgcgtggtggtgtggcactgcaggaagctcttgacctgtccccagaggccarctgggacttggcgttcacctggggcttcagagaattctgggaggactgagacttgaatgcagtccccagaaaagacagcggcttccttccrgatgacaagttggggagcgcctgagaggctgggcgggagaygggagagggccgagggtgcagcatggccttggtcctcaggctgcacccgcagaggcagggctcagagacgtgggccgcagaggggcagggccgaccccccaggctgcgctctgcctcccatccgaactccctggggtgctggcctttcctaaaagggggaaatgtcagatcagttgagaagagactcagagaaagatttttttttttttaatgcaaggacagtgcttccctgcctcagtacaatacttactcagcctctttctggggcaagttctcttcctgcaggatcgaggacttaga

SEQ ID NO: 1326 - DNA, 598 bp, Bovine  MMBT15806
  misc_feature (1)..(57): n is any nucleotide
nnnnnnnnnnnnnnnnnnnnnnnnnnnnnnnnnnnnnnnnnnnnnnnnnnnnnnnnnaaaccgcttacagggtctttctgaatctcccttagtttggctttcaggcatatcacattaaaatacattagacagaagtaaccgaggggataagaaaatatggttccttttttacgaccttggcctccctgagtcagtcttcataatgaccttcctaacagcagacgagacggttgcaccactctcgttcaattcacagaggagagacgtggctgactggggggcccgtcgggtcccatctgyrgaacctgggccagaaggcagctcccgctcctccacatctctgtccaccagaccagccaagccccttccgtggccggcacgtccagagtcacatcagtaggtgctgaaataccagacctgaggaggcttcctttcatctctctctytaatcatgctgtcattcaacttataaagcaaagggctacaaaggacatgaacgggtgaactgacaacactggagtatgaacgcaggttggacagatttcagtgtcaatatgaagtttrctgaagttgaatactgtatcattgcaatggaaaa

SEQ ID NO: 1327 - DNA, 598 bp, Bovine  MMBT14550
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgacctatactctggggtttcagatccatcaactatgacgaaaaggacccctttcctgtgcaacgcctgtggcttctgtaaatacgctcgcttcgacttcatgctctacgccaagccctgctgcgcagtggaccccattgagaatgaggaggacaggaagaaggtgaggccgagtcygtgcgaggcccacgccgagctctgttyggagcttgggggccgagctggtgtgggcagcgtgcttttccttctcacccaagtcttcttggctcagcgtgttttcagggctaagcttttgagtggcaacaaataagatggattggaacacgtgttttgggtagaattttggagacgtgttggtaatggaagtagagtatctcaaggggcaagtgacgtggtggggctggagatgggaggacagggcagaggggtctgtcagaacagtcaccagcagcagcagcccagcaaagcggagtgg

SEQ ID NO: 1328 - DNA, 534 bp, Bovine  MMBT18341
tttccttagcctctcatatgagaagctcttctgtgggtaagatgggaaagtggcaagagagagggggaagtgctaaaatggatcaaacattgttcagaggatgatgttttgtcaccttccatgtaatttcatcagatggcatctcaaaccagagctaacatgctcttttctacctcgcagcaaacaaatcttgggagaaattcttctggctragcgcttctccaaggcatccttctttaaggggagaatgtgtaaacaatttgatgttgattttcagtctggctgccatttggtaactgyctgggtcaccaagcgaagaaacataatgtgtcacctgttccgaatataaatatcacctgattgtaactgctcagtgagctccgaggtcaaaggagaggttagcaccagtggaaaagtatcactttcaacacaggatgtgctgtgcatattagcaacatgtaccgcattaagcaatttgtgcaggtttccatgaacttgccagcctggtctatgtaaacttcacaatgatatcca

SEQ ID NO: 1329 - DNA, 600 bp, Bovine  MMBT16837
agcaaattccagggtgagatccagacccctgatctggtgggggcgcctgttcctgcccttggacaagatttctcaggacctgggagggagacagtaagggtgagaggggcctggaggcacggcgagacgggcgcctggatccagtgacagctcgttagcccctctgctgctgtagccaccgcacctgcaagtcggtgagctctcctcaccaggaacatgtcacatacagttatggctgcccttggtggcacgggtgattccctggcaggcagtgttagtgactaaaagatgctccttgtygtgtgagggttggaattcctccttctgctgacttgttctttccctgtggtctttctcattcttgacaatgtcaggaaccgttgtctccaaaygtggggctgttcacatgtggcgcgtacagaggactgtgtgtgtacgcgagtattaccagtcttaaccacgcaccagcaagcatcactcagttgtcagttggggacgaggcgagcatcctcgtttagtttccacggtcctgagatcgccacctcacgctttgacatgttgccttgagattaagcaggtgggctttgcatattgcccacg

SEQ ID NO: 1330 - DNA, 601 bp, Bovine  MMBT18343
  misc_feature (1)..(1): n is any nucleotide
nctggctgatgacagtgttcagaaataacagggttaaccctccagtcatatcccagaataaaggtgagggttggtgtatcccygccctgtcgcttctccatggcrtctttgtctagtatttatgtggaccaccacctcagaacaatgtactcctccagcgagcaaagcctgycctctttctctcagcatctaggcccccttggcctgatgggcccttcttcctctggttamgtgtggggaagagttacaccaaaggctccmtggtccccaaaggttctcatccctcagaactcttgatgtyatctccacaagaggctacacgttggggttgaaatcacgccagtatggtgaaagcatctgtcaaatgcatacatttaaaatccatgacagtttttaaaaacagctgtgttggaatataatctgtatatcttaaaggtcaccttttccaagtgaaggtggttcagtgggttcttgcatttgtggagttgtgcagtcatcaccacaatctaattttaaaacattttcattacttcaaatagaaaccttgaactcattgagagtcactcttcattcctccaaaggcaactaataatctaccttc

SEQ ID NO: 1331 - DNA, 600 bp, Bovine  MMBT18317
tttgtcctgcatgcatgtcagatgatgggaggtaaccgcacccaggcagagggctccgaccgttctcttccaaaagaccaatgtttgtcatgcagtgccccctgccatggatgtgggcatgactggcagcgccagctggctgctcatggtctccttccttcttccttcctccccctctcctcccttccctcccccatccccctccagattcgggtggtgaaagcgttccgtagctccctctacgaaggcctggagaaaccagaatccaagacctccatccataacttcatggcgacrccygagtttctgatcaatgactacacccacaacatcccgctgattgacgacacggacgtggatgagaacgaggaacgcctgcgagccccaccgccgccctcccccaaccagaataacaatgccatagacagcggcgtctacctgaccacgcacggcaccaagtcagctacctcttcactgttttcttccagacccgggagcccgctccacagcgtggagacgtccctctaagcaggactgctctgggcacacgcaccatgcacacacgcacacttggacgggcggggtcacgggcagtgagga

SEQ ID NO: 1332 - DNA, 600 bp, Bovine  MMBT16829
cctatacactggtagaagtccagcgtgagtcacggcccccggtacagggtgccctccagaaaaagtcccagcctcacatccctccagcgacggaggcggggtctgtttctccacctcgtcctcaaggctgaagactcggagttaaatgatgctgtcgggtgggggcattgatactttttctctctttttttccttttctccgcgtgcctctcttcctgtgggtacctgagaaaattctcagcctgtttgactgtggcctgagccaagaaggagcgctagctctgggaagaaaaggtttaytttcagtctcacgtgactgtccgtccatccatctatccgtccgtccatccatccatccccccatttcacagtgtttgcccctcattccttccagccaggcactgtgtgctgggtgccagctctttctgagagagcccagcacgacccagcaggggcagagccggcccaagtccaggctcggtcccgtcccagggattcagagagtaggtagagccgtggagggacccgtggccttctgtctgcacgtggggcgtgcaggggacccacaggggtgtctgggccattcgtcacccgcctcct

SEQ ID NO: 1333 - DNA, 600 bp, Bovine  MMBT15714
tgagtgttttggaaaaattaactgtattgttttttcgaccctggattaaacttttctctgtgcttccactggtcccataggtcacagtgccagatttccacatggatgtttacaggggtcacttacttttmcctttgcttctcttacatgtgcttgaagatgcacagagagctgtcttctttaatcttttaaaaagtctcccaggaatttcaatcttgcctcaaaccaaygggcagagagattgagtggaaagagccagagcgtggccaccaaggaacctggacttgagtttctgtgttycccccaaaactgactatgacctcagatatggccccttaccctctctgagccgcagtctgtgaaatgagagaatgggactgaggcagctgtcaccagccaactggcctgctgctgactggtttggcccacgtgttgttttttttttaattaagtgtgtatttctttgggctgtgcagggtcttcgttgctgtgccggctttctctgcttgtggtgagcgggggctactcttcgctgcagtgctcgggcttttctttgtggtggctcctcttgctgtggcttgagggctctagagggcgcag

SEQ ID NO: 1334 - DNA, 598 bp, Bovine  MMBT16434
  misc_feature (1)..(3): n is any nucleotide
nnnttggaaacattggaccaaatgtgactttttttgtttccagtgaggataggtttgtatgtctggagaccagtcttagctcttgctgtataaggtcttagaatgctttgtaattaaaaaaaaaaaaaacaaaacgctagaccttagatagcttttaaagaaaaggttctaggttgtcgtcctttgctccacttgcttttggtgtcctgaggttgatgctgtccatttacagcaacatctttatccataggtagcaaagggggccatacagggaaaaacgccagctgatgcacttggagyattgattgtaatctcgtcggctgttgtggcgcctgcacagatktcctgkgacatagaagtttctccctgtttagatgcagtgtgctcagtttcattctaaaaggttatatacgtggggtcaggtagtagattagcaaggaggcaaatagagaagaatagcccttttcatgtcttaaggtgcatttgaaagtaaatggatctcagagacagtctaattccaggagaataagttggttggatttctcgttttatggtccttatgtgtctgcacaaaagttgggcttaatcttcattgtac

SEQ ID NO: 1335 - DNA, 598 bp, Bovine  MMBT17533
  misc_feature (1)..(34): n is any nucleotide
nnnnnnnnnnnnnnnnnnnnnnnnnnnnnnnnnngaaccctgtcagaatcatggctcttgtactcacacccaaccaataagaaacggagggtcgacctaggcatctacctcaaccagagccccttggaggctgcctgctggtcccgcccctggatcttgcactgcgggccctgtgggtactctgatttggctgctctggagaatgagggcttgtttgggtgtttgtttgaatgtgggaccaagcaggagtgtgagcagattgccttccgcctgtttacagaccgagagatcctgagccaygtgcaaggggactgctccacccctggtatgaactctgagccaagtaaaaagtaattcgcttaggacccaactttgcatagaaggctaccgtagaaggcagtcacagccaggacagtggaggccaggataacagaggttactgaagtctgcagagaaacaaaacacctaatattctgctccctacctgttttcacttctcattctccagagaacaaaatgaacatcttgccatagctactgcattcaaaagagcactgaacggtgagctgagagactatgatgtcatcttggctcttcc

SEQ ID NO: 1336 - DNA, 600 bp, Bovine  MMBT18281
atttgccctcatgtgatactaatatagccactccagctttcttttggttagtgtgaacatggtatccttttccatcttcttacttttaacttattcatgtctttatacttaaaagtgtttcttgtgggcagtatagagttgcattctttaatcctcaaactctgctcagatccctgggaccttcaagaactctcttaattctccaggctacccatctccttataggaggctgtgataattagagcatcattcctcataatgagagccccrcctgccttctatcacttccctgccctgcgycccccaggaatagcagtgaattgtttccacttccccaggacagtttttcagaaaacatggacatccaaacctatggcaaatccttaggcagtgccagatccagccacactggatcaagcaggcccatggaagattacccaaggctacttaagaagtaccaaaggctaccttggaaaaagtaagtgtgggggagaaggaaatagaaaactaatttctaagaggaaggattttattgactgaaaaaaaaaaaaaaactcacatgtattttttacatttccagaaagtgtttcaactaagatg

SEQ ID NO: 1337 - DNA, 600 bp, Bovine  MMBT14691
aaagtagaaactgtacatgtgctattgcccttcatattttcaaagagaaaactctttacagtcccctttatagctccgtggaaactacctttttccccctgggcacagatgtaacctatttgtagagtgtgttccatcctgcttatttcatcagcatattcctccgtttctgggtgcctttttctacagcctgatttctgaataatkctttaatttcagatttctctgcattttctaacctagcagcctggttgacggaagagttttgtcatatctgtccttttcatcctaacactattyttagtccttcacacttatcaaccagcttaaaaawttttttwaaattattttgtactggagtatagctgagtaggcctcctctggtggctcagacagtaaagaatgcacctgcagtgcaagagaccctggttcaatccctgggtcagaaagattccctggagaagggaatggctacacactccagtactcttgcctggagaaagaagtccatggacagaggagcttggcaagctatagtccatgcggtcacaaagagtcagatatgactgagcaacactttcactttttttcatagttgat

SEQ ID NO: 1338 - DNA, 600 bp, Bovine  MMBT17363
agtccagattttgaaccatccctgtgagtgaagacaggaaaggcaccctccacccccagaggaggaaagtggttaatatatatactgagctcctaaagtttgaattcaggtactgtgtgtacaattttatcaacatctcgacccatgaaacttacatgttgtgccaagaagctgttggttctcataaggtacccatgtccagcatttgcagattcaggtatcaagaagcagagctgtctcgtaagtagcactttactaccaactcagcatctgtacacagtgtctacatcaaatgacatyggtccactaacagagtatcacatattaccctcacaaccgtctgatgtaaactcgtgcaattttccatcaagtatattttgcttaacattttaaagtacctgatgagggtgttaattttttttccctaacctgcttagacaamaattgcaaaaaaaaaaaattgacaagcaaggtgattgaaggrtgtgatgactgctatagctctctgcrttcagttgatatgaaataaaccaatttatttcttgtggagtaggtttggtcagttagcaattaccaaatgacttgccaatataactggtg

SEQ ID NO: 1339 - DNA, 600 bp, Bovine  MMBT17751
aatagtgttatcttagagatactagagaggaggccaaaatcggacctagtcatcaaaaaagactgctattttaacagttttaaaagaataaaattatttctgatgtaactgaaattttctaagttcaagaaacattcagatcatgagtcagacgatctttattactaaagttttatagaagcccctcactttacaagtaaaacacatagaaaaattttcaacatctagttatagatgataattcagtatcagggcatgttatatgcttataggattttttccaattaatttctcttttaygtgaccttacttttgtatccattcactggttctagtttcatggggtatggatggatgtctatccatggatgtctgtgagtgcacgtggaatacaaggaatccatacaaatagattttaagtctgtactttgaaactctctaatatgcaaatcaatcagcaatgcacaaatatgattatacaagttaaaatgtgggcaagtgataaaaatgtacgaactgcagagtataaattatttgtacaatgtgcacgttatagtatgtaatatatttacaaatgttaggctagatagaatatgattt

SEQ ID NO: 1340 - DNA, 600 bp, Bovine  MMBT18292
atttggaagatctgcataactcagtaaaccagtattttccaaatgaccaatataagatatttcagaatcatgtgaaggtaaaaaagatccatcctaaataccaatatacaccaatggatttttacagagtaccaaaatttcattgatatggtttcagattccacattgtgccttatcttttaagaaacctccacctgctgagttctgatgtaatatcaaagaataccatggttatttgaaaaggccattaaagtacctcccttttccaactgcctgtttatgagaggtcagattttcttyagatatktacttcagacagcatatctaaacagactgaatggagaagcaagtgagaatccaattaaattctgttaagctagacattcaacttgcaaaatatgtgtgtgtgtatatatatatatatatatatgaaatgatacttgcaacttttattttggaaaattgtttttttcattaaaatgctattcatgttcatgtgtaataagtttattatacttttagtggttttaacttcagatatagtaatactgataaatatagcctatataaacaaaagttctttggagtccttaatcattt

SEQ ID NO: 1341 - DNA, 600 bp, Bovine  MMBT18336
caagaaaatcaataaaatgatgccatttatattatctttatttactagcgatgtctattccaaatgaagccttggctcctatgaataaaagtaaatcattttggcagaatgtacctttctcctaaagtaagagagaggaaggagcagggagagagggaaggtgggaaggaggcagggaagagcataacttctagaagatggttgcaactgcagattgtgaataactataaacttttcattaagaagttccttaaatcaattaaaacaatttaactcaatcccatacttggaaaccacatytgactcaatccaacaagattaaagaaagaacattcagctttttgtcatttatagtacattcacaaattaatatgcatccctaacttgtaaaggagatcagacctgggatttctttggaaggaatgatgctaragctgaaactccagtattttggccgcctcatgcaaagagttgactcattggaaaaggctctgatgctgggagggattgggggcaggaggagaaggggacgacagaggatgagatggctggatggcatcactgactcgatggacgtgagtctcagtgaactccaggagt

SEQ ID NO: 1342 - DNA, 600 bp, Bovine  MMBT17185
ctcttcttggagctcccttatacttagaagtaaagtttgaagggaaactaaaccaagatggcctccatctgtagccacttcagttgtaagaatcagcaatgccctgacrtttaaaatccactcaggatgacaaaagtagggatgtggcagtcaggcttctggttctgttatcaccaacaaaggatgacccctctactgcctaattttctcattattcatgctgaaggaaagggggctttaaaaaatagactaatttgggatcagcttcccttgtggcttagtggtaaagaatctgcttayaatgcaagaagacttgggttcgattcctgggtcaagaagactccccgggagaagaaaatggcaacccactccaatattcttatctgggaaattccatggacagaagagtctggtgggctacagtccatggggtgcaaaggatcagacacgacttaatgagtaaaccaccaccaccratttgggatcactgggaagctttctttctttttttttaacctaggtagttttgtgactcactcaagataactttgtgtttcatcagacccttgaaactaaagactgaaaggattaaagaaaacc

SEQ ID NO: 1343 - DNA, 601 bp, Bovine  MMBT17564
  misc_feature (1)..(1): n is any nucleotide
ntgcaattcttctgtgaatgcagtctgacctatgttcacagtgaattttctaactacaggtctctatatatagagataatgagtgaagcatataccagggagctatatatagatttatctagctccagagagcaagggatattagaacagagctcttacacaactaaaaaaagattacaccactttctacatttttaattgctctaataaaatcatttttttaagaagaaacattttacaagattgtctcaactttaagtaccactcttccatctgaagatatgttagttttcatttttgyttaatatcttaacctcaagggcaaaatctgccagactctaacgactgctgcttcctcctaagcttctgccaaatggaagataactgactataaatcaaacttcgggacaactttagtagaaacctaacagtttccccaactgtcattatttcaagctactataaagaacaagcaaaaacacccagatgtgttagtgacatttttctgttatgaaagattaaaattgagttctttctatgtttggttcccactgtaattagtctttcctttataaaacatcattgctctattactcctctg

SEQ ID NO: 1344 - DNA, 600 bp, Bovine  MMBT17385
aggagggtagcattgccttcttgcaaagctgtgtaacttttaaagctaaaccatagcagtagtccccactccaggtcaatgaggtatgtcaggtactcatgatttgagaacaaagacaagaaagaataagaaatcacaggcatttttctaaatgcttagctcagattttaaagctgaaatttctacattcaaaacaaagtagagattgtgtgtgtcatactcatcaaactgcatgcattgtagtgtgcaccatttttgtatataaattatacctcagcaaagctgtcgaaacaaagtgaygatcctaatagtatgtttcactttgagtgttactgagaagaaaagggagaaacaaaaacgacagcaacagttttcattagaatcagaaactgttttaaagtctaattggctccagaggaaatacttggggtgagatagcaggagtaggtttcttaggagcaggtggtcacctttaagaaattcttcagcctggaaattctccaagtgccagaaggcccacatgcgctgcccaactcttttaaggtccacacayctaaagttttggtgtcgttgcaagatttacagtctgaacatggtaca

SEQ ID NO: 1345 - DNA, 470 bp, Bovine  MMBT15235
gtaagatttacatgctgcctttgaagaagagagttgatttatatatttaacgtgatgtcatttaaaatattaggtgactagacaygaaacacaaagacattaaattaacatacttcactggattatgcaaaacattgaacagtgacaaaagcgtttcagagcaggatttgattattgtggccaaatccagtaatgtatcctggaaaatttgattccaaagatatgcaaaacatgataaactttgcactctgttttatctccagaacaagatatagcagtaayagttgattgtaccttgaygatattggcaagtcacattctggaatgcagacagcagtgctgtccaaatagaaggaattaccaaaaggcaayggaaaaaaatctgaamatataatcttcctcttacataatcttttggataatatatgcaattctaaggtcatgaggaggacacaaggagctgcagaagt

SEQ ID NO: 1346 - DNA, 600 bp, Bovine  MMBT15486
agatactattatctgaaactgagatcagaatcatttctatgcataattttgggccacataattattttgaaaaggttaggtacatttcaaatacaatttttgcaaacaaagtgacactgtcattgtgtgtagaaattttatctttctaggcttgttttaattcatattttacttgggtgattaagtaaaaagattttgtgtttcaaagaacattgtcttgtggttttattttacaaactacatttttaaattaaagcacaacagatggaagcttcgttgcttaaayaagcatctatactytaatgcaaaaactcagaattaaagttttgacaaataacttaggaatcttccaaaaaatcttgattttcttcttagccacaatgtactcacattgacagatttttctttctacaataaaatgaagcaagagattcctaatatctgcatccaacctatctttacttccttctaatgtaagggcaaaaccatatgtctcttcagcttcaaatgattattcaacctatcagctatgtcacagattttaacagatgctggtggtagaatttttgttccagtttctcaatcarttttactataatc

SEQ ID NO: 1347 - DNA, 600 bp, Bovine  MMBT15961
ggtctccagcctttcacctgcggcagaatctgtgatatttaccaattttcctttgaataacaagtttagtgtagattgtcaagtttctgggggggatcaacgcaaaattatacccccctcaagtctatcagttatgttttgtggaacttccttttcccactgggtagctggctccatyagctatgtgtattatcagtctgattctaaaacatttcatcatttgagttatcaaaacagattctcttcagttattaagattaagctctgctcaatttaaaatttcaatcttatatttgatcygaagctttcctcgttgcctctaatgcaaacaaggccctaagctttagacgatctggggggaggggaggggagggtagacttggtcttctctttctctctcctctccctccctatgcttatgcttctggttgtggaggaagaagaagaaaagccaaaggtgaatatgcctctttgtgattgctggtggcaggtccgttgctccctgtggctgaccaagtgctcctgagtctgctctgggacagtgccaggcagcttcaggtggtccaagaaggaccgtgtggcttccttttccagtcaagc

SEQ ID NO: 1348 - DNA, 600 bp, Bovine  MMBT14755
tgacagatggaagtgcttcaggcagcaattgccttacacgttcctccatccgcacctccatctgtcagcagaagtatgttactattttgggactcaatttatccctttggtgaatcattttcaggcttgtttctaaggttaaaatgaagtctgtaactcattaggcctttcccttttcccttctcgttttcattagaagtaagaactattggggtgaggagataaatatacatggggaaagggtgtgcttaragaggatggtaggatattaaaatttgacaccaatgcagaataagtcaytgaaaagaggattgactatatcatgccttcttcagggaacatattatactaatttgaaaatgtaatttaagaataatccatgagtaggagagtccagattcaaaactaaaggatccattttcaccatatttataaagtcattgtgaacctaattcctgaacttaaaaggaatatttaatgagtgaatttttaaccaaatgacccctttttcctcttaaacctgaagagcctagaagttagaccagccattgtctaatttcagtagaaagagatgaacaaaataatgttttgtctgcaccc

SEQ ID NO: 1349 - DNA, 600 bp, Bovine  MMBT18272
cacagtgttcactttgtaacaagtttcattttgacctcactgaaggcttcgagattttagctccagttactgtactttcctcacttctttagctcctctcatttctgttcacaaatcggaatgcactgtaattcaagggagaatttaatccacaagaggatagttgcaaatatgctctctctggactttgctaccaacattattacttatgtaaattgaaaggtgagcttggactacatcagctgacaggtggatatatgaaaatttgaacacaccatgtgatttgaataaactgtctgyatagaatacacagaattttgtattgggctgtactgtatgttcacctacttggtaagaagagcaacrttatttttagagtctaaataagtcaataaataagttgggtggaataaatctaggaaatgcatgaaaacaacactagagtcctctctcccatcctcttccctataaaacattaaaataacaaaatcaaagactgtgataatgattattttgtatcccttagattgagataatgagcacacccaccacctgcaaaacatcctcctgcccatttatagtctttctcaccaaactttc

SEQ ID NO: 1350 - DNA, 600 bp, Bovine  MMBT18342
gactttagtatcaagccatcttacgtgcttttgcttttgattttcagtacttgcactcttcttctgccatttgcccttagcctacttttttcatgaaatttgattatagtcactttgaatagctaccacctctaaattattttaactataacttattagatacccattaacgttatatttgtgggtaattttttggtttcatcttttgctgtcattctgtcttcatcaggaatgtaacttctgttttgtaatttcctggaagacctctaatacagtatctttactatgatgtctatgtaytaagtcactgtctgatgggatattatcttacctaattatccttccagtttcttgaaggtgttgtttttctttgaagctgtactttatggtcgtctttgggttggtgcattggtaaatttccctgtgattcttggaagttttattttcagagttgagctgttaagtcatgaggatttgtttaatttccattttatctagrtaggtcacctgtgcattaagatgttctttattatcagattctgaataaaggtcagcaaaggctttatgatcccagggtgttggctccctcattcaatcctg

SEQ ID NO: 1351 - DNA, 600 bp, Bovine  MMBT18340
agaacattatatataatgaatctgagatagcaaatgaaatcactcaaaataaccactttgcatactacagtgattttcttgttcttttctgtataatttttataaagttaaagttgtatggtaggtatgcatctgtgtacaaagacacaatatttgttttttaaaatctaacatgaatacaacagttttcccatgctttcaaataatcaccaccaatattaactataagcagttaataatagttctttccctactaatagacattttagtgatttccaatttgtcacaaatacaagtgcyttgaagtgcttcatgaytgtttgaacctatattttttaaccacttatgtatattgtcagaaaataagaataatgtggcctggtataaaaaaaaaatccataggtaaatgatccttttggcctcactgtagcatgtagggtcttagttccctgaccacaaatttaacctgcaccctctgcagtggaactgcagagtttttaatcacttcagggaagtcccacaggtaaatgattcttaatggagcacttttaaagagttatatctgagctttccatatattggttatattggtttgtactc

SEQ ID NO: 1352 - DNA, 598 bp, Bovine  MMBT16828
  misc_feature (1)..(17): n is any nucleotide
nnnnnnnnnnnnnnnnnctgctcaatttgccttgctttatcttagagaacatgttatatttttattttattttttaacacccaaaacatgagaacacattatatgtttaatgtctctttctgggaattattatttgatttatagggaaattaattttatccctggataaagacacttatgaagaaactggacttcagggccgtccctctcagtattctggcaggaaaaccatgagattcagtaagtatggtgctctctccatcaatttctaacaaaaggtagtggtcttctgtagcagtycgaatttacatgtttgaactgcttctgttctccttgtgtagaagcagtgtggcttagtctcgtctttaaaattcctcatcagagaggatgagatcctgctgtgcagccaggtgactttcgcgactgcrtctcataaaggtcgtagatgtggacctggtctgttagaaacctatgtttcgggtcacgggttcgaagtaatgaacccaacttggtcttcgttttttaagttttgcgttgaagcgtggtggatgcgcggtgtgtgtagttgctgctgtgcggcagagtgactcggttatgc

SEQ ID NO: 1353 - DNA, 600 bp, Bovine  MMBT17097
agtgtggaacccctagtccttcactttgggaaaactatttttggaggagggcagggcttatttttttttaagattttattattttggccactccatgcagcatgtgggatcttagttccccaacctgggatcaaacctgagccccctgcactggtgtagcacagaatctacagggattctggaccagggaaatccctgggaaacatttttggcctgcaaaacttttaccggtctgatgggtcagtaacaataagcattaaaagatagtgttcaagttgtgggtcttatttttattagccytttcactttccagaaagctttatttcttttagacctggataaatccctcggggtccacagacttgttctgatttgcatagctgtccttcgctctggggccgagttgtagcaatgatytctgtaacctacaaaaaagcaattggaatatgggcttccatctgccaccaatttgtgttttgggtaagcgatgccaagaggkatactctgcacctgatatctacctcctttcatcagaaataccccagtaggttcctgctaactttattccgtgcagyatcgcctaccttgggtagcacggag

SEQ ID NO: 1354 - DNA, 598 bp, Bovine  MMBT15927
  misc_feature (1)..(60): n is any nucleotide
nnnnnnnnnnnnnnnnnnnnnnnnnnnnnnnnnnnnnnnnnnnnnnnnnnnnnnnnnnnnttcggataatctaccctggttgattcatagcagtgatgtcttatctttaaggagcagtaattaaatgtatataatttaactaacaaacatggtgcttactatgaaatagtacttaaagttctggttgttgttgaaatattcgttgccattcaccctccaataaggacctattacttacattttaacaaaatcagtgaaggtgatgttatgaccatcgaagaactgaatttagatacccaygtagctcttcattatgtctactattcctaagaagctcactctcaaggtagcagttttaattttgttacaagtaataaatgtgaatttattcttataagtatcaattattacatttagggttaaaatccttttcttaattataaaaaatatgtttgttgcaaaaaaaaatttttttttatatagaaagtcaaagaattttagaaatcacttgtggtcccacaactccttgattaccactgttgacatcttgtttttaccactttgttttcaataatgccagatttacaatgaagaaatc

SEQ ID NO: 1355 - DNA, 600 bp, Bovine  MMBT13654
tgtccatgggattctccaggcaaggaatactggagggggtagcctctcccttctccaggggatcttcccaacccagggattgaacccaggtctcccacattgctgaacacaaaattactttatgttttcatgcctgagcagcatggatagtcagtttgggtgtggttttgtttttgcctatatgccttgtggggctttgagatcatcacggatcagctgcagcccagctcccatgctcttgtcactccaggacccagctgacggggcagcttcttctggggccactgtggcttaatggcrgagagacaggaggtgcaggaaaagcaccttggtgctcagggcttgtgttcccaagtgatgctttccacttcccccaccttggccagagcaagcccctgtccccgacatccctgtccagtaggrcaggaatgtataacatatgtccatacagggtcatcacagggaggtgaaggcaccatttgttttggaaacagaaatatcacagtagggttaacacgaagaaggatcagatttgacagaaaagaagcaagatacctaagacttactaatttatgacatatcaacagtagtggaaataga

SEQ ID NO: 1356 - DNA, 600 bp, Bovine  MMBT11762
gtttcgtttgtttgtgtggttaaatgcaatgatagcttttctcttgggtgactctgtcattctcctgatgactgtgacctagcttcagctcttgttggcagtggtttccctggttttggctaagcttccgatttgctcattttcttagactctcttatgaacattctgctacagatttcctcatcttctttttgcaataatcttattagagagctcactagctagaatactcagctattttttgcattcttcctgggacctgctgggagttttcatcctcaacgtacctggcataggccraaacacagcatcctgattctgtttgctttatgttaatgtaaggccttcttcaagatggtctccttatagagtctcaaatgggagtgatgacacagaaccctctgcttttggcttctctggcctctctgggatcttcctatcattttcccttagagttggccccagtgcagaaggtaccttggaaacagagcaggagacaggaggacactcatgaataacctctcattcctttctctctctactcgatcctttccttttggccagaagggctttattcttagtcctcttgtcttgctttag

SEQ ID NO: 1357 - DNA, 598 bp, Bovine  MMBT17316
  misc_feature (1)..(170): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgacatacatcactgagaccgaagatgtgttctacacctacaagggctccctgtcccctaaagacagtgattccgaggtctctcagaaccgaagcccgcaccgaggagtaagaaacttgtgctcctrtctttcctgtgtcccttggttggggctgttgaggaatttgcacaggycccatggccatttaagaggaggcagaggctagagccagcagccagctccctggggtgctctctgccaggctgagaacatcagtccactcccttcccccaagagctgtgtgcctggggtcattagctcgccctgcttttttgtcagtgacagcaacctaccgtccacacacccrttagctctcctgaatggtgttttctccagttgatgagcaaaackcagtttaaaccattccatacaccagaggttgagg

SEQ ID NO: 1358 - DNA, 598 bp, Bovine  MMBT16061
  misc_feature (1)..(151): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagagatagggcagagatgatgctcacgaaggtgtgcccataaccagagcaagaccaatgagtggccgcatgcttccaggccagtccacttctcgagggttctgatgggcagagtaggtctgggagggaggtccagaccccagggargtcrgaggggaggggccacctgggatggacagcagacagtctgtgctttgcgggacagagtatgccaggctcccagggaggggagctgggaccccacagagcctgatggtcttggagtctcgatgccatcaagcctcctccaaccccaagaccctcaggcagaaccccacagcctgagtacccctgcctctcacctgggcctgctgacggttacgcaaagctgggaggacctaataatgcacctaaacagacccctttcctcgtggtgtgttttttatttaattttccaacgaacaca

SEQ ID NO: 1359 - DNA, 600 bp, Bovine  MMBT13832
tgtaccaagtgatcaccaagtccactaatgaccagagcctctcawgggggcctatctcattartgccctgggtctgccctaaaagcctagtgaggagtggagatatttgtcctcagcaaacttggcaggcacttgagtcctccgtgtgtttgtgggcgggcctttctcaggctgctgcagatctgatcctgctggggatcagactggttgacctctaagactacttccaaatagaagaggcagtgatgctctcayactctggagacattttcaaggacagcccaaaggaacaactgggargtttccagctgttccactccctgtccctggctctgcaactctcccgcccacagcttgcccacagcttgcccaagcctgtccacagstcagggtcctcaayccctggcctttgtttgtgcaaatagtgaaagctggtgagatatttagatctgtaagtgccctgggcatttccatgtatggctgtaccctctgaagtcctagcccagagctcmaagggttttcaagagttgacaaggaagtcggaacaatcctctgtatgagagggtgccaagtgcatggatgctgacaggaacagaggga

SEQ ID NO: 1360 - DNA, 600 bp, Bovine  MMBT15770
agctgatgtttggtaattgatgtgttgagtgaagatcgtggtgggagggggctccaggcggcgatgagccttttgtgtgtggcctgctggggggccttcctcactgactcagccctgccagacggggtaatggctcctcagcgcagcgtgtctgagcgccgctatatgccgggcgcggccccacgcgtcctgtgcatgctcacttgtttgatctgccaggccccgacagagcaggttctggcctttcccccactgtacatgtgttggtactgaggctctggaacatcacttgccagaggrcattcaccagggaccgagctgtggtttggacccgaagcccggctgtggcttcatgggcttgacccatgtgtgatgcctgcatgacttttccctcaccattcaggcctccaagcagccaggtgccttgcccctaatgctgttctctgctctcttccagaccatcatggagcagttcaaccccagcctgcggaacttcatcgccatgggcaagaactacgagaaggcactggcaggtgaggctggggtccctggcctgcgggtgggagtgaggatgcccaagcaggtagactgcttcacggg

SEQ ID NO: 1361 - DNA, 600 bp, Bovine  MMBT18124
gagtgtgggctctagactgcgtgggctcagtagtaatgacactcaggcttaggtggcccacaccatgtggggtcttcccagaccagggattgaacccatgtcccctgcattggcgggtagattcttatccaatggaccaccggggcagtccaggtattttccactttcaattggctgcttctctgaaaattcccctcaccaagcattagtagggacctccctgttccccctttcctagtaaagactgcccatgaccggccaaatggcccatggataggtaggcttgcaaaattgagcaartaaaattacaggatgcccagttagaactgattgccaaatattgcaatgtttgtaatctatttacactagaaaaaaaaaaatagtcgtttatctgaaattcgaatttcactgggtgtccagtattttatctggcaattctatcctgggagcctcttgtagaaaccatcaagggtggcaggtctgctcagtgggccctttaggccaccaatcgggacagtccatcaaggactgcctgagctcacacagatgcctaaggccacatctcagggttggttttgcctgtagcatggggggcggacc

SEQ ID NO: 1362 - DNA, 600 bp, Bovine  MMBT15732
agtcccaacaatcaccactgtttatgcagaatctctggcaaacggcttccaactcagcgagttttgaaatacgcatcacccccaccacaatattctttccccacactatttccagctagtggattttgtttagagtcattttcatgatttgcactcattttttaagcaatgtgaggaccaactccaaaagaaaagctaatcagggctctacccagagaccctgcaatcggaatcagatgtgctgaaggagaaattaatggaaacacagagagggcagggctcgtggctgatttcacagcrgagaggaggggctgacaggagggaatctgcgctgaacggagggtctgggggaattccagctgtgcaatcgcccattgtgtttatcacgcatgaggcaacatctgcagagagccggaacattcctgggccccaaacatcacggtaaagagagggtgtttggggaaggggggtgagatagcaaaatggtttgtgctgcccacaaatcgcggtgaataacgcctcaaatagggggggagaggagacactgacatccagctttgcgcctttcaagcagctctgtcgagcacagcaggtttaagg

SEQ ID NO: 1363 - DNA, 600 bp, Bovine  MMBT18282
aaaaggctggcacaaggcatggtttgtggtccctgagaacgaacccttggtgctgtacatctacggagcccctcaggtatgtatcctactcctggtcctttcagccacctggcaaagccaggctactctcctttcctctcagtccttcacctctccttggccttggaggatagtgtgaacctaaggggaaatcagaagcccccacccttatgagtacaaagacaggctcgagtacaaggagtgattatggatcaacgtatgtaaggataagtcgggtgagttatgggggaaggaagctgragtggagacgagatactgcttaatccaatttggagtgagcaagatggagaagagggcaaaggcctgaaaacattataggctctaaactagcctagctggcttggggtgtggaaggaaagaggtatttgaatcagcctgcagttctagccccagttcattttcctattgctcagttaaaccatttaaggttcttgagcagggaaagaaaaagaggggtttagaagatgtaaaaccagtgagaagcccaaccccaaggtgaccctagctctgtccctgtcccccaggatgtgaaagcgcagc

SEQ ID NO: 1364 - DNA, 598 bp, Bovine  MMBT16717
  misc_feature (1)..(237): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaaagaggagcctcaggagtcaacatgaccacatcgggactgcatataacagaagcagrtacaaaggccctgtgtcggggcccctcagaccaccctcaggtctggtgattttctatggggactcagagcattcagcatatgtcttactkgtgtccatgatttattacagtgaaaagatacaaaacaaaatcagcaaaaaaraaaaggcgcatggggcaaagtccagagaaaaccaggtgcacgattccaagagtcgtttcctaggggagtcacacaggatgtgcttagttctcccagcaacgagctgtgacaacatgtgttaaacatcgaccagcgaagctcgttagagaagcagtg

SEQ ID NO: 1365 - DNA, 598 bp, Bovine  MMBT18236
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnncctcacagcccttgcttcacaagtcagggaagccccttgagcaagtcggcccttagagccagtcctgggccagcatccccaaattcccagagtctcatgacctctggggtgttttctgggccttgagcaagtgtctgactcccaaggcctctgctgggcatttggcgaggttgaggatgctctgtttcaccgcctggccactggggtctcagctcrggagtcactgtatggaggccacgtggcatcattaggacagggctggacctggatgaagccrygatgaccaggaatgagggggtcaaggtgcctgagaaccagacagacagaagttagctgaacctgtgccagtgagtctcagatggaggagagagaaaggcagcgtgattactgagggttctcagaggagctagggtctggggaagaacttggtgggcaggtggctggacttcaggggcatgtccaggtcstgtgcacagatgccgagggcaagtcctgggctttygggtctccctgc

SEQ ID NO: 1366 - DNA, 600 bp, Bovine  MMBT14603
acatgtgttcttatttatgagctgcatcagatgccgtcggcagcctacctttggcccttcaaggccagcttcgtgcgtgttctttgttccctcaagtctcaccgagtgaaatattaactgctggtgggacagagggccrgggagcctctgaaggcagggttggtgaagaaggatacctggagggagggttgttcactgacctggaattttccattcctgtgaagctcatatgaccagggcagtgttttctgcaagccacatagcgaagctgggtgccaagtggccggtgcttaggcaccrgatggtgggcgaccacagctgtttatagcaccatggtcactggtcacatcttgcccatgcagggggtcatggaaaggatcagacccaagagccgggagacccgggttcagccttggctctgcctctgggacagcctggggagtcttgtgggagaggctaatcgtctcagggcttcttttcccttggatgtaaaaagagagatcagaagagaagcacaaaatctcctttctgactcattttctgccctggatgctgagacycatgaactccacttagagctaactgtggtaacacattcca

SEQ ID NO: 1367 - DNA, 600 bp, Bovine  MMBT17498
taatgtctggctgccgtatggggaaaagtgaggagctatagacatgggagagttcagtcttcagaagttgtcccactgcctctctagttaggggactattccagattgaactaggttttggtttaaagaggcccatatttgaacacacagatttctgacccaggacaacgtggggacagctattgagttactttgtatttcctgaatccatgctgcatgccctctgctctctcaccttcttaagttgcttctcactcagtgaaggttggctgcacatcttctttatacaaggtaaagaaragaagagttctcagatagcaaattagtcaaaaaagagaaagcatgtatataatcagataatgctaggaatctggaggttggtgtgtgtgtatgtgtgttcagctgcgtccaactcttcgtgaccccaatgactatagccctccaggtgcctctgtccatgggattctccgggaaagaatactggagcaagctgccatttcctactccagaggatcctactgacccagggaccgaacctgagtctcttgcgtatcctgcattggcaggagggttctttaccatggyatcacctgggaagtt

SEQ ID NO: 1368 - DNA, 600 bp, Bovine  MMBT14379
cgttacactatgctgtatctttaactgtttgattaactcagaaacaattttatgcatacatattaagaaagcattcatgaatctggatttcactaagaaaatgatgcaatatgggggccccagtaaataggggctcctatagagtatatttgttggaaaatcatgcatataaggatgactggatgttcaagcaatttagattccagcctactcagatttaaaatacaagaacagtaaaagcttcatcagctcgaaattactttttaaatgatgtgagggcgtttcaagtcaatttgaaargattaggggataatatggatttgccaagtactttgacgtaccaaggaactgtkagggcacttgaaagattacacaagatatttaacagctttaaatcttcaagtttttaattctttgccttatttttttccccagcatttcaccttctttattgacttgtgcctgcagtccttctggttagccatttagccaggtaatacctacagtgaaaattaacattaatacagtgccaatacatttattatgagctgtcctcttacatcaatattttccattggctgtcttttttaaaattaatta

SEQ ID NO: 1369 - DNA, 600 bp, Bovine  MMBT13649
acatggatggtttctgtgaaagttcatattttgtctttgtaaatgtcactatagggcagtgatttttcaagcagaagtgatttttctctcctctcccctcagggacatttgatgtagacatttttgatgaatgattaggagtagtattggcatcttgtgggtagaagcaaggaataccgctaaatgttttaaaatgcatagacagtagcccccacccccaatgaagaattatccagcaaaaatgttaatagtgctatggttgagaaacccttatataaagcaagcagttgcatcttgcargaaccataatatttaaagtgttattttgttcattctctatattatttcatctagagccacaaattactgatgcagttgttgcaaaaacatagtaggcagaaactggaagaaagtctattttatgttaagttaaatagtagttaagtaaagaattgttcatctttcaggatttagattgagacttagatttttaaggataccgaggaccaaacatttgttctttgtaaaatttgtatcaatcaaactgttaattgcaacaaccactctactaaatacatatgtttgctgtatattaggctc

SEQ ID NO: 1370 - DNA, 582 bp, Bovine  MMBT12846
atatctaaaccagtggggtacatccccctaaaaaatcattttaaacatgtacttgaatttatactgaataatttgatttatatatcacatttggtgtcacacagctctcaaacggacttagcataaaaaactggaacataacttggaaatcaataggttagtataaaagctgtaagcattaacaaactcaaaattttcagtttgagtggaatcttcctccccatgcatgacaacttgtaaatggccaaagtatacatacaattgccaataattaataataatgccaaaaataatgtgcarcttgattttactttactggctatggtgattaactctgtcaacttgatggagtcgtaggatgcccagatatttggtcacacataatttgggtgtttgctgtgggtatttttagatgagtttaacatttatatctgtaaactaagtaaagttctccctaatatgggtgggccaatcacttgaagacccaaataaaacaaaaggttgaccctcccaccaagtaagaaatgaatcttctgtgtaacagctttacactaaaccggctctttagattccacacaagtc

SEQ ID NO: 1371 - DNA, 600 bp, Bovine  MMBT17511
tatttgaagaaagttgttggggaatcggactaaactggaaagaaaaataaatggtttctgttaaggtatctggatgccagacatgctatgaagaattaaagaatgattagacataataagctaaaggtttggggcagggtctgagtgaataattagaaggttagggttaatggaatggagaacttacaggaatgattgtaaaagaaagaacacagttgacctggkagatctgtaaattcagttgattttggtgttaaaagaatataggaatatgcgtaattattctyaagtttttaaatrttagaaagaaagcagtagaaaatgttagtcactcagtcatatccaacactttgcaaccccttggactgtgcccaacaggctcctttgaccatggcattctccagcaagaatattggagtgggttgccattccttctccaggggatcttcccaacccagggattgaacccgggtctaaatgttcattgtgcataaagttgttttaatgcagtggaaataagtgaagatcctgactgctgtctgaatttgaaatgttcatgtaattagtaattcatatttagtaggccaagttaaacttaac

SEQ ID NO: 1372 - DNA, 600 bp, Bovine  MMBT09221
gaaagtggggatgggataaattgggagattggaattgacatatatacactattgatactatgtataaaacagataactaatgagaacctattttatagcacagggaactctactcaatgctctgtggtgacctaaatgggaagaaaattwwaaaaaacccgagaggatatatgtaaacatatagctgattcactttgctttacagtagaaactaacacaaccttgtaaaacaactattgttgttgttatttagtccctaagttgtctccaactcttgcagccccatggactaacctgccrggctcatctgtcctatactccaataaaaacattttctaaaaagctgtaaaatttagtgtactacataatgaagctagtccacttgtaggaacctacgttaatgaaataatttagaatgtgcacartgattttatcaaaagcatatttgttgcagcattaaacctaaatgctcaagaaaaaagagtaaaatacattctgaaacatctttatacatactacacagacgtcaaaacaaagcccagttttgggaaagcaaatttcttgtcaaagaaagatgctcatgatatattatttcatgtg

SEQ ID NO: 1373 - DNA, 600 bp, Bovine  MMBT12652
tgaccaatagatcaatgaaggtttgcagaggtttttcccaccaggagtcctcaagagccaaaggcctgaattctaacagacacatttttacccagagctgtctcctgtgctacccaaacaggagcatccttgagatgttcttatccaagctgaggagttgaagatgcaagacgtgccataaggggaccgtttccctccttctggcacttcaccttgggactgtccccacagcatgggggtgactttgagtaagcagagcacactttaggcctaatctggacttgacacaatgtatatacrccacatttcatcctcctatagcgtaaagtgcctacccagctgtctgatgyggtcatggctaaactctaaggaagggatttgggaaggtttttcccaaactctgagcatgatataactgccagtttccaccagggtcatcataaacatataacaattcctaacatcagattttaacagcaaactcatcttaaactaccaaccccactccatactacagagttaaaaatggggggaaggggagagttaagggagtctgggatagacacgtacacgctgctgtatttaaaatgggtaactaac

SEQ ID NO: 1374 - DNA, 600 bp, Bovine  MMBT11887
agtgagtttcactttcactttcacaaccatggataggatcctgcaaagcacatcaaaagcccagctgtaactttacataattttttactgaaggcctgaggaagagaggatactataccaccctcccctcccccacccctaccccccacaaaaacaaaccaaccatacaactgggcattggactctggcttctagagtctattgcccatgggcttgtttggaggctgccccgagtcctacctccctggcgctgacctgtcccaagttgccagcaccatcttacctcccctagatgggagrgattcttggacaaggtccccttgcctgagtccagaccccacctccaaaacacaacaatcaacgcaaatgcagcttggcccctagagaagatagggttactcataattgaccacatgatcctttcaacccttttaatccaagagggaagattttgtttcatgtggccaggaagctcatcaaaatgttgcttcttccatcgccctgaacaagcgctgttaaaatgaattaaaaatttattgataatgtcaaacaccagtttcccctacttctatccatgaagatactaaaatgttgggattt

SEQ ID NO: 1375 - DNA, 600 bp, Bovine  MMBT18328
gttgtcagggctgggggcctgtggaggggcgctgtggtacacagcctgaggtctgaggtgggctggccccgggagaatgggaggctgctgtggagagttcggtttctatacacactttgttttcccacccggggaattcaggctgtgtcctgttctctgctcgagtatattgaagtgtttattctcttaacatgtaacgtggactgaacacctgacacgcccagcgttctaataccacagacaacccttctgaggatacaggcagcctgtccaggaacctaaawgtgtctcgagtgcacrgtgccacgtgcagcgcagtttcccggaagccagcgtcccccaagcggtcttgcgagctgcgctgcttcccgcaccggggtgggcggctgagggttgcggcccacggmttcgtcttgtcccctctgaggggtccccgccctcgcctcatgagccccagctgtgctctggttttgttggggagactgtattggtttttagacacagaagaaaattcactctggtttaaattggcagaatggcttgaaattattttctcattcccagaagatttttaaaacaattttcacaaaattttaggaa

SEQ ID NO: 1376 - DNA, 600 bp, Bovine  MMBT14251
tctgcctcctgaggccccgccccctgaggcccttctgtcctcctcacagaaggcgtgtggcatcccaacgctgctccctcgagtttctggaagacacrgtgggatgtccctcgggtcaaaggtaaggaccccgcctctctcctggggccaggatgggtctgggaggggcagagtgacctgcttttcacctgcagaaccaaacacatatccggatccccgagacacaagggcctgaaaaagacacacttcatcaagaacatgcggcagtacgacaccaggaacagcaggtatgggcgcgcrgcccaccatgtcctccctccagccctgtgggacctcgtcctgcctgtgtcagcagccctgtcctccttcagctcaggggactcgtccccacagcccgtcccttgtccccttggaagtgagccctccttccctcccacccacctccgttcatattccctgagcgccggagtccacagcacgtcctgggcgaggggccgcccagtagactctggtcttgagtagaaatgctgaacgttgagaacacagtggggacgggcaaagtggtggggtggccaggagagaaggaaacacagagggtac

SEQ ID NO: 1377 - DNA, 600 bp, Bovine  MMBT15673
tctggtggtgccagcaagaacctttcaagaggttgagcaagtctaaatcccagtcatgtgctttggtggttgtgttatttaaccttgtgatcctcgttttcttctctgtctcaggggtagcagcgcctccctcatggagtgctatgcctgacacattgaaatcttccgcaaatgatagggagaaaggcttggcaactgcatccttcccttgaatggaggaggaaagggtcgggttccttttcattgtcctgtcaaagttgtgcagagggccacaacgacacaatgttgaacgtcaacaaraggtgcatggcaaggctgaaacacacctgccrtaagagtctcatgtcttcagcagagtcaagcaacaactcgcttcaaagatccatgaattatcttgataataaaagcttcctctttccagcaatggaaactttacatggtgacaatttaagataaatttcctgtatttttcttttatcctgactttttctttttaaagaaatttttttttgatgaggatcatttttaaagtctctattayatttgttataatattgcttctgttttggtctttttgctatgacgcacgtgggatcttag

SEQ ID NO: 1378 - DNA, 598 bp, Bovine  MMBT17638
  misc_feature (1)..(22): n is any nucleotide
nnnnnnnnnnnnnnnnnnnnnnccccattctttggtatttcctcactttgtaggccccggcagcaggatcgctgagcagacgattgaagaggtagaagagggaaagctggaaaagcagggcttccattttgagatcatgggccagccggtgcagcatcttgaccacacagtggttggtgtgggcgctgttctgcttgtagctccgcagcagcagcaggtaggctcggaggacggttgagtttgcgaagctgcaccgagacaaggagcgagaggatgcaggcatgagaaagatatagctcrtccgcatggcaccccggtctgcaccctgacaccaactccatcctctgggcgcgcaccgtttcaggtagtccaaaaagttaaattctctctccgacacctggaccacttctaactcttcctcctcctcctcttcttcgtcttcttcctccgccccttgttcctccagaccctgctggcctacagaaagagtgaggattaccgggtatctgtgacgttggcrctagagaagcatgggaaggagagtgatgagaaggaaatggagactcacggggaagcggggccaagaggatttgcttca

SEQ ID NO: 1379 - DNA, 600 bp, Bovine  MMBT17106
cacaaatctccaggtatcctgcctcatcctcagtgggctatcatgttctgtggtacatcttggtagcccttaaaactggtggcatggtctcagatagattcttgcaggagagacagatttatggattccatcagcttcttccaggggagccgcccgatcgccaggagggcacaggtgagatgcttgttgaggttctctcagcctgtctaccagggtcaaacagcagtttccaggtcctcatggccaatgatcttataattctggcggctttccaggtaggcagccaagtctgggtccccrgcctgttgggctctgtcttgaggtgtcttaccctgtaggtaacagtgaagaggaaagagacacgaacacttgggaaacatttttaaaaaaatcatagaaacagagcagctcaaagataactcactaaaactgatctttccatgttttctgtttgagttgatgagatactttctaaatctattattgcatcaaacgtatgagatatgcaagttcaaaagagatgatcacttttcagaggtggggcttccatcaaaggaaagggaggttctagagtaactagttagcagcaaatcgtgtagc

SEQ ID NO: 1380 - DNA, 598 bp, Bovine  MMBT14791
  misc_feature (1)..(12): n is any nucleotide
nnnnnnnnnnnnatttttttaaaagtttttcccaaattcatggatgaatcataaattatgccaggtatgatataaagaatattgaccttttttttttggtcacaacacacagcttgctaaatcttagttccctgatcagaaattgaacttggaccatggcagtgaaaacaccaattcctaaccactgaaccatcagaaaattccctaaaactgactttaaaaataaaatatgttgtgaatgccctaarcaagttgattagttgggtttttaaaaatttaatgtatatgtaaatctgcatrtataaatatacattcaatgtgtatgtttgtatgttctttattcaactgctccagatgatatgatatgggtccctctaagatttttttctgtgatgatcaaattgagccaataaatgtttgattaattcctatggtgagccccataaaggccagtcacagatagaaaggatagttaaggagggaactgctagttaaggagattttttaaggcttagagtagagcctgaartcaaatagaacagaaaaggattagcatcaaaagagagtgaaaacccaaaagtactggtctcagtctcta

SEQ ID NO: 1381 - DNA, 600 bp, Bovine  MMBT12638
gtcaataaacagtcctcgttcaagagacttttgccacttctgggtcagtagcttgatctttgtctactgccakaaataaaagtgattgcttaaatgtccttgtcaccagaacaaaatgactttccctacatttaaaaacaagtgctgacaactccaaaaacagattatttctaacaataatagttgagcttytccacatacgcactgtgtcctgggcactctgctacctacttaatcctcagtgttttcaatattcccattttatagatcagaaaactcagagcttgaatggcttgcctraggagttgcaattagtctcttgtggagcaaagattagtgcccacgtctgtcttcaactacagtgaaagcttttaactatctcgctaaacsaagtctaaaaataaatcaattaatccaaatgaaggggctggagaacattaagaagttttccctgttctcaaattctaagattacttgaaaaacatgttctgaaatattatgtaatatattctgaagtcaaagaaccatgcctttgtttaacagccactgttctggaagctccattccttagcaccccatctagccagccaaatactcaag

SEQ ID NO: 1382 - DNA, 604 bp, Bovine  MMBT16333
  misc_feature (1)..(4): n is any nucleotide
nnnnaaggaaatattctataggagaaacacggatgcagcaaaaattgttaaacaagtaagttagaactaacaattaacaataaaaatccacagaagttcacatgtccttggatttgtttgagtcaactcaagtataaaacattttttaaggaattatttttgaagctggtctttttaactcaaaaatgtataactaactgatgccagttttctctctctacactctctctctcttttttttttaagtcaaataaactgcatttaaaacctgaggcaatatatagcagaaaccaatgcaatattrtaaagcaatttcttccaattaaaaataaataattttttaaattgaggcrttctacttgatgttacttttttttaacgtgaaagatatttagtttttgtgactgctttggttcaatattttacttartgaaaataagattaagtggaactgctttcaactggttttaggtgatgtgattaactcctgaatcaaggtgctaagtggcattttgaattagagagacagtgtcagatgtggcagaatgaaccaagatatcgagcttttttgtttccagttctggctccactttctggaagggtg

SEQ ID NO: 1383 - DNA, 600 bp, Bovine  MMBT17534
gggggctgtggaaggcttcagggtgaagacatgactgagttttacgagaccaggctggtggtgcasagatgtggatccagggcccaaggcagggaccctgggggctaaataaccagaagctagrcatcgcttagtgtggggaagcatcttgtgttacaggacacatgtcagatccctttgtccccacagctttctgtcccacaagggttccatcagagctccgctccttactctctctgggagggcagctcccataactcgttagaggctgggactgagagcgcgccttggtgacagggygcatggrgccrcccctgcctcccctctggttgctcccgcctgaaggccggggggaaggtggactggctgtcaggctcccgcacagaacccggctcctcagcctcctgccctgtgacctgggcaagtcacccttcgccccagctccaggggagccttgatatcttcacctgtcacacaggatgaaaggtggctgggagggcgggcaaggcctggaatgggacctgctgggcaccgggaggccccgtttgctgagtgtcttccctcgccacaccctgagccctggggcyatgtccccagccc

SEQ ID NO: 1384 - DNA, 600 bp, Bovine  MMBT17575
acagactcagctgagctgagtsaagaactggtggagggggacaagaattctgaacacctcccgtccatggctggcttgcttaagcaccaacaagatgccagtccacggagtgcgcactgtcagcctagggcagtgagggtgccctagaccccccttcagacagattgcaggggagttgtatgttggttcagaactggttttaaaaaataaaaataaaaaacccttcactacccacagtgggggcttcaagccagaccaggtgggttggccctgcagagagccaggggtccaagcccccarcttggccacatcccccctccactccacttctcttgttcccctgggcctatggaaggacaagctgttcccactgagccctaccagggctgcgctttaacccctacaatccatgctaatcctcagctccacccactccagctgctctctcccctgagccctggcagtgctgcctgccagcttcagccctgcgctcacccttcccagggcaccctctcctctccctgagaagagctgggagctggcccagggccctccagagcacaagtcacgggctgggcacctgctactcagatgcggagc

SEQ ID NO: 1385 - DNA, 600 bp, Bovine  MMBT09694
ctctcgtgttcccagggggacacacagagggcctgacaccatgtagaacgtctttctttctctctcctcactccctctgctgttccagtttgcatctctaacctgatcccggccacccagccaggtgccacctgtgccctggaggaagaggcaagaaacagtctgttaacattttcttgaggtgccagaggagatgctagagggtctgacgagggccttggagcgtgccagtggcaggtgttgggtcacagacacggtgccctttgcacagcatctgtcctctccctgccagggcaggcrgggctctctgtgcccctggatgtggggcatttacrctcactggcacccctgttctgctttggtgcagagcctgccctggcctgcaatgtgtgtgaggctgaagtcttgggaaatcctggagcyggggtctgaggcaccccgtcattttctaggaacaggaataactggaggtgctggttgcccgagtggtcccgcctgtcatgggtaagcgggaatgcccgctggtggggtgactcagaggtccccatgaggcactttggagtccttttctcctttaatggcagtctgcagacagtgggg

SEQ ID NO: 1386 - DNA, 600 bp, Bovine  MMBT18357
tgaatctctctccttgaatgtttgcggagttgtgttgtgattgaaaatgattacacaatgactataaaattctgtgaagaggatggaggttaaaatggaaaggattttgctgtacgaccacacttacataaccttttggtgagtgatattcaaacttactacacgctccacactgcatggggtgcagaggtgcagaaaaggcgggcggagggatgtgtgctccttgtcatttaggggctyccagtcaagtgagtgatggctataatggagtcacgaaaagggccctacggggaaaggccytcttcccatgaggggcacttgacacttgtctgaagaatgaggaggagtttgctgattatggtacatggagggttaaaaggtattctagctacacgtttagctgtgagaaaagataccatgttcaaacacagtatgtacttagtatgttagagctcaaggcaaacatgagctggtggccagagatattacggaagggtaggcaggggttggctcttcaaagtcttcattgaatttgttacaatattctttctgttgaatgtttttgggtttttggcttggaggcatgtgagatcttagctc

SEQ ID NO: 1387 - DNA, 598 bp, Bovine  MMBT17263
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataggagctgggaagccctagatcaaggtgacagcccacatggtgctggtgaagccctgcttcctaagtttgctgatgggctgtcatctccttgtagcttcacttggtggagagcagagagaaagcaagccctctggtctgtcttcttagaaggacactcgtcccattcatgagggccccacccaytcttatgatctcctaaaggtcccacctccagatgccatacactcaaagttaagatttcagtatgtcagtttggagcaggagacacaaacattcagtccataacagagtaatataaaggacacttgtatacccaccactcagtgtaagagtatatggcaacattgcctatacatgagttacattcacctccttccctgtttctactaagtaatctaaggaataagaagatgaaactatcttgagggtgaagccctttattaagttctttcaccttacactaaaattctacatggaaatt

SEQ ID NO: 1388 - DNA, 600 bp, Bovine  MMBT14437
atattgcttcttacttgggggcatctcagcttccctgatcacctgtcttactgacaggaggcaacaaggaggagaactgcagacctcccagggagcagcttttgggcatttgattgaggcaccaagacatccagaggacaactgagtattgacgatggatagctttgaatggcttttcttttttaaagatttatgtgtttttatttatttttggctgcactagatctccgttgctgtgcrggattttcactagttgcagtgcatggacttctcattgggtrgcttctcttgttgccaagygtgggctctaagtgcacaggctgcagtagttgtgtgctgtagagcgctagatcagttgctstgctgcatgtgggatcttcctggaccagggctcgaacccrtgtcctctgcattggcaggcagattcttaaccactagaccaccagagaagcacctgaatggcttttattaccatgttgtgaactgactttggttcttaagagtggctccatgtcggttcactcttaatctcagtactgagacatcactccaagctttcctaaatggtaggacttgcaagatgcatgttagttagtgcct

SEQ ID NO: 1389 - DNA, 600 bp, Bovine  MMBT17624
tagagctaatcaatgaatatagtaaagttgcagtatayaaaattaatagaaagacatcccttgcattcctataaactaacaatgaaaaatcagaaagagaaattaagaaaataatcccattcaccattgcaatgaaaagaatataatacttaggaataaatttacctaaagaaacaaaagacctgtttacagaaaattataaaacactgatgaaagaaatcaaagatgacacaaatagatgaagaactatatcatgttcttggactgtaagaatcaatatagtgaaaataagtatactayccaaagcaatctatagattcagtgcgattcctatcaaactaccaatgatatttttcacagaactaaaacaaataatttcgtttgtatggaaatacaaataatttgtatggaaacaaaaaagaccccgaatagtcaaggcaatcttgagaaagaagaatggaactggaaaaatcaacccttcctaacttcagactatactacaaaagctatagttatcaagacaatatggtactggcacaaagacagaaatatagatcaatggaacaaaatagaaagtccagagataaatccataccccta

SEQ ID NO: 1390 - DNA, 600 bp, Bovine  MMBT17190
tgttttattttactaaattcctctgtctccatctctagagtctcttgagtggaagagtgtccacatccttacaaacagctatttctcctataattccatttacatttaattttaattttactcccagtttccctcctcggttctctgctataccaattccctcttttgattacctattcttacaaaatcccacgtggactcatcaccaggaagcaaagagatctgtgtgtgaactaacaaatacacaatgacaaatccctgacagactttgaaagaggtgacctgatygtcaggaacgtytgttaattaggtagagatytgtggactgaaaaaccagtagcaaagcttggactttatgaaattactcacagttaatatatgtggtaaaactgaaatttgactttttctgttggggggattggtgtcatttaacttaggattggcaaatgaaattctgatagtagaggtatgcgaaacaagaattatctgtgctaggtcaatggaccatacacacacatacaaaaacaaagtaaatattgtttaaaattctattcaaacaaacaaacaaatatgccaaggcataaaaatgcaaagcttgaa

SEQ ID NO: 1391 - DNA, 600 bp, Bovine  MMBT18018
gtatatgcctgggtatctgagtttttttgtgtctactgtgtatgtgtttggtgtgtgcctggcctccgcgtgtatgttttcctatggtttggatgattgtaagtttgtgaatgtgtgccattggtgtgcaggtgagtgtgtatctttctgcttgtttctgtgatttgtaactacctgtaagtttatgggctrtgtgtctgcctactagtctgtgtactagtatttccatgtatgtgtgtaaatatgaaatttacttcactatatgagctataaggtatatgaccccttttaaaaattttytgaaaaatcaaatgtaatcattgatgagcctcaccccatcctgaaaagatggtgggaaagtctatctaatcacccttgggagccccttccttcccgccctccagacttgtacaaagagcctaaggagcccgagacaattgggggggggtcctctggttttcagtccccactgtcacttgctgacatgctcattgttcaggcacatggtcccyatgagggggtcaatctgcagttgttctcatcactgggggccctgcaggccactctcccctgaaatcctgtcccgccccgccacccacc

SEQ ID NO: 1392 - DNA, 600 bp, Bovine  MMBT16261
gatgctggggatatggcctggtgagaattttaatcttgaaaaactaattatgaaatatttcaagtatgaagcatagaaaatgatttcataaacactcataaagtaccactcagctttcccaaatcttaacatttggtcaaaatggttcagatctttttgaaaaacacaaaatactttagagttgtgtttcactccttttccttgtcacggaggtaaacacggtgccaattttggtgttgtcattctcagaagttcccttttgataaatctgtatgcatctctaaacatattttgaaatayggaccttattattatttaaatatggtgacaatattagccgctcagtcgtgtctctttgagaccccatgggccatcaggctcctctgtccatggaattctccaggcaagaatactgragtgagttgccattgcctcctctaggggatcttcccaacccagggattgaacctgggtctcctgcattgcaggcagattctttatcgtctgaaccaccagggaagccatgggtcttattattattcaagtatggtgaagccatgttatattcacagctcccaagagaaagggggcctgtgagga

SEQ ID NO: 1393 - DNA, 600 bp, Bovine  MMBT17196
acaatttttaccttgaaagcctaacctctaccatccccataaaattaaactccactaaattataagcacttaaattggggtcttttacatcttggtgtggtcacatgtcataaagacatgggaaaacttagaagtcagtgtatcttctagagataatcagccaacacctcccttaagcaattccctttggctataaagcaaaacttattgaattagcacacatttatcaaaaattggtactacttagtctcactaatgagtttgaaatttcaaatacagacttggtggaatgattccatygtgctgtaagtatgctagattttgccaagtgctgattacgtatttggcacagtttcagtactaagtggaattatgtatttattacttaaattatgtaagctatccgtacttactataaaaagaaaggaataggtatatacttaagaaaaagaagaaagtatatacacaagaagaaggtatatacttaagcaaaaaaaaaaaaaaagaaatacaattcaacaatccaaagatagagcttattaacattttacactgtaattgttcacatttttttcagtatgtgtatggtgtgtgtccttt

SEQ ID NO: 1394 - DNA, 600 bp, Bovine  MMBT17020
aaacattcccaaagcatcatggggcaggagggccattgtatgcctagggttggctggccatggactccttccaaagactgacccaaagataacttgatacctcctgtaccttctgctcatttctttatagatccagctcctgtttcctgtatttcctaattacccacaacactcattctgaaaacgtcattcctgaagcttttggagaaaaagaaacctgctaaatgtgcagataagagaatttcatgtaaaagaattttacattttgtaaaattttacaatttgcatttggtagcaaaygggttgaagaagttttaataaaatgaaggatcatgctcactctcaccgaatgaaaggaggcagaaattctttgatgtcttgattacagaccaggattagagcctgtgattcagctagggtcatctcagcctcacaaggagactcactcagtcccttctccgctcccccaccgcctctggagtctctctttctaattctccaaggtccaagacttcaagtcttccacgtgaaggagttagaaagcgtgggtgtgtttgttttgttaaacagagacacttccttttctggaaaaaaatatca

SEQ ID NO: 1395 - DNA, 602 bp, Bovine  MMBT17372
  misc_feature (1)..(2): n is any nucleotide
nngcatgcaccacgagataagccactacaatgagaagcctgtgcaccacaaggaagagtagcccgcacttgctgcaactagagaaagaccatgtgcagcaacaaagacccagtgcagccaaaaaataaatcaataaaaatttaaaaaataaatctttttttttttttaagtcatgcaaattactgtctgttgtggccagaagaatgtgcctctcagattttctagggcaggaggtaaaattggcctccagtcgtggctgctgacatgctggcagccaggttaatcttcctacaggctgcacyggccagtgaccaggcacgttaggggtttcactcctgggagaaaggggctgttctgatggaggaccttggctcaaaagccccttccagattggttgaaattttcttagaaccacagagcagcccatggcattcctcagcacttttattcctcctcccactccatctcccttccctctctccttcatgggcgccagacctgcctcrgggtctgctggctctcctgcctcctcctgctccttccccatcatccctcactggtgtttccccagtacatctcttatccatctcatccctgcttgg

SEQ ID NO: 1396 - DNA, 600 bp, Bovine  MMBT17177
tttatcacaaaaaaacatctcaatgattaagacaggcatttctggtgataaaaaagaagggtcaagacttaaaaaaaaaaatcaagaaatctggccaaagattactagtttatattttaatgttaccttccaaacattcataggacattttgagatgtttactaccactactttatttcaaaatgaatttatgtaagcttttagaaattcatgctttcaaatggacatgaaatatgtcaaatgatgctaaagaatggctgtaattaccatatctgaaaacagactaggacattaaatttycaaatgctacgttcaaaatataaagtgctttaaatctaaaaacacacatgaaatgatattaccaattargaacatctgtgcaggagctgtatacttatttatttgcaaaagtaacttgaaatgtgagagtttatggaaaaataattatgctattcatttcatcctaacaagaatayatagtatgggaaaacatcttccataaaatgttaatgattaacacagacattattaaaacttaaatattattttgcttccaatatttcagcaccactaactttaaaaaaaaaaatgtgtacttgc

SEQ ID NO: 1397 - DNA, 600 bp, Bovine  MMBT16732
atgccaatactgtcacgtatttgtctacctataggaagagccttgtgatgcaggcagccgcagaaatatacatgctacttactccctggttcacgtttttcatttttctctaaccaggggtgcgtcagctcgaaatcatgtgctgctttggctgcatgtcggttctcgccaactactttgtgttcatgactttcttcccagcttgtgtgtccttggttctggaggtaagagctgttcttatttatggcactagtagaagaagaagatttctcattacgttagttcacctaaagacaatcrgcaccttctaacgtaacactgacttcctttgtagctttctcgggaaagccgcgagggccgtccaatctggcagctcagccattttgcccgagtcttagaagaagaagaaaataagccaaatcctgttactcagagggttaaagatgattatggtaattacatgatttcttttcattatctttggttccaatatcatattctgcttttcagttttttttttccccttcttgtctttctacaacttttggctcttgcatggatattcctcttcctttttcccccccctcttatctttttcct

SEQ ID NO: 1398 - DNA, 600 bp, Bovine  MMBT18193
cagcagctggcaggaacctgcctaaataaatgcaaagagaccccccctctggaagctgctcttgccgcgtccccatccaaatgttaattttgccagggccttgataaatcttcctgtcgcctccacccacctgagacatagatttcatcttattgagaggtgacacttctgccctttggtaccagctatcaatttcaggcggcgcccagagtggagagagatgaagaaccaggttctgctaaaccgccttcagccaccccatcctttccttaaacccccatggggccagcccacctgagrcattgtcacctacccttccagaagaagtactgggaccccaccactattgcstggctgtcagcaattccatgctcacctgcctgactttcaactgccaacacctgaacctcttttttttttttttaaagatatgtgttttgttcatatttttaatatttatttatctggctgcaccaagtcttggggcatgtgagatatttgtctgtgggctgcgaactcttggttgcagaatgtgggacctagttccctgaacagggatcaaatccgggccccctgcattgagagggaggagtcttagcc

SEQ ID NO: 1399 - DNA, 600 bp, Bovine  MMBT16736
taatgcaacattgcaaagcaattatacttcaattaaaaaaaaacttaaaaaacgaattgtaccaggaaaccaaaagtataccagagaggtgggtatgacacggagcaaggactcgatgaggtgatctgcgccagagccaggtgcattaggtcccagaaaaagcagcgagcccagggtgagcgctttccagatcagaagtgtgaggcctctcacagccccagcaaagccacggcctctgcttggcttgcatcccactaccgactgggggaaactagggatggtcccacattgcccactatrtccatcatctctcagagaccgctcacacactgcgagcgcactcagacctaggatggggttctcgtaagggactgtgggctagtctcttagcttccgaagcctccgtttcctcatctaaagatggcattatctgctttcataggattactgtgaacagcaaattagacaatgcctgtgaaacacttagcccagctccaggcacaaagcgttcattgagcaccagctatcattgctacatcatcatcatcattatcctcattttcattaggatactttgaaggtgagtgagtgcaatgtgac

SEQ ID NO: 1400 - DNA, 600 bp, Bovine  MMBT17942
gatttaaaatagcattgtgaagtaactatgctccaataaaaattaattaattaaaaaaaacaacactgtactcagattttgtcctgttgtattactccaggttagttacttaaatttgctgagcattagcttcctttcgtgaagtatggctcctatcccaaagggtgttgtgagaatcctgagagtctaagcacacacactgcattgtaaagagtgcctggcattctgtaaatgcccgttaccgttgccaaaatacggtgggcttggggggcagatgtcctggggagcagctggagaacraagcttgagccagttgtctagtactctgagagttggtcttcctcgtgttgcatcttccctttgggctgcagataaggccttgactcagctttgctgcactaggtcctggaagcacctagtctcagggtcttttgtgtctgtcacaaggtaattatttagtacctgtgatttactcaccaaatagtggctagttgatttacttcaaagtctccaatcctgtcctagatcaatcagatcaacattttcaagagggttcaaaaatcctaattcttaggtaaagctttcaaaagtgaacaaaam

SEQ ID NO: 1401 - DNA, 600 bp, Bovine  MMBT16471
atgacttcaggcaacarccatctcgatctctcagcttcctccagtcaggtgctggcctggctcagcttattctctgccagagggcttcccaggcggatcaaggtgccagccaggctggggtcctcctctgggttcaccactgctggctgctgtggacggaggccctggctcctttctggctgtccatgggggcctccctcatggccccactttctcacagcccaggaacacaccctcctgctgctgtgaccaggtctgatcagagaagtgattgccccaccacccctctgccatgtaatrcaaccccatcaagggagcagcttccctgttgaaccacaggctctgcccattttcaagggaaggagatcacctgggctgtgtgcccctggggacagccgtcccgagacgtctcagaattctgcccgctgtagcctgcaggtgtctcggcattcctgagggcttccgatcaacagccctgaactcttcattaattatgaattttgcctagcaaccattgccaagcaacaactcttcagaaagaaatgttcaaagaatttgttggttgctgcgtggtggagatgaggaaatgagtgtcagcgg

SEQ ID NO: 1402 - DNA, 600 bp, Bovine  MMBT16404
caggccatgacacaagtaactaaggaaatgaggtcataagggtgggactctattcccataagaccaacgacctcacaagaagagacaggaaaggggcgctctgtctcactcaggggtgaagacgcagcaggaaggtggctgtccacgggtcaggaagagagctcccaccagaacccggccctgcaggccccccgatcgtggaccttcagcctccagagccgcaattaaaaataaatatcatctggagaactttgctacagctccagacacaacagctgggtccagtccgcagtcagtaartatgtgtgacgtcgatgaacagtcatcctacggcccctagtgaggccaggagcaagctttcataacacaaacggtacgttaatcggattagggatgcagagtcagacctggaaccgactcttcctacctcaaaaaccgaccgggagagcaccgccccacaggactgtctgctctgggggtgagtcctctgcgatggccggtacagtagccatgagccacacgcatctgctgagcacatgacatgtgcccgggatggcagagcaacggatttttactttgattcctgttttttcatatatt

SEQ ID NO: 1403 - DNA, 600 bp, Bovine  MMBT14358
gcaacttcaggcttgtgaatgggccagacaagaagctggttcccttgtctagaggcacaagagctcctccattcatcctcattcaggctttctctaattccttctcatttcctcattgggaacctggggctaaagagggcttgtgactagatcctgagaggaataactaagtactttacatacttaattgcaccaaaggtaaattaataacatacttgaagagggtgaaatgagctctttcacagtagctagattcagaaggactcaagaaagacagtgatgaggtcttstgcctgcttrrgtctgtttgaattcagcttttgctcgtggtctaccaggcccattggagaactctctgtgagctgagggagcctcctcaaacatggcctcccacaaagttcatcccaggggctgtggatgagcttttaactgtggagttaaaaaatactgacccaggtataggttttcagtgtgtaagagcaccacagctatccacctggaaagaacctttccaaaarcctagggcaggagatgatagccttccaaggagcctaaatatcagggaaaaggatgaaatgaagcagcaagatcagactaaaa

SEQ ID NO: 1404 - DNA, 598 bp, Bovine  MMBT17144
  misc_feature (1)..(52): n is any nucleotide
nnnnnnnnnnnnnnnnnnnnnnnnnnnnnnnnnnnnnnnnnnnnnnnnnnnnccgcacagtgcaggatgtagggccttagttcctcactgagggactgaacctgtgcctctgcatgggaagtacagagtcgtaactactaaaaggtgaattttaaataaaaaggctcagagcacargcctcaaattgcggaacccatgcttgtacctggttgtgcactggtccccagtatttcttccattactgtggctctaagatctagagaaaragggacatgatgacattgttttcccaccaactcrtcctgtgttccccatctgtatctctccacatagccagccctctaggtctaacctctgtaatctgtttctacctctctgtcctcttgtgccagagaaaatagttctttttcatttaaaccttagaatatgacttctacatgagatacccctgtgaaactgttttcccaacccggtgtagcttcctgccctttgtttgaagagtgaaacaacacggactttactttttgacctttgagcattcatgagggagacagaggagcaggcagcaaggaggcctgggagaacgcaggcccataaa

SEQ ID NO: 1405 - DNA, 600 bp, Bovine  MMBT14357
agctggcaaggaccaatggacctgcattgatctcagcttattttaaagaatgtgtggttaagaattttatctgagttgtctcacctctccctaccttatcaccctcaagcaaactgtcaggttgaaccaaggcttcctgaagcactttgttgaagatcggccagtagggtttcccagatttttcttctctcaacatgtcactccatgttcagcaacaggagttggtcttgctgaattactaatgaggggatgtctcaagacttggctccacagtgttcctctcctttcctttcctttcartaaatatctgttaagtacctattgtgtgccaagaactctcttgggtccatggaggatgcaaagatgaatgagacaagtctcattagtaggttaaataatcagcttgaatataaggtaagtgaaataagtgttaaaccgaagtataagcaatatgttgtgggaacacaggtgaaaaaaagggagacaggaactcactaaacactcagctatgttgtcaattcctgtaacatacgttatcataaagattaattctgactgggggaatctgaaaagtattcatgcactaggacatttaattgg

SEQ ID NO: 1406 - DNA, 598 bp, Bovine  MMBT18219
  misc_feature (1)..(118): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctctgttaataagcatgtggtctctaatgtgagtgtcccttgaaaataacttatgcttttatctgtatcttgccattctaaggctcaaagatacgggatgatttcaggctgacgtaaggtgtcctagcttaatgatgagaggaatcacatttgagaatgccgtttctttggctgtccrcagcctttagtatgcccgtcacgtctctcctgaagagtgtccggacatcccrcacattgttcttccatttcaatccctctccagcttctgaagggaagtcacatgggtctctcactgtgccctggatccagctcctgtggcactggctgcctgttcctctggtgctgaaacggtcttcacattgcccatgattctccttgtcctggggagagcattcctctcccagccagctgacaggctttcttcatggagaacagagcattcatcctcactccaaggagtctgtctctctcagttg

SEQ ID NO: 1407 - DNA, 600 bp, Bovine  MMBT14467
aggaatgagaggccaggaatgttggagaactgaggctgaggactggggacagggattggaggggtgtttagaaccttttctaggaggagggctgagggatgcatcagtgagctttcccgacagtcccctggtggaggggccgctggaagaaggtactgctcagcccccgtagcagccctctgtccctctgcccgcctctctcccatagcaacgtccaaggagacagccagaccagcatctgcatcaccattgagcctgggctgctcttgaagggagacatcttggtgagtcgctcctccrtctcaagctctcccctgcccccaaccgtttatttttttctttcttttttcatcgtgctcccctcctgtctctttggataagtgtgtccctcctggtgggccaccagccttgggggcgttgactggctctcaggggccctgcaaggccttccagcctggaaggtccttgtccatccacttcctcacagtgggatatgccttgcctgggctttcctcttgttctggagcacctccagggaaatacggctctgtgtgagctgttacctccaggcttcccgctggtgactgggactgcctcaat

SEQ ID NO: 1408 - DNA, 600 bp, Bovine  MMBT16615
tcttgcctggagaatcccacggacagagcagcttggtgggcttcagtccacgaggttgcaaagagttggacatgactgagcttgcacgtagttcagccattctggtgagtcactcagtctttctgggtctctccatgtatacaggttattcaaattctatttgtttttcttctgttagtcctgcctcatatcaatttaattcttagaccagccagaagaacctacaagggagaggaaagttcttctccttccccacagaggtacccggcggtgcagcttcccttggcttcacagaccacrgtgctctgacatctcagtgcagcagagacggtccctgactatggttccactcagggctgtaactttacgatggcgcagaagggatatacgttcaatagagaccactcttccgattttgaattctgatcttttcccaggctggtgatatgcagtacgatcctctcttgtgatgctcagccctttactgaaaacacttatgagcaattgctctaaagaattcacaagaagagggcttccctggtggctcaatggtaaagaacccgcctgccaatgcaggagacaggggttcaatccttgatc

SEQ ID NO: 1409 - DNA, 600 bp, Bovine  MMBT14486
ccagagaaagtggtcatttccaactgggctgttcttgtattgctgtggtgtgtggtgtgtgatcatagtagggacaaatccaggtggtcacttctatcatgatgctccatggatagttgccaggattcttattttagggcttgattctttggccccatgactgcaacgtgtgtccaccaatatgtttggctgaatcttcttaaccgtgttgggaactggtctggcctggcctcctgtagggccctctttctgtggccaaagatgccaatacaagtagtttcctacatgcttgtggcctcractcccttggacgacaggctggccatgcagtgacagacctgcctctcagtgggagttttcaggatgtctaatcggatggaaatctgatctggatgcacgactggccttggcagttggatggtgcagaaacccaaatctgccctggctttactagctcataaaatgaccaccgccatcagtcctgctttgtgggcccattgtcttctggttggatggcttgggttggatccatttctcaggaacctaaaaaagggaagcagtgctaccaggatgtcatgtggaggcacaaacctggagctc

SEQ ID NO: 1410 - DNA, 600 bp, Bovine  MMBT16800
cttgaccctacggagagcctgacccttgcacctgccggtctccttcagaaccttaagcgagtggcggaggtgtggatggacgagtacgcagagcacatctaccagcgccgtcccggagtaccgccacctctccgctggggacgtgactgcccagaaaaagctccgtagctccctgaactgcaagagtttcaagtggtttatgaccaagatcgcctgggatctgccccaattctacccacccgtggagcccccgggctgcagcctggggtgaggtgagtgtgaaggctagggcccrmcacrtaagtaggtctcaagtcaaaatgcacgtgcagggtccacaatttagagaaaaagtggtggtaacacaacactgtaaatcaactacatttcaataaaaattaataataaawaaaaaaaaagcttagcatcatctagaaagtgccagtagaggtataacatataaaactttctcctttccttcgctggtctctcttagccttggggtggtggtttttgtttgttcactatttaatgttacaagtagaaaaaaattaaaactttaaattattagcatgaattttactattcatctttatgttc

SEQ ID NO: 1411 - DNA, 600 bp, Bovine  MMBT18263
caaggccccaggagccccggtctctccagctaaagaccagagaaaccaggctgctgcttagaacccatgttggccccctgcctgccctcacgaggctccatcaccatttgtaagatcaccacccccaacccccagctttgctcctcttccgatgaactggagctgtgggagcaccgtccccacacagactcccagctgggaatcctccaggggagtggaagcagctcgggtggtttgtaggagtttgggtgatcctgagagatgctgagagagcagagactgagggtggggagaaaagcrgtctgcgaaggagtctcaaccaagaccccagacagattctggggctgcagctctttgccaaggaggggcgatggccaaccccatccccttctcccaggcctgtgaagatgcagcggggaagagcagagggaggggcttgaggtcgcctcttgcacctgcagcagcatccgctcaccaccaggcgtgaacagccacggggaagtttgttctccatgtagagaacctccctggccgtttgtaatggtggccatcaacctgcgatttcaaatctgaaagttaaatcatagccaattgtcacag

SEQ ID NO: 1412 - DNA, 598 bp, Bovine  MMBT16420
  misc_feature (1)..(140): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccttgagaacagaacagtaactgtgggccctgcagtctggcctcctgatgcctgtcccgggctccccagcctcaccgacatcaagactatttggcacaaacctattatgggccagtgctgttcaggaggacttaaaaattgacagaattgaccagaragggtaacagcctctggttcatgcccygaggcaataaggtccatccggtcctatgtgctccccagactcccaggaggacccctgccttgcttggcccagagcctcggtcactcacttgccatggggcctgccccagtaccactcgccctcgtaggtggcctggcagaagcggccctctgcacggaaggtgtatgctccacagcggcaggtggggggttcagaagrctccargcccgctcccagcaccgggaagtccttcttcccacgcaaggcctggcacacagcctgggtaaccttc

SEQ ID NO: 1413 - DNA, 600 bp, Bovine  MMBT18137
tttctgaggattatctcctctggtcctgcgtgggccctggtgtcacccagatgataacagatgtgagaacttgcctgtggcgggtgggaagtgacgggtcaggattggaatccaagcacttggactcgtggaaaatgagaagcatagtccttatgaagggcgagagaatgaggcatggactgtgacttctgggtggctggagctctgtgaggcccagaaataggaagcctggttggcattcaaacactggcttgcccgtgaaccagcttagccgaatagtaaggaatgtctgaaatgtcrgaggaagaattaagtggttggaaaagtggtaactttctcctgagctgttgtcagcctttctcaggtttgttttgtcttttccaccacagtgggcagctcctgtaagagagcttgcctaggccctgactgaccaagcgtgtgtgcgtgcttagtcgctcagtcgtgtccaactctttgcgacaccatgaactgcagcccgccaggctcctctgtccctgggattctccaggcaaggaaactggagtgagttgccatgctctcctccaggggatcttcccaacccagggatggaaccctggt

SEQ ID NO: 1414 - DNA, 600 bp, Bovine  MMBT16789
catcatttcattcctttttatgggtgggtagtattccattctatacatctgccacatcttcttatctgttcttctgtcaatggatatttaggttgtttcgatttcttttgactattgtgaacagggaacattggtatcatctgtcttggtatcacttcgaggcttcccatttctttggcagattttccctgacaaagagacaagagggccactaacagttctcatggtttcaaatccagaaagaaaaaaatctctcatcacaacagtccaatacagaaattggttctcagacttcactgrgtcccgggcccattcctggatcaacacatcacttgggcttggtggcttggatgatctcataggtctgtctagggtcacaggttcatcactggacgcagggttggtgtctgtctaycccgaatcctgggacctgagattaggggagggctgggttctaaagaaaaactgaggtcctgttaccagaataaggggtaatggctgccaaacagctatctcccttggggtagaaaagacgaagagcatttgagcctgagtgaacctggcggggtgggggggggggggcacaaatgggagtctgca

SEQ ID NO: 1415 - DNA, 600 bp, Bovine  MMBT17996
ccgaccagggatcgagcccgtgtctcctgcattggcaggcggaatctttaccattgccaccagggaagcactccctgactcactagggaccctcaaatcaggtctgaggtccccttgggcaccttgaactcaacatgtccaacctgtctgagcccccagcacttgcagaaaggggtccttgcagctcaccacccaaaggttaattctcagtcccaccccctgtgccttcttggcgggtgctctgggctggggattctgcagtaaacggctcccttgcagctgaacaagtcaagttctaartgggcccacctggagcataaggtcctgtcttgctcccattttgcagatctggagactgagggtaggaagctcacttggggtcacagagctgggaagcaggaccaccacgggccttggggcctctgctcagagcccccactgcacggccctcaccctggggtgaacctcactgaaccctctctctagaatgaatggaccgcctactacgaggagattgtgtatgtccttggaggagatcgactacatgatcaggaaactccctgagtgggctgctgacgagcctgtgggagaagacccccc

SEQ ID NO: 1416 - DNA, 600 bp, Bovine  MMBT16667
tacaacactctttaatgtcaatatccactttttcagtttttgtgaagtttggcctaattttttttttttctttcagtggtgggcttttaagtaatttctctggaattgtattttcaaatatttaggaattcattacatttcaaaacttataaaaataagaaaagcattaatagatcattgctttgggtggtgtgaagctgccactggaaagaggagcaggtgggaagcagtaggcaatttgtagctgggaaggcttcctgtaggtggctcccatggtccacactgacagacggacactcraggctgagatgcagaggtccagatgttagctcgtgacygmtgttgctattatgtattgatacatatttatctggaagaacaaacttactcccaataccgcagcaaagtagaatattaaaatttcctttttccagtgcaactttaagttcaatttcaactttgcacaccatgagctatctcagcacagacccaggcatccctccagacccgyactgaacatggcagtggggaaaatttgccccaaccccagtgagagcccaagacacacggaagccaactccagcctgaaactgcttgtaa

SEQ ID NO: 1417 - DNA, 600 bp, Bovine  MMBT17943
tctgtgaccttatggatggtagcccaccagtctcctctgtccctgggattatccaggcaagaatactggaktgggtagtcctttcctcctccagggaatcttcccaacctagggattgaarccaagtgtcctgcattgcaagcggatgctttaccttctgagctactagggaagcgctctcctcttcccaagtcataattcagggacaaagaaggactcatttcagtcatgctttcatctgacttagtctcccggcccagggaggggaaggacccgatgtagaattaaacatgtgcagarmccagaccagctctttaaaatgctttagacaaaagcccaaacagaacagaaaccgtctaatccttgagcttatcctctcccactggccttgtcctctttcgaggagagagtcatttataaaattcagttcaatgaggtttccagctaattgaggctttcctgaatatcctatttggtgcattgattaagcacctctctgtgctttgtgccatggagggctgggaggtaaaatagcgaacaagacgaggcctgtgccctccaggtgctgacaactccagcggggagggagacagacacaca

SEQ ID NO: 1418 - DNA, 600 bp, Bovine  MMBT17314
tattttaagagaagcccccagtscatatcagaacagcagaggtgtctaytccacattaragtccttttcccttcggcgtcttcttggctccctgacagttgtgaacccttttttgtatagtgtctgtccctggtggcttctgggcagtcctcagctgctctgttactgcccagggcagcagcaagcayagaaatagcgttttcaaaggaagagaagaraaaaataggataaatcgcaggtacagaaaagcaagcctgaatgctgagggctgttacaaaggtccacctgttgactaagccrtgtccagggaggcaggggttggggtgtcctccactttttcttttcctctgactccatggactccatttccccttttcactctgcttttctgtctgggttttcttagcgagttggtaaagtactttatttatttatttattttttggccacgcagcatgcagaatcttccggatcagggatcaaacctggtcttaaccactggaccactagggaaggtcctgggagagcactatagttcctataattctgtctcactgagccctcaggacagtggtgtgcagatagatgtttaacaacaga

SEQ ID NO: 1419 - DNA, 598 bp, Bovine  MMBT16835
  misc_feature (1)..(173): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatgggtgtaaaatgaaaaactggaacagggcaggttttttcctccacctcaacccccarcacctctcatttatcagcaggatgatcactattctccttctaggtaccactcatggggagcatcragaccttacagaaacttgcagaatgaacaattgttggcatctccttgggaagaagagaaaaaagccaaagctttgatagattttaaactgtagccctcctgggatgccccaaatggctcataaatacagctagtagaatattgcctatgtgtattttccacttacactcacctttgagttctgctctggccccttgagaatcaatacacacaataacagaattgctgatgtattaatcttttctgctgatctaagcactttttttttttttcctaccaaagtgggaatacggctgggg

SEQ ID NO: 1420 - DNA, 571 bp, Bovine  MMBT14349
cagcatcacatctccaaaattagaaggcacactaaccctcagcctctaaaacagatactcaaacacatttatgtctctgggacttagtacatagggtaatacagaggtaatacaatgtgcaacccacattgtagttgtcatcaaatatctaaggagagacttagtgacagcaaaaggaaagaaaatagacagagaatacatgggaaaagagagtatcttcctggtttcatcctcagcagtatgtggtctctctgtgccagtagtcttgactctatgacctgtgaactttaattgggaagrtactacgcaagtggttgattgtaccatcatgagtcccaacgccacatctgtggaagtccatggcctggctgttagtgctaatggagattctcttagaaacccaatgagaacacattggttttgactgggtgcttctctccaaaactttgcatatttttcaacatttccaaagttgactttccctaatgccttaataatggaagatacaaggcccattccattactcatttttttgctgaaataaggttcacccttatctgcatatgagttt

SEQ ID NO: 1421 - DNA, 600 bp, Bovine  MMBT18245
cctctagcactgggttgtagcaacaattaaacgtgaatagtgagaaccgcgcctgacacatggctttgacgctgagcccttaacaaatgtcacttgatcctcacaacaaccccatgagcagacactgttactatccccattttacagatgtggaaactgaggctcagagaggtgaggtcactcgtctgaggctgcgcggataataagggggcggggaagaagccccatgtctacccacggtccataccttgctgatggcaatgcaggtagacaatctcctccaggcggatggtcatggcrtagtcccagtagacactggaaggggcgggagggtcaggcttgcaggatgcctgtcccactcgtcatggcgaagccccacccacaggctccttcaccctcctcaccaggaccacctaacccccaacttccttgtcccgacttcccagactctatctccccttcttctgggtccagtatcccagttttccagctttccctacacacacatgtctttaacctcagtccatgtggctgaggctgacctctcctaccctcccccttcaggactccaggaatgggcacctgaccctggcttggctg

SEQ ID NO: 1422 - DNA, 600 bp, Bovine  MMBT18227
ataaaacatctaagtcctgcgtgcctgggggctcactgtaatgtttgtaataagtagaatgaatgctgctgcttgttggaactcaggcctttgagcccagggtccttggcatcctctacgtctgaaagtgttcttgaacttcagtactgtttcacttgcaccaacagaacttgtctgggaaaatatctaataagccatggtaagaaacatctcactacagctgtaccgcctgccttctctcggccccaagttatccgatcttgctcttgtcagtgaggygtgtcgatgaagtcaaacccragtgtgtgctttgctttcgagccccaactgakgacagccgtgcccagttgatttaatgagctgggggcagataaaggcgaggatttgcaatgttcgaagtgtcttcccaggtgagaagacaaagattgctgacatgcctctttctcacagcccgggtgcccaacccgggcctggaagcacatcaaaggccacacttmccttctttttatgctctgggtctgatctctccctctctgattgcatgcctgcgctcctcacgagttgaacaatggaggtattatgctcttgggagaagaagga

SEQ ID NO: 1423 - DNA, 600 bp, Bovine  MMBT17536
gtggtgtttttgctttggttccgtctcttcattctttctggaattgtttcttcattgatccccagtagtatatggggcacctatcgacctggagagtttgtcattcagtatcctatctttttgccttttcatactgttcatggggttctcagggcaagaatactgaagtggtttgccattcccttctcaagtggaccatattttgtcatgcctagttgtagatgattagggtttcatgcctgggaaataaaataaggacctcgtaaccagatactggtgtatggggatggttttcaggartaaagcagaattgaggcaggtaataggtgtcaaaatgggcagcttagcctttaatgcctagtgtttctggtttgaggaggagtaggaaggtagaaatgtttcatgtttctccttaaagtctgaacagggcagagcctaggagctggatatgaaggtggtagttatgtgactccagctttggagagacaagggatgtagtggctaggacaccgggagagcttgatacctagagggaggcatgcactatttatagaaggaacactctgcatatgaatcgtttctgtcttttctttttcagct

SEQ ID NO: 1424 - DNA, 600 bp, Bovine  MMBT15928
ttaccagctacctgaacaaattgaagttctgttagcaagtacaaaggagaggggagtggctgttaggcaactgtcagtatctaccaataaactcaacaaagactagtttagagaaacaagtagcctgctccaattttgatgtggaagacctgagaccaagagatttccagagcgagccattttctcagtgcccacacagttgcacctaagggtcctcrtctctcatttgaaaggtcaggtggattatatgggccctctcagtttggctttttctcagcataaaggaagagtctggtggcrtgtgggccctctcaatttggctttttcttagctgaaaggaagactctggtggagtatggtaaggtctcattctgttactgccatgcaagtagtttctccctgtggctctacttcaaggcttgaggtgggagtgaatggtcggcctgtttctccatggcggaaatcattcctgcctttggatctttgattttcttatatggtttctgaagtagttctgaaattgaattcacttccagaggaaaaatatccagaagaagaaatttccaaaagtaagttatacaaagcactattaattacttg

SEQ ID NO: 1425 - DNA, 600 bp, Bovine  MMBT15369
ctttgggaggcaaaccacaggtttgtggaaagttcactaacaattcctaggtatcaaaattaactgccaatcaagtggtacaggaattacaaaaacaaatagcagaaacaaagaacacttcacaaaggaattatgtcccctcaagtgggggacatcttcagacaaaggcgaggaggccaagatgtgcatggcatgattggacagtggggagtaaagcccagacacgacacacacacaccccctcagcaccttgtattcgactcctctcttcacaggcccgggatgcrgggagctgagccrcacacacaggaactctgggggccaggctgcagaagaggctctctaaacctgagtgggaatcactgacactcaagcccccaacccaaacatcatctccagcttcgtgtttgctctaaacaactatttaagcaagctgtcatccacagaagctgcacgtgtgaacccagttcgagatccaacaagcattttgaaagaccccaaatcacactggttaaaattccaaaactgtaaggaytgtgggattatcttgggtaatcttacattctccaacccctcatctctcctctttttaaaatgaaa

SEQ ID NO: 1426 - DNA, 598 bp, Bovine  MMBT15387
  misc_feature (1)..(41): n is any nucleotide
nnnnnnnnnnnnnnnnnnnnnnnnnnnnnnnnnnnnnnnnnggttgttttcttctttgaaccagggtacctgaaagattcttctacagatgaagaaactgtgactcaacacactgtgatttactcaaggccgcattactaagagcaaatggtcacaggattagaatcaagatcttttacacttctaattcagagaaattttccttatgcccttccatctagtagctgtcacattgcacacttttccatatactacatgaaatcctgaaaggcaagaggatgggctatgggtgtctttggraaactccttaccaatactttttctgagtagagctgactgcaggtttttggggagtgtttagattaacaggcctgaggacccaggctgaggccaccagtcccgttagctgttgagtttttcagagtgacaycctggcttcgtttcctaaatgcatgcaacttgaggtattattattgtttaaaattaattgacaaaagaacacacttctgatcatctgcattgcctgggggagaataatagagcagagatttctactccctattcctttggattgcactaaatggagcatgcattcaaa

SEQ ID NO: 1427 - DNA, 598 bp, Bovine  MMBT16540
  misc_feature (1)..(130): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttcagtcttcaggagtctacttgcttcctccagtaacctcaacaattctcaaaggtaaaacacactgtcaattctgtgtgactgattcaaaaactatttcagacctgtattacttagtaagaaaaatcaaaataacagcaagcattgtattttaactaagtattccrtaagcaactgccctatgcccagcactgtgctaaaaagtgartgctctctcattcaggacacgaacaaacctaggtaagcagggttatttccttttgacagatgaggaagttgcaatgcagttgggtcaagaaacaataagacttaaccrtagagtcataatcctgactttcttacttcagcccagttcttcttccatttttgccctctttttcatgaccctggggttgaaacattattagttatacgtgagggcttcggaaccatagcaatctggtagatttacacacctagccaagt

SEQ ID NO: 1428 - DNA, 600 bp, Bovine  MMBT15771
cgttgggcagctccttcccgtatcctgtgtttgatgttttctttttcatgaggagagaactgcgggaagaagtgttgtaagaaatctgaacagggacatccctggcggtcccggggttaagactccacacttccactgcagggagcatgggtttgatcactggttggggaactaagatccctcgtgccataaggtgtggccaaaaaaaagaaaatctgaacaaagcagagattgcatttttagcagttagatatacattaactatccccattaaatatgtcatttctttcattgtgaacractgcattattaccagatgaaaggggccacctcctgttttcttaaatcagcctgtaggttgcgactaaggggtcagttagttggttcgggatacctgagcctcacctctgctcccgtcctcggcaggttcacctctgtctagtcagcctgtcttaatcgcygtgcagcgaccactgccaccgacgatcaagcctgtcacctacactgtcgccgcccctgtgacgacctcgacttcccagcagcccgtggtgcagacggttcacgtcgtccaccagatcccagcggtgtccgtcaccagcg

SEQ ID NO: 1429 - DNA, 600 bp, Bovine  MMBT17247
aagttgtgttgctgctgcaaagtcacacattaccttaagctttcatgtcactgctctcatatcaggctgctttctcaaggggagaaggcagaagagaaaagattttttgatacctatcatgttttaggtagtaagctttatattgaaatttaatgcctgtaataaatgtacctgtgttgtcagataaggaaattgagattccaaggttaagacacatgccaaattcatcattctctggggtcacacacctagggaagactcaaactggaattcaatgcaagtaaggatgactattccacrctatcacctgtataatttttttaaaacaaagaaaatattrgaagagcctggaatttctaaagtattaacacatagaaatattgatcaggcagtacacatgatatgaaaacatcacataaaactgccatttctgttaggatgctcacttagactgctggtagagaccaaatgatacaagctttccccccctaaaaaaagagagagagaaagggagacttgcactaagtaagaaaaaaaatctagcaggaggtttgctgactaatattcttcatcttcaaccaaattctggcccatcagccc

SEQ ID NO: 1430 - DNA, 600 bp, Bovine  MMBT17963
gatatgggagagagagggaaaaaacacagtcatttgaataaaaaagtcatatcttttatgtactttatgctatattctgtgtacttgggaaatggctgcatctgtccagagaatggtggaaaattgaatactatgcttcatagtgtgcttcttgtagtgtttccttaaccaaagaggagcagctgttgggtagcagagaaagcactgttaccagcctgagcatatggaactccgaagctttggctgatacggatgtctgggcaacggttgcagaaagactgtcataattgtttgctgtgrttttaggtccacactccaatgttggaagggaaaactttttatagaggcttactttttttttttatatggctttgaagggaattgtattttacttctgacgcttattgtattgtaaaatctctagtctctgatacttaaaggtggaaacttttaactttcttaaaaatccaactctagggactttttagtagtatagcctctcaaataatcttaaagctttgaaaaatgaaatactttcttttatgaagcagttttgggggtcagttttttcccctaaaatgtatgcttttatgttgggta

SEQ ID NO: 1431 - DNA, 600 bp, Bovine  MMBT11464
tggatcaaagggacaggttatacactttaaacttacacaatgttgcatstcaaatgtattcaatttttttaaaaatagcaacaacccataaaataaatgggtaaagcttctatctttggttttctttgaaagtttaatttgccatgcatccaaatatgggttctgttgyactctttggagaaaattgatggaccctctgtcctggaaggagcacaggttggtggttaaggagaggcccattcatttccctccatgacaggaggccaaccacaatggtagctgcaaccatgcttgctcctrttgctatgaacatttgggacactaaaataaattgactgcacaaaaagattctttactttccccaccacatcatcttaatggggaattcataccactttgagctgcatttactgccggaatggaataatggcttctaaaattactttagcacataatgaattgtayctaagtttactgggttatcggacaacattttggttctagtgaaggccattttccagaaggccttggactctgaatcaattattcattcattgaattcagagatgtgaatctttcctttagcttgaaatctccatc

SEQ ID NO: 1432 - DNA, 600 bp, Bovine  MMBT16734
ccctggctttcctggtgaaaaacaacatgctcacattgagtgctccttgtgggacactgaaatgccagccccaggtaaaggtaggaaggggcgaagctggtgtaactttctgtaaggccccaggttgaaaaacaaaacaagtaagccaaaaccaaaaaaaaaaagcctgtctctaagatgggcaaatgttaagaaaatgtttgagtttctttttaatacaggtcgtaataaaagctaagatttattgaagagttaacacgttccttgcactgttctgcacatttcctgtgatttagtacrttcaaacccatctctgtttcactgatgaagggagaagctgaaggagagaggaataaaagggagtgctgtcaaaccgcacagaaagcagtggagtcaggatgcagactccagtgatctgacaccagagcctgcccacttgattacggctccaccctgcgggagcccgtactgaagtaaagtatgaagtgctgctttcacagtttccgccagcacagcagtgacattgaaagcttcttggcccttattcctctatcaaaacacatcattcaaagtgatttgacggcatttgtctgaggatat

SEQ ID NO: 1433 - DNA, 600 bp, Bovine  MMBT16440
ctgataaaacttttatctacccttaagttttactgcttagttttctccatcaaaattccattctcactgtaagcataccataatacaaattatctgacttctgtgatgctaattgccattctggaacaattactcaatcttttagacttttcctgcttgcattccatgaccctgttcattaagacatatgggtatttgattttgatctggaactttcaattatggtaataatgccagttctgtttttatatctgtaaatcatttttagttctcaactctatttggaagcatgctcctctrcctgcctgtaaacacttgaccctattcccaaatcagacccctggttatatactcactcctgttttagtccatctgccaactgtcataaaaccctgagctttatattcaarcagatctggcatagggtttcctaatgtttactaattcaagaggctttttccaagtgaagagacaacgattttgtgaaagataaaggatgggtagaaaactaggcaagtaattggcttatatatctttgtttcagtatgtgcttactgaaaaggactgcttacccatttacagaataataggccatagatt

SEQ ID NO: 1434 - DNA, 598 bp, Bovine  MMBT16430
  misc_feature (1)..(86): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnntaatacttccttaagttagggctacctttcaaactttccccatttattaaaaattctttaaggccattactatgattccatagtattttgagggggaaaagaaagcccaggtttttttcagatcaataatacaggagaggtccagatccctgacttggctctgattaagtgaacaaggtgcttgttttctcgcaaataaaaatgtggtctttgratacaattctttcttcagtcccaggaatatggcttcagtctcctattgaaaatctaaagtgttccagtcagaacaacagtagacttttctcttccttgagtttggacaatgattgttctccttccagaaacagagagagaaaagggaacttggaaattcagccaggtgttagccaacctccttggggggttctcttctgccaggtcctgaaatcccaggcctggaacaggccccactgactttttccaaagtttggcctttattagagaggttgaggccagggatttttccatgcaca

SEQ ID NO: 1435 - DNA, 600 bp, Bovine  MMBT15154
gacacgactgagcgacttcactttcacttttctctttcatgcattggagaaggaaatggcaacccactccagtattcttgcctggagaatcccagggatggtggagcctagtgggctgctgtctatggggtcgcacagagtcggacacgactgaagcgacttagcatagcatagcataaggactcaaatgaaggcaacttcctcttcactaagggacagtttggggtaaagaaaaccctgccatgtatcccagcatgtgtcctcacaacttgatrgttgagtcaattaacataatttgargtgatttttttcaagccttcattactgttgtattttaaattgaacactgtcttccccaacacacttaggggaaaaaagtatgttctatctccccttccaaatgttcaaaagcaagtaagacagtagtcaaaggccttgtaagagatacagaaaaggaaaagaagaggattctcggtttccccagaaatattctcattactttttactaagtttatgaagcctaaggtcctgtcctttagatgtttcttaacttgaagaatcatagagcatgaatgctactttacatcatttggtccaagg

SEQ ID NO: 1436 - DNA, 600 bp, Bovine  MMBT16816
ggttcagcaaatgactgaaatgagcaaatcagagtctttcttaggatttttgtaactataactggagaaagagacctagttcctctgtgattacaaagctggaacacgtgatgaacacgagtaagtggtcatgctttcagttgtgtggctcaagccgctataacggaatggatcagaaccattttctagaagggtaaatggcatctagcttaatttaagcaatcaaacaaccgattattgggaccttcctacatgcctaagagaagacacagaccacagctgccagcaatccagttaggragacaaaattaagatatatgaaagaaaagaaaagatatggcatacaattaaatgctaattggtatgggtcatatagtcattgctatgaaaattctaaagaggaagaaagcgcttcaagctgaatcaggagggctgagggataccatttggctttggaaggatgcgtatatttgatgaaatcaacgagagggaaaagagtctttgcgttgagggaagcaaaggcaagaaggcagaaatagaatagtgtgtggggctkgtgagagggctctgggaacgtggtgtatgagggtttggggacat

SEQ ID NO: 1437 - DNA, 600 bp, Bovine  MMBT15307
ccgagcgccataccttcccttccttgggcctcagttttaactttgttattactatttaaaccctgcctactttccaagagaggttttatattttctaattacttcctttattgaatggatactatcgtgacagttacaacagaagtaaagaaagtcacaggagagtcctactacctaaaaactttttttcttggggcctagtttggaccttatgtatctattatatctcttaagggggaaaataaataaatatatgaatgacattaaataagttgaatgcaatcaaatagccaaatgtarctggtgtacagtccaggatgagagcactgatgttaggggtcgggcagatctgcttttgagtctctacccagactcatctctgagctgtaattttctttttcctcttctgaaaayggggagtaatgcctcatggggttgttgtgaaaattaagtgaaataatgaaggtaaagcacttggcaaaatgcctgacaagtagtaactcttccgaaagtggtagctattatcttcatactagaaataagaaaatatattagccaatggaatcagtagatgtactgtaattgartgcccaatttagt

SEQ ID NO: 1438 - DNA, 600 bp, Bovine  MMBT16817
tatgagagaaagaaaggtttcctccttctacatcatctgtgtgactgaatttcccccaggtggagtggggtgaggaggctagaaatattatgagagttacagaataaattttttttttttaggagaggagcatgttatctgaatattgtgctaggttctagccttctggcactgcagcccccttgactacttagaaaagggccaacagtatcttcaagctcctgggaatgtgcctgggcggggcctggctaggctgggtgttccagtgtgtactctcccctaacctatcactagaagacrtagactaaggcatctcacactgccaggaatgtttatttctccagaatcacagaatttaagaggctraaaacaccctgaagaccaagtcactatttttaatatttatttttaagctacagaaccctttgtgttatatayataaacataacaagctgaaaaaatattgtcttgacatttgacatcttaatacctcttagggaggaaactatcattgtttggaaaataccttggtaaatgacttggctgtgacatcagcatgatacgacatacttgggatatgacatcagcaggagccaagac

SEQ ID NO: 1439 - DNA, 600 bp, Bovine  MMBT13605
atatgactgggcttttttcagagccagtcagtctggtttaatcattttgtgctgccgaatacacaccatagactataaacataggtttagattcttacctgtaaggtttccaataaggtacatagataatttttagttaaaaaccgtgtggcctcagatactcatttattcagcaaatatttattaagaaatgagtatgtcattcaatatgcaatattaattttctttcatttttaacatggaagacagctctaccctaattttttttaaatgtcaggaacacggttacttatccaagtrtaaattctacactgcagtaaagctgatgatctcatattaaatagatttaagcaatcttttcttaagtaagcagtcttttcctgatgtattcctgtttgacaaatatagcacatatgctaatttactttagcaacctgacaaaccaagaaaactggtttgatcaatttttwaaatattccactagttctttgtgaactgccatgccaaagggaaataacaagaactgtcttattaaagtaacaccaaggtgatatattaacatgtttaagcaaataaaaatgccctttccttggttcaact

SEQ ID NO: 1440 - DNA, 600 bp, Bovine  MMBT14552
accaactcgatggacgtgagtctgagtgaactccaggagttggtgatagacagggaggcctggcgttctgcaattcatggggtcacaaagagtcggacacgactgagcgactgaactgaactgactaatatagtatatgcagtaacatattttacttgcagttagtagtaaggcatttatagtgtttctaccagaaaagatggatttcttgctttcttttgtctcttcattgtagtcgccttcgtttctctcactgcttgccagcagttgaattatgagaactagtggatggtgctgttratgagaccatatgttcgttattaaatgttagatcctcttcatgttccctgttgttgtcctaaaaaaagtatgtgattgtgtttttcattccatagcctcttttgctttcttgttagtcttttctcctttactcttgttctttagttttaaawtttattrtatamtgttaatagtgctaattttagttaagagtgtcctcaagtattttaaagctttttgtggatgaagaaaagattctaaatgccttgttacgttttttaacgtatattgtttctctcattagtaaactgattttaggaa

SEQ ID NO: 1441 - DNA, 600 bp, Bovine  MMBT11731
ataaaactataatagaaaagatactttgtatgatatcaatcttttaatctattgagacttaatctgtgagccaacataaaaagtccactttccatatgcccctccaggcataaagatggtgatagctcccccaacatacttcaccatcccttactggttcttttaatcctgcccacacctttgtaaatagtttccttattaaattctattcaggtctcctttgggtgtgccaactggttttctgccagaactctgactgcttcatcactgttcatgttctccctttactgtatttattcrtttcaagaattttattctcattttagcagagtttctagaggcaacagaaataagtgccatatgttcaatctgctgtatttagctgttaaatattctttttttccaatatcttttcctatgcagaagtatctgactcttgctttctttgatataacatactgattatctccagtgcccaaagcaaagactggaggcttgatctacaaactgaaaagacaggttccaattcagggacaagcacagaggtaggcaaagcagaagcatcatactgtaaagaatgacaaagtccatatggtgcag

SEQ ID NO: 1442 - DNA, 600 bp, Bovine  MMBT17186
atatatccgttctcccgcatacttccctcccatccaggctgccacataacattgcctgtgactgtttattgaaagaactcttggcttagggtgtttgtgtgagggtgtgtgtagtcagtttacaaagtgccaaggcaaggaatatcttctccttcctttggattcctttaatacctagaatatgtcatgtaggctaaaatataccaccttgtttaccattcaaatgtctattcaatttttgaactaaaaaaaaattttttttgtagattttgagtctttttctttgtcctttgtgttttraagttataacttgtagctctggtggccccagtgggaattctcttggatttggattcagagtaatcttccacctcatctacagactccctggcagtgggatcataggtcagctgttctgttggtcagtaacatgggtagtacctgcctggcagggtgataggggccattagatgagatcatatgtataaagaaccaagtgcagccccacacccgagaggagctttaaaaatggtacagatcagaagtagcagcagaaagtagtgagggggtataaaagtacatttatacgaaaggaagaag

SEQ ID NO: 1443 - DNA, 600 bp, Bovine  MMBT14347
ttagagggaaatccaaacacagaagcaagcggtctcttcaattaggtaatagtttctaggattcaggaggcaaggaagaggagtataaaatctcaagttgctgtcttcaccccaaaccttctagatcctcagaagacggactagtggtcaaaacatactgatatttggcatcagaactgtttttataaagtgagacactcataaataggggaagaagacttaaagtacaatgctgaaggyaaggaatagaatctacagattgggtagagcacttgggttgagcactttcagatttaacartatttgtttactataaatccttttctaatttcttgggcaaacctgatctatctgtacctttgctgtcacctgcatgtacaggactgggcaatcataccctcatactccttgtacaagatactcccatttgcctcaatcagaaggatgctaatgggaacatacttataagggacacaggaaggctgagggacactctgatccaccagctcattgacaaggttctggatgatggcatgattgggagaattgagaccatagtgtagtacccgaggacatactcccttacagtagtttgggggt

SEQ ID NO: 1444 - DNA, 600 bp, Bovine  MMBT16413
tactaaagagacttggtagattaactatgttagagtgaaaggcaccaagaatttgtagttgctatgacatctccttgctgtataactttgagtcatcacttaacttctctggatatcaattacctcacctgtaagaacaaggtgttagaaaagacagtgaccaatctctctcaggtgacagggcaccctgaagcctcctgcagggtcagtggagctcttagtcygagcaggggttaaacagaccaggccacacacaagggctccttaagttgaacrctcctctttgatttatttacaacrttaaagagaattgtgtctggagaaagggctccaatgataaaagtctggacaagatgtctccaagggccattgtgactctgctgttctgtacaaacagctattaaaaggagaattacaccagaacaggatcacttgtgaagtaaggttgataacacagtcagacccatagttacagagcaattagtagcagctctgtctgaaagacttacagcaaagcatggtctcccattgatttctgtagctattagaactagctctctaaagtaccatgtctggcaatcacgattagagctgaataac

SEQ ID NO: 1445 - DNA, 600 bp, Bovine  MMBT12438
gagggcaggaagagaaggggatgaaggaggatgagatggctggatggcatcactgactcgatggacgtgagtctgagtgaactccgggagttggtaatggacagggaggcctggcgtgctgcgattcatggggtcgcaaagagtcggacacgaccgagcaactgaactgaacagaactgaacccttgattaagtaaaaacctgtgtttcacagagtattttatgtttgtttgaaaataatttttaacaagatgcatagccataaaacattcacatttcaggtatacattaytggtttctrgagtgaaattaggatggcagcctttaaaaaaaattcatatcctgattgtagcagagattctttcttttaattaagaagctcaccagacacttgcaaaaaccatcccctaactaggtcccttgtgtctcagaattgcttgtactatgaatgaggggaatcgcttaatacaagcttattagacaaccgagcggcttggaggttccccactagacctttcaataaggcttaatcaaccaagtaagaccctgatgaggctggcaattagacttactgtatttttaaacggagttgctgagtttt

SEQ ID NO: 1446 - DNA, 600 bp, Bovine  MMBT16788
atgaggtagagtctatatccatcttttctatggatgagggaacaagttgcctgaaaattatcttgcctgtgtgtgtgtcatagaagactggggctaaaaggactttagaaatcatttgacttgatgcttcactttacagatgaggaaagtgagttcagagaggttaagtcctatgcccataatcacatagcctggaagtggcagagctgatacccgatacaagattccttccatgttggaactatactatctaccatttggggttaatacacatcaccttggcctctctgtgagtctgargcccagtcttttgtgatttgagaatttgtgccatctccaagtgtgctgtcatcatgcaaccaaatatgattcaaaacaaggctgggggcgggtgggggtggggggcgttttgttctctctgtgcatcagattgatgatgaagtcaaacttcatgactcagaatacgcagaagctctccagcccttaacaactttccccacaggaaaactgccaggtgcttggttaccttttgagttctttgtgggtggcagagaacgcctctaaaaaatagattcgtcctcaactctcccagaagaggct

SEQ ID NO: 1447 - DNA, 598 bp, Bovine  MMBT18285
  misc_feature (1)..(36): n is any nucleotide
nnnnnnnnnnnnnnnnnnnnnnnnnnnnnnnnnnnnatagcttaaagatggaagcaatcttagtgacctcaatggatgaacagataaaaaacaatatactaagtgaaataaaccagttacaaaaggacaaaatactatatgattccactgatataaggtgcctaaaggagtcaaactcacagaaacaaagtagaatgatggttgcctaggaggaggggacaatgaggagctactgtttaatgggtccagagtttcaacttgagaggatgaagacattcaagtgaatagtgatgatggttrcacattcttaatgccactgcagtgtatacctaaaaatagttagagtggtaaataatgttatatatattttaccacatgaaaaaattaaaaagcagataatgactctttcatctatatcttagctactatagtaccatrccaagtagttgatgcttagacatagtccagagaaatcttggtttaatacattcaggttcaaatgtaaaatagtgaagctataaaaagcacacaaaacacttggcatcatcacaatgctatttgagaaaatcatttacttagttatcaagccccaatgcat

SEQ ID NO: 1448 - DNA, 600 bp, Bovine  MMBT13717
acaggaaggagtcgacataggctaatattaacttaaaagagagtcaagaaagttaaatgagtttgtgatgatgaaataatacatggaagcaatattgtaataaacattttcaagattagctaatagaaagattaatagggaaagggaaatgaaaataaaaagtgtcatcttaacactacragaataattatacagtcattattgcagccaaattcccactggtttcagtgggggctttggagagaactagaagacatatgcttcagtagcgtacctagaattgcaaagtttatttaaggrataaatgtagaaaaatctaggaggtaataattgatagattttwaaaaaaatacgccatgcctgtattttttagaaagcaaccttttaaaagaactgatacagagatcttatttcacaattggcatgtttaagctgagtacatttgtatgtatcmctaacttttatcaattcatcaggagtctgggtctctcagcacaattcctccatccatctttgctgtgaaactggaaatggatttgtttaaattattgggcttttaatttgccacattttgtctcctgtctgagaagcctgtttatt

SEQ ID NO: 1449 - DNA, 600 bp, Bovine  MMBT16791
cgggctacagtccatggggttgctaagagtcagacacgactgagactgagtgacttcactttcacttttcacttttctgcattggagaaggaaatggcaacccactccagtgttcttgcctggagaatcccagggacgggggagcctgatgggctgccatctatggggtcgcacagagtcggacacgactgaagtgacttagcagcagcagcagcatacagaggaactgaaatcaggatcttgaaragatatttgccctctcatgtacattgcagcattatacaaaataggcagracatraatgcaacttaatgtccactgacagatgaatggatttttagaaagtgcacaccctggaatattattcagtcataaaaaaattgtaatatactacaaaacgagtgaactttaaagacattatgttaagtgaaataaggacagagagaacaaatattgcatgatttcactaatataaagtatctaaagtagctaaactcatagaagcagaaaataaaacactggttgccatgtactgagtgggaaaagtggagagaagctctgcaatgtgcatcaagtttcagtcatgggggatgtaaatgt

SEQ ID NO: 1450 - DNA, 600 bp, Bovine  MMBT13721
tttccttgaaagacacaattttgcaagaactaattcttagaatgatgttccaatgaatcactggactcataatagcatttttctctgaaaatcttttgccaacatcaagactatgagccaggatataaaaaagtgagtcttaatgttaagggacatttatagtcaagaaagagagtttgattattgaaatgcattatgatgcttcaccctgaaatcattgaattaaagtttcatttatttggaaaatctatataattgtcctcactttctatctgaatattaccactgtgtagaataccrttttaggtcatactgaataaatggtcacacggcataaaaatgctgttctcgcccatgttgtctgggtgagaatgcactgaacccgtttgaagagatttgattgtccctataggggaggagccatctcccttggttatatgttgtcaggaactggccagggaccaagatgaagctcagtcaagggtgatgttagtcccccacatgcatcatctatccctttgactctaagactgagattttaataaccaaacatttccatcaacttctaaattgtttcttaactgggattcttgtcttctg

SEQ ID NO: 1451 - DNA, 600 bp, Bovine  MMBT16537
tctctctgcctctatccttctgactctgtctctctcattctccttcctgccttccttttcttcttggaatgccagtcagttccttttgcagaatcaaccttggaattagtgtactgaaacccttaggcaccctcttctcagcctagattttacatgctatccagagacaaattctccagcagattaaagctgtctgaagccttcttgagttttatgcctcagttattcagagcttgggaccgctcaagttctgtattttaaaatacactttttgggagaatggcattgaaacatgtatartatcatatatgaaacgagtcaccagtccaggttcsatgcaygatactggatgcttggggctrgtgcactgggacgacccagagggatggtacggggagggaggagggaagagggttcagaatggggaacacgtgtatacctgtggcggattcatgtttatatatggcaaaaccgatacaatattgtgaagttaaaaaataaaaaaaaaacttttctgtgctaatttagataattagaagatacaaaaagtttgcatttaatttatgaatgagaaatctagttcagtaatcaaacagaaca

SEQ ID NO: 1452 - DNA, 600 bp, Bovine  MMBT18294
agtttactaaattagggaggggttaagttcttcaaaatgtacatgggcagtattttttttaacctacagacagaatgggattccttttcaataagagcctgatttggtaattcctagtaaaactgaagcttctgaaaagcagtttaagaataaatatagtgtagtgcataatcacaatcacctgtgaggccaaggtttcctgtttagaaactaaagtgtgggcaaaggtggcctttgtatttcaaggggcaaagtcaaaaattcacagctgccaacaatatgcattaggattagctgctrctggccagagctcaaaatcgatcaaaaactgggagtaaacaagcatctggcaataatgatcaggtactaacacacagttgagacaaatgaaattagctggtctcccactcatgattcacacagtaattaagttcagtcacaccataattagataactgtcatggttgtgttggtcacaggaaacaggcaagagacaagcacgtcttcaacaaaagggtattttatgactacaaaacttactttggtttggttttaccacaaattatgccatataaagtataagaactttaatgacgtaaa

SEQ ID NO: 1453 - DNA, 600 bp, Bovine  MMBT17352
aggctcaggattttaaaaagatagacaaattaacagcaaatgtagcaaataaaatactatgtaaggatttgtgttgatgatgagctcagtacaagtctacaataggctgccatgtaaaagctatctcagactaaataatgcattaaagtgggtggactctactgcatgcccatcaaatcatactttagtactatgttcatatcacactttatgactttgtcaatcatgagtagactccaagcaattcctcatgtatggaagatcaagcaagttcaagaaaacattaagctcagggrgacrtgagaactacctgaaaaataactgaaggggaacaatccaagaagggtcaagattttgattaataacaaagagctttccactgattagagttatcaaaattggaagaacagcattgcttactgtagcttaytggtacatttgaattgtggtgctggagaagactcttgagagtcccttggagatcaaaccagtccatcctaaaggaaatcgaccttgaatattcattggaaggattgatgctgaagctgaagctccaatacttggccatctgatgtgaagagcacactcattggaaaagac

SEQ ID NO: 1454 - DNA, 600 bp, Bovine  MMBT16668
accctcctccacggctgtggctgtctccgtccccaactatggcatccccctccacggctgtggctgcccccgtccccaactaaaggaccccctgcatggctggtccttcaggagcgtgggatggactctgattccattttggtaaaattaaatctatgtaaaactctattctagcatcttaaatgcaaatatttccaaacttgaccaagatgttattttaagggcgtagttgacccctcaccatttcaaactatctgtaggcattcggttgccaaatagaaatcacaaagtcacattacrttccagtttgatggccttttgcttaaaaatgtatatagttgatcacttataaaacttaaaaatactaacttaaaaacaacattgggagaatgtgattatgcaaattacactgttaacaaaatttacacataaatgagaacatttttttcccatcatagtttttattaaaacaaaaccctgggaagtaaattatttgcgggagaatacagtataaaaatgtattaaaagctctaagaaccaaattgaaatgtcaaatatagttatttatattaaaacccaacaaaatagrtgatgggcctt

SEQ ID NO: 1455 - DNA, 600 bp, Bovine  MMBT12549
gtttcactatatagaattcatctctctctctgtctctctctgcctctgtctctctcacacacacacaatacatgtatagataaacttttcactttttcctgaatatgttctctttatttccattttattgtattttcctgttttgtttcattcgttcaaaatacctctttattttaccctgccaactccttttttagaatctgtttcatccttacttataatccaaacaagtttttttcatgaacatttctcacttgtttccagctggatgttaatgtgagatgaatcagcgtagtgtarttgtcaagaaagcttrttggatccattctgcttaagttcatctctcactttggcatttcttacctgtaagaggtagcacaagttgcttaacctcttttccagtttccttatcagtaaaatcaggacagtaaatagtatattctataagaataaaattaaaagaacatgtaaatttcctaacatggtgactggtaggtaacaaatgccccaaagctatatttattaacttctgcaacacaaaactctctctatccaaaacactatttgtggagaaaatatttgaagcctgagactacaaaa

SEQ ID NO: 1456 - DNA, 600 bp, Bovine  MMBT16847
tatatagtcttttctatgaacatgtaatatttttatatattttttaaactatgaaacctctttaaaagaagatcatcaatggtggaaaggatgaagcaccaacatttggtcaacaaataccatccaaatgctacctctgggcatgtgtgaacagtgatggccacaaagatggtaggtcgtcgtctcccgacttgagagagcttactgcccaacagggaaaggagcacaccaacagtaaaagtacaacgggaaaacttctttcattcagtcaccaaacactttctgaaagactgtctactrtatctctggcaccgtgggaaaggctggagaaacacggtcagagttttagaaaaagatagaaaagctgttggcatggagctagtaattcaaaaagagaggtgggctatattcaaaacatcatacaagttaactgcaaacttacaactctgtgaaatgctgagagagtaaatgaaagataactaaataataaggaaacggaaaccaagagacaggactgtcgagggtgcacagagcagtcagcatagactgagacagcgtaatggtgaagccaagattcgggggacaactatgacggaagtg

SEQ ID NO: 1457 - DNA, 600 bp, Bovine  MMBT16124
caacttgccttaattataaagttacatctattcactacatgtggattatattacttttctcaatcttgtggtttttgtgttataaagagccctattggttattagtcacattgttctttagcacataatgtaatacaattactacactagcactaatttctagtgtgcaagtatcttgtgaagttgcatgttgtcacaaagtgattctaatagctttgatcatttctcttaacagttcactaagtattactctcttgggaagtgtctagagaaatatctcagatgttaaaggtacaaagrcacattaaacctgcaaattcttgatttactcagaactcagactattacaacagtcagctcatactctatacttttgcttctgacctccrtaagcatcttcaggacctttcttagcattgtctcagctcagattgtaaatgagaatgttttgcttaactaacaccgtggcttgtatgcttttgaatcaggagaggggagctgaygrtttagcatcaaggtcagcctctcactttgctagaaatggttggtgcttacattctatcatccgagaatagtaggaagctaagtgtccactctaaa

SEQ ID NO: 1458 - DNA, 600 bp, Bovine  MMBT16686
atcattaaatactttcacttaataaaatgctcattggaatgaaataaataacactattttgtggcagataatgttcattgtcaagacataatggatagaactcaaatataatgcgttgtgaacaggtttttcctgttcagaaagcaaaatagaatggaagaatatgtggaagattaaaagactgtagctattgtagcaaaattgaaagataatttaagataacactgactcatatattaaccatttcaattcttagtagtaaataaaagtaaattacaggattgaaagttgaaaactagrggaacgtttcactattttagaagagtccaagaaggagaatcttagaattaatctttgaaatgttctgtatatggttcatttgtgtgcatatgtataaaattaatcaattactctatgtaataattgttattctccctggaaaacattgtataataagctctttctttttccaaattattgccattaattcttcctattatttcaatgcattatttcacccatgtataataaacacatatagactggaaacagacatttatattaatataattcaatatttcccctattagctctttttat

SEQ ID NO: 1459 - DNA, 601 bp, Bovine  MMBT13757
  misc_feature (1)..(1): n is any nucleotide
naatgaagaagtggcactggtgattggcattctgtccctggctgccagccgcccactgggcacgcacacaggcagtgccatcgatttgtatgcagtgctaagtcattctttcgcccagctggctctgtggcagaggtgcctgaccacagccytgatagcagccaggaaggaatcctttgttgaactgttcactcaagtgcttgacttttygactctgtttgctcacagatctgctgtaaaaactatctaaagccattcctctttctaaattcttcattatgatctcttcaggctactttcrgacatttgattttccktctctaacagacaagtgtttgatgttttgcttatttgtttgtttgtttktttttggtttgtttgyttgacaggaacccaaagatgagttacatgttttaaaactaccatccttcatattgcttaaagtttctacagtttatgaaggtcagcttgatattacctaaatactggaagtaaaccaagggacggatattggaatttatacttaacctctatacaagattttcagcacatgctcatgagaaaaagtataatataagactaataaagatacatcaacaca

SEQ ID NO: 1460 - DNA, 600 bp, Bovine  MMBT11877
tttcaatggatacacatgtcgttgatatctttaatgctctgccataacaaactacccactcgttttcactgcattatgctgagcatcattttcagttggtatgtaaacaccagtgccttgtctgactcctccaactattctattttcttaataacaacagctgctgtcgctatcagcagcctgatatttgctaggcacagtattagtgctgcacatgctttctatcttaaatctttaacaaaaatcctcctcagtacatatcctcaccatcattctattaaggcaaagatgttcagtgargtcacatagcacattaagtggtggaactggcttcgggagcacaaaaccaaggctctcttccttttcagcctcaccctcagaccctaacacatgttcagcttcctctgagttcttaataaacacagtgactgaccaaacgaaacaacaggttaaagcatcattaacaaaacatcgttaatgtgactgtgagtgtaaaaacagataaatcatcacattagccactttgctctggagtcacttacacaaatacgcactcttagacctcattacctgcctgggactttaacaggcagagtctga

SEQ ID NO: 1461 - DNA, 600 bp, Bovine  MMBT17133
catggggttgcaagagttggacacgacctagcgactaaactaactacagacttaaaatattacactaaagaaaatgaaatgactgcaccttagaatcctcagcagctgatctgatcatatttttttcaggtgctgttcagacctagcagctctatactgcaggctgcatgccaccaggctcttggcatttggacagcccagaggaacaatggccctatgtaagagaaaggttgattccaaagctgacctcatcacaacctgtcctgagttaacagacaagagcaaggatgtgaagaccarctaataaaaacaaaccagagaatattgattccagcccagaaacatagtgtttaatttattaataaaaggcagctctttggaaaatcctgtcttctgttgtcaaacaagcattgggacctttctatctttccaatcattcaattagagcagagacaagagaatgacactcttggctttcaagcaagcctgagggcacagggtgaatacaggatttggatgcactattctttcagattgccagttttaatttctgattaaaaaaagaggtcctttcttctcatacattcagctatttttcac

SEQ ID NO: 1462 - DNA, 600 bp, Bovine  MMBT17148
atttgtcacctggatgctgagcagtacagctaattcatctcttttgacacagtcatttcctgcattgtatcacctcagctggcttatttctttacttgggatgaagcaaggagacatcaagccttctcctttctatgattttgcactgcaaatctgctcttatctagattccacttgacatgtgatggaggaattaaagtggattcatatagttccctctcaccccgacctggcattagtgtctaaatggccagagtactgtatcttgtgaatggagtaaatgctttctatcttgtgctrttattactccagrgcttcccattgtgtaacttgctttccaaagagatataactactgagttttcgatctctctcattgattcctattatcatcttaaatgctgtaatctttgtgcaccattggctctgagggacagtctgctgtaactgcgtgtaattttccctgtaacatttctattttaaagagtcatccagtctttaataaatattctatagccatccacaaaaagtatgtatgcaagtcactctccacctagtctgcatccatacggggaacataggatttcagcaaagtacttct

SEQ ID NO: 1463 - DNA, 600 bp, Bovine  MMBT13022
ccatggactctagccaatcttggaattccccaggcaagaatactggagggggtagccattcctttctcgaggggttcttcccgacccagggatcaaatccaggtctcctgtaacacaggcagattctctttaccatctgagccaccagggaagcccaggagagggtaggggtactgtaatgatccaggcaggagaaggcaagggcttgacttgggcaaagaccatggggatggagaggcaggaatgggtaaggaccagggtaggaagattccccactgtctcctgtaaaatggttggggraagaaagataagtaagagctatgttatacaggtaatattctcttttcaaattttccttcttggcaccagaaaaagacagaaaagcaaaaagagaaagagggggtgggattctggaaggaaagttagcccatatgttaatgtcactggggaaatggaaccagctcacaacttccttctattatgttacgtgaagatacattttcagctgaaaggaattattttaaaacacgggtgtgaaataaatgagcacatgagaccatgttgtccacaaggcctcagcagaatgttttccttagatag

SEQ ID NO: 1464 - DNA, 600 bp, Bovine  MMBT17158
tttttgtattggattgacggaatctttgttccaaaatcagagtgatgcataatataaagtctcagtaagtatgtcttttgttcttttgtatacacatgatatagttaattccttgtgtcagatttgtaaataactatgaaatatttgcttgttttgttttagtattgtataaataaaacctgcaaagaagttcctttaatgggatataattgtaatgccactataaaatgcagaggaaatggggtaagctacttttgtttttgtaattctaaattttatgttattttttgagtaattcarygtaaaaaatctatcctgtttgggagaaatgaaaatctaagttgctcttttatccaggcttgcctaggaatagctaactaatataaagaaaatcagctgattaccaatcgatcaaaacactatttagtgaactgtactatatgtgtactgaatttattgtaagcactcaaaacttatgaattggtaacacatttaaattaaaaaaaataattttctcatgcaaataaatgcatattttgcttatattgtgggcatatttcttctttctcatactcttcataattaaaatttaaagctata

SEQ ID NO: 1465 - DNA, 600 bp, Bovine  MMBT16592
atgtgagaactcatcatcaatgatgtcaaatacaatagatgggtccaataacgtgaaggttgacagcatgctgctatcggcatatgtgaccaaatgattggtacattcttctgaaagatgcagccaccatactgtgggaagatcaaaacgcagacagaaatttctcattaagtttgttaggttgaaggcaattgtataagtgtgttgtcagcactttttaaaatgctgttgactagagaaggcaaattccttggtagcaaagtagaattttactcccccacaagctatctattaagaatratctctgcattctatgttttttttcagttcacagctagtgttttccagcatagatgaaaacttacaaaaatttattacagacatgaatacgtatattgaccttaatattatttcttccaaaggaattcaccccactggatcatttatagataagatataggtgatatacatgtagatttagtgttatcaaactcttaaaattatatataacaatatataagataaatattaatgttatatattaatttattatacattactgtattattatatatagtaaaaacatacatgtatatgatt

SEQ ID NO: 1466 - DNA, 598 bp, Bovine  MMBT15862
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcactcgtctattgagtatgtcttagcattatatacatattttattgcttaaaaaatcctgctctctgacaatgcagggttgacacaaatcatcagtttgtaaaaaaacaaatcagtattagagaagcacaataaagcaaagcacaaacgagagaagaaacataaacccaagccaaracttttgcttgtagacggtggtgggaataggattgaacaattaaaaatttctggctgtacctgtttttaaagttttaactttagaaccatgtaagtgttttacacattgttaaaagaaaatgaaatcaaagtgaaaaaccarcccaaaactctctttggcatctccttcagtttccttgctgtctgtgctgacctacacatatattcagagatttggcatttttcttcctccccatcagagctgtaggtacatatacagtgcccagctacttgatggttactccgtaataaaaaataa

SEQ ID NO: 1467 - DNA, 600 bp, Bovine  MMBT16168
actttggagcttaagttgtaagcaaaatgtaagccttgaagacagcattctgcttgcagaaatcttatcttgtgatgaaacactgtgttgggccctgagagctctaaccagccactgacatgctagggagactttcaggcaggatgtgacaattttggcagcactgaaagccctggtatgtttatgtagtcatgtccagtttacctgtgtcagatgagactttgacaggcctaagagaaggaactacatggggtcactagttagccatgccgctggaaacaccactagccctgccagtcraagaaaaacacatgtgcctgccagaagtaacaaagtaatgaactttccatgaaagctatcagttctggacaatttggtatttttagagaaaagacttatgtatagtagggaccatgatcattaagacytgaactgatgtggctcatgtattcagaatgaagrtgagagttgctagtgaagaaatgaagcatcaatgcagaggatttgtgttctcgaaggagcagtaaagcacaaatagggaagtagacaagaacctacactttaaagcgtctagtgtcagagtccaaggattcttcatgg

SEQ ID NO: 1468 - DNA, 600 bp, Bovine  MMBT13197
tgctgcagtccatgaggttgcgaagagttggatatgactgagtgaacaacagcagaattgactcagatcttaaagatttgttttaaggatatgataaattatttaactaaaaggctttagttaaataatttatatttatattaaataatatattaatttagtaattaatatatcgaatattaaataatatgtattacctactttatttagctaaaggttttaattaaaatactatttacatagtgaaaagttaggagtatatagccttatgtaggaagtgagttctgtaacattgggggrataatgatgctttagacctttgcattatgtgaaacaatttagacctctgcatttgcatctctctgcttgatcttcctggtcttaatctttgtgatgtgacaaggatcaggaaaaagacagagtgtaaatatttgctgtctgtgccacaggcctgatcctttgtcagccataatagagcataaaaatgcatgaatgtcctccactcctccttagctaatgtcccatttgtatctaatgttatagacaccattgtaaattacccttaaattaagaatttcaatctctcaataacagggtcaa

SEQ ID NO: 1469 - DNA, 600 bp, Bovine  MMBT13650
cttttgtagcaacaacctataccttttttcgccatcatattatgcttacctggtatgctttcccaagctcagctgatagggtaatcaattttaatatagtcatttctttttttcatttatttatcagctttttaagcatccataatatacacaatccttgctatttactgtggaaaaattaaaaaagaaaacttcacaaacccacttcacttcatcctgaaggatcttacagtcaaactgaataagacagayataatacagatakaattgtattggtgatggacaggggagsctgatgcrgtgcagtccatggggtcacaaagagtcggacatgactgagtsactgaaatgaactgaactgaatacagataaatataaaaccttaaagtatgtaataagttctataaaatgattaaagcagacaackcaaacacttttaagtagtaagtgatatttcacctagagacatcatgaaatgcttcatgaagttatggcataaaagtccatgtattaatggtgataacattatccattctagtttctaaatgtatatttttaagatgtcagcttacctgcagtgttatacgaatttaagtgctt

SEQ ID NO: 1470 - DNA, 600 bp, Bovine  MMBT14378
ttttcagagtgagctgcacttgcctcctgcctcttggggagaccctccaagaccagcaggtgggtcttacccaagctcctactcaattatggcttttgccctgggttccagagcttgtgagattctgtgtgagctcttttgtgaagtctctattttccccaatctaatgtcatgtttctgtctcagcttccttgccccctgcccccaaatgtaaagccccttttggctgaactctatatgcttcatctctcttttctaggtcagacttgctttcattatttatacaaaattctgactcartagtagcattccaggatcctgaaccaaactctaaactctctggaatataacctaggaaaaagaatctatttcattattatgtgagctttaagctcttgcacacttttgctttctcagccaggactagctcatctccacaccatccttttaagtctgagtcagcagtagtgtagaacattaactcattaacaatgaaatcctctttcctaactcttgccaggctaaggttgttttcaattagcaaatttggagagagaggttttttccccccctttattgcacagcccttccttttacagg

SEQ ID NO: 1471 - DNA, 600 bp, Bovine  MMBT13162
tggcttctcatgcattcaaaatgaatttggttacaaactgggtaaacagatttataaccatagggaccacactgataaattgaaattgtgccaaagcaacttgagaagtgggaggacaaaatggaatagaaaatccaagtaaataactttctggcaagagstcaccatagaaatgtacacattcattttcaaattatattttatttgcaaatgagtatgatgggtttgtcactatgtaaacacaaacatcacaaatgaatccttcaaacagacttgacagtggtgagtgcttggggctgrtgaaatactcaaagtattttgtgctgccaggaattctatttatgatttatactaatctttgttttttactttatccctatttataagatgtataatgacttaatctatgttctagtgattgcttgttcaaccattttggtatctggccaatgtgattagtactggtgaaagatgtttcagatcagttattttccgtatagcagggggtactctggcctttgtttgtactggtagtcagaggtgggggtaggggcccggttaaattgttcactgcagagtctctttagttaacagctcttt

SEQ ID NO: 1472 - DNA, 601 bp, Bovine  MMBT11535
  misc_feature (1)..(12): n is any nucleotide
nnnnnnnnnnnnaatcttaatctttatgtaatcgagaaacatcaactttttatgtaaagaagcacgatgcttatttcagttcagttgctcaatcctgtctgactctttgtgaccccacggactgcagcccgccaggcttcatttaaattgctcaaaatatgaatggaagacatatgctgcggaaataagcccttaatcttctttgacatttgattctaaaactaatatttatagttattgattgatgagtatttgctacatcttattgctctacacaatctatgctgtaccattttaagggaratcttctgtttttttaagcaaagtaaaatagcctaggtaaagttacataagcaataggattggaattaattttcaaagttttcactctttactaccagacactccatatgccatctgtggcttgcttagagacaagtattcaaaagtttttattggaacacgagatgcggattctttgacaattactttccataataatttttgtatatctccaaataaatacacctacttaaacacccgccaataaaaaatcttcctaaacaatttaataaaggacactggtttcagcagagccact

SEQ ID NO: 1473 - DNA, 600 bp, Bovine  MMBT13118
aattatatttccttaggaattttcatagaaccatcttcctctgttatctgtatcttctcatggcattctgtatgtgtgtgtccaaatttccctcttataaggccatgagtcatttaaaattagggatctaatggccacattttaactttattatgtatctacagactttacttctaaatgaagtcacattcacacatcctaggcattcagacttcaatatattttaaagagagaagggaacactgttcaagccataataagaatatacctgggttaacatcattgcataatggcatagtrgckgtgtttctggtatttggaggaaaatcttttcatctggacaaagcacagggttggataatatgagagaaatgggtaagtgttctgagtattcttttgtttctctagatccattctcagctcttctctgtgcccttgawgctgagttccatacaaggcattatctggaaatcacatgacttctgtcttccagtgaggttcaaacaacaggagttasagtgttgagaaactggattagttattactgttcttcctgcatgtcagtgcttcasttttattactaaagcttacaaatgctgt

SEQ ID NO: 1474 - DNA, 600 bp, Bovine  MMBT17311
tcgcagtgcctagagggaacatctaatacagcaattattatcctgctgtttagtgtcyttcattctctatatgtttgtgattttggcctctaatttactgggaagtggaagtgattactagtaccatctcatatttatatgcagtattttctcctstattccctttccaaaacctataaagattacataatttgatagctatatgtgagaagtcttataaatcatttttatcaaaatagggtattccaaaaatcttagtgcagttttaagttataacaacttcagaagataatgtcacaracttagaaaaatcatcacccaaaacttgaagattcttttatacccatttacttttttctttctttcttcctttgggccataccacacagcttgtgggattttagtttcctgaccagggattgaacccatgccctttgcagtgaaagtgyrgagtcttaaccactgaactaaaaagtcagatatgtcctaataagatttgtgttgatattttgaaattttaaataattagctttttaatgttagacagtattatatgtaagtttaggatcttgcctgatactttggtgttagatattaata

SEQ ID NO: 1475 - DNA, 600 bp, Bovine  MMBT11605
tgtgccagattaagtrctttatatacaattatctcatttcattctaatctacaaccctatgaaattagtatattttctcttttatgaatcagaaaattgaatctcagagggtcaagtaacttccaatggttgctctaatcatttwagtggtaaagccatatttgaaaccaagttgcttattaaagcaaagcctatgcattcagcctttttgctatcccacttccaaatgccatagtgcaccaacctatgcttgagagaattaacttgcaaaggtgrgatgctggaagtggatttagagcrttggtcctactttaaactccataaagggatattttcaggtaagagctttcctggtggctcaggtgtaaagaaggcacctgcagtgcaggagacaagggttcaatccttgggctgagaagatcccctggagaagggaatggcagcccactccagtattcttgtctgaaaagtcccatggacagagaagcctggggggctacagtccatggggtcccaaacagtcagacacaactcagcatgtacacatggtacttattattcatagatacatgttattcataggttttctagttttgagtt

SEQ ID NO: 1476 - DNA, 598 bp, Bovine  MMBT13795
  misc_feature (1)..(61): n is any nucleotide
nnnnnnnnnnnnnnnnnnnnnnnnnnnnnnnnnnnnnnnnnnnnnnnnnnnnnnnnnnnnntgtttcttagatggtgttttactctggctatgctgcatatatatatgcttgtatatatactgtgcttgctttccccctgttgtctatttcccgtcgtccttctactgtactctgatattgtcaaggttgacaatatttactttctgttttataatctatcttaagtcattaatgttttatgaataagttgagtctaaagttggaaaaccaatgaatagcatttataggatataaccatrtaaatccagttcactgaagaaccatgtggtatgttgggaccctagaactttctctatgcctgcaggtatctcacttctgtgacactgaaaggagtatgttctttgtactctcgcattctattttcttttactacaagtgctctaaaatcatgccacatttagttggtaaactgacatttaagtacacattaagaaagatcagaagtggtggcacagttgcataggggatattcaataaatgaatggcctgtgtgacactattarggagaaaaaagacaagaggaaaatgaaggaaagc

SEQ ID NO: 1477 - DNA, 600 bp, Bovine  MMBT11452
atgagaggctgagatgaggagcctcctaaggaccgggcttcagcgctaacgtctaaaagccacgcacgcacccgttcccatcacccaaccctttccgccagatgcgccaccatggacttacctgccacccagcccatggtgttgatgataagaggggactctcgcttgtaggagctgaaaacatactttattacctcaatatagttttcaaagttgtttttacaagaagttttcccataatagaccattttctggggtgtcctctggtgggtgaaaggtggtcctaagaagataaaggtragagtcattaatccatgagaacataagaggtggcaagggttatggtctagccatgatccctgacaaagctgctcaggaaatctgagcccatcggaccactaggaatagctgtgctctcacttttggaaatctaagctttcaacttcaaacacagacatgcctgcatttatacacggttaatccaaactatgtcctaatatggccattcattcaacaaacatctacccggacgtctgctgcatgctgggcattgttctagatacttaggacacatctgtgaacagaaaaaacacccccaca

SEQ ID NO: 1478 - DNA, 598 bp, Bovine  MMBT15825
  misc_feature (1)..(202): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctcctcctccccctcctaagatccttctatggtcatcctggctcctttaacattggttctgatccagccgtggaactggagattccttcatagratccaccactggagatatgaatcatacccatttgacagatgtggaaactgaggctcagaaaaatgaagtcacatgcctgagaaataacctagccaggatcagaaatggtggctcagagtttgaatattatgtacatgtgcaagtgttcrcatgcatgtgcaaagccctgagcacccgtgttgacaggcacacgtatggtagcccccacactctgctgggctttgcctgccccayctcaccctctctagggtgggcgggggacttgggttaggcacctgaggccggctgtgtttggtgc

SEQ ID NO: 1479 - DNA, 598 bp, Bovine  MMBT17973
  misc_feature (1)..(15): n is any nucleotide
nnnnnnnnnnnnnnngaaacagtatctagagagtctctaaggtaggccttcaattaccctgaggtcccttccctgtaatttctaagattggatgtgattcttttgcttcttcccttttcatcgacatttgatggatgcttaaaacattccacaaagtgaaagcgagggtcatatcaccaatcccaattagacattacaaaagccccataaatctgggtgagtatgttacagggaattgaaagctgaaactgtatggccattgctctaaagaacagagcaatcactcttgtaaagccctcrtgtaatttttttccgtctgctagcagtgcgtgtctatcaataattggtgtgttattgatttcctaaccctgaataatgcagctaatgggccttctttcccagccagggtgaaatgaatgggccacgacgcgctgaatgatggctacttgcctggttatgtgggagcgtgttaacacacagctccgatgacctgcacagaagctgggtgtctctggcattgagaatggaattgagtattgatttctataccatcttcttattgtttaattaaacaaaccacagtccctgagtatgtgct

SEQ ID NO: 1480 - DNA, 600 bp, Bovine  MMBT17457
aggaaatgaacttacggttgctaggaggaagggatagttagggagctgaggacagacgtgtacacactgctatattcaaaatggaaaaccaacaggggcctactgtatagcacagggaactccactccatgttatgtggcagcccagagaggagtgggtttgggagagaatgaatgcgtgtatatgtatggctgagtcctttagctggtcatctgaaactatcacaatgttattcggctataccccagtacaaaataaaaagttcaaaataaaaaaaaaaaagtgacagaaaaagagatraagagtacttcatacttacccaaatattttgtctgttacttgcaaagaagatgagttagactggtacatttttataacttgcaagcaatataaggaaaacccttgttcaaagcaatattcattgtacagtttttgtcgctgtcagcttacacgttcctgttttttttttttttttcattattgaagtatagctaatttacaatgctgtgctagtttctagggcacagagttcatcttagatttttacacttcaccagggggcagggactattcctcggagcataacagcgttgtataagg

SEQ ID NO: 1481 - DNA, 600 bp, Bovine  MMBT16663
caatttgaggtgattcattatttatcttttttatgattttaatgaatacaagtgtctcttattcattaaaaatagaacaacaaaaatattcatctagtcattagcctcttgattaatcttccccattaagctaaagatccaagcagagcacctgaaagcaccttaattcttcttcagagatcatcatcacactaaaattatttgcttctggaaatcattaatttctttttatggatatgagatttttttttttctggattgcagtatattaacattcgttttcattcaccccattctarraattcttggtaataaagcagaactaaatggcacacattaaacattattcatttaatcttgggggaagttagttacaaggaaagtttgaagagtgagttgagaatagttcttcaatctcattgttggatatttcattttatttgccagtaaatacatagctatatatgttactaatacatatcaagaggttaaaaaatgatcacataattaattactcatcattattatatgctagaaactcttgagtttggcacatgagccccttgctcaccttctgaggcgtctcctggcttcaggagt

SEQ ID NO: 1482 - DNA, 600 bp, Bovine  MMBT18295
taatgcaggagacattaagagacatgggttcgatccctgggtcaggaagatcccctggaggagggcatggcaacccacttgcttagaggatgctgtggacagaggagcctggtgggctatagtccatatgattgcagagagtcggacatgactgaagtgactaagcagaatagcacatggaagatgatagtagtttggactaaggtagatgtagtaaatatgaatggagtcaagatatactctgaagacagaattgacggactttctgacagactggatgtgtaggactagaggaggaarattaaggataacttccaggtttctagcttaagcaactgagtgggtggaggtgccattttctaaaatgagtaaaattggaggaaggaacagtcccagagtgtgcgtgtcactggttaacaggttttatttgaaatgtctgtgagacctggaagtgcaaatgtcaagtaggcagttgaatttattaaatgtggagctttctaatgggaaacctaggrcaaggtcacttgtgataagagcctaagtaacaacaaacttatatgttcaaaggaaattcttatctggctaggttaatcagaggaa

SEQ ID NO: 1483 - DNA, 355 bp, Bovine  MMBT14466
tagtgtcacataaagccatgwgaaacagaaggtttaaataagatccagagtcttataatacaaaaatgtccagatttcaactgaagatcactcatcatacaaaaatccaagaagatctcaaactgaatgaaaaacgacaagagatgtcaacactgagataatagagatgttaaaattatctgacacaatgaatataaaaatcaactcaaaatggttcacagagtttaatgtgacatataaaactataatacttttagcaaaagagaaaaaaacctaggagataaccttcagaatataggrctagacwaaaagagttcttaaactgacatcaaaagcagatccatcaaaggaaaaa

SEQ ID NO: 1484 - DNA, 600 bp, Bovine  MMBT17428
ttgtcagctccaccgcaggggttctccacctgtggcaccctgtagaatcacatggagtgctgagaagtcagttctcttgtacagccctccctgcccctcacagactcattaaaacaaaatctatggaggtaagctgtggacctaggcatcttatttttaaaaattcatctagatgattccaactgcagccgaggttgagaagcactgggctgtggaaatctttgccccactacaaagatgggatttaatggagtcatttacaaagctgccagctgttccttgtaggctgtgccaacagaragaacaagcttatagttttttatttttatgcaatatggtgaataatcctaacagtaagcaagggaaggttcttaaagccacatgctgcaggagaaattcagaggggtgggaaaattccctttttgtagaggaaaggggctggtcaaacatttcagacacttttaccttctttgtttgggaaggaaactggagtgtgcagtggggagagggtacagcgggcaacagggtaggaggaaggggacctaaggaagagcatcacccttgaaatttgtagttaaaggatgaattaagccttaggtg

SEQ ID NO: 1485 - DNA, 600 bp, Bovine  MMBT17906
agtcggtggtttatatcaagatcctcttgaaatagtactagaaatatctgtaccctgccttttttgcactaccrataccaacrttttttatacactgagatctatattaggatgtctttttcttgggtcttttgaaatgtgtccctcccttgaagctttaatcaattattgattgtttcttagtgcattttgtgactgctatatttgtttttataagaaatacaggtatcttagagtctggagactcttgttcctgcctgaaatatttatcatgatattagatgtatatttttaatcccrtaaaatgtraagaaacagtaatattgtattttagccaaaatatttgggagagaaaacctctcttaacatagtatacctatccacttgtagtgacataaaatttgtatatattttgtgatctttaaactgtagattgttagattattgatattcatagatcataaatttagttattttaaatccttctactaacagctatttcttttcataaactgatataagaatgatgaggtttaaaayatggttagttatacgttattctaaacatttgcttctctttggaaaatcagtgaattcttt

SEQ ID NO: 1486 - DNA, 601 bp, Bovine  MMBT11781
  misc_feature (1)..(1): n is any nucleotide
ntaaaacatgttctataaattagtcattgtccccaaagtcactaatataatgaacagttaaaagaaaaatagaaaatagataagaaaacacaatataagacaaatgaaagagtcaacttagtaggtaataaaaggtagaagggaagagaagaaagtacaacatgaaaattatctacacatacacaaataaaacaaggaaaaacaaacccttagacaaaagaaagggaggtcaaagagaaagaataattcacacaaggatcctgaacatttagagataaatgaaaataagcaaaccatcacrcagttggaactgagaatgtaccatatttggagctctttattctcagtgtctagcatgatgcctggcacatagtgtgcactcaatgagtaaagtcaggattctaaactatgccattttcataccaaatcaatgtgttaagtccaatttgagaagtcattgcatttttatttccttgttgttgttttatcaagttgttggatactttatatattatgaggaacacaaaacaaaagacaacgaaacgacaatggaaattttgtgatgttacatctgcaaatgcaataaaaatctaagggtttg

SEQ ID NO: 1487 - DNA, 598 bp, Bovine  MMBT15175
  misc_feature (1)..(87): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnntattatttttatacagaaggtgacttttgctagagagctgttcctacctcttcatctactgggacagacaagtcactcaaatggctgattcgtccatctcttcctatttcgtgaacgacaaagtcagagtatctgaggaaaagaaaatcagagcattattattttkctgcctattaattttaggagaaagtttgtcaacagtaagccttattrttgtgcaaacaggtattaaaaataaaaastctcagtgcaaagtcatgtagttattttttctggtttcgtgatgaagtctaatccacaccttggcctggtaccaggtacagaaaagaccttctgagcttctagaatactcttccagaaaaatgcctaggtcaaagcttattaatgttgccctatgattacatagttcattctaaagtgaatcatgaaacacagcaaatttaactaaattggaagctagtgtatctaccttgagccaccctgaagcttacctttatgctaaatactttac

SEQ ID NO: 1488 - DNA, 598 bp, Bovine  MMBT14610
  misc_feature (1)..(124): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacacgactgtgtgactgaagtgaactgaacttgattaatggtgataacaaatatgaactcaaggtcatttcaattacgataattgttaccgttctagggaatcctgctatgtgttaaggtctatagtgggtgtgtcacacataccacattgcttcatccttctgtcatggcrtatgtgttatttttctattttacataagaatgagctatgttttagagcaagaggtcatccagctcagacatccatcaactacatgtggatggcctctcaaagctggttgcctagtccatactcctgtagttcctcttatccaacccttatccctgagatatatacatgcagaatttgccaagactctaaatccaaaaagagactttactgccagcagggcaatctcaagatttagagaaaatgaaaataacccttttgttccccaccataaaaataaataagattcaacatacctaat

SEQ ID NO: 1489 - DNA, 600 bp, Bovine  MMBT17265
taacatttgtttagtctttcagttactttatatcacacccatgaggaaaatgccccaggaataaaccaagaattagcatattaattataaataaagcattatagaacaacagcaattaacagttcaaactagttttttagtgctattaatcatgctgagccactaataaaaaaaagtaacaggaatgacagaagacagtataaccaataaattgtctgtctgtctggatgtcttctatctccctacctacaatcttagttatattatctcagggttgtttttttaatcctgattctgcarctttctacctctgaaatgctatgcaattaatttaaattctccaattttctatattctctacaaggatgatgtctaatgtacaacagcagtgttgctaacttctgtctgtatattgttctctgtcttcgttttggttcccatttcctctgacttgtaataaaaatggcatactttgaaaatcacatataatcgtctacttccgttcagacggaaatagccaaaacctgcagcctaagatatttaggctaggtaagtgggtgaattttacaacagtaaacatttaaaaataaagtaaggatt

SEQ ID NO: 1490 - DNA, 558 bp, Bovine  MMBT16915
gctctgtggtgagaccctgtcatgaccaagacagacaaggttcttaccctcatggaacatgatttagtgggaagaaatagacagtacttataaacaaagaaatatgttgtgtgatgtcaaaaaatgaaaggaaaaaaattaagcaggacaaagagatggaagtggtcagggaaggcttctctgaggactcttaaatgaaggggaggcagccaaatggaggcctgcagggagaacatttccacagagagaagcaaatgcaaaggcccagaggtagaaaccatcttggtaagttgatgaacrgaggaggtgtggctggagcagagaaaaagaggggaagaacagaaaaagataatgctagaataggcagagtcagatcatgttgagttttgaaggccttgggtagcyattgaagagttttgagccaaaggcatggcatgaagtaatagaagctttgaaaggatcatctggctgatgtggagagtaagcttcagggtgggtaatgggaagaggcagggagactagataggaagtgattataatcacctagattaaggaaaa

SEQ ID NO: 1491 - DNA, 600 bp, Bovine  MMBT17684
gcacgtggagcccctcacggccctggtggtgatggaggggtcccctggggcaatatcactgccaatggctgagatctcagggtctgatgtgtggtttaaaaaaaccatgcgattctacacaaatgttcacagcagcactaggcacaagagctcataggtggaaacaacccaagcatccgtcaacgaacggacaaatggataaacagaatgtggcatgtccatacagaggactaccacttagtcataaaaagggatgaagtgttgacacaggctaggacgtggatgaacctcgaccgtatratgctgagaggaagaactcagatacaaaagggcattcattgtatgattcaattcatggaaaagtcccaaacaggcaaatccacggtgacagaaagcggactggtggatgctggaggttggcagggcttggggggtggggggtggggagtggcctgtaatgggtacggggtttccatatggggtgatgaaaagttctagaataatggttgcaccatactgggaatgtacttaatgccactgaatcgtacgcgttaagatggttaaaacggtagatctgatgttatgtgtgtttcaccaaaa

SEQ ID NO: 1492 - DNA, 600 bp, Bovine  MMBT15494
taggctggaaagcaatcagaattggattttcttgaagggagggtggtgaaagagacaaattaagccttcacccctactccgagggttgggtttgtaggaaaaagrgaatgggctggacttgggggggggtccctyccaggggggatccytccctcttcttggacaccagcaactgagggaagacggtccttcctgctgctgagggaacaatgaggggctggtagccgaggtgggctgggacctagcaagactcacagccttctccacrgggagtcaccagagccgctggccctcctcacrgtgggatctagttcccaaggagggtgccaggcagaccttctgcccctgcaaaaacaaagctgcctaattgccttttaatctggggatgtcggtctgctggtgtcggtactgaattgtaaggggagatagtatctttccctttgagtgagaagttatttgatctctgcgtcagaggaaggcctgtgcccagggaagaggtgggacggaagggaaggtggaaggagagagaagagtgagggcctggctcccggccgacctgaggctttatttctccccataacaatcataaataaagggaaa

SEQ ID NO: 1493 - DNA, 600 bp, Bovine  MMBT17627
agcattgcatgaatgtctacaattctgtcttcaactgagtaattagcatctttatatctttacaaaatattagtagtgtaattttaacccctgaaatgctaactctggctcttttgtgatctatgttaggtcagacaggctacacagatcaacagactaagcaaagaactagaactttggaactcttttctttcatttactgtattggattatatgacaagcacttctggcctctatcccttgttatcctatgcatgaccaggtactgtgctctaccgtcttatgggagggcctgtaggrtcccctggttctagggaactcccccaaatatttctagtatcaattcatttcttgctcttattgctcagagccccaacagagtatgtggtctgtgggaatttcttaatcactgaaatattttcttaaaactttttctcccagatctatagtggttttttttggtaaacatttggaattctcccatctgttcttatattattaaaaattccactggggttttatgctctaagaatgtggaggccgtgatttccccgtgatacctgtgaagctcccatagaaagtcagaaatccctagaaatt

SEQ ID NO: 1494 - DNA, 404 bp, Bovine  MMBT17076
aaaatgtctccatggcctctgggtggagggcaaataggactcaagctatattttaacagaaaagcaaaacaagatgggagaaaagcagctgggcagggaaggtttacattcaatttatgtcaaaatcaaatatactgggttttttacagggaaaggaatgtaactagcaactctaagaatgaaatgggcagaatcaacttggcaagaaacaaaacagcaaggggattaagtagccctgagggtggtttacacccccaaacaacacaagagtgaggcaaactccagcaaaccacctcctcrtttactctgagagatagggtaagatacaccaccaggaacaaagtctcaacccagaattcaggtgctctggttctctctttctccctccctccttccctccctca

SEQ ID NO: 1495 - DNA, 600 bp, Bovine  MMBT16359
ctgttacaccgaataaggctctccataaattctgcgtgagcctgtcagtggctaagcccatatgtaacgcgtcaatacagcgcctgcgtctgcctgctggtgtctccaacaacccagcctgtggccgcctctccaagccccgaagcatgtgtatacacgccccaacccaatcaaaaacccagggcctgagatgctgtgcgtgctcagaaacggacacctcccattctcacggaggatgtgcgtgtgtatgtgtgtttccagcaagacattgtgttttttagactgtgacggaatcaaacrtgacgcwaccacrcgttctgggtcttgacgacctgatggggggatgggaaggggatgaaaagagtatggccacagcaatttcaggccatgcrgcactgtgacctcctcactctgtccgcttacaaaacagaagaggggagatacgtgccaggcagtgttcaaggtacagagaactgtcagtgtcattagttataatcaaagggcaggggccagagggtgaatgccttctggtctgcctccttaagtcacctgaggagagaacacaaacctggggagagactctgcttccctgagaccttt

SEQ ID NO: 1496 - DNA, 600 bp, Bovine  MMBT15681
cagaaacaccccagggcaagtcattctctgacagccccctgaagggtcctacctgtccaractgcatggtctgctcctgtaaacgtatgcttttggttttttcctgtcaaaaaatcatgctaaaatcattattttaaccagtgttcaaacagcaagctcatgtcaactcttggctggaggcttctgcttagaggaaaccaaagacaccagaacatccatttgcctcaccctgtcatgtgtggaaaattttaatttgcctagttaatcgtgtgggacatgggagacagacaggcagaaggrcatgacagcaaagagcacrgttcagaagcagcctccgccgttcaaatcctatatccgcagtyagtactcgggtgaccagtcctagaccaggagcacctgaaacctcctgttcaccttgaggctttcatgccagyacctgtggctttctgcgggctccaaggtgaagcacaagatcygcccccctacctttcaagacctccacatgcatcccttccccctctccagtccactttgtcttctcagaaaaaacctccatctgtgtggtctcttgtggcaacccactcagtattctcgcctgga

SEQ ID NO: 1497 - DNA, 600 bp, Bovine  MMBT15207
ctgggtgttgtcagtgtcacagggtgggtggctgagggtcttcaggttaggactcagcactagggctgggagggtctgagaaaggctagaaactcacagggaccacacaggtgaggggcatgggaacaggtaagatctggagatgtccatcacagttggcagttaggaatgtgcagagccagagcctggtagggaggcgaggccccatgtcctgaagtcaaggtaagaaagtgacttagagacttgggagtgaccacatggttggtatctgggtctaaaatattatttgccccacgaaaraaggaacttgtgtctctttttctctgctgtaatctgcactgcttagaacacagcctggaatgaaagtcacactatctcattgagagccagttatggctcttgaaggtcagggctgatggtggccctttgagtcccaggagacagagcagtctaatgagagaacgaccagacatttttaaaaaagtttatttactaggcttaatacctacatgaagcactgatggtaaaaagtcatgaggaataaacttgtaaacagtcatggtcctgcttcctaggtggcgctagtggtaaaaaccctgg

SEQ ID NO: 1498 - DNA, 600 bp, Bovine  MMBT17112
ttcttgcctggagaatccccatggacagaggagcctggtgggctacagtccacagggttgcagagtccgacatgactgagtgactaaggacagcacaggaagcaagcacactgagatagagagtatatgctaggggctgccaacctgctacctgctccaggggccttggtccctgagaatggggaaaggaagacagagaaaccgacaagagccagcggggggatgcgtgtcctgactgagagaggcaaccttgtggggtctgggaaggctcccaggtcatgcagacagcaagggttgggragctgacggtgtgccagttgcaaataatgcagggtgcagagaagtttggacttgatcctgaccaattttttttttaaactgtccacgggagggacatggtcagaaatgcatttcaccgaaaacagtgccagaatacagagaatcgactggttgagggggtgagttgggagagacgggcatggcttcaaatgctttatcgggtaaagcaactctggtgtgctggcctctgtatcagaccgccatatataaccttgtttctgggagaaaacgtgctcccagttccaacttttgaaactatct

SEQ ID NO: 1499 - DNA, 600 bp, Bovine  MMBT17874
tgtaagaaagcacaaggaaagaaatgggscgtcartaacactgcagctgggctctttgaggtgccccaagtcagagagagggaaacaagcattccattcaacactaaaatgcatgkgctgccctccagagcaaagctgcctgtcctcagcattcaccttgataatgttgccacaaacactgaaattttggtggtcgttacacatctctggggtggcaaagcaagaagtcagactgcccagggcaaggccaggtctcccacagagcctggatgagagggaggtcagatggatggtaaatarattggcaagaagaagcctgaggggacttccctggcggtccagtggttaagactgaaccttccaatgcagggggtttgggtttgatccctggttggggcgttaagatctcacatgcctcgccrccaaaaaaacaaaacataaaactgaattagtattgtaacaaattcaawaaagactttaaaaatggtccacattgaaaatatatgttaaaaaagagggatactaaagtcaatccacagagtcaccaccaacctgcttaccttatctcatactacaaactttttgaattccaaygatctc

SEQ ID NO: 1500 - DNA, 600 bp, Bovine  MMBT17030
ttagtatacacacactagttaagtcactgtgcttgactagactttcccggtggctcagtggtaaagaatccacctgccaatgcaggagatgcaggttcaatccctgggtcaggaaggtcccctggagaggaaatggcaacccacttcagtattcttgcctgaaacatcccatggacagaggaacctggtgggctacagcccagggggttacaaagagttggacattactgagcacatacatacatacatacataagtcactgtgctggtcgagagtgacattcacatagaaagtcccatrgtcatccttaggcctcagaaccttccattcaggcctggtgatgccctagacccgatttygcaagcaggaactgtggacctgtctgcagagaggccacttctgaggaaagaggttatctgccatcaccacccttcccctttscaaggtctcagygtagrgcatccttggtgscagcagagctgggacacgagctgagaagcagggtcctgctgccgctggggaggctcagcaaactgccctttgccttccagacagtcacggcgatgtgatccggcctctgcggaagcaggtggagctgct

SEQ ID NO: 1501 - DNA, 600 bp, Bovine  MMBT17639
ggtgggacttcaagtcctggaaaacaccttggaatctttcttgacaggggatctccccttcacactgagagaagaaataaatacaaaagaaatctgggtggtacctctgtcccacacacgtgccttcacacactggcggcagcaacaacgctctctgtcttggtgacgtccaggatcactgtctgcagcctgtctgatgtctggttcctcagttgcttggtcccccactccatcagacacacagccaggaccctcaagcctcgtaggtagagctgcctggccagctggttcctgttcccragtcacagcccgtgatgaagacgaacttgtcctggaggcggctcaccacctgcctctcctggtaccagcgcaggaggtagtataagcccatgaggaatgccatgtatagccacatggcttcgaagggaacagacacacacagagtgaggtgaaatagagtctggctagtaaacagacaggaggaattaggaacatgcatgatgatgcttggccaaccaggttccaggctctctggcatggagttaccaagyttttccagttcactgtcttcagtgagtatgactgactctgacctcawtg

SEQ ID NO: 1502 - DNA, 600 bp, Bovine  MMBT15201
taaaagcatgaatgcttcagcagcaaaaaaatagaggaggaaaagaatatcagaaaaaaggacagttcttccccacaaagtaaacctaaaaatcccccctctctctctctcgcacccacccacccacatcacacccacctacacccacctttacccccgcccccatcaccacccccactgtgctgaatttactttatccattctctgtggatctcactttgggctgactcaggcgggttggtagattgggctttgggaaccacagctctatgagggaggggttaggtatcattaacagcrtacatgttttacagatcactatgcctggtgagacaaaagtgccaagggacaacgttcaactcttctgttttcacctgtaggggtgagggggtgggtggtcatcactgcaccaaaacaggattttgtatttaccccggactctcttattaaatgaaggaggagagcagagacaggctcacatgttttaaaaattaagagaaattaagcacacaaagattcagctgtcaagattttatcttcaagttgtaagtataaaattttttacaatacaaaattaacacaaaactcaaacgtactaaa

SEQ ID NO: 1503 - DNA, 600 bp, Bovine  MMBT14063
aatatagtaaaactttctcaccagtgctcacaggagaaattaatccgaccctttaaaaagtcatttggaggactgtgtgtggggtttttagaatatttataactttggcccagaaattgtatttctgggactttgtgctatgaaaatgatccacaaaatgggaaaaactccttgtagaacgatgtccatggtaaggctgtttgtattatttaaaatgaaatcaatataaatatctgatagcatagataacacaaaatggaataggacattttttaaattaatgcttctgattgtagaacrtggcaaatacttggtaaagcaagatataaaatagtaggcacacatttatatgtctgcagtggtacttttatttttatatatgagcattcatgaggacaagaaaatgcagtagtggttgtgttaaagtagcaagaaaactttttcttgaacctctgtttttcaagaacacagtttatattacttaatgaaaaaaayacacagctttttactttaaaggaacataaaagaaaacaaagaggtgggttagatatgtatttcccaggtttttcaatccagatcaattaaattaaggaaaaaaac

SEQ ID NO: 1504 - DNA, 600 bp, Bovine  MMBT12689
cttatccataaagtaatcatgacaaagctgttttgttgatttcttgattaaaaatttaggtcacccactggtttttataggacactcccaaagattgttaaaggagacattttgagtacaggcgtgtctgagatgctggtgtagtccacttcgtagtgcatttctggtgacctttgaattttctgttacttggagaagaggggtctttatttttatttcagtcacaataaactcagtgagagatacctcatggtcactgactgtcaacagtagtaagatcagataagaaattcacctgcrccttttaggaacttgtgtataaagggcactgtgttaccatgaaacacttgggctcttttataaggccctggggtgttcacacagaagaggactcctgtggagaaggagaaggctaatttgtggagaaggcttattttatcttaattgtttaatgtttttcctagacagatgacttgaagtcagatgttcacctttagggaatacaagaagatacatagcartgactggtctgtaggcagcggggtggtagttctatctttgctttggtagttttgtggacaggttatttgaagacacttg

SEQ ID NO: 1505 - DNA, 600 bp, Bovine  MMBT16243
gacgaactccttttcctatttggaaccagtctgttgttccatgtccagttctaactgttgcttcctgacctgcatacaaatttctcaagaggcagatcaggtggtctggtattcccatctctttcagaattttccacagtttattgtgatccacacagtcaaaggctttggcatagtttgttattttaaaatcaaagaagacacaccataaaaggagattattacaaagttcaaaagcaatccaggtattattctttctctacccatgacagataatatttctcacatatcttcattatratatattggcattctgatactamtgactaaagaaacaaagctaaagtaatctggattttgcacctgattttctaattagctttctttcattatataattattaaaaagaaaactgttctttattatcctagatctagccaacagcaatactgatgcagaattacaaacatatacatatttcacatgcatatttattcaccattcttctctgttattaaaagctggcattcttctaggatacgagtccttaagagtacaagccagctgtcaggtcacatgtatagaaacaaaacacctcaa

SEQ ID NO: 1506 - DNA, 600 bp, Bovine  MMBT16214
taggaaggaaaccaaaaaagaagggatatatgtacacaaatagctgaytcactttgctgtacagcagaaactaacacaatattgtaaagcaactatattccaataaaatttaatttaaaaacagaaaaagtctgcctaaactagaatcccaactttcccctaagggctcatgacatcctagaactacaatgattcccttccaaatgctgtaacataaccgagaatgatcatgctatcatattcatcaagtaaaaaattatagcagacaaaagaaaatcctcaccatcacagccacaaatrttactcagcaatattgctgagtctttaccggagacagaactcctgaatagtctttgttcctctaagaaaagctggaccattattgtttgatgtgagaaccactactctcaccattcatggaatttttattagaaggtaggaaattctgagtgtgcacatatcattctggtgcctccccactgacaggaatcatcatgctactcttctctgttctccagattgagagccgacccctggaaattgccaagaggacagacgtctcagctgccagcagggaatcacccaaaatgtcactgcagt

SEQ ID NO: 1507 - DNA, 600 bp, Bovine  MMBT14052
gaaatagaaaagctgtatatattagttaatctgcaatgtatacatttcaaagtctgcaaatgacctgagactaaaactcctcactgccactttctgatattgcttggagaaaaattacaggaatcactgatcgcaagccccacaacagtgtgattcttgtttcccctgtgtctcacaagtgtgtgttgcttcccttcccctccagcagggcttccactctgctagttatctgctgtgctggtgcccctgacttgtttcctgaaccatgtctttttttcttttgaccacaagcagcaacarttttctttctgcatggcaagtgagaacaasgggacttctggagttgttttcctgatctaagtaggaactgaatctcctttagcagaatagaaataaaataacaggccaggtgcaattttatcttccaggaaatcctcatattttacatcttaacaacctattcatagccagtggtgtactctcatctgggcttaattctatctttggctacaggaaaaccatcaatattcactcatattcaaaacatttaacaactgggcatcccttggtagttcagataacaaagaatccacctgcatt

SEQ ID NO: 1508 - DNA, 600 bp, Bovine  MMBT14075
gcctggagtcccctgtgttaattctgttctcccattccaataccattcctcttcatcttccatctgcccgggctgatgtggctcttctcctttccaggcccacaggtaggctagaggagtacctgggaagcatggccaagattcagaaggctgtggagtatttccaggacaatagcccagacagcccagagctcaacaaagtggtaaggggccagcagagtgatgtgagagattggcagacaccaatccctgcccgggtctcattactgacactgaaccagctaaaagataatatagtcraataaaragaagtatrtaatactatgcacatactatagacattaaaatctctgtttcaggaattacaggtatacattttgattgcattttaataatttagctaaattataagttgttgtttagttgctgagttctgtctgactcttttgcaaccccatgaactgtagtctgccaggctcctctgtccatgggattctccaggcaagaatactggagtgggttgccatgcccttttccaggggatcttccttgaccccggaatcgaacctgtagctactgccttgcaggcagatttttttt

SEQ ID NO: 1509 - DNA, 600 bp, Bovine  MMBT13312
tgcggccccatgaaggtggctcatgggtaaactgcctgacttctgggcagcctctcctaaatgccaactaacaatgaaaaatagatatgcaaaactccatcagcacctttagccattatacatcactcacctttagaatgcaattaagaaaattctgaagctttcctcctgggttctgtttaaatattccagggatagttttctgtgacatcagtacaacatttggcctgatgttccacatagagagtccgaactgaagagaaaaagtccatgctggaaaagatttttgatctgtgttcrttattttctaagggagaccctccccttgaagggtcatctttggtgatatttctgaaatgacctggcacagtatttccaccagctcttacctttggtattaattccagtaccagccgttcctatctgaaatgtcttttataattatgtaattacacacctcatttatccaattgttaagcccagagactgattaaatattaacaactgcttggttctcgtggcgtcattagttggaacacaaccctgcaatctcaggtaacatgcgacggtaattatccttcacatccacgcacagctgaa

SEQ ID NO: 1510 - DNA, 598 bp, Bovine  MMBT12692
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaaggtgtgaccatgagcttgagctgttgacaccttataagtctttggagctgaggatgtaaaaaaaaaaaaaaaaatccagaatgtctaaatgccatgaacacagatttctacttttagaatgcaaattcacattttagtttatgagttagcatttctatgactaaartataacacataaacacatacctcattgagtgtcaacatatcttctactttggtagcaccggtttcaggcagggaaattaacaatgttttggctatctcctttagaactgcatcaatatgcatttcacacaagtcattgatctaccaatgagaaaacatatgtagaagaaacctcctttttcatccaaaaagcacttgagttataaactaacctggagggctatatctggaaacttgcatcctgagccaagcataatttggtaggaattttaggagtaaatcttttcttgatgtggaat

SEQ ID NO: 1511 - DNA, 600 bp, Bovine  MMBT16997
ggtttttatcatttgttatgaagttttattttgtttgtttgtttgtttttccagatttccctactacctttacccaaaactgtctgcttactactggagttttatctcttcccattcctttttggtcatggtgtcctttctgaaagggtgaccctgccaaactgtggttagttgttgatattttaaatggcattaggaaaatttgttggtagtgtggctatctttttctccattccaagaagtaaaaacttccccccagttctgtaaaggagaacagtcttacttaacagacattatacrgtctgtggctttaaggtttgaaacattagatccttatataacatgtttattaagaaacaggataaaatactgttaatgagattggtaagttgtatgttgctacaaaaaatgtatctctggctttacaaatgattcgtattcttatttccaactccaaactatgatcaaagatgcagtgttgataktaatttgtatccctgttgatgttgaggattaactgtatcttttgttttatttttaccatttttttgttgagatattattcacataatgaaaaattcactgttttcaggtgataat

SEQ ID NO: 1512 - DNA, 598 bp, Bovine  MMBT13319
  misc_feature (1)..(10): n is any nucleotide
nnnnnnnnnncctagaaaacccccatggacagaggagcctggaggctgcagtccatggggtctcaaagagttggacacgactgagcgacctcacttttgcttttttaaaattacctgtcttcacgtcaagaaagaactctgagaagaatcagcctttatataaaaccagaaaggaaaaagggattcacttctaatttctaaaatatgcctcccagttgtgtgtgtgtkttttttaaatctaaagtaagtggaatttacattaattttwaattattgattgttgaaaccaatatttgaacrtatagggagtgaaagatatgaagtgaaagtagttatagataattacrtcatagaatcagtgaatgtacactccagtggcccaggaaagcctcatgcatttggttaaaccctgtctttgtacataacaacatatttcttttctctcrtattaatacagcatagtaaatgttgtactaactataaaaagaccaaaaacttatttgaagaatataatatatatgtattgtatgcacaggattgttgttcaaatttgacatgttatatcctgatggtgtacaaaaatgcattgaacttgata

SEQ ID NO: 1513 - DNA, 600 bp, Bovine  MMBT16178
ttatatgtttaataaatactgtgtggatacagctggtagagtaattaatttcccatggggagaatgtaagttaccaaaaaaagaaatagtgcataagaagtgtggaggacttgaagcaggattaggaagtgagagtgaagaggtcattccaggcagaagaagtgatgcaaacaaatcactgatatagtagatgtctggtttgaaaaatagtaatcttgagtggtaaagaataaggtaagtggaggggctggagtttagcctgcagtaataagcaaagggtatatcattgcagcctttgtrtataataggctaaaamttttcaattygctgttttggrtaatgaggaagtatcataaaatatttttaagttgtggggtgatttgaccagacttatccttagatgataactgttaaaactgtaggaaagcctaggaggcaggaagcatagtaaggaggcaaccgctgagatactgaggtgacagtggaagtggagagaagagacatccacaaggagcttcsrcatcagtgttgacaggaactgttgcccactggacatgggaaataaggaaggtataaagacgacaccgggcttctttaagt

SEQ ID NO: 1514 - DNA, 600 bp, Bovine  MMBT17727
caggcaggttctttatcactggcgygtcctgggaagccccagagtttgatttctgtgttctaatacaatttaaggataatatttgcttgtgtgctaatagttattcaaatactgatatagaataactattctaagattgagaaaagggcatattactcaattatgacttcttccccagagaatcaatttatatgggaaaagcaaagtattaaaacaggaaactctgtacataaaaagttttctggatttcagggaatcaaaaactcattgaaaattttgccttcttaattgttatttctrctctgaaccatagattaatttttcctacaggtataaaaaaatccatagaaaaaaagaattaattattcaaatatttattcacatacattttcagcaatagtttcaaggcttaattataattttcaccttgtgcttaattgttcagttgtgtctcctgcattagctctttgctgcctcatggactgtagcctataacacgcctctgttcttgggacttttcaggcaagaataatggagtggtttgccatttcctcctctggaggttttcctgatctggagatcaaacccacatctcttcta

SEQ ID NO: 1515 - DNA, 600 bp, Bovine  MMBT17730
cgtgtctgactgtrtgcgaccccatagatggcagcccaccaggctctccrtccctgggattctccaggcaagaacactggagtaggttgccatttccttctccaatgcatgaaagtgaaaagtgaaagtgaagtcrctcagttgcgtccaactcttagcgaccccatggactgcagcccaccaggctcctccatccatgggattttccaggcaagagtactggagtggggtgccattgccttctccaggctaatcctagctcaccttaatctcaagggatgggtcattctagaaacaacrtggaatttggaatcagcagacctgagatgaagctccagctctgccacttacaagctttataactttactaaagtagcttcacctatctctgagattaagacagtaatagccaaattattccttcatttttactttattttctcatatggatcctctttcagaacatttgaagcagattatgaaaaattatatgtataataatcacctgaggctgatgaaacagaaatagaaaagcagaacaaagaaaacggagaaagcatttctaactctaaaggttgatataatagccataaatataca

SEQ ID NO: 1516 - DNA, 600 bp, Bovine  MMBT17734
ttatctccagtgttgcaaggtaaggggttaagaacatgcttaaaatcacacatctagtaagagagctgagagttgagccaaatctaattttaaaacattagtctttatcctatattgtgttgcttaggggagtagaactgagaagcttaatcttctcaggtaacatgacaataatcccgggaattatgtatggcatgtctttttcctaagtgctagtttttccagactacggaaatgttaatcagtgttctgtgaaaacccttggcccgacaaagaatgatctaagaattttgttgtctrtatcttgagactcatgtattaaggtttaaagggaaagtggtaatgatagttttcatttaatagtacttgtataagtttaccatggttgctatgacagatgaccacaaactgtgtgacttaaaacaacagaaatgcatttccttagttctggagacagaagtccaacatcaaggtgttagcagcaccatgcttctgaaggctctaggggagaatccttttcttggctcttccaacttctggggtctgctagcattccttggcttgtagccacatctctrctctgtctcaayataacsttat

SEQ ID NO: 1517 - DNA, 600 bp, Bovine  MMBT17735
aaaaagcagagagtaaacgaaaaggtcatctcacactcgtggccttctgagtttggggttttcctttttcctttggccactaccttgccagtcatttccatgttgtttttcttgtttaatcaagaaaaacaggcaagacaaaagggattattttccagaagctctgcttgtttagcgtcataggaatttgaggttgttatctagtatatttgggatgattcttcaggggtaacagcgaagtctacagtgtttatgaatttatttcctagtgtgatatttccaccaccttttactcttccrgatgggtttcaactgcatctgtttgcttttcctgttgcttgtgaaagtacacctcgtgatcactatccacagctgctttgtatgagcctcagagaattctatgagcagggaaattttaaaacatacgagaccagagtttttcataaagtcttattaatcatattttgaaagggataaacgtcttgccaaatttgtctgaatttctggtcaagtaaaaggcagrtcttcaaaccatcagacaaaatgtattcagtttatatctagtgtgtccagaactacacccagctaccacatgggatg

SEQ ID NO: 1518 - DNA, 600 bp, Bovine  MMBT17736
aaacacaaaatcatttgtccgcacaaaattaagaaccaccaataatttacaggccatgctttccaaaacagtagtataaatactgtatcaagtgtagaaatatatatttacaaagaaaaaaggaaaaaaggaaagaaagraaggaaaaaaaaacactttcacgcaagatgttaaagtacctggaattgacatctccatgtccgagctgcccatgttgcccgtacccaaatgtgtagacgtcgccattttccattaaaaccactgaaatcaaatttcagagctttattttttcattatacrcattttatatttctatcacaagtatactgaaagcagttcaagtttcactatttttaaaattttaaaaatttgtagagccattaagaataggcaatagaagcaaagacatttatatttaatgagaaacaatataattttagttctctaaaatatttttgttgttataaaaatacataatgtttttaaaacatacactttaaacttataaatgccatttaataacactaacatttaataaaacagtggtctgagtcaactgttaagtctttttataatgagtaactacatacaaaatactct

SEQ ID NO: 1519 - DNA, 601 bp, Bovine  MMBT12643
  misc_feature (1)..(1): n is any nucleotide
ncagaagacttgggttcactccctgggtcaagaagatcccctagagaaggaaatggcaacccactccagttttcttgcctgggaaatcccatggacagaggagcctggtgggctacagtccatggggtcacaaagagttggacacaactcagcaactaaaacagcaattttatgtatacacacactcacgtataagtgtacaaatcacacacatatattaatgatttgtttcacagatttaattttaacattttgtaattcatatgaatattatatttgcatatgggcatgtrattttacrtctgtgtatacctgtacacataatgtgaactgagttaaagaaaaaacaatttcaaagtaacttgacagctttccattttaaaaagttaaaattgaattgagtttcttggcaaacagattattcacagaagtgaataagtgtaaacagtgtggtaaactgaatagaataaatagaaacagtgttttaaatggygcttaggttctcrgatggtctttagcagctttgaaccgccaatgaagagccagaaggtaacagtaacagcaactgatgcyagtgctagcttgaaactagtacacaaag

SEQ ID NO: 1520 - DNA, 600 bp, Bovine  MMBT11903
ctaggggatcttcctgacccagggattgaacctgggtctgctgcagattctttaccgactgagctaccagggaagcccatcgttctttccatagaratatctaatattttaggcattcttaaaaagwgttttataatcattaattatggaaatcatatcattcattgactttttctacagcgttgaagaaaatatttattttttaaaataaggaacataagatttaaagaaaataaaaagttgctcgtgatgtcaacaaattaaaataggtttaattttttctattccttcccatatttragtccatgtttcatttcaccttaatttttgaacaaggtttgaatcctagagtaatwtttttttccccctctgtggatatccaattgctctagcactattttttgcaaacattatctccccgctactgagttgctttcgcacctttgtcaaaaaatcagttgagcatatttgtgtgactctaattctggggtcttttctgttccactgatctttgtgtctgtccttccaccaacaacagcacagtcttgattatggtagctatacaataaatcttggaattgggtagactaatcccttcta

SEQ ID NO: 1521 - DNA, 600 bp, Bovine  MMBT16305
aaactcaaaagcatgcacatttttaaccaaattaacatctatgggcctcatttcaatcaaccccaattaaagatcattaagtggctgcagataaaggacaatgactagtctataattactggctctttcatgctgaaaatccaattctcccatgagcatacgcacatctgcatgatttaaaaatgtacatagaaaataatttgctttttgaaacccatagaaggaaaaactgtaatttttgcttcaaggggtttgctaattacatggagatggaaaaaaagaaacatctacaaaacaacrtatttttaactctcatattcctgccactcaaaactcaaaggccttcaggtaacctagcaacaaaaaagaatcacacaaagatgaagtattccattacagccaggycactcacccccaactgctgctcagatgctttttcactgctgttttcatcacaagtctaatacttgtgaaaaatgaagtctttggcatttatataatcaattacacaccttaaaacatagttttgaacatgtcaagagaattacaacccaggacaaaacccatttcttccctaagtgtattgctattacattaata

SEQ ID NO: 1522 - DNA, 600 bp, Bovine  MMBT18344
aggtataatgttaaatatgtgagagcttagggaacaccaatattctcactaatgaacatcccaggttatttaaaacttctgtggaaaacctatctgtttatatttgttctgaaacatattaatccaatttgaaatactagtacaaatagtataacaacagaaattaaatctttggtaattggggctctcttattgtctcagaccattcattgtgggcacaaattctcacatacagaattgaaaacatagataagtctgtatcagagatggaatttagtgtgtattagactaagaccaaarasctataaatttccttttttgggggaataaatatgtaataatattaaaataggtagcaaaattttaaattaaggttttagttgggaggtctgggtctggcttatttataatctttcaaatgtgtgtagatgttctatggatatgtggatatatgcctaaggcagtcaactatatttatatgtatgctaaatttctattctaaacatccttgtttaaaaaaagatgtatccacatttattctgtttaggaaagaagatatgcactggatatgttttccccatgctcctattataattaatt

SEQ ID NO: 1523 - DNA, 600 bp, Bovine  MMBT17105
atctcaggaatggcatcgcattgcttctaccacattaattggccaaagtaaatcacagggcttgcccagattccaaggacagagaagtagactccatctcttgattggaagacttcaaaagatatggatataaggaaaggaagcactgtgaccagggataataactcagagtaagaggctaattttaaaaaatgagtctatttaattacatttmagtaaaattatttagtgaataatattaaaagtggtgtgtggatgtggcagaagtataaggttgtaatatgaattgttaaagtttgraaacacttttctactctyacattattttcacttttatagcatccctttgtcattgtcctcataaactatctttgattgttccaatggccacttctacttgaagcagggcattttttttgaaaatgtgtggcctactctgttcttcatggtagtgtggtattctgattgagccctgcattagttaagttagatgtaccatgcccagcttcttaactgtatcccaccacatctagatatcagttcagttcmgtcactcagttgtgtctttgtgacctttatggactgcagcacaccaggctt

SEQ ID NO: 1524 - DNA, 600 bp, Bovine  MMBT17662
cattgacttccccaagggatcttctaaccaatttataaatgtttcctcaagaaatcccacactgggagagccagttaattctgtctagagctataaatccctatgcagatatctctcttgatttattaagatgatgttgctccctgctagttcacatcattcagttattatatgagaaattataaaagtccattgtctacactgtgggtaactattgggtttaggtactggagcacatatgctatagtttgccatagttcagaaaaagaagatataaaaatgtatggaatgtcccaattrggataaactctccatgtgctgtataattcctgacattataaagagaatacttggtactaagcatcctaactggcagaaactaagagaactagagggcattaaatactaatgttttctagggtacctgtctttggcagctttctattttcattcttttccctcttggtttttagtatccaactcatactatattacctagcaactctctgctgatatctgtatcaagtctttaacaattattttaaataggaaatgtaaaatctgcatgtggtttgaatctctctcctgagctccagatct

SEQ ID NO: 1525 - DNA, 600 bp, Bovine  MMBT17104
aaagtatcctttgctaatcataataaagcaacaaaaagccagggtatgatcagggaggaagactaagagggaataagttaggataataaaaagaagagacaattaggagttcaggracctggatcctgtacagctctgtcactatttctgtctccttatattgcatcatttgcttgggtggcaccttacttaccagaaaaatgagtgaggcagaatgatctctaaagtatcaccagcttcaataaataaagattctatgattatatgaataatttatatcctgagattgttgagaaaacrtaccacagacctcactgaggaaarctttacaaagaataagtgtgaacaaagccrtagtgaataaatagtgmctacttactgaaatagttatyttgctagcttctctgtttctaaggggaacgaacttaagtgagatcaacaaaattttcctgcttagaatagaccaagtaataaaatgtgaatttataatctataatacaagtaatgcttgccatctgttgggttgatattctgtgctgggcactttatgtctttacctcctgtgatccttaaacaaccttgcaaagtagactccatcac

SEQ ID NO: 1526 - DNA, 600 bp, Bovine  MMBT12779
caacagaagacagaactgagctgcctcagggcaatgaggggtgaacatcaagagcagtaaggacagcagagtggaactgcttgtttgaaagcttacctgagctgctttggttaggaaatcaagacgtgaaatctcaaggtaaaaaagctagcttgtgacaaagccagagtgtcttggctttagcgggaaagatcatagaagaagcttttcttgcaaacaacctggttctcttacacagtatgcaggtaygtgtaaaaaaagccaatggaacctctcaaagacgtcttaagtcttaaagarttaaaaaaaaaaaattacatggagggaagtgggttctagtgtttcacatgaaacyctttctagcagatccaagttatgccatgcaatactttaggacagaagtagagaaaaacaaaaaacaagcaacaacaacaaaagcaccccctccccaccaaaaaaaaaccctaaatgccaaatccagattttaagatatgagactaactggaatggaaattcttattgctatatttattaaatatgaaatttgagaaatcaaagactcagaaaagtaaagagaatgtagtgggacctctgtctgct

SEQ ID NO: 1527 - DNA, 600 bp, Bovine  MMBT17005
ttttgattttttcaagtattgcattaaatattatttatcttgattactgagtcttttggcagtcttagattttacatccaaggcaggtgcctcaattgcttctgttaatcctgactctattaagtaatatgattcttgcaccagtgctattaamtgactctgtactactgctagtyaaatactctgctccctcaaattctggatgcaagagaaatatacaatataggcaaatacaatgcttgccctgattgttcagtgccttaatataccaagtcattgatataccttaaaaacatacarggtgttgtaatctattaaccacatgctaatcacaatccaatttagmataataggaaaatattggttttagcaggtttagaaaggttttcagccacatttctccaataagataaaagtttataattataatttgattgaatacataacctttgtcaagtctttcatggttaacttaatagaattccccagacttaatgtaaacaagcycaaccaaatagaccatgtacttaagagtggttttgtctatttactataataaagaacaaaatgactttagaaactgaaattaggttcccaaga

SEQ ID NO: 1528 - DNA, 600 bp, Bovine  MMBT14730
ctttcacaaaacagaattctcagaattgatgtgttaatatcattctcttaattacttgacatctgacctaaatagcagtaacaagatgatttcggccacagtgaaagggacagtttaggccgtcattcacatatttttggccacaaaaaaaaaaaaaaaaaaaaccccacagctattgagaaaagaaaaacatcttatgatatcaggcagattgtctacccagctgaagttcactaaataattactttatccaccacttcccttttcctatgtatatcagcgtagatcttcaacaatacraagaatttacttaccatttacagttatcattttggggtgagaagacaatagtttgggaagggagtgtggaatcttcaaagaaaattgtatattagagtgatttgtttatggagatttttttttaagcatgaaacaaaacatatagatataaatattggttaaaaaagaacactaagaagccctgagcggggtgggagtggggggtggaaactccaaataacggaaacttcattaaaagatagaaattataggtctgaaattcaagttaaatcagtaacttctactcatcaaaccaaagtt

SEQ ID NO: 1529 - DNA, 600 bp, Bovine  MMBT12721
ccgtaacaaaaagatcagtagcaagctctcaggtcccaaatctgatgtttctcttgctaagagaaagaagtgggatgctctaccatctttttgagggttgacagcttttatgtaatcaccaaaaccattttgatggactgaggccatatcacgaccaactttcttctaattacattactctttatattttcaaagtacactaaagcctatgatcaaatgcatccccaaatgctgcttttgacttgctaaaaatttactgaaaactactactctagggcagaagtctgcaaactttttctrtaaagagccagatactaaatattttaggctttgaagaccatactgctctrgcttaagtactcaaactctgttgtagtgtgaaagtcaaaagcaaatatgtacattaargggtgtggttgtatttcaataaaactttattcacaaaaacagccctggatccagcctgaggcctgtagtttgcagatctctactctagggtcataactaataagttagtcaactgggtggtaccagcacacaaccaacttattcaactcgaggcgtttgatctaccttaaaaaaaataactaaccataggca

SEQ ID NO: 1530 - DNA, 604 bp, Bovine  MMBT18380
  misc_feature (1)..(4): n is any nucleotide
nnnnaaacacttgtagaagaaagttttgccttcatcacagcctggttctcctgggcccttttctgtgttagaaataaccacacagattgatgctgggcattgatttgcaggagaaacaggaagcaattctctcctaatcaaatatcatctctgtgtatatttacaaccaggaacatagatggcaaacaaaaatgttttagtaggataagttttatatatatatatatatataaactatattcaagtatatatgaatgaatattgttagaactgtcactgcttttccatgtaaaagggattcatrcttttagccaaccaacataagataaggaacattcacctcagattctgggcaacatatgcctgcctggaattcatattttctggatacatttcaagtccaaacatacccaggaacccagctgattctccactgcagaagtgagacacatgacctgccttttataggaaccaagtctctcaccaaaattggttttgcctagtgagtgtcactattaacatgcaagccgtgcttacacctacacttggaagctaaaaatggagcagaatgctgagacttagtgtaaaacgtaagctccgccct

SEQ ID NO: 1531 - DNA, 600 bp, Bovine  MMBT14244
ggtttttctttctctgaaaaatagtgacttgttctttctgaaatctgaatgatcagatgcagctgcatttttgttgctatttgagtttagggagagggaggtygagcactctgaagggacacagagattagagtaactgttaggctgacagaaggagaagaatcacctattctttgcctagtttaagatttagagacagtagagtgggtataggtgaaaattgtagaaggaaaataaaccagatggattaagatttttttttttttattraagtgttactacatactgaagaagatgacracgttctaccattagaagcaataaaggaaatcgcagaggaaaaggtcaataggctttgactacttaaaaatttagaactactttaaaactttttattgcttagataatgcatatgtgcttagaaaaccatcggaaaacaatagaaaataaaaattccctcaatcattctcccaattggcagctctattgctataatgacattttacgatcatcctcccacacttaaaaaaatttttatgtaagggaaattaaatgtgcaaacaaataaattggaaaagtggtttccagcacagacaaaga

SEQ ID NO: 1532 - DNA, 600 bp, Bovine  MMBT16311
ggaaattttttaaaaggtttaggaaatagtccttggcattaacacagttccagaaatgttttttattcccataagccaaactggcaagtttatagtttagggtaattgtgtagaaaactcagtagcagggattaattaaccctagatgggaataccaattgggacctgcatagcaaatcataaaagcaacactcaagaaaracaaactatttctgagtaattaaactgcatcctgggcataattcacaaatatttatgtgagtacaaaaatactcagcacccagcaagttaaaattcacratgtctgtcattaaaacaaagattaccaggcatacaaagaagcaggaaaacatgacctgtaacaaggaaaataattaatcaatcaaaaccagcctgcaactgacacagatgttagaattagcaaacaagtacatttaaacagttatagttattctgtatgttcaaacagttaaacagggaaatggaagacataagaaagacccaaactgaacttctagagatgaaaactataaagcttggggtaaaaatcacaatgtacttaatggcaaattacacttgggaaaagagaagtaaactcaa

SEQ ID NO: 1533 - DNA, 600 bp, Bovine  MMBT16318
ctaaacttttatttatttatttatttattttatatcctatacttttaaaatcaaggcaaaaggcacctggctagcaacaaaattcagattacttggacatgacaatgagaataaaggtcccctktccttaatcctacatccatctggaaaaagcctatggaggacttcataactaaaccaragatcactctaagctaactttcagatcattatgggaacccattttacagcatccttcaaaggctttccttcagagccttacttcccaagagtyaggccacttcaagttacattttaacrcatattagttataatgctaccatttatgcttatttactctgtggcaattatttaagcaaacactctaaatttctccatataattgttataattgcaaattcttataattatgttctcaaaagctgcaggactaatctgggaataatttttcactattagttttctagctgccacacttttgctccacattaagtcattcaataaatttttggaaataacagtaaattttggtgaggattagaatgaaactcttagcaataaggcatttcttttcaaccattgagtgcaaattaaaaaggg

SEQ ID NO: 1534 - DNA, 600 bp, Bovine  MMBT14977
tgtggttcactgggcaaacataacttgggcactgactgtatctctgcatgtgtttgcaggctcgcttcttgccttttgacttttaaagcactagttgggggaacaggtttctttctgctaactgaatcttgacagatgaactcctccttgtttggaagtattttaatccttgccaaattaatttacctagttgattgactggagttaaaattcaactgcaaaatgagagcagattgttctcttccttgcgacagattcatgtccgttggagtacatcatcttcaacaaatatgaccracrcaggaggtgactctgaggattaacaaggtttggccatgtttatataactttttaagctcttattggaaaagtgctttggggaccataaaatgttgatcttaatctgtgtacgcttagaatcagaattgscttccataagttcaactttttctccaaaggcagtggggattagtaaatcgtgtttccagaaagttcaacctatatttgagaccagtttaaatgatagctgatgtgaattcagttgytccttagaacagagatcctccaactttaggatgtctcgaatcgcctggagggctg

SEQ ID NO: 1535 - DNA, 600 bp, Bovine  MMBT16392
aaacttactcrgggatttgaatcatgccatttgtttttttattgtttgactttcttctccttcaaattggacccatgtcagcataagcacactggctgacaccggtcctcactggacatttccatgacaaacctaaaagtcacaggcaacataaattgtcaaggttttatgartacagctctgctaagtgcaaagtattttctagacaaaagttwagcgcaaaggtagaagggtcattttagtgtagtaaaaacagaggagtcctggatgcatttttttagaacctcaaattaattatgraatcaggagtgctgccctcctaacccttactttctcatgaaccaaagtgtttttcccagaaatgctcaacctttatttaattaatggaaaaaaaaataagggttttaagtattatgagctgaaaytgaccctgcctaaacatggaaaatattttcactttccaaaccatgaaaactattgatcctggctttaaatatgaaagaaaaataaacctctgacaagaaaaagaaaacaaatgaaccttgcagccaactcttgctttttcaagtttcaaacaccagaagttctttctcaaatatt

SEQ ID NO: 1536 - DNA, 600 bp, Bovine  MMBT17828
atgtggctaagatcacacacagtgtgctctgccttccagcgactgaacttccaggtgagaccagattagacagagaaggtcggaggaaatttaattcttatcatctactgtggaagrctggcaacagcaatccctgcacgaaagaagaggctcctaattatgattaaaaggataattcaggcaaggtgactctagatcagcttcagttagtccttatttttgaatttcatatttaaatccattcccttgacagcaacygaagaagtgaaacacaggaagaaaattgtctayaaaggatarcatcaaacactaatctccatgtaacrgagactctacagaatttcaaaggcatgttggtacttgagtgactgctatgyaccaggcaatgtagggggtgatgggacacaggatacaatgatgctctattcggaggcagttcctgtggtatatgactcctcagtaagccctgcagtgcaggcttgctcatatccatttcacgctatttacgcctgcygaaggcggtgtgcaacatggatgccagtcatccccaktcctagtagccatgcccttatgtcaccattggtgcctgctcagtcactc

SEQ ID NO: 1537 - DNA, 598 bp, Bovine  MMBT16911
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnntactgggttaaattggacttaaagttctcttttgagtttagtatgcactgaaatatttctttgtctaaaagcgagttagtggactgggcaatgcacttaaaaatgaggaaaagtgcttataagaatcactgatcatggatataaagttgaaaaaagttagaaagtatgtctaatgatacattattataaaaaataagttaaaagcccaatctcctaaccratatttagtattgatttttctttgttacctagtttagggaacataattatgaaataaatcaaaagaaacagtagttttagggagcattagaaatgacatttaggtactgygcatgacattgaagctcctgaaccctgaggcactcctttatttaatttaaagacaatgtggctaaagctgactagattattttctggtatgtaagaagctgtttgttgttagaaaatttgactaatttgcttcccatttttactaagaacaggataaatyacacataatatacattttattcacttag

SEQ ID NO: 1538 - DNA, 600 bp, Bovine  MMBT12732
tttataataccctgtctttaacttggtatataccaccttttggataaaaagattattggttgtttgagatgagatacaagaacaaaatcattcttgaggttccacctcgaaaaaaagacgatgtttgctcatagcagctagtttgacacccctgttttccttaggctagccttcacacaacgagcatgcatatacagccatggttcactgcatctgttctgaagttgagaactgctgcttattcaagtacagatgcccccatgtgatgtaaggagacagttgaattgcatgtccaccatragaaaaggaaaataaacgatgaaacaaatgcagcaaatataggcagctggcattcagaacacgccaaaaagctaacactcatgaattgtcattataagggtctttctttcctttaaaaaaaaaaaaaaaaagtctttctttgcatattttgaaatttaagggtcccagagaatcatgaagtgccttgtcgtttttgctgctgactcctgatgacctctagctgttttttgcattgctgatagtaagttgaaaggcttttgttttcatctaaaagctttttatgttcctgcaccagacgag

SEQ ID NO: 1539 - DNA, 600 bp, Bovine  MMBT15597
gctaaaccactaccagatgattattggctttgtgttttatttggttataatttgcaaatagatgtttaagtaaggttatttactctctcattgtttctctcccatcctcttcaccccattagtgatgggagggggttggccaaacacacacctcctgacacctgacattgagactgaaagaagggcaagcacagtgcagcaagccgcttgcagaggcatgtgtgctgacactggttgtagtaaccctcagatggaagaaaggaaaaaaaaagaaatctcttaacggagattgagagagcrtttcaacatgtcttttgactgacgtgtttgcagatgtttaagtactttgagcggaactataatttatggaaacatgattttgcatctggttgatttaccttagaaacatcccattgaaatatgacatttgattttgatttttcaagaccacctcaaagacaaactggtttrtgttatctcctaaygctgttgacataaattatgtgctggtcgtgcctatttcagcaagtcttccttcagtaataccatgaattgtaaatgtgttactaaactagtggtaaactctgtgggaatggacca

SEQ ID NO: 1540 - DNA, 598 bp, Bovine  MMBT16933
  misc_feature (1)..(9): n is any nucleotide
nnnnnnnnngggtgggatggagggtacctgcacgagccgtcttacctctaaataagtgagacagctaatgcagtttggtagattcctaaaagtctgttcctccagaatttctcccttactcaatggctatggtgaataaaacttttaacactggaagtattgacttttagagaatcctggtgaatggattatatctattttggggccatttagaaatctcaatgtgttagctggaaagtacaacacattgttatgttagtactcattcatcttaaacaatgacttgtttatagggttgaragtttgaaagaacatgattctgaggaaatgagagtaattattcaaacagggacaagagtcataaaacagctataggtaagagtgcaatgcaaaatttactcatgttgaaattttggatagaattgccaagactatttctctatgttattaaytacatgctgttggaagttcttctttcaatttcctttcccttctctcctctccctttccttcctccttcctttcttctctctttcattttacatttatttaaagtagaatcttacatttgaatactccattaaggggtaaaattgaa

SEQ ID NO: 1541 - DNA, 598 bp, Bovine  MMBT11614
  misc_feature (1)..(115): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttacagtagcagtcactgattggctgactttcgaaaccaggggtgacgactgctttcttacctttcagatgtgcaggtattggactgagactgttattgactggctgatttgcagaggcatggccactggagtgaggctgtcattgattggctgattttcacagcatgtgcactgatccartgttatttctaatkagtgatggttacttattcatgacttgrgacttcgggcaaagaacagtctattcctttactgaacataaaaactaaatatyttaattctcatttcccttcagaataacctacaggagagaccataaaggaatatacagatctatacttctgcargtatgattttcaactagtattgccatataaaagatttaagtgtcagttattgggttggaaaaataaaaaacmtttaactgctgaattttgatattgtattataaatgctaaatacacaatatttagtgcat

SEQ ID NO: 1542 - DNA, 600 bp, Bovine  MMBT16277
ttccacagcagcagcgtctacaaagggcagcacaaaatttgaccgcacagtttaggaaaagtggcctaatagaaggaacacaaactaagaagaacccctctcttgccatagtcagtcatcacaaacagaaagctttttccatgagtctggccaactgcactgaaccaaaatggctcagacaaggccatgtctatctttgaagtgttcttaagggtgattctgttatttaaatagggaacagcaatttcttaggaagtcccttggctgataatacatttgttttgacttgtatagaaatcrtctcatcttagctgtttctaaggcatgccaaaagtaagctgaaaagtgaaaaactagtcaactggacatttctaactatctggatccttaacaacatgmatarcaaacatctatttctccagttagcatatctttcttggagaaaataatggtgtcttgccaccatagatgtttgagtccctgtgaatacatgggtagaaacaacccatccaaactcatctcatatgagatggctagaaggtcttgtcctactctggaactaaaaagctatccttaagcaaaaactgacttttccttcct

SEQ ID NO: 1543 - DNA, 600 bp, Bovine  MMBT15535
atggtacctacttcataagactgtgagaattaaataagaaaatatgttaaatacttagctactattaaattaaaacactaattaaagcactcagcattagtttttaactgataaatcaggtgcaaatattaccaacctttaaattgtacgatttctccattctgagtttttggcaatccctttagacaaacctcactggtaagagctaaggcaataccacagcttcctagcaagaagccaatctgctgccccccagcatcctgtggagaaaagataatgaacatggtaggggagcgaacrtgagcatacccaagcccaaaatctgacacttagtaatgctctggcacttgygcaatacattcatgaaatccccctgatatctggcaactgtcaaaatctagtgacaatatgttcttccaaataactgctacagcacaatgatttcctgagtgcaaaccatgtttcattaatctgacgctgctaacgatgaattccaccagccaaatgtggccattttactcaaaggtcagcaatgctcctcttctaaattaatctcaggaaatgaaataaaagtgaacatggttaagttgtcctgaccta

SEQ ID NO: 1544 - DNA, 598 bp, Bovine  MMBT16270
  misc_feature (1)..(9): n is any nucleotide
nnnnnnnnntattgagcaaattactatggcaagtaatttgattgcatgctcctcattgtcagtaacactaataatactccctactaccatgattattgtgaggaccaaatgaagtgtgttcagaaccatgcttgatatagatagcagtgccaggtatcaaatgttgttgccamagaagaggatcagtaactgagtctgattgtttcctgagaagaggagctggcaagagaagctgaaaaagagtggaaagagaggaagtatgaaatgtaggaaatgatagcatcacaaaatctaaaccartaaagaaaatatcagagggaatagtcatacatttcaaatgctgcagagaaagacatacctaagatttaattacatctagattctatttactctactggactttaatagtctttactcccgcagcaggcacttataagctcactttgttacgttgacttgcttttgtacaagccctcagtcatactcatttacataacgtctgcgcaccattttcttctacgtatggtctcctcaaccagactctaaactcttcaaagctagatttgtattttttgccctaaataataaacttcttatt

SEQ ID NO: 1545 - DNA, 600 bp, Bovine  MMBT14990
cttatgctttttgtaacattttcaaattcgttgctgtcttccagatgacaggaaatgcaggtctgccttcctcctgggagatctttattcacagacaagtcaaaaacccctgacaaaaggcaaccaggggaacttgttgaccttttagctgtctggctaacatcagtgcaagtattgttccctgatcaaacaagaaattcaatttaaggggaaatttagaaggcatttgaggcgcgctcattttattttacctcttgggctgtctttcaaaccgagaacaaatgtaaataaacaagagcrgcactctcattccgcacatacaataacaaatatctggcctcacagcttgatgtaaatgagccatggtccccttgtttgtctctccattcagccatttgtagaatttttttttatcctttctctttctccctccctccctctctctccccctccttctctttctctctctcacacacacacacaattattgggaagtgaaagctttcacttcttcagctagacgatttgttttcttttttcccattcatttgttatatcttgaaaagctatgttcttttataaatgaggaaaaaaagaaca

SEQ ID NO: 1546 - DNA, 600 bp, Bovine  MMBT14774
taagagtacacattaaaatcaaatgtctttcaatgtagaaatgcactgaaatgtcaaatgtacattaattatctaggatccactttgatgatgtcctcttgttaattcatttgtcagatagcaaaagttagcagccccagaaggaagccatcaaatgtgtaatagacagggagatttggcaggcaggcagggaaaatttagccaagccaacactaaaccacttacggaaatgtaaaacttaagaatgtccagagtaagtcccggaactcaagacctggcagatataggctccaaggacaraagtatatttttcacttacrtttgcatgaatatgactctttggaaactgacctaatttaaagcaggtttrtatgctkgacagttttctcttcctcgcataaaacatttcatttagtaataggaaatgctctctctggttctggcttgcaggatgcatcacaaataatcctacaaatgcttttttccttttcattaaacacattattttagctacgaagacccttatctaaacaaaatgcacctgccaacaatgacttaatttcccaagttgctggagaaagttgatagagacttgcaaac

SEQ ID NO: 1547 - DNA, 600 bp, Bovine  MMBT16972
tttcatgttagtgtttatcaaaatgttctattcatttaggttgttttgagcaattgtgtaatactactagtcaatgtaatgataacctaatccagaaatcacttagaccctatggttacaggaatttttaaagtgtataaatttaaacttttatacaaatgtttgatagattaaaaatatgatgggatattcagtaaaagatgttcaatcataaacatgacactagcataaaatgttgaaggggaagtagaatgggaataaaatttcaaacatggaaggcatggcagaagtagagggaargcaggaagttacatatagtttttgcttgctaaagagaagcttgtgggtttatttcttaaatggatgatagtggatagcaaactgttacaagatttaaattccatttggatacatttaaaactgatggttttaattagatactgttgtcagctattaattgccataaagataagactaaacctttaaaaaaaaaaaactgatgtaaccatttaattttaaaatgtcaatgtttacaatatgctacaaattatattctttgcacctgtttaaattatgataaaattataaatatcaaatttt

SEQ ID NO: 1548 - DNA, 600 bp, Bovine  MMBT12697
agtttataaatattttcaaattctttcataatttatttaatcttaaagtacaaattgaagcaatttttgactataaactgactgggaaattgagatttccaaggggaataccatcaaatttataaaaacaaaaagatcagtattctagtgattcattttcaatatattctctgcattgttaattatggctgaactcaaagtattttccagtgtaaattatacacaagacttaacaaatagagagacctaaatctgcaactccctttacagaaaccaatgaaaaatctatacacagcgatraaattggcatacaaataaaagaactgtcaagacatgtatccctaaaaataagcctacaataactattttaaaggctgtgtgtggtctcacccatatactttggcaagatgcactttctccaaccacagctagattcatccgaatgcagtggcactggagagcctctgtctcacctgtcaaagctgaagaacgtggttccaaagaccaccatgagtccatggagaaaagccacagcgctacagctgttattgataagcagtctctacaggagaaaacacttcaaacaattatagcaaccca

SEQ ID NO: 1549 - DNA, 600 bp, Bovine  MMBT14763
gaatattcattggaaggatggatgctgaagctgaagctcccgtatttggccacctgatgggaagaactgacttcattggaaaagaccctgatgctgggaaagattgaaggcaggaggagaaggsgatgacagaggatgaaatggttggatggcatcaccaactcgatggacatgaggttgagcaaactccgggatatagtgaaggacagggaagcctggtgtgctgcagtccattgggacacaactgagcgactgaacaacagcagaagatgtctcttgtgcacattatratttaggaarcactggagctggactatcaagtacaaaaacttgccctaagccacagtacttctgactcttttcaccattttatcctctcaagatattgactgtggacaaaaagacaaactcaaaaccctggtttatagcagttttacataaaactgtgttcctagcacacaaagggaagtgagtaagaggacaaagaaaaccagcagcttttgaactttcaccccttctcagaattcttaaaaattcagacagctgtcctctaaaaggcattttctctttggcagttgratctttgtagtctgacttgtg

SEQ ID NO: 1550 - DNA, 600 bp, Bovine  MMBT17695
gagctatctgccacacatttcagtgataatttttgtgagaaagaggcagattgcgagtgatggatgaggtgagctgtgacagtccaggacggggtgagtcagggccaaagaatgtgggcgggtgtgaagtggaatggatgggggaggtttgtcttctctgctcaactctgatcctgtttagggaaatgcgcagaaaggaagggccctaaatgcattgaaatgaagtgtaagtaacttctagacaagagttatcaaaacccagcctctatgggcaagcatacttcttttctgtcctgcctrcggaaatgcagccaattctacaatcaattaatatgaacagggtayattaaccatgaatgtgaacccaacacaccaaatgtaaatccggttacatatgatctgaaataaagggtatgttctgggcttcatttgcatcaccaacataaaacaagcactagaaggtaggtgccacctcatttatttgacatcttattataccagtagccaaaagagcttggaatatagctgtgtataagtctcacccctttgcctttgaaataatcaacttctattttttttaaattttgtttatagcaaata

SEQ ID NO: 1551 - DNA, 606 bp, Bovine  MMBT12632
  misc_feature (1)..(6): n is any nucleotide
nnnnnnagtaactctgatttgcttcacccagtagctcttagtacacaccactcttacaatactgattatactctactgcaatgccatcaaataaaaatacacatgccacaagcataattttaaatgccccaatagcctcattaaaaaggcaaaaagaaattggtaatttttaacaatatattttacttaaccagatacatscaaaatattatcatgtcacatgtaatcaatacaaaaaacaagatattctataatttttcatattagttctttgaaatccaatgtatgttttccctttacagcatrttttagacactraggtgttatcaaaaatagttgatctgtatttagttgtcataaaagttacaactgaaaaaagtagattcacacacccaagttgttcyaaatgaacttgagagttttataataactgcatcaaatatcaactttatattttaagttaaaattaacatccaaaatcagttcctcagtcacactagtggctaatggctatgaggttggatcatgtagctctatggtaattatttgcatatacatttgtccttcccactaaatcagactatatctaatttacctatatcctcc

SEQ ID NO: 1552 - DNA, 600 bp, Bovine  MMBT16326
tacctctgttagtttaagagctccttgaaggaggggctgctttcaacagcttattatcccatcctctagggggataatgttcatgtaaaatgcttcattagctgaaatctaaatgtggccacttttttatcattgcaaacagtgtctgttgacattaatattcataagaagaagaaataaagcctaatcagctataaatgaaaacagaaattgaactactcatatatctattcccacttagaatcagattgatagaaccattttctagttctgtttgaaatagaaatctggccttggaaraaaggttctattgattgtgtttttcaagtagtagccatgtatttgaacttaacttacatgctgccaaatgatggagaaattaaaatgtctgtttaaagacaaatatacaagattgtgatttaggtttattttaatgaatggttgcttatattttataatcccagctaacgataaataacaaatcaatgatagtactgaaagtaagcttcttttatctcattttaaaataatttttatgttttattttgactaatctagtatacaatattctatacatcttatgttggaaaccactgatat

SEQ ID NO: 1553 - DNA, 598 bp, Bovine  MMBT15537
  misc_feature (1)..(119): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtccccagagcccacagctaggaagtgtccaagctggcatttaaaccaggccttccgatttggactcccttgcccaggttgctaaatacctgctgcttcaccacgggtgactatgatctgaagattacttggtgccagctgaggccacctgctcctcgcttccccaaggcctctgccmtactyggaaggacaggtgtgggatgtggagatagaaaccagctagcctggtgctgggcaaagacctgcagtggctctggctgtgaagwcaagggcagacccyggakagaacgtggggcgtccagggaggatccaggaacagcagcacagggacagcattcggttctggcaggctccctggaggagttgccaccctcagaggaagttcctctgcccttcttcctgaagttcctaacctctcaggggcctggcgagcctccctgggggtatagacgacatccccaggtctgtactcaatg

SEQ ID NO: 1554 - DNA, 600 bp, Bovine  MMBT14564
aaaaaggaacaagacaagcagacacaattaactgcaaaatatcaatggtcaccactgagagctgccccgggctcaagacattccgtgggggccgaagacgcacgcagtggctgggggctcagccaagccactcagcytgagattctcgttgcggccgggtgggtttgtatggacaggcttgtccatctgtaacttcattaagtgcttctttagtgcttccccttgcagaaccttataagaattcagctggcaaagcagacttgtggtttgcagagtcctactgcctgcatcattaaggcmgattgggaagaagggatatgagtttggaactgaggggcaagaacttagggtttggaactaagggcaagcatttaayaacttgttcgagcaaaccgctaagaaatagggtgttaaaaaatgctgcctcagatctgttttgccgccagtgtttatgtgattttcgtagggtgcacgcatgctaagttgcttcagtcgtgtccgactctttgcaaccctataaaccatagcccgccagtctcctctgtcggtgggattctcaggcaagaatacyggaggagattgctgtgccttcctccaggg

SEQ ID NO: 1555 - DNA, 600 bp, Bovine  MMBT17198
atgtaatgggtctgaacctcagtctgtttttatacaaacacaaagaaaggaattgacatttgcaacagatttcaatttttttgaaaactcatcatttggcataatgattgacattaaaagaatgccatttaactcttggctgaatgaatgatctattattattatagatggctctataaaacattggaaatacacagaatatatgaacacagtrcaatatcagtataggtgagtgtgagtggttcagattctgatttattatcaacaattgttctgttgtttcccagcaacaactatagmctgaactcttgggaaagcrcttgttatacccagtttgacttccaggaaacttactcagtgaaatgatttgagtaactagggcaaaggatataattattggtatatagtaatttgattgacctctggcaccagagtatttgtattaaatattttcarctggagcctgggtttaaatttcttccagtttgtctgcactcttgcccattttgagtgttattaaaaacattgaggataatcaagtggaaataaaattttccctaaagattgatgtcacatttgcttgtttatgytttctcttgt

SEQ ID NO: 1556 - DNA, 600 bp, Bovine  MMBT17807
gtttttggattacattgtagagattcattacacataatggacagcagtaatttgttaattggttgcaaatattattgttcagcttgttttgtttatgataacttycatatttttatataatcaaatctatcaatctttttatagctgctgggtttcatgacttatttacaggatgatacaattctaaatgaaaaagcagaacacaaaattgtactttcaatattctcttaattatgttacaactgttggagagggaaggaagaaagacaggagggagaagggagagttgggaaaagctamaagattacaagtctaggtgatatgttcaycaatgattttttcttttttgtactttctaaatttttttgtaggaattacatattaatttgataaccaggaaaaagtcataagatatgtatttatatattttggctttagtccttttctttagtctctctactctytcaggctataattcccaacaaagatgtgtagggaaagtgatctactggtaggagtggaaacgatttattctggaaaccaggttgctagggcatgttgaaaaaaattgccttacttccttagggaatgtgaacattt

SEQ ID NO: 1557 - DNA, 600 bp, Bovine  MMBT06083
atagcttggtacttagaagccggctcttctttcaagttcatgtatgtgctgtcgagcaccgatgaactcattccaccaatctccatgtaattactgtcgccaatctgaatgccagaactgctgtgtatggtatattttgaagactcatctaattagaaagaaacacacagagattagtagtatatctagactgaaaggaagagaaaaaagtacagcctggtaaaggggcaggactctattccaaatgcttaagtaaaattatttatcctatgccaccacttgaaattttcttctttaaamgttggctgagagggaggagccaagatggcggaggagtaggatggggagaacactttctcccccacaaattcatcaaaagagcatttaaacgtcgagtaaattccacaaaacaacttctgaatgccggcagaggacatcaggaacccagaaaagcaatccaactcttcgaaaggaggtaggaaaaaatataaaagacaaaaaaagagacaaaagagggagggacggagttccgtcccgggaagggagtcttaaaaagagagaagtttccaaacaccaggaaaccttctcactgccgaatct

SEQ ID NO: 1558 - DNA, 600 bp, Bovine  MMBT07928
agtctctgatgttatggatttgactactcgaggcatcgcgcgtgagtggaatcaggcaatacctgtctatgtctggcttctgtcactcagcatcgtgtcctccaggcccactcctgttgtctcgtgttayasaatgtccttccttttcacggctgaatattcctgcactatatgtacacgtcacacgacgtggggcaggaaacagcccacagggggcagcttggtgagaagatgtaaaggggtatcggctgctaaccctcacccggccatcagccacggcggccaaccctggcctgcgcmgagaagactacaggaaaccagagacaggctcagccagcgctccacccgtcctcactaagcaccaccccccacacaagggagagccagggtaggggccgggctgccccggtgccactgtggatgtttctcccgactcttcccctccaggaaaaaaaaaaaaaaacgagttaaaaaaggaaagctaagacacagccctcagaatggcagaaacatgcttcccacacaaatatgcagcaagaccattaatgagacaaccatcagattgacagagcaggttcaaagaacaatgcaagaagctgg

SEQ ID NO: 1559 - DNA, 598 bp, Bovine  MMBT17678
  misc_feature (1)..(211): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgtaattcttggcacagggcctggcatttatagttgctcaataactacttactggatggatgagtggacaaacaaattgaacagkgggatggacagaaggaccaattaataaggagcaactggaccatttttttcggtcaccaccagagggcagcaccccacaaccaaatcacccaccttggttaggactgccagccctgagatccttggtccacacaccctgggcactgtcttcccagacaggagggcagaccacagaggaaaggcaamacccacacagctcctggtagccccaggtgcacttctgggcaggaagaagccacaggtgcaggcctagcacatacccagcatgccgatgcccagcatgaaggcgtccatcccgt

SEQ ID NO: 1560 - DNA, 564 bp, Bovine  MMBT18297
aagtggaagacaaaaacaaggaaaagaaattccagttcctcctcgtcaccctcccactccacttttggcttgtatccaggcaaccagctgaaaccagctgccggatatactcctagagcctcatccgaggtcccaatcagctgcaggaggcgggcagaggaaggatgtgtgacaatctggaagatcaccctccaactcttgtcccttcactcactgtccaccccaactgacatctgttttctgaaaagaaatacaggagggaaagaaggagaaaatttgcrtgttggcattcagcttttkcttttgtagactctggatgctgagtgggcttgattggacaagcagatgatgtttggatgatggacttctgagtctccatcacttgctgggcctattgtacaaccagatgcccactcacttgctacagaagattgtaccaagctcaatgccttcgttgtaggctgcagacctgtaaaggtgtttccattatttttctagagaatttgttgttgttgttcagtcgctcagtcatgtctgactctttggaccccaggactgccgcag

SEQ ID NO: 1561 - DNA, 600 bp, Bovine  MMBT17497
aatgcaagattggttgctttcatcttgggcaggtactttccttttctgggtgtgtttttctttatgaataaaataaaagaaatccgtaaggtaatcttcaaggtctcttccacctctgacactttgggtcttgttcataaaattcataaattcacacctttaccctagcatggggttagagaatacttctaagaagacatgatgtttgaggtgggtctttaaggataagcaggaggaagagaaaggctttccaaggagtgggatcaacttgaacaatggcttgcagaaggcatgcaaackgggggcaaagaagggatcaggaggggaacaaagcagtgggagacaaggctgcggggatgtccgaaggttgaggagctgggacttcatcttgtatggcaacagggagcaggaaaggtcttaaagcagagttgggacttgatctgatctgtttccaggagcaaatagctgttcaacaaaggagtcttggagaaatggcagtgggtttgattttgtggctttgtaagatatgaattcagtaagtttgtggttttcagcttgaggcgaggaagttgctgcagccctttgggttcagcacactgg

SEQ ID NO: 1562 - DNA, 600 bp, Bovine  MMBT16826
tattccagacgcagccggcgagggattattggatccagacctgcggctgcttcctaagaccagccctcactggtccccgcccgcccttcaggagcaccgcccccagcccagcctgtaggggctctctcagctggcagccccccacgtctcctcctttcgccgctccaattcccagctctgctgtggaagtcaggcaggacaaccaccatgcaaaccgcaggacacccaagttgatcctactcgacgagatttttagtactttattacgcgggaagccagcctcaggggtaacagactatkaacaatagcaggcgctcggtggggcagctgtacgaggctgagggctcagagatttcccggaggggctgtcgggggagatgacccttcagacgaagctctgtcttacacatcagattgaaagaggagagaggaatggaatccaagacgctgagctacgatgttcagaaatcatgtgcgtgttcccgacacaagtggagggctgaagggagtagctgtaattaagactgtcttctaagcttttaattactattaatgtggagacttataagactgagaatatatatatatatattttttttt

SEQ ID NO: 1563 - DNA, 600 bp, Bovine  MMBT15422
caagggtcgggctgggccgggctggactcctgcccgggggtgtggagaggacacagacggcgccctgctgagtgagcgcccggcaccctcacggggcagcagggagcccggggagggaaagccccagagcgctttgatggaaggcaggcagggcacccagaggggcgggagacacaggctgttcacttacagaccccagaaggcgcctggggcggacgccgagtcgggcagggcagcccctgtcctgggacaggagcgagcagtcattatctctatggtcgctgcagggaaaccaaggtkggggacttgggccacagtcagagcctgttctgatcttgaaggctcagctctgggggtctgagcacctgtgtttaatccgtgtagagtttgtttgcgttccgtgtcatagtatgcttcaagcatagctcagttgcaacgtgtatgagactgtcgtttacaccagggattgcagttagtactaaaccgtagcccgtcgtccaccgtgatcactcacactgcctacacgagagcccttgggcagagcttggcaacaggacggcacactggagaaggccgggcagccgcttggacggccgtgtt

SEQ ID NO: 1564 - DNA, 598 bp, Bovine  MMBT15457
  misc_feature (1)..(138): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtttgattgcacagaaaccattataaatcagtcacttgcagactcatatcaaaacctggtcagtgcgtggcaagtggcaattaagctgcatccagtggcaggctttgtagtggcaagtgagttgatgtacttcagttgtacgggcatctggtataggkgcacaggtgtcagaacctgacacttattttggtccgtgcaagttccacccattattttacttacctcttctatctgtgcctctgtcccgcaccatgcacttgtctcagtcacagtactggtaagcccacaggttaaccctagacaaaatgagtaagaaataaatgtcaccgggagcttctttgcaaagggggtaagacccagtgagacagcagaagactccccaagactgccaacaaaatgaaacctgcattgaaaagaaaatactgactcctgcttaaactgtggcttcactgcaac

SEQ ID NO: 1565 - DNA, 600 bp, Bovine  MMBT15736
ggactttgttataaatggacttggttttgtttagttggttatgtttttatttggttaaaaaaaaaatcttgcaggatcttaactgaggactccatgttagtccaaacaaaccaagaaagggcagacacgatggacgaagaacctgcctgcccccgcacgtcaggtctgcctgcccctgcacagcaggtctggcttgaggtcctgcttggctgcagagcccttcagtggataggccgtcacagttacccccgtttctggcgtgcctactatgcaccagccctcctggtcagccctctatgktccctcctttctaatcctcccaaaggctgcatgaggcaggaaatgttgttgcatcgttttaaagatgaggaaactgaggccagaaaggtgaaggcactgggtgcaggtcacatagttgggaggtggcagggatgtctttcaaccatgtctcacagccacgcaggctgaagccagatctgcccacaacgtaaccctcacggargctgcttggtcactgagttttctgggacacagaaccccgtgtgtgccagccagcctgcgaagccacccagtgagcgactctcctctggtaccagatag

SEQ ID NO: 1566 - DNA, 592 bp, Bovine  MMBT15562
tctctccccgacatggccccagaggggcggctgtcttccttgtcacaagcccatgaggcaggtcttccctttgagctggagaaggcgtgcatctagttcacttccccgagaagtccatgctgtctcaatagcttgttaagtctctcaatttcttgttcctgttattacaaaagcagacaaataaccgaatttaccttctgagcctccccaggcacgtggcagtcatgcagtgagccccaggcacatactgggccccagagctgaatgaaaaccacgcttctaatggaaatcactcagtckgggcccagcagtgacagcggaagaggagacactggaagagggggttcctggcggagctgcagggcggagcagtgcctgggctgaatctggaaggacaaggaaggcctgtcccaggggagtggggctctgggctaacggccccacgagagcagaggcctggctgggagggaacaatctgtaaacggggtgttttcccaagcgccttcttaccttctcagagcagctgaattcaaggtgctggatcttggtggccagttgtatgtttatctgttttaaccttaacagttgccgt

SEQ ID NO: 1567 - DNA, 600 bp, Bovine  MMBT15106
agcgtgagggcttccctggtggttcagtggtaaaaaaatccacttgcccataaaggaggcatcagttagatccttgatccaggaagatcgcacatgctgcaaagcaactaaccccctgtgccactaccactgagcttgcactccagagctgggagctgcaaccactgagcccatgggccacagctactgaagcctacacatcctagagcccctagtcctcaacaagcaaggccaccacgagaagcctgcgcacagcatctagggagcagcccctgctcttcacagctagagaaaagcccktgtagcaacaaagacccagcacagccaataatgttggctattatattaaaaaaggcaatgtaatgcaaaacgtggctagctgtgcaggtaacagctgtctgcctgtgctgctgactagacgtggaggacaaagggtactggcctgagagcayggaggctgggctcctaccagcagggttrttctgaacgaactccttataacctttctggatctatcctgatttcctcatctacaaaaaggagctgactagaatcaccagggttgatctctaaggttccttccatgtcactaattctata

SEQ ID NO: 1568 - DNA, 600 bp, Bovine  MMBT14138
ccgtttttcttgttgttgccaatttaaagagttgaagctaagactttttgttttgtagtaagaaaagtgttagtttctcagtcctgtccagctctttgcgaccccatggactgtagcccaccaaactcctctgtccttggaattttccaggccagaatgctggagtgggttgccatttcctactccaggggatcttcctgacccagtgattgaactcaggtttctgaactcgggtttcttgcatctcctgcattgcaagcagattctttgctgtctgagccaccagggaagccyctgtaktaagaaaaraggtgttaaaatactttgatcctcaaaaacagtagtgaaaaagtgattcaacaaatcatttgttaaaatgattccgagtgaatctttaaagaatcttcagactaaattaccctttggttctcattatctattattagtattttctttttaaatttctttctagttactttgtgatttgtccaccttggattttctcttttttttagtaaaatgacgaaactggaggaacttgaagagatcgacctcagtgggaataaactgaaggccgtgccgacgaccatcatgaactgc

SEQ ID NO: 1569 - DNA, 600 bp, Bovine  MMBT16286
cctaccaggctccactgtccatggaattctccaccaagaatactgaagtaggtagctatttgcttctccaggggatcttcctgatctggggatccaacccaggtcttctgcattgcaggtggattctttaccatctgagccaccaggtaaacaactaatacagtatattctcagcttcagacacatttccttgattcatcttcgagctgagactgggaccgtaaagacaatttgaagaatcttagaaatatttaaaatgttctttgrgaaytaaaaatgccttacaaatactccttttkkggggaggaatgtattatattttgccattcagtatacagtatggggcctagatgatactctgattagagtatctcaactgcaaacaatrccttatttgttttcttgacaacactcagagttaagagtgtggttaaatawaaccaaacatagccatctttctcaggggtaggcataaagccctggtacaagggaaacataatcaattatcaagtcaggatcccttcaagaaaagcagaactgttcagagcattgttgtttagtcgctgagttgtgtctgactcttctgcgaccccatggatg

SEQ ID NO: 1570 - DNA, 600 bp, Bovine  MMBT17322
tctcattggctgaactcttgccaggaaagaagaggaagtctttcttcttactggactctgctgtcatggtaggacatgagagctcctccttctggtctcctaactctattttaattaacatttttgttaatttttacacctagtttatggcattactattctaagctaatcagtagcaaaatcctccctttaactctgcagcgtctctagattatgcctctccttgctactcccattgctattccctaaataaaggccttcacctcgtatttggagttttttcctaattaatctccttakttctactcttttcccactcccatgcatcatgtatattgacaccaattacatttctgaaatacagatgtgatacttcactaccgagactgcaagctcctaaaggaaagggaatatgtttttttgtttttgtcttcctagcactaagcagagcctacataagcaagctcttgaaaaatatgttgttgagttgaattgtcttgctcaaaagatcttctacagcctcctacatcatcaaaatagagttgaccacagctgattcaaactcctccacaatttgacccatagcttagctgtgtctga

SEQ ID NO: 1571 - DNA, 600 bp, Bovine  MMBT13640
cctgcgtggtggggtcctgaaatggactagggcatatacaccaaggcatcacaaacacagcgaaacagatgaaaacacacacagataccacgaaaaccgtctgttgatttgcttcatcttggttctttcttgcccttctttctcagctcacaccagtgtgcagtatagcacggagatagagaacatggaccgggtcaaactccagytgcaccttggcccagccacttgactgcaggcaattcatttgtctgtctgtcacttgggttctccatctttaaaatgatgacgaataacgataakggccacctagggccactgtggttgtttaaaaaaaggtaatactagtttgggcatcattatggcccaccatttggattctaagattcaaaagarcaaaattttagaagatctcaaagatgatctaactcagatccattttaggaaacaggagcttagagaatttatgtgatgtatccatggttacacagctagttagccatgggatgaaattaaaatccaagtgccctgacccctggaccagtgctttttaggggaggggggagatgggaagaaggatggtgaagaaatatactaataggt

SEQ ID NO: 1572 - DNA, 600 bp, Bovine  MMBT13775
gggcatgtgtatgcctgcagatgagtgtgcatgtgtgtgcatggtgatggcaagtgtgttgaaagtgatctagagtctagctttttcagaaagatttagtcacatgattctgaatactccctaactaggaacactgcattacaatttattaccttactgatgacccttcaaatgtaataaagaacccagtaaatcagaataattgataattcagggtcatttgaagttcagctccacattatgtaataatgtgaaaaaatacatcgaggtaaaatttacctttatacagaatgatgtatktcggcacttcagaagctcccatttacaatcaacarcagaaatactacgtaactggagactggaattcagggctggtattctagcatgattaaaaataattcccacrtttattaaagctgaatctaattgcttatactgtaaaatttagatcgggggatgatatgcattaaaagtaatttatgttccagaactttcactaattcagactgacataacttccagataattcatacttgtgaagttttttaatcaaatactcaaagtaacagcattaccattgtttattaatattgaatgagc

SEQ ID NO: 1573 - DNA, 600 bp, Bovine  MMBT16992
tatgagcaaaattcctgatttaaaacaggttaatttttgccctatttgactcagatctctttatcctcccttcttctttaccatccaggaaatctaacccatcttatggaaacatctctaatcatttcctatcaaaatgatctcttttccaaaactcttttttctcctaattctaatattcaccaattctacattttatctctcatccaggataggtatgagaaaatcatttaatgtaagggaaaatatgtaagtaaagctaaaagtacgggaaaggaaaagttacatggaggagacagkgaccaataataaataatatgcaacatttacaaacattttacttcattctgggcttggctctgaaaattaacttggataaactcatataactctgaaaacaagtccatgaggtaaaaactactggtcccctcattttacaaaatggagaaatttttggaaggtccttaacaccatcaagtctagttcaytacaatgtctgctggggaatgcatctgatggtcaaacagtgaggagtgtgcagggttaaatacaggtgaacaggtcgctttgtggcagaatttagaacccttaaaaaaagag

SEQ ID NO: 1574 - DNA, 597 bp, Bovine  MMBT14023
cattaccatggtgacattctgaatgaggacaaaattcacgttagccttgtttttctttaaacgtcaaactttttattttgtattggggtacagccaatttaacaatgttgtgacagttccggtgaacggggaagggacttagccacacacagacgtgtatccatttcccccccaaacccccatcccatccaggctggcacataacactgggtagagtgccacgtgatacacaataggtctttgttggttatccactttacatcagccttttagcaattagattttgccaagtcaaagtakggaactttyataacttctatcaaagagaaaaaaagtggttctcagggggctggggggaagggaggatgaatgggcagagcacaggggctttggcggcagtgagaatactctgcatggggtcctaatagtgggtacaggtacacattcatgcaaacccacagaatgcacaagagcggggtgaaccctaatgtcaacttgggactccaggtatagatgatctcgtgtatcccgtcaactgtaacaaaggtgccatccgagggggttgctggggggctgtgttgaggcaaggtgtgtgtg

SEQ ID NO: 1575 - DNA, 600 bp, Bovine  MMBT14654
agagttgccatttattggcctaggataggtctgttatgggtctcgacttggagataaatatgttacctccatcaagatatttaccctagaagagagttttgcttctctattcttcttctcagcaagggtctattgctgagaccttggcactttctttttgttcacttctcctgcatagcttcttgctgcaagagtcactccatttcttcatgttctttggcaaattttattaacagggcaaatcacagaaattctactttgccaaagtaatttttcagtataagaactgcctttccacakctcttttttttttttattttcaccacaaatgaatggttttcgatctaatcctttctaaagataacaaaaagctgctcagagaggttaagaagtggttatagtggcacagctaggctgggtggggcatggcctcagacccaagactctcctcttctccaagtcctgcatcttaccccggcagcacatgctgatgttgaaagagcttggccctcgctggattttaaacaggcattattacattaatatctttaagtaccttaattaggtcttacaggaaggaaaagaattatttggtcacca

SEQ ID NO: 1576 - DNA, 600 bp, Bovine  MMBT12619
acatggtacaggtataagattaagagatagaaactactatgtataaaatagataagcaacaaacatatattctatagcacagggaattataaccattattttgcaataacttttaatggagtattatctataaaaatactaaatcactatactctacacttgaagctaatactgtaaatcaactaagtcatttttttaaaagtgtgatctcagaatctcaagaatttaatgccagccgatatatttgacacataagccaaaactgattcaccatttctaactatagaagtttgtcaaagktttgcagaatcttaaggaaagatttctgtcacccatgtagtttccacttaggagaaagtagagacttaggcaattatatacaataagaatagtgactactttaggctttgagcttgctgcagaactcctccattctatattctttacatwattcctcaggagaaatttaaaaatgagatactagrcactacagattaacttctgaggattgtgtactcttaccaaagagtttttattttagctctttagtaatctgaggctaatgattagcttgtagaagccagcctacttcagcaaaag

SEQ ID NO: 1577 - DNA, 600 bp, Bovine  MMBT14658
gtactgagggtaaattcgtcactcagccctgttgaccttggcttccttccaaaagcagactggctctcygactgttgccattggtttgtaatctctgtttacctctttggcttcttggatgactagaggggtatgacctggattagtaggcagttgagtgtctcagtttggttatgttgcctcagaatatttttcacacgagtctgatgaattatgatraattatctaccatgggggcatgtgtagccatgggaggagttctcctgtgagatttgaactatctctccacagacaagaagktcactctggttgccagctagcactctgtggcacacggggttttggtatgatgagtcatcttctgtttatttctgttgaaataacttcaatccacagttgcacagttgacttttaggctgtcctctctttcctatgtgaaaggttcctatatgaaaggatgatgcttggtccttcatgactctttcactaaaacacttcacctaaggctcagagagaaaaatgttagctttgggcatcattcttcaacggacctaaattttattgtatctgacaatgtagtataatgattattctgagtat

SEQ ID NO: 1578 - DNA, 600 bp, Bovine  MMBT14920
agtaaacccttgcatttacaaaattgactgaagtgctaaaatatttcccataaggtttatttaattgaactttctttgtgttgttgagcctcattatttgtacattctggtgagtgaatgtgtgctgtctcaaatttacttgtaaattcaaaatcacttcttacaacagttgcatagccatttagagacatgcacggagctgcaaaaaactggagtttgctgatgcgagcattcaacctgtggttgattaggtggttcttgtcttcttgttttctgctctcataaacaaatgtcctcttkgcactctacttaatgccacattttttgcatttcggtgctttttgttggtgataatattgtttaaaatggcccccaaacatagtgctgaagttttgtctataatgttctgaaatgcaaaaargctgtgatgtgcattatggagaaaatatacatagtrtttttgctcaggcatgaattacagtgcttttggcagtgaacttagtgttaatgaattatcaatatatatcaaataatgtgtctttaaatagaaacacacagaaaacaaggttagatattgatcagttgttgaaaatgttgtga

SEQ ID NO: 1579 - DNA, 598 bp, Bovine  MMBT23168
  misc_feature (1)..(125): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagggctgtgtgcacaagagtgggaagagcaaacaactgggaaaatcttgtaaatgtctattgtcagtgaccgatgctgagtgaatgaataatggaggtttggagcatgtgtggaacaggaaacagagtgagacagacttgttcaggacatgctgctaaagaggaaaagcaggkgagagatgctcatattggtaccctgtggatgtgtgtaaatatagagaaaaccgtttgcaataaaacacacagaactgccctcagtagttacatctggagagggggaggttagtgctgttctgtacaaagaatatctgacaatatttgtttatttttaaggcagcggcatggatgtgtgtgcatgctaaktcacttcagtcrtgtccaactttgtgcgatcccatgaactgtatgtagccttccagactcctctgtccatcagattttctaggcaagaatactggagtgggttgccaat

SEQ ID NO: 1580 - DNA, 600 bp, Bovine  MMBT15284
ctctcgtgtgtccataaatgttgatcagaaggtttgcaatttatcaaacacaggacctataggcaaagatgtcaaagaggatgaggaggttttaagccactgaactgcttaacgaggaggaagaattcctagtccattcccagcaggccaagaaattgctgatactccctctctactttttaaacttcagccaactgtgtattcttgtacctcaaaacattaaacattacggaagcgtcgtttgtgaccctaggcgtagaagaagttaagcttgaattaaattcaaactcacactggttmaaatgatcagcccgtatgcacgggggattcattctggggggtgggggcacggaggygtgaccgtcactgattcctttgaggtgcgcacacatatgcactgactgggtgtctttgggtctctggcttttttctgttttgggggcattgctggacattctcatgactgcgttggtaaaaggacctgcgtgttttctgatggtgatgctgctgctgtctggaaagcctccagaactcgctccccgggagtgatgacaattaggaagtttcgaccagaagctgggtcagcctggccacgttccc

SEQ ID NO: 1581 - DNA, 600 bp, Bovine  MMBT22355
aaagcaaaaacaaaaaacacctgccacaactcagggcacagtttgggagctgaatctagaggaagggcagaggaagggaagggtgatgaaagaaatgtcagtctcgagaccactgctcaagaggcatcaggacaaagtggcccaggatgatgcctgtgatagggcttgatcagacaccaggagaaggaattctggcttatgaaaggaaggaggacaggaaagacacaggtctgtggaaggattctgccaaaaaagacacatctctgaaccccaaacataaaccaatcccctgcaacatcmgtacctgtgtcaacagggctggtaatagaggatggaaattgccttcaaatctataaacyagcaraagtccttctacaaaagatttgggatccagccatctgtctttggacccaagacaatggataataacatggctagccgctmacagttacatgccatttacagggttcctccatatcacaaactgaattgagtttagaagagataactaaaacatggtgttaaaaatctaaatattcaacagatgattcacatcatctcagagccaaatccaggatctctgctgcttttgcaaaagac

SEQ ID NO: 1582 - DNA, 600 bp, Bovine  MMBT23190
cttccatcattctgatgtttttatcactttaggtgttcatgtgtctaaaaaaaagggaaaagattaaatttcttgtttctaaagtggaggaaattctagtggacattttggtgtccaaatttccagagaagatgttttcaacacatggaaataccatgaagcaggaatttcacggtatttacttaaaagaaaataggcttgctccccctccccaccctgtcaaaccaactgtcccaacagtttctggggctgacagataggagagagacaaaagtgagccctggtagagtgccttttccmagtcccccaagttctctctgctccatccaactctcaagcaggccatatcccctcctcagtaggcatgatggtcatgattcagggtctaccacacctcatctaatggtaaactggctgcagtctagaggttcagttttcatttttcatctccatatagatttacaacagtctctgctcatgctggaattatggtttaaacataaataaaccagctgtcctttctgatttgcagccagagttgccacaaagttggaaaatcatgaggcaggaattttacataaaggtgaagtgggagtttcc

SEQ ID NO: 1583 - DNA, 598 bp, Bovine  MMBT22556
  misc_feature (1)..(11): n is any nucleotide
nnnnnnnnnnnttttcaaagacagattagttcaacgtgtattatagtttttttaactacttcctaagctcagatcttacatttgcaaacatttacacaaagtcattagttagcttaatctcttaagcaatcatactttgcttgggccaatagtaaattttctttttattctgtagcccaagaatacgtcgtggccctggataatccatagtaggtaaggtacacacaaatcaagagtctatgcctgtgatgaagccagaggataatttaagttgcaccatttaccaccagccaaagacamgtgtatcttttggaacaataccttttctgagcccataagtggctgcactgttttccttcaaaccagtcagttaagtgagaatcaatggctggatggcctgttggtgacttcacctcatcttgtgagaacgacttgaatgtaagcaataatacaggaagmaagataatttaagaataccaaagaaacaacaagggaaccacaatgctaattgtctcaagaagccacctcaccttcagtttaaagggtgtccaccagtgcaaggcaaatggtacctgaagagaagtttcaggacccttga

SEQ ID NO: 1584 - DNA, 600 bp, Bovine  MMBT21672
gaatttttctctcacttgttcccagtgcctggattagaataatgcctggcagagaagatgtaatcaatgtgtcaaatgattgtggggggaaaaaaaaaaaaatcccagtgttcccctttagggtggatatgagtcctggttgtagagaggggttcaaacagttcaaaactcctatcaaattccggaggagagaggagaatccaggagttctaattcacacaaatgccatgmagctttcacagggcctccctttcccttccgtctacaggaaagtgagtggtattcaataaccaagttctmaaaccacagctyagtggggaaataaatcagagtccatggaaacggagtcarggagaagtcatgtactctagatcagaacaaagagaagctctggatagaacaagatagggggaacaaaactgcagtaaatatccagacgtgctaaggcaacrctcccagataaaaacaaacaaaactaatcaacccttaagagaaaggaacctggcgtgcagaggaatgataaaacccccactcttaaagaaaacataatccaaagcacaaaacagaattcctcagaaggactttgtgctatgaatcaag

SEQ ID NO: 1585 - DNA, 600 bp, Bovine  MMBT21004
acgaaaccaggagatgagtcacaaagatccaagagagaaggagagagccgccaactacctcggatgctgctgagaactctcgggaaaatgggacagagaggagactctgggcttagcaaccctaagtcagccatgaccttcaccaaagtcagaccagagtactagacaggggggaaggtgtatgcgggtggaaggcatcccagagtaggaagaaactggtaatgagacagtcactgagcagaatcagttaagggtggatggttcttttcagacattttggtactagaaggagcagaaaamcaggagtgattggargaggatgggggtcaagggaagtgttttyagtaggagaggcaagtgcatggaaatgatccagtaagtgaaattgttagtgaggagagaggagacaaatggagggctgggatkcttgcaaaggcaaaaggagatggarcacagagaatcagagacctttgactgatacagggaaactgaacctggcctgaggccagcagagccatgttgaggggggttctggaggcagaagagaatgtgtgatacagccttcatggggaagtgagaaagacaacctgctcaggaaac

SEQ ID NO: 1586 - DNA, 434 bp, Bovine  MMBT18844
tgagtttgtgagatctaaaaaaataaaaattaaaaaattaaaacgtgtatcacaaaacaatcaccacctcaacacatttacttctcttttctcamctattatttcyccaaacgttatagatactgcgtcttcagtaagtaaactgaccaaaggtctattccctattgatcacaatcttttcaagatttagatgactccttttagactacaagtaggaaccgacttctaacttcggttcccgagctcaaagctcggtaaagtggatcttcaaggtttagcaaataccctcagctgaactamagggtacagaatctctagcgctccctacagctcagagtttgaacctacctaccacaaaaaaaccccagttatcaaagattggctacctcgctctacttttcttttccgcttaaaaaatcggatggggagggggg

SEQ ID NO: 1587 - DNA, 598 bp, Bovine  MMBT20365
  misc_feature (1)..(131): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcctttaatatcttatgatatgcgacttggaaatctatgcagattcgtcattttatcaaataattgtttactgggattatttcagtctgtaattgcttctctcttttcccctgtgaaacacgaagcgtcccgagtcctgtgcccagttctcaggaaggggaaacamcagcatcggccgtccctcggagatgaaaggmgcacacggctcgaggtcctcaccctcgctggagaacgctgccgcctccgtctcccggctgatccctaggatttaaagctctgttttgcgcctgagaccaacacggcgtgctgtgggaagcaacccttctcaactttggagatggaggtcagacaggtagaaaggttcctctgagtctcgaaccctggagctgggagcgcagaaggggaagagccccgggaggcaggatttgggggagactggccaggcctctcrgagcacatggctt

SEQ ID NO: 1588 - DNA, 600 bp, Bovine  MMBT20955
aaggaaatggcaacccactccagtattcttgcctggaaaatcccatggacagaggagcctggcaggctacagtccatggagtcacagaagagttggacaygacttggagaccaagcaacaacaataagcacaaccttggatggatggatgaactaatggatagtcaaaggaagtgttacatttccatttagggtctgcaaaaacctaaagaccatcattttccccctctactgggcttctcttgggtctataatgtgaactcagatctgctcatttactggatttctstttcctcattcmtcctcacaagttcacaagaacatgcttctctattctacatgtgcctcattgccaggttccaagtactsctagcttgcctcctaacttttctttccatgttgccatcttgatattctggaccaaggaggctgaacaagagaggatgtgtttcactgatcaagaaggggtcccgaaagggcaggtctactaagatgtagatttgtgtgggcgtagggtgcactcaactgcagcatgctcagaccacctgctggctcagcacctttccaaataagccatatactgagagcctggagattggaa

SEQ ID NO: 1589 - DNA, 366 bp, Bovine  MMBT19873
aatgataacagccataactgctttccactcttttctgtttccccagctccttccttccaggcttggtcctgaggaccccccaggtttgctccctccgtaagtgctggtgccccctccctcccactggctgcaggcatccttctgctcaggaaggcacaggagaggggacatggaggataccactcttagggatgctgaacagatttcctgcacccctaaacttctcttggaggggtgatggacaggagaagtctggcaagtkgtctcctctctcagctttcagggaggaggcagcagctkctgagcctttagggctagggctgaggatggcccccaataccattgggaccccaagtcagggatggg

SEQ ID NO: 1590 - DNA, 600 bp, Bovine  MMBT18878
ctaactaataaaataagcaatagcttatggggttgtaatacatagaaatggctggatggaggagaagaggagaaggcaaggaaaaataccaacaagtggctcaaattaagaactgctccatttccagaaaacataccaggcagttagtcaaattactttcctaacacctagcactggaaaagaatgccgactgaggcagaagtgagaaygtgctgtaattctgcaatctgcacagacatggcaggcctgtgagaatagctgatagccagagggcaatatatagccaatgaaaggaagagmgctaaggacagattcagcctactgagacatcttgcccaaggctccttgcctgttgcccaatcagtaaggccaggcattttatgcattaggtctccatgcccatgaattcagtgacagtaataaactggtttcagagggacgttgaagctaagctcaagtataaaccacagtggtacacagcagtaatattacatgtttcttgaaacacacctgaaaaggcaggaccctgctttacaaaatcatytgccaaagtatgttcttcaaaacactagttctacaggtgttawaagctcttcttcc

SEQ ID NO: 1591 - DNA, 600 bp, Bovine  MMBT21686
aggcgatgaatttcagagatcgtaactcatgtggttgttcacagtagactggtctgggatggtgctcagatggtcctcaggatggtgcactgtggtttcccaaatgttaacaaaacaattcattggctacctccaaggagctccttgctgtggggcaggaaggaagcctgaggttcatagtgtgatcatacagtgtgttggcttcttgagctaaatcttcattctccccttctcgcctccttgaacctttgacccatcagtcttggttccaatctctaggttctagtagagcaagggtamtccctcttcyacgtgataggtattccaagaaagctatcctgttgactggtcctcctcaaggtacacatccccttccctccaaccattcttcacggatcttgctgttgaagccctttgccaacttggcagtcaccttccttctgacgctttccattgtgtggtggggtccttcctaaaacatgatgaattgcaactggctgtcaccttgacgtcagagataaaggcctgtggagaaggagacacaaactctgtgtttcayrtttataaacrgtaacatgtactcatagaagaatattgaaa

SEQ ID NO: 1592 - DNA, 600 bp, Bovine  MMBT20294
tgactgtcgggactctcaagctgkggggatcatccctgcttcagctaatcccattatgcagatggagaaaatgaggctgggcacaaagagttgcttaaacaaatctaggcctcatgctaatgcagggaatggtgctgagtcagtccagcttcctgctgagtacctgacgggagtggtggggtgaaggcagggtggagggttgggaagtggaactgaagctcctctggccagtgatgacttggatcaggcaaggacaatctcagagacctgggctctccccctcacccagtgcaatgtcamatgcaggcttcctgtgggctgggaccactcaccttccctgsctctcctcccaggtccctattgtgcccacaagtggacatgccaggctcaggtccactgggcgaacatctatctgcctgacgttggscagcattcccatgaggccacagccagatgttacctaactctgcagaaggaagctaggaagccagagcatcctggaaagtagccaggagtggggctaggcagatggtgacccagaggaccaagtttgagctgcagaaatcctggggtgaagggaagggggtactgtccttcagt

SEQ ID NO: 1593 - DNA, 598 bp, Bovine  MMBT19002
  misc_feature (1)..(18): n is any nucleotide
nnnnnnnnnnnnnnnnnncgtttgatgtgggcttgaggtctttggtttgaattggctcctttggttagagtcctctgtttctgtcttgtcgagatggtactcatgacaygtaattgctctgtggtttccagggccaagtctgagagaacacctctagattttgtaattctcaatttcttggtttgatagtaatttgtaaaagttatctgcctttatttagtctttccaggatcttcccaacccaggaatcgaaccaaggtctcctacattgcagatggattcttcaccatatgagccacmagggaggcctaaagtatctgacttagttgttcttaaaatatctcagtatcttccttttctacattcctgtttggatcatttatgtaaagattaaattaggtaattaaattaagtacagtttggaaatgttccccagctgactttgrtaaagayttagcttttggtaggaacagagatgagctgcaggagaagttggctcctggtcatggagtgagggggtccttctgtggagctaaagctggaatgcagatttagattttccaggggtctttaaattaggtcagctatagggtcctgc

SEQ ID NO: 1594 - DNA, 600 bp, Bovine  MMBT18873
gttaaatggcaatgtgtatgtgctgtgtatgtaatgtgtatgtgctgtgtatgtaatgtgtatgtgctgtgtatgtaatgtgtatgtgctgtgtatgtagtataggtgtagtgtatatgtacatcatgtatgtgttgtgtgtatgcagcacatgtgtgcagtgtgtatgtgttgtgtgtgtagtctgtgtgtttggcacrtcatgcactatttactcctgctttccagagcgaccacccacatggccccatcagtgctgaatttccggatccttcagaaaccctgtctcccacacccagmcaaataagcaagaacacatgtgaaaagccttattccagtgcctcttgggatgcagccaaacagctggaattatatgctttgtagagaaccggggacgtggcacggcagtaaaaaaaaagttgtttgtatttggaaatcaaattcctttccccaaacctgagagggcaagggagggctgggctgcrctctctaagggtgtgtatgtgtgtgtgtgtgtgtgtgtgtgtgtgtgtagggggcatctttcattaaaatctctgtcttttctagtgttcccccatttacaygtgcatttgcatt

SEQ ID NO: 1595 - DNA, 600 bp, Bovine  MMBT18449
ccctcccccttcctgtcctgctgctggactgggccctcgcctcccttgggttcaggggctgtgaggctttctgcttggcactgagcagtgagcatgcctatggtcctctcacgagcccacttttaatctcattgacctctcgttatactacagcacataaattcagatttggagatcttatgttccatcataaattgggctggcagacttccgatcaacaagataaagctgtctcctgtgaggtgggtgttttattagtcttggcctcagtgctgcaggcagtggaggtggggcgggggmgggaggtctctggaaccctcctgtgctgtttcagatgggcctgatgctgctttttgccatcaygggtaccatggcatcccctagacccccatccccatagcatcagaatgagcagccacagctggacccccaggctaggcacgggaaggtcaatagggagaccccatgtgcacccaggcatgtgtccatgtgtgcccctccccctgtggtggakctttgtgagcttggccagagccagagtggggttcaggggtgggggaggcagctgcacatgcctgggcatcctgagggacaaagggc

SEQ ID NO: 1596 - DNA, 487 bp, Bovine  MMBT19331
gttatctcatttgtatgagtaatatgaaaaacgctgcacaatttaatatgccatctcgtgcttttattcttatctcaccaggagggcaggtggtagtatacatgtttgaaagccaatgcagattgatatgggggagggccccaagaaatgatgtgagctgctatctgagctgagtaaaatgatatgagcacagatattattttatataggcaatctcacttgtatctttgccggtgagatcttaatcacagcatgcaatgggaatggaaacctcccctcctagttatctgggtgtggggmgacagcattgtcatcactgggagaacggttatctgttatttcactcrtgagataccaataggaacagtatgagggtgtttgtaaccaaactgtgcagctctgagtgataaaagcaggaggaggaggctcatctccaggagcgtggagataatgcctcttgctcggggaggagatggatggtattgtt

SEQ ID NO: 1597 - DNA, 598 bp, Bovine  MMBT19620
  misc_feature (1)..(68): n is any nucleotide
nnnnnnnnnnnnnnnnnnnnnnnnnnnnnnnnnnnnnnnnnnnnnnnnnnnnnnnnnnnnnnnnnnnncctgcgggccccaactactgaaactgcccagtagccggggctctgccacgaagaggcaccctgctcgctgcagctggagacccagcacagccaaaataatacacaaaaatcaacagaaagagtgctgaggacattacctctaaaaacagcaacaaacgaagaaacaaaagccacccctccccccagcacttggaggcgtttattacaagactcccacgatgaaattcactcmgtgcggagctcccgtaacaccggtactgggccggcagggtggctggactcaagaggtgtgcacttacctgcttggctgcgggcgcagagatggccttcctgtccagcaggtccagcagctcagccagggcggagggcgtgacaggactggcacccccaaaggagagaagaaaacacatcacttccctttgtcagcatacgcgttcacggttattcaagatcaaagcacgtgactctgcaggcttgaacacgtacctccccacccaggaatgacagtaacaggccaactgggccccgtg

SEQ ID NO: 1598 - DNA, 600 bp, Bovine  MMBT22364
ggtcacatagttgggaggtggcagggatgtctttcaaccatgtctcacagccacgcaggctgaagccagatctgcccacaacgtaaccctcacggargctgcttggtcactgagttttctgggacacagaaccccgtgtgtgccagccagcctgcgaagccacccagtgagcgactctcctctggtaccagatagcagactatcacccaggccgaggccagagaaaggccatgtgcagacccctcccagccacttaaacccccgcccctgcaccacgctgggctagcttcccacagcagmggccaaccctgctcccactgaggccccctaacaatccacccaggatggaaatgtctctgaagaccctgtcttcagagcttcgctcctggactttggggaaggtggttggcccgtgtctaagaaatctgcttaagatgaacctccgctccacccaggggatgacctcggcgtctgcacacgtgttaacccctcagcctcttccctgagcccagcaggctgacacgcgactttcaccggctcttccaccccgagttctctgattttaaccrgctgcaattcagagttgagcaccacaccttt

SEQ ID NO: 1599 - DNA, 598 bp, Bovine  MMBT19265
  misc_feature (1)..(47): n is any nucleotide
nnnnnnnnnnnnnnnnnnnnnnnnnnnnnnnnnnnnnnnnnnnnnnncggctggcttactcctgggcactctgatttgctgcatgactgttttcgtttccctgggatgctgtaacaaaattaccacagagtggcttaaaacaaaggaaatttattctgtcctaatgctagaggccagagtccaagatcagataaacagatctcaggctctcgcagtcccgccagagcctcaaggggagaaccagtcctcacctgtactggtttctggtagcaagtggctccgtcactccagtctctgccmccatctccacattgccttctcctctgtgtgtctcttatgaggtctttagctgttggatttaaggcccaaccagatatcatcttgagatcttgcctcaattatacctgcaaagatcctttttccaaataagatcaaattttctggtgattaggatgtggacatacctttggggagccacaatccagccaccactgtgagtgacccacacgagctattcccctcagggcctaaagtatcaggttcctaaccctgctgagacacagactcccttcaggcctcaatgcctgagagtgggttc

SEQ ID NO: 1600 - DNA, 600 bp, Bovine  MMBT12234
tctgagaattctagcctttttctgatccttcaccttcaaccttcgcgggcatttcacccaataaacctctagcaagtctaattccattttagtgtttactcttcaaaggacctgagggaacacaaatgtacattcacatgcatagcaatgtcctgggtagacccagattattacagtcaggctgcagcctagatcagacagggtatagagaacattcaattctcagcaatctcccaggaaaaaaaagatgttatatcataaaacttactctcaacaccgctactactaatgattaatcckaatgccagaagatgacacgctccccgctgggaaaccaygaytccaactagaattgaaggcacacaggactctcctcagtacgrgctagggtctggcagagagagagtgcagrgttctttcaggccwgtcrgtccagattgcaggtttagaatcagaatgaactgcttaagaggtaattccaaaaaactacccccctttacagtatcacagtcactcctaagtttctttaaaagattctgggatttttctacatcactgagaaggaagaggcattgtcacagacatataagcctatatttt

SEQ ID NO: 1601 - DNA, 568 bp, Bovine  MMBT22871
tgacctgccgacgcaggagacacaggttcaatctctgggttgggaagatcccctcgagtaggaaatggcaacccactccagtattcttgcctggaaaattacatggacagaggagcctggctggctacagtccatggggtctcaaagagtcagacatgacccagcgactaacactactactactacacttggagtgtgtgtatttgtgtatatatgcctgtatgtgtatgtgtgttggagagagagatatagtctcttatcccaagataagataagatasataaaccccatgargcccamcaactgtggccggagccctgcagtgggagtcgctcctgattctctcgtggacatcccctgtggtttcctctggttttggggtagatggggggtcccttggctcaggtttcagggttgggcacctgtccagtggatgggactcccctctacctcacttgtgcctgcaggtatctgggagatctgctcggccgatggccgggataccctcttcctgagggccaaggatgaggctagcgccaagtcctgggcggctgccatccaagcccag

SEQ ID NO: 1602 - DNA, 598 bp, Bovine  MMBT23306
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatggccctattgtggtcagtaaccccatccctacccccacgggaaaggagagtaagactggcagtctgttctgcctgtagctcttcagggtggctgggtgcctatctcttcctgggatttcataaagatcttgggatgaaagtggcagcrattctgttcttgccattmagtctagaggaccctaagctttaatgtctcatttcctgcctgagaggttcatcaggatgcagagctcagatcacttctttttttggccaattgcagctggaacttyatatcccttttattatcctctcctgctacagaatgagtctcatataaaattataagccatctctcgttggccctatttcaggtcagtgggtatgattttacctgaggcatttgcatttagactgccaaacaccatgaaaccccactaccattctgatcttaatttacacccccaagccccaaccaaagcact

SEQ ID NO: 1603 - DNA, 598 bp, Bovine  MMBT20289
  misc_feature (1)..(20): n is any nucleotide
nnnnnnnnnnnnnnnnnnnnccagctaaagccctgagtggagggttagagctgtgtgactttggccagcccagagctgttcctcacacatgcttcctatgggcacctcgctagtagcagtgagttcctgcattcttgctgctctgataggacctgggtttccatccatagggagaggctgagaccctggccaggaggcaggaaagttaccagcatcctgagcctctcaggaacccaggtattctaggagctgactatctctgatttcagatgctactgactgtcgggactctcaagctgkggggatcatccctgcttcagctaatcccattatgcagatggagaaaatgaggctgggcacaaagagttgcttaaacaaatctaggcctcatgctaatgcagggaatggtgctgagtcagtccagcttcctgctgagtacctgacgggagtggtggggtgaaggcagggtggagggttgggaagtggaactgaagctcctctggccagtgatgacttggatcaggcaaggacaatctcagagacctgggctctccccctcacccagtgcaatgtcamatgcaggcttcctgtgggctgg

SEQ ID NO: 1604 - DNA, 598 bp, Bovine  MMBT22911
  misc_feature (1)..(54): n is any nucleotide
nnnnnnnnnnnnnnnnnnnnnnnnnnnnnnnnnnnnnnnnnnnnnnnnnnnnnnatttaatctctaggtcagcaaatacccaaagattatcccagaataattgctctaataatcgtgattttataaactggtgatcagtttaactgagtataatgatttatgaataactatttgaagaggtaaaaacaaggcaatgtaggatttcattttgcarcatatccaaayatgctttttccttattaaccatgcagcaccaaatgttcacygttaacatatttcattcaacatcttagtgtatamattattgatggaatcattttaatagttccttagttaaaattcaagtatgaktttcatttttagggcataaagtgcttgttctggataaaagcatctaggttgtcaatttctcctgtaactactggctttttgtgtagttttacgcagttttagccaacttggctcagttctatattctctgtgttgcgttcagtggctcagtcatttttgactctgcgacaccctggactgtagcccaccagactcctctgtccgtggaagtttccgggcaagagtactggagtgggtagccatttcc

SEQ ID NO: 1605 - DNA, 600 bp, Bovine  MMBT23033
tgaaagtaaaacttgccagaaattaggaatcaatttcccaaaataaaatactttttgttttggtgtgatggtatacagtttttggcttccctggtggctcggtggtaaagaacctgcctgccaaggaaggagacgcaagagacacgggaggatcccttggaggaggaaacagcaacctgctccaatattctcatctgggaaatcccatggagagaggagcctggcgggctacagttcatgrggtcacaaaaaagtcagacaccacttactggctaaacaacaacaaatatggctaaaaamcatcgttttcagtaaccatgtgtatgttgtattgatttttttctgctcaatgtattattttaataaatatctcatgaatgaagaaaaaaaaatcactgctttatgttgyccatatctaccaagggggagaagaagaggaggaggaggaagaggaataagctaatgatgacataggctgctgctgctgctgctaagtcacttcagtcgtgtccgactctgtgtgaccccatagacagcagcccaccaggctcccccgtccctgggattctccaggcaaaaacactggagtgggttgccatt

SEQ ID NO: 1606 - DNA, 598 bp, Bovine  MMBT22400
  misc_feature (1)..(101): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccactgatggcacaggttcagtaatgtgtcagttctcaaattttgaaatattgtgtgataagggattaaactgctgtatttgggaggtaggtttgcaaatcactggaaaatcaaaagagaaatgtactgcgtttttaaaaaaaaagtgcccctaagttagaaaatgttgggtatagcaaatggggggccctacgtkgtcaagctacatgtaggcrtcctgtgacatcaggtttgtatatataatctgtttcttagaatctatacaataacttattgagggccacatcttacactcaasggcttgtctttcactgtttatctgtgagatgatgtatatatgaagcaacacaagttatgatgtggttcttcttccaaagacacacartagaaaaccaagacacgtggacaagcaaacaaaagcagacaccacagtaaaccagaacgacccacagtcatttcaacagggaacaccacgaaatctgctttcctacttg

SEQ ID NO: 1607 - DNA, 598 bp, Bovine  MMBT19789
  misc_feature (1)..(75): n is any nucleotide
nnnnnnnnnnnnnnnnnnnnnnnnnnnnnnnnnnnnnnnnnnnnnnnnnnnnnnnnnnnnnnnnnnnnnnnnnnntgttttccttcattgaaatttggggttgtttgttactgcagcataatctagactattgtctttaaaacaaagatacctgtacttaaaagtactcattgtagtgaaaataggaaaataaaacataatgaataagtaaggcacctgatatgatagaaggtaataaacactatggaattttaagacatagagtaggtaaggagccaaggattaaytcatatttaaagkgaaaagaaagagaggatgcaggttatagaactaattaggaaggtcagctaatyaatgatctctgagtacttataaaactttcttatatataggaagcactcaaaaacttattcatttttacattatgtggctctaatataataaatttgttgactatagtactaacttttgatcttttcatcacataacttttcttaaaaattaagacaaagcctcacttcatagttcagaagttaggtttacattgccaagtttctgaaccttacttatttacttcagcacatacaaatcttattaa

SEQ ID NO: 1608 - DNA, 600 bp, Bovine  MMBT19653
cccaaggatcgaaccctcatctctttgtctcctgcattggcagggaggtgctttyccactagtgcgcgtagcagtttgccgaatgacttgattggtatcgggcaaaagaataaggttggctttctgattttgtttcagttagtgtattgataatctacatatctctagatatctctagatattggtrtattgtgtaatctagatatatatcaatagtttataggcctagtcttaaatcagtttgtaaagcttcagctcttctgatgtgtaatatttaaggtttcaaaagatatgcttatmatctagcgaatcttagaaactctaccttttcagaccaaatataatctggcataggtttaggaatataaacataaagtccttaagggaaaaaaatgagtgtgaaaagggttcatgctccaaatggaatcatgtttctgacatgtctgttctgagcatcggaagtttgattctaattatgataggtttcacatttcagaaacttatctgtaagaatataaatctttaattctgatctttcaagaggccacaccaggttggttgagaggattaggtcatagtatgtctgacatattcaggtta

SEQ ID NO: 1609 - DNA, 600 bp, Bovine  MMBT20911
tggatyggtaacatctggctgaactgcatctcygtagggtcagatgggatggggacggggagtrggggagaaagtgtgttgggtcagatatggggtcaatgcagaggaagtgagcatttcagaagcagtcccaaccagaacatttcctgccgattgatgccaagttatttggaagaaaggactccggctattttagtttataaacccttgataaaggtccttgaagggrgtggctaaatcttttagccattcctgagtagagttggaatttattaattcatgtatctaaaaactaaagtmcatacaaataatggaattgtyctaaaataatgtttaaataactgtttaactttgctcaaatatctaccttcccaagagcagtttgcttaactaagtaaattgaccctggtgccttatgaagagcctgagcagctcatcatctgattccaggaatagttttccagccactgaattatgcatatttatattcagaaaagccattcccagcccctctccgtggtgactcactatcttctgttctcagtcatccccagcttgttagaggagatggtgtttctgaatggtggaaacgtgggagat

SEQ ID NO: 1610 - DNA, 600 bp, Bovine  MMBT20708
gcaatactgggtgttgccttaagatgggattctgtgaaagtagagctttctttctggatactttgctaactgtacgtgtgatttgagacaagcattttaactaacctytgtcttagttgttttttcctcattttaaaacttaataggtggaaacatatggtctttaggaaatcttcagcatctcatgttttatgagtgtatttctatttgcattaaagtttctgatcctcactgttttaattaaaaaacacattcttttatattacaagtctgtatgtaagtcacttctttagaactcamaatgatctttttccaggaatgtaacaatacatttagagattattttgcctaattaaatgtctagcaataacaaaggataaaagcaggagttcagtagtaggaaattgcaaggatctttgacaaaaaaagtttcaacaagggatgcagaagaacagctgtgaagggtaaaaatgagatgaggtttggagaaattttgctggtaaagattctagtgtgtaagcaacattttctgagtaagagcaactcttggaactgtgggtttttcaataaagaaggagaaatgaatacatttgcgcaaat

SEQ ID NO: 1611 - DNA, 516 bp, Bovine  MMBT21979
ttcctgtctcttccccatcttctgcctgaatttgtttttatgggatgacctttggtaccaacttatttttgtaataaatgtttcctgagtttatattttaaattgaaatggcctttctgtcaagtatggtatttataaaagttttctttgatgaaaagcctatgaattttgtgcaaacaacccaggcagggtcttagattagcgataacatttgtataggattttatggcttgatacgatactttacactcgatttatttgacccttacctgtgaatacgcagtgaaattcacattttamtgatgagagcaatgtagggaaggtgacttggcatgcttctgggcactagtgggcattcagcatgtttgctttaaaagaaagttagcaaaggaaaccagcarggtatttaacttgttcgaagtcacccagtaaatagtgcatcataccaagaactgaatttgcttctttaactaaaatattccatatgctctcattgtctactgctgtctttcaggc

SEQ ID NO: 1612 - DNA, 467 bp, Bovine  MMBT23220
aaagaatgtcccatctgtttggcgcagtgctcggagaaagaggaagaagaaacaccgtgaactgatacaggaagagcagatccaggagacggagtgctcagtagaatcagaagtcaaccagaaatctttgtggaactatgactatgccccaccaccacctccagagcagtgtctctctgatgatgaagtaggcaaaatagagatctggaattaagacccaggagggcaacaaatgagttcttcctagcttaggtctaaattgaaagtaacaccttagtgtcctgtgcctattatcattamgtagtcatgatttcagtcccagtagctatcccttccctgttgtaatagagaagtattttgggcaggcagatggtgatatactggtgaataggaaagttgaatgataggcagagtgtgacatgatacacctccattgtttgcattttaacctcagtccttaggattct

SEQ ID NO: 1613 - DNA, 600 bp, Bovine  MMBT20543
cacccctttccttacattttacattttaaagaggttgttttggttgctacatttttgttttctttctacctagttctgcttttctgtcatggcttacaatatcatctttcaaagacaatgctgaaagttctctggggacttgtgttgctttattgagtaatctttgatcagattgtaatggaaatccctgmaggtgatataaaatgtgtacatatatttgaatacataaaatatgtattttttttatttcatccatctttgacatgtctaaatatggacttatttagcatsttggcctcmaaacaacaggctcatcttgggggcatatttcaaaagagtkatgattttaaaaattgatgatgaaaataattggatttataaattctttgaaaatcagggatcctgtctcaacagcartagtaaaaactgctactgaagtatacagaaactgagactaaagatgtataatgtccttgtcctattaaatatgttttaaattgtgttaaccatcatgatattcacaagcttggatggcttaaatgtttactactaatacagttgtttatttaaactgagagataatttgtatataaaagaaat

SEQ ID NO: 1614 - DNA, 601 bp, Bovine  MMBT22569
  misc_feature (1)..(1): n is any nucleotide
nacggacctttgtcggcaaagtaatgtctctaattttactatcatttaaaataatgtttacatttcttatcaatataccatcacatatattgaaattttaaaatattactaaagccttaacaattaaaattatagatattttattcacctaattttacatcacctgaaataaattagtgtcttatattttaataatgaagcacttcactatttgtaatgttagagaaagaccactaatatcaattcaaytccacacttagactatgatactaacattccagaaatttttttcccccttccmagtttttatattctaattgcttgctttagaaactttgtggaaattgccatgtagtttgatgttgttaaaatataaaggttaatttgctcaattgctaagactttaattacaacacatcagttatttagactgtttgacatttcctgtaaattcctctaattaggaaacccttagagactctcacaaaaaaataagaaatcactaaaatgtgttgacagagatagatatatttcctcttaccgaatgagctcagagtgttataaatgtttggaaaaacccaagaattataattttatagtt

SEQ ID NO: 1615 - DNA, 600 bp, Bovine  MMBT19838
aattgctccctgtgctcagtcctgcctcctttcccctctatatacatattgattatgaaaacacttggcattaaatttcctgcatatttatcatccaggggaaggcaactgtgatagtggcagacccgtaactggcaaaattcagagctttagccattgatctttccactatgctatttatttgaacagaatgactacttttctaatgataaagtagagcacatacatgcatataacagatggagattatttttaaaaagaaaacaaaaagacaaatgacatgtttaagtacaataaaamttgaatatacatttaaaaatcagctgatacaagaatgtagataatattttaacattaatgaataataagactgattttataggtttttgccacatggctcagtcttggacacaagacatggagaagtggagtacttgagtttttggtctggaatattttgacataaaatgcccaaagtgtcataatttttcaggcctgtaatacatacattattgaataaatatgtcagattctttcaactagaaatggacattatagattttccagtctggaacccttcactacacagattaaagaatg

SEQ ID NO: 1616 - DNA, 601 bp, Bovine  MMBT20517
  misc_feature (1)..(1): n is any nucleotide
ncacaattttacttctgtgcaccttttctcagggaactacttgagggtttactccaccaaaagcgagtatataaaccaaagaagaagaaaaagaaaacacaggatccaggaaatcagtacaatacagagacaaagggcaaagctgatggggagtaaagatcacaagcagactggagcagctctgaagatccaaagacaataaagtaaatgaatatctgtgtttgaatggactgaaagaatacttccataatttkaagagagtctggatttaacttaatgatgagtacagagaaaacaaagmaaataaaacagaaagtttattagcctttaggggtcatgaaatactgggcagcacaagaaaagccaattttcataagaaatgattcagttcaaaatagccttgtagagttctaatgatgttatatagtatgttgatctaatcagagctataacataaaaatgatgaaaggagtagagaaagaattatgactatatatatatatagacatatatatatatatattatgactatagagaacaggaacaggagtgatcttaattttccaaagacagaagtcactaaacaataactgaaactaaa

SEQ ID NO: 1617 - DNA, 577 bp, Bovine  MMBT21611
gctacagagaacaaacttctttgttttttcagtatattagaatactatttttaaaagagagtactgaaattcttttcattgttctctatacctctttgctcaagaaccagcccccaaagccatatttttttttaaattttttataatatgaaagttagtgtggaaagataatggtagtttgcccttgcaagtattattgggtggtaagatataaaatrtagaatctaaaactcttatgataacctcctgactgattcagaggactgcttacgggaccattattatttgtgaattgattgmaaaaggggtatcctcttacagtgaggtcagagtaaacagtatggaaacacagacccttttataaattgtaaaaggtgatatatcaatatatgtatatattaaatattaagtgtttgcaaagtgccagacatactgtgagagatggtacttattactcctcatcacagaatctctgaaatggaaaatactaccacacccttcatttcagataggaaaaagaggcttaaaagggataaataattttcccagggactcagttaataagtcattttcataa

SEQ ID NO: 1618 - DNA, 600 bp, Bovine  MMBT20086
gaaaagaccctgatgctgggaaagattgaggccaaggggagaaggggatgacagaggatgagatggttggatggcatcactgactcaatggacatgagtttgagcaaactctcagagatagtgaagcctggtgtgctgtagtccatggggttgcaaagagccggacacagcttatcaactgaaaaacacagcactgtccatgtgtcctgttgaggaaaatgtatttacagatgattaacattttggcaaatagaagatgaaggcaaataacatcaaatagttaacaagggtcatcttttmattttgcttattctccctaatttcatttccctccctcctgagaaaaatctttttaaattgtctgtgctttttaatttgatttgggtccctcaaatcaattcagtacttccatgacaacggtgctcaaatcaaatcgtgtgcaagacatctgcccctcgtcttctctggtctgtggtttgttaaacagtaggaagaaaaacagtggcaagagagagatctcaagttgttcagataaggttggtgtttggagataagaacactcagctcttgaacttgagctcagcttctgcacattggggt

SEQ ID NO: 1619 - DNA, 598 bp, Bovine  MMBT20171
  misc_feature (1)..(10): n is any nucleotide
nnnnnnnnnntccctctaaggtttttattctttctcctcctatctcccccacaccccaagtcccagaggaacagaggaaaagaaagcagcaaaaagctctgagaagaaaaagraactgatggtaggggccagccagagagtcggctttcagagctggtgttccaggaggtcagaagcatttctctgtacggtttccctcacctttgtttgtgtgggtgacttagtggcggggaagcagagagattaacttgttatccccatgcagtttggtcagtagctctataggaaggccaataargmggagacagtcccaatcatctgctgagctctatttgcagcataaaggagtaatgagtagaactcttgctattgcacttattccagcaattatgtgtataagaaggatgaggagctgtgggcctaagagagaagggagggggccatggaaatcacacagtgtctcyggggctccccagctgtgtcaggactgaaatatgaatgtcatgcaggttggtgacttccttgtggcatgtacacattatcccacccrtgccacaattaagtcacattcagtagcacttcattattttaattaagc

SEQ ID NO: 1620 - DNA, 600 bp, Bovine  MMBT13290
agttcatggcctgagccacagtcagctcctggtcttgtttttgctgactgtatagagcttctccgtctttggctgcaaagaatataatcaatctgatttcagtgttgaccatctggtgatgtccatgtatagagtcttctcttgtgttgttggaagagggtgtttgttatgaccagtgcattttctttaaattttaaaatgcgatttaaaatacgaaccgcaaaaactattttctgaaaacaccaaaactcaaaagcctgtatcctagttttatatatagatacaaaatctcaatatttkccttaaattttcttgaatgtcttcatagcaatttttccagagacaatattatgaacaactccattattgtcatgggtcattttgaaaatgcatcatttaattaaatgatctaggcaaatccttggagaaggcaatggcaacccactccaatactcttgctttgagaatcccagggatggaggagcctggtgggctgccatctagggggtcgcacagagtcggacacaactgaagcaacttagcagcagcagcagcaggcaaatccttctggctcacagcttctcccattaaaaaaataat

SEQ ID NO: 1621 - DNA, 600 bp, Bovine  MMBT19211
agacctgaaaagtgttatcacagacaacattgcatttctccttgcaatatactttcgtattctacagagctcaggtgatctatcaaagtcagtagctgtggctaatatgtgctctgtcctcccagaattacataaatgcctaagcacaggtgctgaggtttgctgccagagctatagaagtgaaggattttaaagaaggaccttgagcagtggctctcctcttttgtgcacggctttaaaaaggtcgtgttgttgttgttttccctccaccccttcccctcaagaataattaattaatgktgtraaatagatactgaatgctacacattaggaaattccattttaatctgtgtctacattagtttcagggacctacttaatttatattgctgaaaaatgtaaagttgtgttggtcaaatgcaactgaaggacatctcaaacattttcagtaaatttggcttaagtacayttataacagatccaaagggtgtccaggttctttgggcatattgaataataccatttgtggtgccagtgtgtgggccacagtctctgactatcaggtcatagtttttttgtgtagagaggttaactgtcttt

SEQ ID NO: 1622 - DNA, 600 bp, Bovine  MMBT19791
ttcccttcatttcttcccttggtcagcattcatagtttataaaggcagcattttcacatctttgattattccaagtattcttttcayacaaactactacctaaatgtgataatcagttgtcaacccactttcaaaaggccttgccatatggtatgattttattggtcaattccagagtatatattaacttggaaaaaatgggctgctgctaatgggrtatggaatggaaatgctgtcttttgtcactaaggggactttatgtgtgaagttaatgtacacataaatcaacgctgtaaacamaaacaagagaatatcaaaaatttgttgctatcagttgtcacctatatacagatgacattgaagtttattatattttgagaatttgtttccatattcacctttatatcatcaacaaatatttccatttaggcttaaagaacaaactgtttaataaatcaaaatgaatttgatagatttgtacctgaatactgactctgaaattaaaggacgcttacttggaaggaaagttatgaccaacctagatagcatattcaaaagcagagacattactttgctaacaaaggtctgtctagtcaaggc

SEQ ID NO: 1623 - DNA, 600 bp, Bovine  MMBT22115
gtttcctatcaggaagatcatagtctagattaccagcctcaaagacctacctggaggtatagtcagacaccaatttttccaacgtgggacattccagtggattaaataaattcttccctgctagaagaggggaggggaccagggcaagaggggtaggggagtaagggggtacaaattattaggtataagacaagttacaaagatattgtacaacaaggggactatagcctatattttataataattttaaatgragtataacctttaaaaatkgtgaatcactatattgtatacctgtamcatataatattgtacaataactatacatcaaaccagtcaatmctaaaggaaatcaaccctgaatattcactggaaggactgaggctgaagctccaatactttggccacctgagttgacaaagagacaactcaatggaaaagaccctgattctgggaaagactgaaggcaggaggagaagggggtgacagaggataagatagttggatggcatcatcaaytcagtggacatgagttttagcaaactctgggagatagtgaaggacagggaagcagggctacagtccacggggtcacaaaga

SEQ ID NO: 1624 - DNA, 600 bp, Bovine  MMBT20465
tgggttcccagtagcaccaccccggggaagcccccatttctgtatggttgtgccctaatcccggtcttactaactcattactaagagaccccaggcttcttggtgaaatatcagtggacagaaggagggaaaaaaaatgcagagcttttcagccagtgctatgagatttgtagtctggttacttttctcccctgcaatgaaaataaactggaaagagaaaaccgggtaagtgaagtaaaatgatgatgaggtctcgcctcttgatagactatcttcagggaataataatgaaattcacamtggagaatttcatgacacacgatttccatttgggaaaatctttatgctccttggagcaaccagtttaaggtttgtttggagttattttcttcctttttgagggggagagtgaaatgctggtctaacattgatgttataaaatcctgggaaatacataaagtctaagaaccatagcaattagagatggagaaagcccattatatcatccctcaggcccaggggaatcagtggagagtctgtcctaggatagattttctagttctttagtctgttgactttcaaacaactcctgggatgggg

SEQ ID NO: 1625 - DNA, 598 bp, Bovine  MMBT12436
  misc_feature (1)..(68): n is any nucleotide
nnnnnnnnnnnnnnnnnnnnnnnnnnnnnnnnnnnnnnnnnnnnnnnnnnnnnnnnnnnnnnnnnnnncacacataatgattaaaaggaggtagttgttgattagacactcagataggaaggtaaattatttaaaaatagtccctaactctgaagcatcaatttagaacttcrtcaatgtcactgacaaatggaaatgaataaataacaaattttaaaaataatgaaaaargagataaggaaattatatcacttatatttcccagtgtaactttattttacaaattctgaaaattcagckttatccattaaattgaattttttaaacctgtagtagacagtttatcgattaacactgaatcaggtatatagcatgaattgatccttgagagtttatgaatgatactcatcctttgtaatataattaaactatttgaaaatgctttggattattacatgttggtttgcaaagagccttaagcaaatgattccatagatatattttaatgtggcaatactgacattttctttttagttttatctcagcctacactggacaaaatatgttttcactgtgcattattttaagctaccacaga

SEQ ID NO: 1626 - DNA, 600 bp, Bovine  MMBT18658
gaccccagatagctgaggttcatatgaaaggaatgatttcagtgagcccaggctcttgcatccttccatacatagaaaagtgctaataaattccttaacttgagatatctggttttctttaattaacaataatctttgggaaaggagaaggaggtggcagaggatatgatggttagaaaacatcattgactcaataagrcataaatttgagcaaactccaggaaatagtggaagacagaggaaccttcgttgcaaaagagttggactcaatttagcaactgaaggacaatagcaacacamcaacaacagatcttttgatgttcagactacctgttcttgcaaaacttctatgtaacctgattcctccccttgcctccttggagcagttctctcacagttacttgagatgctgtctctcatgcttgaagtcctaaaaattccctccgaataaaacaaaactcaacttttaggttgtgaatattttttaagttgacatatcctaactcatctctctgctcctgtttctatccattgttgactctccatcccacactttactggctttacttaacacaacaactaaattgatcttttaaaaaa

SEQ ID NO: 1627 - DNA, 596 bp, Bovine  MMBT19381
agactgaacarcaagycttggccccrccaaccctccctgggctagggaggaaagtacgtgactaagaaatcagaatcctggctctttctttcccattctgaagctaaatatacttttttaacaaaatcaaggccctacttccctttgaggggccttttggaattgaaagtagttcagaaagacctcttgacctacagtggtctttttttaattttattttcaaattctaagccaaaactggttgacttcaaaggtctctgtacaaaaatcacagcattgttttcctaaggaggccttatkgagtgattgatattttgagggttttccagcccagtgatttctttgctaaaaaaaaaaaaaaaagtgtactcactcatcttggcatttgtttgcaaactaaacccatggtttgaactctgtttatcatcccccacctcacccctcgcccttgacactggaattgctaacacacagagaacacagtggtctgttgctagcaaaatgtgctcccctgtgactttgctttttatgcacagattatcatctctgtcattcattataacttcaaaggctacaagagagtatactccctttag

SEQ ID NO: 1628 - DNA, 600 bp, Bovine  MMBT22127
ctttaactgacttggaaaaaatttatattaaccaacaaaccagttctagttacctctgttcagagagagattatgctgtatgccccacactaaataattctacatacacctatgccttccaagttctcaaagtttccttgtataatttttttggatcagcttttgtttaaaaaacatatttattgaggtatacttcatatgccataaatttcactcatttcaagtgtcaattcagtgagttttagtaaaattacagagctgtacaaccatgtctcctcccgtgtgtcaggctacccatgmaatcttcactgttgaaccaatttctcattcgttgcttctagttttctgtattaaaattgtgggtaaaaggtaaaacaagagttaccagcctctgagcaaaaatttttttccccagggaggaaaggatacaagctgtagtgtatagattgtggcatktatattgtttgcttagagaccctttaamatatttctccaggtcttctgttctgattcatatagacaagtccactccatgtaactgctattcaaccctgctttctccacacccagtactagagcaaagtttaggctcttattaag

SEQ ID NO: 1629 - DNA, 598 bp, Bovine  MMBT21386
  misc_feature (1)..(98): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactggagtgggttgccatttcttcctccagagcatctttccaactccaggatccaacccggatcttctgtgtctccygcgttggcaggcagattctttgccactgccatcacggaaggccacatatatattatacagtctccttattaccaatcaatttgggaatatgatgagatcaatgagtggatttccttcacagamgaatggaaagaagcacatatrcgcaatatcatatataaacaaatattcatggaccaaagggcaagaatccggacaccatcccaagcgcgtcctgagctaactggccttcccaccgtcatgtctgtgcttctgcattttatcctctgcctgcagtacccatcttttattttctcacctaccaaactgctacttctccttcagatttaaayttaagctttgccgtgtctgtgaagctgtttttttctgacgcttaacaaaccctaaaggtttcttccttcaagcttattccctagtagcg

SEQ ID NO: 1630 - DNA, 598 bp, Bovine  MMBT23064
ccatagatggaagcccaccaggctcccccgtccctgggattctccaggcaagaacacycgagtgggttgccatttccttctccaatgcatgaaagtgaaaagtgaaagtgaagtcrctcagtcgtgtccgactcttagtggccccatggactgtagcctagcaggctcctccatccatgggattttccaggcaagagtactggagtggggtgctatcgccttctccaagcagatctactagtgattctttatttctcctcaaaaactaggkaaaccaaggcacagactgactgacagagmagatagcttcaaattgaatttgtagtctctgccttcagaccaatggtgcatcctgttcacctcttagccatgaagcttrttaactttaaaaatggagttaagtgtatatatcaagttggaatcaaaaatattttaaatctttacctgtatgtatacttaagattacattgaatggttttatctccaggacatgggaagtagaaagaaaataacacagacacatagacatgagttcaaaattgatagaaagaggaaggaagggagtatgtccaagaggccaccagagtcacatgggctc

SEQ ID NO: 1631 - DNA, 600 bp, Bovine  MMBT23050
gctcttttattcaccgacatacattcaggacaattacagagctgtagtgggcacgttgtgaatcttgctcatagaaacgtttgaaccactttaagatgaccataaaaaggaacacaattgtgccatttgcagagacgtggttgaagctagagactgtgctacagagtgaagtcagttrgaaagagaaagtcaaatagcgtttattaatgcttatatgtggaatctagaaaaacggtacagatgaacctatttacagagcggaaatagacatagagggaaaawatatatagacataaagcmgaggaaggggtggtgggatgaactgggagactagaattgacatatataccctaytgatcctgtgcataaaccagatagctaataaaaatcctactgtatagcccagataactctactccatgctctatgatgacctaaatggaaagacagtccaaaaaagaggagatatatgtatacctatagctgattgactctgctgtacagcagaaaccaacayagyattataaagcaactgtattccaataaaaagtaattttaaaaatgatcattaggtgtgaaaagtcaagcttttacagactt

SEQ ID NO: 1632 - DNA, 600 bp, Bovine  MMBT21294
tcttattccccttaacattccccaacctttcgttctcttaacttattaacttatttcaacttaattattgcatcatggtgaatgaagggagtcattcttcctcttaagaaaggccatagtctcttaggacctttctgatgctactattccaataaccaagccactcctccccactactttgtggatctttatagatcatggtgggtagtatgaaatgtaccctagaagattctgaaacgagttagaatagtacattaattaagttggctttgaagtcatgctatgaaacactaaacattmatttcctgttccatgtcctacttcaggttagctgcccaaaatagctatatattctttaaaaattcttcagagattctacagtgatatcaaatgacagaattaacatatttcaaccacagaattccaataacagaccctcaatgtgcatgtttactcttgcccattatcagatttttgtaaagaaatcaaatttgaagaataaaatgccaaagaggttaaaatccaaaaattttaagtcttcagagaagtgaattccaaaatcaaataatcttamctttgtgagctaaaatccaataaaag

SEQ ID NO: 1633 - DNA, 600 bp, Bovine  MMBT15394
agacagcatttggggagaggcagtataacagaaaggctttattgacaaaggagacttagtaagacaacttgcaagagaaaaatgaaaaagtgattacagactattgttttctaaagtgaggaagaactactaacacaggaagaaaggcaacacgtaaacataagcagccacatactgtcaaggggataataaaggcagtcttcatggggtgaacaaaattattttgaaatctcagggatctgtatcaagctaaggtgatatatatggccaaagacaaaggaatacagtcagaactctaamggatactcaaaagagcaggaatgggtttctgtagttgaagaaataggagaaagagtgataattagtgctgatcctaaattatttctcagctataccttcacatacccttttaaaaggccaagaagccacctgttcgrtgatcttttttttttcttctgtgtaactaatacaagagatctttaaccctctttaaggatttaaaccctcttttagggtttaattaaccctaagcataattctggagccttttatctttggtattttcatacatatctgtcaagatttgcccatctacttctt

SEQ ID NO: 1634 - DNA, 600 bp, Bovine  MMBT12810
atacaatgttgctttttaccaagtctcatccttggaggactagccccccaaaaagtagccttcaaatacacactaaaacatacagcaaatattcagtaacagcagcaaacgtatcatgatgcccaaaggctttttgtatgtgtattagcaatgcactaatttgacattagtcaaagcactgatctcaagcaaggttttgggtataagattcctacagtgctggcagagttactgaatatacccatgtggctgactctttaattgatttttgcttgtcacttctattctatccaggtatgmytctgagttgcttttgtgctgacatctaatttttctacggtgcaatcagtttctagtaaacacagaaaaaaattaagttcatgagactgtatgcaagtaccactcaatctccaattcatactcacccaaaaacttcacatggtatttaatgtgagtgttggataccaggctcactttgggcaaaaaacacatggaaattcttgcctcatgacagatcctgtcttcagtgatcattacataatctggtaaataacttttgtccaaccaaatgaagtagatgtaaagcaatactactactcc

SEQ ID NO: 1635 - DNA, 600 bp, Bovine  MMBT20586
gcacagatatgactcaaagaaaatgctacctattttctrcatataagaccaagcttayatgatcaatttagaaagcatctcttaaatttaaaatatagttacatttccatgattttttwaaaaaggacgtcaaagtaagaacctgtaaaatatagtaaaaaataagaaatatatcagatcattaaagcaaatcagacaaaataccaaaattcaaggcatagaagatcccaaaaatattatattaagacactgaaatagaccttatgaaggagttgtgtaactactattttctttcccagmtccwtatttcttatgttggataatagcaaaaccctcttcccttctaccagggctccaaactcyggtatccttggaaaatgctgcatatttcagaatgtatctattagtcatccacttcttaatcactcaaaatgtgatcataagcaaaccaaaacttactttggtttttataggccccggctgaatcacattgaatctcattccatatttaccccattcagctgcaagagacctaaaaattaaaacaaacagtacagatttctaaaatactatactataaattacaaatactattaacca

SEQ ID NO: 1636 - DNA, 601 bp, Bovine  MMBT19776
  misc_feature (1)..(1): n is any nucleotide
ncagtcacttaaaagaagtttaacttgtatatactgatccaaaaagatgttcacaatattgtacatgaaaaaaattataagatatgatgctayttttggaaaacaatgaaaataccaacacattctattatttatataaataagtatctatacagaaaaatttagatagacatattttaaattgctacttgggattaacttgggaggaagagatggaacattataaaggmctaactttttagatgattttttaatttgaaatttttataattggataaaataatcaacawaaagtgatttmgagggttgaggaggggccatgccatgtagcttatggaattttagytccccagagactgaacgyagaccctcagctgtgagagcacagratactaaccactggactgccagggtatttccatgatttatcttttttaaatataagattaggaggaaaaagcacaaatattcaagtatagtaagaattaagttaagctgtaaaagaactttaattcaaaaaagtactctgtacatttacagcactcaacttatcagtgtgaacgtttcatttcaagggtttctgatgctgtatcatactttc

SEQ ID NO: 1637 - DNA, 600 bp, Bovine  MMBT18664
aggctccctcgctgatagctccaggactgtagggcttccctcacacttattttgattactgctgcctgtcacattgtttcttcttcttgaccttggtgcctgtcagaccattcacaccccctaactgtctttacctgccacttgtccgtcttcaccgaaagcctggtttctctgattactcaggccctaacagcttctcgtggagttacttgactcttctcagaagtgaaggagtgctgtgtggccttctttgccactggacttgatgaaggttgtcggctgtgagtcggatcatagacsgtcctctccagagggccaccttagggagcttttagagaggggtcatggcctaagtgggggggaagctgccttgaagacaacatctttctgactttcctgcattttcatttactggctttctgagcttgagcaagccatgtggctgctctcagtctcagtgytcttatctgttaagtgggaattatttatagtaagaatcaagtctatgtaaaaatactgctatgtccaaacgaatcttctaggtagagctctcagctttttagaggggtttaagaattgtgtgctggcctccccggtggc

SEQ ID NO: 1638 - DNA, 600 bp, Bovine  MMBT20964
gattaaaaaaaaaaaaaacctaaatattgtaatatgacagataacctaataattgtatctacattaaaatgacaaacatgatattgctgcttgtcaaataaaaaaataaagaaatagaatgccttttttatgtggatggagtatcacaatgctcagaaatgtccgtgagtcctcgtgttcctgtttaaatcctacatgaaaacgtctcagttattgtttctgaatgccttcagcrtaaaggatgcgttcagcataagtgatgctttctttttatggattagaactacattggatgtgagsctcgtgaggagtgaggctgtgattctgttcgagtttctggtggtgtcctgctgcagcgcagaaccrtgagcgaggggactgmggggaccccgcgtctggcttagaaagcgccgtcattcccaggctgtgttactcctgtctccgaggtgcrtcagttctaatgaggtctgacgcccctctgctccttccctcccgcttcctcggggtcggaggtcatcctgcggtaccggtaccggtgtctgcctgtgcgttccccccgtacccctgcctgcctgttactctccacctccttccacttta

SEQ ID NO: 1639 - DNA, 573 bp, Bovine  MMBT22464
actgccctctgaacccacctctatactgaagcttctgggcccggttgtttggacagtccttcccctgtaaactgaagttgatgttggtgcggatgcagcggttgttgagtgactggacaggcctgaaattgtcactcatgctcagaaagatctgagatggttgattctggctgagcaggcgtaaggaatgcatctgaggggagagaaacarctgtgagatccacccatcctcttacatgtagtacggaagaartaagactacatagaccatggccagcctgggtagtgccagctgtgtgsgaaagtgtacttgaaccttccacagrccctgatccatgggttcagtgggtacaacccactgatgcctccatgcttggagagagccttacttttagctcacttgttcctggtatgcctctggacaagtcagtgattattttctgtcctatgacacatcgtcaaaggagaaaacccaaatgggtattctccagagactcttctcactctcagacactgaagctgagtaattaagggaattattttctgatatgagtattatcaaaactatagtga

SEQ ID NO: 1640 - DNA, 600 bp, Bovine  MMBT15644
tagaagtatctagagaggtccaaagtcaggtttcattgggtagcggtgagaaaccattatccctttcacaaaagatggtgaagaggagccagagggaaaacaattggcgtttttgtgtggggctggtctaagcagcccgtgcgagcccagctggagcttctttggccctgtgttctgcaggcggcgtgcatttttgaaacacccctaaatgttccagcctttaaatagcagcgagtcttctaaaatgatgctgcatagcgcaggagaaattaaagcggctgcctgggaggcaggaagccsactagcgagatgcttaattatcgtggaagtaagtgcttgttgctggggagcggagcgcagcgagcccgggtcggcctgggtgtcagccgtgatttgtagacaatgcggccccggcagcgcagtgctggatcagcagcatctttgcaaacatgcatttggcaggaatttaaaggccacctcttgtgtcatttgtggagccttggaaaagggtcctctgcctttattttcaggatgtacgcaaccatgcaggattttgtgctcagaatttgtgcctcttgcctcctgattgacgtgctcctg

SEQ ID NO: 1641 - DNA, 568 bp, Bovine  MMBT22902
atgtgcttagaaaaccatcggaaaacaatagaaaataaaaattccctcaatcattctcccaattggcagctctattgctataatgacattttacgatcatcctcccacacttaaaaaaatttttatgtaagggaaattaaatgtgcaaacaaataaattggaaaagtggtttccagcacagacaaagaattgatggctttaaaatatgtaaagagcttaggaaaaatgcttacattctcaaggcaaagacaggcatccgttccattgtacatcattcagcagacgttgagtgcctgctgstaagttaaaggagtgcttactgtgcacaaaaacagctgttaggagggacagacatggcgttttgtcatctgttttattccagcgttttgagtcataatcaagatataagtgaaactatatgggaaacatttttctttacactttcaaaaataatgtaggtgagtgtgtgtataaacttgagatggaaaaccatttcttaagcaagactccccacaaaactaactatagaggaagagatccataaattgagctgtgtgacataagaact

SEQ ID NO: 1642 - DNA, 600 bp, Bovine  MMBT20105
taagctgaactctttgcatccactgtgtttctttcctgggcacaaaaaagaagtaacatgattatcctcctccttgagtcttggtttgcccagaacttattacagcaggtggagcagtgacctcagtgatcagggcattccggttggtagataagactcktccccgtattcacagacaagggttcctgtggttgttggatcttaagtgcgtttaaaactataaggagctgtttgttgctttgatgaccagcatgtgaactgttctatcagaaactgtagggaggatcaccccaacacccstaatcctgaatattcttgcctgagtctcagcgagggggtcacaagagccatggcaagaaaaagagtatgcacatagtaagggcaagagggaactggggctcttaatgtatttggagaagacatgtggggacacatacatattgaaagacaccattaataaagcatattttattaggaatgaaacatgcaaatggtcacagaggacaagcggtgagtgtggaaagcgttgcaaatggggaagctgtattccaggtttaaaagtatagaaggagacagattcatggtggcagtcagggtggg

SEQ ID NO: 1643 - DNA, 600 bp, Bovine  MMBT21700
ggagccaagatcccatatgcctcatggtcaaaaagcaaaaaaaaaaaaaaacaacaacaacaacacataaaacagaagcaatattgtaacaaatycaacaaaaactttaaaaatggtcccacatccaaaaactctttaaaaagataaatgggatggggaaagctgaataaaccaggattttgataaagggaccctcaagctttcccctcaatgttactagcttaaagtaaataataacaggtcacctcttcagggagctttccgtgtgccagacgctgtcctaagagccctgggagtaastacggtcgatcgttaacccatggatggttgtaaaggtgaaagaacagtttccatgttgcccagggagaagggggcggagccagracacagtcatgactagtttaccccagaccccgggcacttaacatcccacacctgagagtgagacttcggtctcagaagggaccagatgcgcccgcttccctttgatctcttgcgcgttttatcctttgagtcctccgactagtttggaaagaagcaagtctttgaagccgcatcagtggcaagggcgagacctgaggggtgttctaagctgtgaag

SEQ ID NO: 1644 - DNA, 600 bp, Bovine  MMBT22719
agtccattgggagttgctgggcctgggctggatctgggcaggacagagcaacatctggtcagtcaaggagcatttcttgggacttccttggtggtccagtggttaagagtccaagctcccaatgcacgaggggcctgggttcgatccctggtcagggaactaaatcccacctgctgcaactaaaaatcctacatggtgcagttaagacctggcgtagccaaataaataaataatgagcattactcaaatagccaccacaaggaaaacagtgacttaggcagctccctcgcttgccctctstaactgctggagggcacctgggaacacctgaggcagtcactcatacccctcctctgccagaaccttccctggtcctgcctccccttttttttcctggctatgctgcagggcttgcaggacttagttctccaactcgggtattgaacccatgcccatggcagtgaaagcatggagtgcaaaccactgaaccaccagagaattccctcctcccactcctaactgatcacttcttygagccacagggcttccctgccaatctgtaagcacaccaggcatgtgccagcctcagggcctttgcat

SEQ ID NO: 1645 - DNA, 600 bp, Bovine  MMBT19695
aaatcacaacttatcccatgatatgcaaataagatgacccttggaagcaaaagtacatgtctattatacataaaatgcataatatgtatcatacataaaacagagaatacagaatttatttacatacattggttgtgtaactgaaggaacattacagtctgatggtgaaaagtgagctctgtcccccatggaggggccagaatggactcagtctgtctactgcaagtccactcctggagccaaatcagtagagaaacagccagcatccaccaccatttccaacatgcctgatgcaccaasaagcagagtgcaagtcctgctgactggcagctsttgggattaccttgcagtctgggtggtgaggactcattaagcaccattggtgctcaataatctttcgactcgattcaggtcatatctgaatggtctagtggttttcactactttcttcagtttaagtctgaatttggcaatgagttcatgatctgagccacagtcagctcccagtcctgtttttgctgactgtatagggtttctccatctttggctgcaaagaatataattactctgatttcagtgttgaccatctggtgatgtccg

SEQ ID NO: 1646 - DNA, 600 bp, Bovine  MMBT21338
caagggcagtaaacaggacttcgggatttaccgccgaggccccagggggtgctgggacctctgctgagccttcggctacagtgattccatttaactctctcgtmctaccccctgccgtagtaactgacctcactgaacgatggggacccsggggacccagagtgcttaagtgatttgcccaaggtcacacagcccgcatccaaacccaggctctccgaagccagagttgggccctaggcagcgctgactctcgctccggaccgattgccaccctgactaattktaagtcccgtttgtgtststctctctctyattcccagggactcctcggctgggcccagaaagacctgcagagtgaatttggaattgcargaggcccacatcctggcggtttccggccttccacctggtcccaggatgcttctcgggactacagcctgggagttgcaagccctcgaggggacccaggcctcggagagagggactgggccagcgagtgtgggcatggagttggggaggggggccctggggaatgggctggcaggtgtgccctcgactgygaggagggcgaggtcggcggccaagacggccgtggagcrg

SEQ ID NO: 1647 - DNA, 600 bp, Bovine  MMBT19120
aggagcaagactcttgggtcaagacattgttattcacagcacagcaagtagcatgagcttcttgttggtgacattcccccatgtcacccaagtctctctggtgtgatgtaagagcctgggctaccatggctgtrtagtaatacattattgatcgggagatgtattaatacatttttagagagtgattacaattaacatcaccatgtgaagttgctagagcttaaaattgatcaagagttcattayacaacttattgtcattatcaytcacattatcttgtgttaggtttttgttctaggsacgggggagcccagtgggctgctgtctatggggttgcacagagtcggacacgactgaagcgacgcagcagcagcagcagcagtgtatattataaacccaagtttattaccataaaattttaaaaattaatgcattgcaaaaattttgactgaagaagaattttttggtggattttatacagatactttctctgattgtccatgttaaatatatagtattttctcaggagatgatagttgttcagaatatagttctgattcagacaatatgaatattaggccaacaaaaagacaaaaaacc

SEQ ID NO: 1648 - DNA, 600 bp, Bovine  MMBT18754
cccttggtatgcrgacacgcccagaraagcccattctttatggcaatttgggccttctgcctggcttctcacatgtgcaagagattttggcaaaacactgcttttttttttgtttctctcattgtcatataatacaaagctttgcttctttcctctaacgggctttcctattttgtttctcaaatccagacaaacacacatttcaatgtccattcacattattaaccaaaaagacctccataatcaakcatttggggtttgattcacaaagataccatgtatggrgywctggagcttttscactcttttgggggaaggttgaaagggccttgtctgtggcaggtcgggtgcaagagggttgcaaagctttctcaggttcgtgactgacttgccccacggatgagaaaatcagagctcggggacctgactccagtgctgggatgtctgagacagctggcttcaacttccccctctccaccggcccccgccctcactcacgctgcctaagaggcacctgctctgggggcctgttcaagctgtcccatcatcccatcattctgagctgttgtttccagggttctaagggaccagggcctgagt

SEQ ID NO: 1649 - DNA, 600 bp, Bovine  MMBT19702
atgacccttggaagcaaaagtacatgtctattatacataaaatgcataatatgtatcatacataaaacagagaatacagaatttatttacatacattggttgtgtaactgaaggaacattacagtctgatggtgaaaagtgagctctgtcccccatggaggggccagaatggactcagtctgtctactgcaagtccactcctggagccaaatcagtagagaaacagccagcatccaccaccatttccaacatgcctgatgcaccaasaagcagagtgcaagtcctgctgactggcagctsttgggattaccttgcagtctgggtggtgaggactcattaagcaccattggtgctcaataatctttcgactcgattcaggtcatatctgaatggtctagtggttttcactactttcttcagtttaagtctgaatttggcaatgagttcatgatctgagccacagtcagctcccagtcctgtttttgctgactgtatagggtttctccatctttggctgcaaagaatataattactctgatttcagtgttgaccatctggtgatgtccgtgtgtagagtcatctcttgtattgttggaagag

SEQ ID NO: 1650 - DNA, 600 bp, Bovine  MMBT21613
tgtggtctaatgcaagagagtttttatatgtggacatcccacttagaaggggggtggatagaggagcatgcctaggccagatctatgagagctgtcaaaacatcactggacactgaatgagatggaatcatatctcctctaagcgagagtgctgagtgtgtttgaaaggaatagtttgccaagtccctggggtgacaggaggtgtaggctcttcacaaggatttaactcaaaaactaacggctctcccagacgtgtgggtcaygtagagcattgttttactgagtggaatttgcaagagsggtactgaaactcatggcccatctttttccatgcagcactcaacctctctcaaaggatactgaacaaatgcttcaaaaataccttttacctgggctataaagattaattttatcattgttctttatactacatatacagttttcactttatatggtacacaattaagtgatcattgcctgctttaaaacagtggcaaattgtttaaaatctactaattatattggaagaaaggaaatcctgtaataaattcaatatataatactgtgacctactctgaagaaaccacaaaaacaaccaaa

SEQ ID NO: 1651 - DNA, 598 bp, Bovine  MMBT21832
  misc_feature (1)..(83): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnntactctctgaactcctctttggagagtgttttagaagagtttgcaaaaggacattgatggattcctgcagacaaaagtttaaaaagtaataatatctgagctgggtgaaaaaaaaagaagatgctgaagtgttcccactgtattctgctgatgctttaagttctacacggtagtaattggaatgggatttcattacaagaagtttttacccactcasaccaactgcatccttataagagtgacgaagactaagtgcaccygttctgaccattaccttcatggtctccagggaaacagcccaaggaagttatcaaagctgtaaaagtagaggaggcaatcataagacattgccaacaagctcaacacttcaaatacttggagctgtaaaataaataacaaactcatacaatttggcttaaataatcatgagcaaaaaaagtcttcatctccttttctacttatttattttatttaaaaacagcccatttcccttgaaaagtattattcatattcct

SEQ ID NO: 1652 - DNA, 600 bp, Bovine  MMBT15690
tttcttcttgaattccatttcatatatatttttaattggagtatagttcccttacaatgttgtgttagttcctgctgtacaacaatgtgaatcagctatacttatacatatatcccttccctcttgagcctccttcccatcccacccctccaatttcttcctgaatttctagtagtatctgttgtatacattttcatgccatgtgtttgcattcctggcctcttgccatcttaaagttaaaagaagataacaattcctgggatgttatgcatcatacaaaggaagtcctgtctctcatascaaagggatacaagcagagtcaaggtgyttgctttcccccacccagtcttaccagcattgtgtctggcaacccaagtcattctgggaacaccatacccagaatcacatgctgtgggacccaatcccatgggtcggtgtgtgtrtgtgtgtgtgtgtgtgtgtgttttaatgcaaatctcagcttccaaagcaagatcctcatttggaatttaaaagagttctaggttgtttaacgtttgagtggaattcctgagcctgttaactggtcacagtctactagctctcataattagcaagaga

SEQ ID NO: 1653 - DNA, 600 bp, Bovine  MMBT22087
caggaacattcgagactcctcttggcatggattacttttcacttgggaagatgtgttcatcgacatcacattttctgaagaacatcttaggagggaagtcaaatagggaaactgaataatgcagccacatctgttcattgcacatgcaaaatgctggctggttcgctgattatactcacctctcctccaaagaatctgtatttatgagcccactcaggaaagataacactggcatcttgcctttcaggcaaaagcctgtttgtgctttacttgtaagaaagcacaaggaaagaaatgggscgtcartaacactgcagctgggctctttgaggtgccccaagtcagagagagggaaacaagcattccattcaacactaaaatgcatgkgctgccctccagagcaaagctgcctgtcctcagcattcaccttgataatgttgccacaaacactgaaattttggtggtcgttacacatctctggggtggcaaagcaagaagtcagactgcccagggcaaggccaggtctcccacagagcctggatgagagggaggtcagatggatggtaaatarattggcaagaagaagcctgaggggacttc

SEQ ID NO: 1654 - DNA, 600 bp, Bovine  MMBT19922
ttgccaaactattttgatgtacaattttttcaataaaatgtatataacaaatagttgccggggrggacctctctcctccatgggcatctgatcgccaggatgatgcaactctacactgggcaggatttttttctaagctgtgtaattggcgtggtgtggggtctgtgccttgagtaacgcaggccaggttctgattgcgggtcttctcgggagagaaagggaagaagaaacgttttctgttatttctttgcttcaccctckctctttctggccaaaccgaaaccagaaagtgaaaggagsttaaaggaaagccaggcgcccctgcccttcgctgtccttcccaagtgcccggcctctgcaccgtgctttcgcttccccgccggctgggctgggctgccctcctccggctgcgagcagagggcaggtgcccaggacacaggccctgcatccttaggtggccgtcagatccctgtgtctggaggggaaggtgaggagggtgtgggcagtcctggcatcagagacagaagcaggatgaggcatgtgtccacccccagttcggggcacagaggtcggcgcccacgtgccacccyggtctgcctc

SEQ ID NO: 1655 - DNA, 600 bp, Bovine  MMBT22437
agcggttcggtcaaaaaacaaacaaaacaaaaagtcctgtgggcacaatttggttcttaaactgccaatttgcaatctctggtctcctccaagtctgcctgctctccattttacagatgataaagctgaggctcagagaggcctagtgaccttccyagggcttcacaggtcactgttgggaaaaccatgggtccaggaagcctgtctagtgctccttgcccaagatagcagatttgttggctgagcccaaggtcttaacaagcaattctcaaatgcttcccacgtatctctcgtttgcasagacatgaggtttacaaacacctcataacctacttgattctagcaatggccatgagggagcagggctggcattaatccattttcttttacaggtgaggaaaccaaggcttggagaggctaagtgacttgcaaggtcaacagtcttagagagggctggagttagggcctccagtaacccctctatgatttttctacccccaaactctgtcatatttgggagatacagcctgagatagaaaataaactcctaaaaaggaacagtaaatggatgggatacttgggtaaacggaatattcttcg

SEQ ID NO: 1656 - DNA, 479 bp, Bovine  MMBT20262
ggataggaatttgggattttttttgaggggaggaggagcatgtgggatcttagttccctacagtggaagtcttagccgctgtaccaccagggaagtcctttgaatctccctagtctgaatcgtgagaaactctgtccagttggtactgggttggttcagcctgagagtgctgtttttctgcttggcttattgggagcaagtaacttttgcagggaaagagcggctgctggaggcaggagtggagctggttgggctgagcgggtatgtggaggcctcttcctcccctgargctgcaagagsgttgctgctattgtgtgtgttttatttttcaaataattttatttatttatttttgtctttgctgggtctttgttgctctgygggcttttctctagttgcaaagggcagggcttactttgtagttgtggtgtgggtcttcttgttgactcctcttgttgaagagcacaggccctaggtgt

SEQ ID NO: 1657 - DNA, 600 bp, Bovine  MMBT19662
cctggtttagagaggcaattggaatggattcagggttgatgaaaagaagaagatactagactagctgagccctataataaaaagcctggccaaaatgatacagatgactggctgagatcatcttgcataaggctggccctcagcaaaattgtttaggaggcataaacattttggttctttctgtttcttcatgagatatccattctcacttttgcccaagtttctaggttcctttcactgcccttttcctgtggcagcagagagctatcaatatccaaatcttcaaccacacctgccctscagatctttccattccttttagaactagttcagtatactgggtgtattggttttgtgtcttaactacaatactcagggcccaggttgctggtcaaataaatccaggacacgaatttattataagtgaacaaattaacttatactataaaatagttaatcaaatcatctaattaaggtgataatgactactagctaaatgtgtttgcagtttagcattgtgcaggtgatgaaatgcaccaggtgtgagtctgtgggctcagctcccaggtgcagtgctaaccagccacgggaagctgggca

SEQ ID NO: 1658 - DNA, 600 bp, Bovine  MMBT22561
agatatttgctgaacgcaacagataggtggtgctgtggttcaccaaagccttggaattagactccaaaggcctgggtttttacaaaggctatatcccaagtttaaaaatcacaattagaaagtcaaataagtgccttgaaaaggcatctgacttgcatagtagctgaatttttgccttgacaaataaacttctgtagtttctaagatgtccactaattttctatttggctaaggaatgttttgggttaacacttcaattttaagcatttgcaaggtctgtcacagacttctatcacttasagaaatcaaakactaatgcaacattggcttaaacataatgagttyattgctttatgacataattacaaacccaaggaaaactctgtgttggttacctatgacaaattgtccaaatrattctacttggtaaaggcagctttcttttttggctaaaaacacactctgcttggcttcagaaggcttgtgtctgatttcttggctccatcccttcctggctgctgcaccagctttgagttccttggctacttaatcgtctgagaatcacttttcttccagtccaggggttctatctggtgttct

SEQ ID NO: 1659 - DNA, 600 bp, Bovine  MMBT20319
gcagacaaggttaagggtttagctaatctgtgttctgacaactagagtgggttttgttttccatattttgccaacacctgctcatttgattatgttttcccttataaataagtaagtttagaaaaattcctgactgcatttagttaataggggttttactgttatatatttatgaaagatggtttaaattcaccccagtacagattgtactcacatgtaacaggttttttatacttacatatctatcaagtaaaatcttactgggtaatagacagctatctcaatattgcagaaagtttscttcttttaattttacaagatctcttttccttcccttgctactcttaacctgctacatagtatgttgttcaattacaataaggcaaaatgagggcttccctcatagctcagtcggtaaagaatctcctgcaatgcaggagacctgggttctattcctgggtcaggaagatcccatggagaaggaaatggcaacccactccagtattcttgcctggagaatcccatggacagaggagcctggcaggctacagtccatggggtcgaaatagtcggacatgacttagccactaagtcaccaca

SEQ ID NO: 1660 - DNA, 600 bp, Bovine  MMBT19382
ataccacagyaaccaacaacgctaacaatactctgcttgggctttaaaattagtaagtgaaagtgaaagtcgctcagttgtgtccaactctttgtgaccccataaactgtatagtccataaaattctccaggccagaatactggagtgggtagccttcaccttctccaggagatcttctcaacctagagattgaacccaggtctcccacactgcagccagattctttaccagctgagccasaggggaagcttactagagactcttcaaactatccaactgtatacaccctaactaccaastcaaagtgtgtgcttctctctctagcttytcctggtattggttccttactaaccactagatcttggtaggagttcgtgaattatcagactgcaagagctgcagcgagcaaatgacattatgtgccacatgtggtaccttactatctggtaagatagctgtggagacagaaagattatcactctctcgaagtaaaagcaacctcccactgactaagtagtcttaagaaaagtagacaaattggcaatgagttaagtaagcacgtggacatagcagcacttcatcctggacactcgagccac

SEQ ID NO: 1661 - DNA, 500 bp, Bovine  MMBT20117
ataccacagyaaccaacaacgctaacaatactctgcttgggctttaaaattagtaagtgaaagtgaaagtcgctcagttgtgtccaactctttgtgaccccataaactgtatagtccataaaattctccaggccagaatactggagtgggtagccttcaccttctccaggagatcttctcaacctagagattgaacccaggtctcccacactgcagccagattctttaccagctgagccasaggggaagcttactagagactcttcaaactatccaactgtatacaccctaactaccaasagcaaattagcagagggttaaggactgaatcaaaaatgtgtaaaataagccataagtagatatttattaccacctcaagattgtgactctgctaaggcagtatgtgaggactcttgaaagtgatgaggaaatgagagaaatggaaaagtatttcagattttgttttaaagataataaaatgctttaaaaataaatttaaa

SEQ ID NO: 1662 - DNA, 600 bp, Bovine  MMBT21439
catgccacattgtgttcataactagagagttctgtacagagttctgaactgatccgtgttactgccaacaggaaagtgatttcagagtcagacaaagaagaccaggaagaagtcaaagccttggactaatttgattgacacctgggrgaggatggctcacttagaccttcacttttgaaacaaccagctcttacatcagaatcaccggaatcaattaaattagaccaagaaataaaagttaaatatacagcgcttctaggagtaccagctattgagtacttgtgtctgttttacttactsaaaaccactgcatttgataccacacagttatcatctgtctcattttatatattctcaagctccaacttaacttgctttcgtttgaagggtatttccagaactgctatatttgatctatattatgaatatcagataaacaagaaacaaggactttatatgcctcaacttgtagaccaccataaaaacaagggcttcccaggtggtgctagtgctagtgctgccaatgcagcagacgtgggttctacctctgggtcaggaagatctcctggaggaggaaatggcaacctgctccagtattct

SEQ ID NO: 1663 - DNA, 600 bp, Bovine  MMBT20977
gaggacacccccatttacgtatctcactctcaagtgctgagttgaagactccttgattgtgaaaactatgtctcattaatctctacatcccttaacgagcctagtgcacatttagacatttaataaggttatttctaactttgattgactcatgaaaatattatttgcttattcaacaaatacttattggatgtgccatgatgaatgaggctgccctcataatagtgatgacaatcataatgatttattgagtgcttattatctgccagacacgacactcagggttttctgtttattaastcatttaagcctcaaaacaagtctatatggatggtgctataattactttaatttaactttgggaaagkctaagtaatctgctcaaggtcacacagccaggaagaaaaggagccaggatttagaaccccggccatttggcctcagagctcatgacactttggctgattaaatatattctagcaagggaggtggcaataaagatggatgattaaatataattttaatatgtactgcaactgggaagtacaggatgccatgtgttatayggcgggtggagtaactccagtcttgaggggtgat

SEQ ID NO: 1664 - DNA, 550 bp, Bovine  MMBT23265
  misc_feature (1)..(2): n is any nucleotide
nnggtggctcagtggtaaagaatctgccttccaatgcaggagacacgggtttgatgcctgggtcaggaagatcccctggagaaggaaacggcaacccactccagtattcttgcctggaaaatccaatggacagaggagcctggcggcctatagtccatggggttaaaaagagtcggacacaactcttgtgtgtgtttgaacatacacacacacacacacacacagatctgcatagcggtttaggaaaagttgaacaaaacatatgttgcaagatatraaggaatattaaaaatgtaagctgsgcagtaatgtgaaggcagtaaaagtacttgtaatatcagttttactgggtatgaaaaagcatgatctaatacagacagaatggccattgaatgtaatatgtgtctgacagcatgctgagctacttgaaccagttcaacactggtggcagttacgtaagtggtggtctcaggacttaaggctaaaaatgtgtgtggtgtccttaattgatagaaataaccacacatcatgtactgtggtgttctaaaag

SEQ ID NO: 1665 - DNA, 598 bp, Bovine  MMBT21727
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnntacctgaattgtttactttaaaatagttaagtttagggacttccccggtgctccagtggttaagaatctgccttgcaatgcagggggtaactaagcctgagagccgtaacaaaagctcccaagtactgcagccaagactcaatgcagcaaaataaataaatagataaatagttaaaaacagttgtttatgttacgtggatttcccctgaaataataaasagcagctggcagagggcaacgcgtagctcagagggttgaatcctgaggatggacctccggcacagtggaggtgatgctccgggccctgtacctgtattgtagccgtcctggagctccatgatgaagccgtgggcgttggccttctgggcagcctccacyactgtctcgaagggcacggtgggcaggccataggagatgttgtctgtgatggagcgggcaaacagcactggctcctggctcaccagggagatctgtggaggaggaaggagggggcatgggaggccgggaacgcatcagt

SEQ ID NO: 1666 - DNA, 600 bp, Bovine  MMBT15735
gttatctttatcagaaagatacaataacatttctgtaagaacagagttcctttaccacccttagggcccaagaagaggcaaatagatagctctgatgccctgcaggggtttcaaagcctccaccagcaagcagacaagcccagacactgtggttgggcgtcacttccctgagcctttggtaattcagctttgggagaatggtgggaagaacctgcctcagatttgcctctgagccactgagctgccccagatgggataccaactaacagatggtaaattctccttgattcttttacttcsagaagaatcttaggttagaaatgrgatgcctcccattttccagatgatgcacccaaatctcgggctaattatattacccacattgaactacctcacctccccagaaggtccacgtccttttgggttctcttgaacagagagagaaccttagacaaggacttggaggcaggtggctgacctggggagctggtctcacagcccaggaagccgagcgagaccaggaaggaggaaaagctgctcacagggggctttatctatgactgagtattgagtcaccccaagctgtggcttatagccata

SEQ ID NO: 1667 - DNA, 600 bp, Bovine  MMBT22938
aaaatcttgaaacttttacttcacatgtgatacacagttaatgytaactataaaagtttaaaatttttctaaaataggttatacattctttcatacttacasgtgacataaaacgaaatttaaatttgygttactgaaatcatttggaacagcaattgttaacttagggtataaaaccatagttactaaggtcctgatagccttctatgatcccattaaaaggtcccaaatgctagagttgtagggtcctgtactttagactttttcttctccttggcttccaggttcttctattgtgtstcttttaagtagtccaaatgttttttttttttaatttttcctttctaatctgtaggctgggaaaacaagtaactctgagaattggcctataataaattagagactttacatggtctgagccttgggtatttctatgattaaagtgacagcaaaggtattagtcactcagttgtgtccaactctctgtgaccccatggactatagcccgccaagctcctctgtccatggacttctccaygmaagattactggagtgtcttgccattcccttctccaggggatcttcctgacccagggatca

SEQ ID NO: 1668 - DNA, 600 bp, Bovine  MMBT20989
ttgaggacaaggggtcagtgtcgggtagagaacactatgggaagagatatgagtgagtctgagagcaagagccagtcccagccggtcaaggggactcgtgagcgcggagcatctgggagctaagaacagcaagtgaggaccagcgtgaagcgaggtgctggaraaggaagggcagagatctgctcattacctgccttggtggaataggagctgagacccagccaaggagagtgaattatcgattcctgtctgcaaatcagtaactgtaaccaaaggaatacgttaggcatattggtaagsagaggatccagaagtcataccaagcrcaatgagggcaagtaatgtttgctccataattatctgctgatcggccaagaggatgaatatgttcttttagctaagcttttctagaagtgtattcatggtgccagcctccatctcctgagcctggtgcttcacatcccctaacaagccccgatgcaggaratgttaaaggtggaggygagattcagggaggtgaagctccacagaccagctccctcccgggttagtggggccatgagacccatctcacaaaagtgtcgaaagggtcgagaagat

SEQ ID NO: 1669 - DNA, 598 bp, Bovine  MMBT20057
  misc_feature (1)..(2): n is any nucleotide
nnctgagtttacctgaagatggcatccatcccaaggctgtatgtgatttgtatgagaattctctgcaaattcacaagcactgtcataaactcctttctactgactgggaaatttgtgccatgtgtggtaaatgattcttctttaagtgacaacacattaatatgttcttcagatggttgcagatacacctcctcttgggctgagctgattctcaagtcttttccctaaaggggaaaagagagtataaaggataaaactgtgaaaaaagggattctcctctttgtaggttatcatcagtasgttttttatttcaggttagctttccctgtcaggatatttctagtatgtataaaaggcagagagaaaacaatttaaatattagccttaactcgatgtaccactaagtataagtttcttggttatgcatgactcttattcctctatttactaaaataattagtacttggtaagtctagatatatatgattacaaatacgtcaattttatagaagtgtgcaaaactgaatatttcagatatactattttatggtgaatgtggattgtataggaaaatggggaagaaaagttaaaacagtgt

SEQ ID NO: 1670 - DNA, 600 bp, Bovine  MMBT19761
ttagtgagtccctttggtaagcctgtacactctattacgctgaggtttagtgtataagaaaaacgtggtgtgttggagtttgcctgcttgtgttactytttctcctttacatgctgtggtagcttactcagccatagaaaataaattcaaagctgtttaataataaggctaytgttgtgtagtagaaactaggcattatggcagtaagtaaataccttatacatcaagaatatttcaagtttctggtgaaatccaaagtatcacaagggcttcattatgcccttgctttcagcccacaasccctctgatcttaatgactcccaaacagagtcatccaagattttgtcccatgtagggtcactgastaagtttgtgatgggtctctgtgtgttctctatgaggaggggagagagggtgatgactcacactgagtatgamcaactggaaccccaattttatgcacttttgtattttttggaaaacatttcttaagcatactccagcagtctgatttatcaaacagctttgcctcttattgctgagtcatcctactacgaatgggaaaggcacccaggaaactacaaagtgacttacatggga

SEQ ID NO: 1671 - DNA, 600 bp, Bovine  MMBT18550
gaatcaggagacttggctttgccaaccactggatgactttggccacatcacttagactctgggcctcgtttcctgatcttaaatgtccagaggctttctttggtttttagtgacagttgctgcttggggaatataggtrgcattcaacacggcaggcttctttgttatgagactagaaaatttgtttcatctctctgtgacttagtttcctcatctgaacataggaagggtgattgcatcataaaaaatgttcttaaaaattaattgggatgctgattagagagtcctagacatgatttstgaaatgtaatgagcactcaacaaatgtcagatgcctttctacccttaagtcatattactgcttaatatctgtgctgtagtatagggctactcctgtttagtctgagcatagaatctgaaatcacgttagcagtcattacgatcaagtgtgatgtgtatattcccactctacactctagcatgttaatttctcacagatgcttctgtacatattgatccatttgccaaagaacacacctcctttactcatcctacaaggttaagcacaaatgattctccctcatgaaactatgagccytc

SEQ ID NO: 1672 - DNA, 601 bp, Bovine  MMBT20435
  misc_feature (1)..(1): n is any nucleotide
ncccaagaactgctgaggatacatttcatagtttctcctttactaacattatagttttctttgctaatgagtgaatagcttaaaagcatgaattcataattacattgttgtttatttcaatctatagcatacacagactataatttgctggaaaaactcttcactgttgcccttgtttattccatgttaaagttaaccatccatgtctataaattaagtttactayraaaactcacatttaaaaaaaaaattatacaagaaacagctggattatcacaatcagcaaggaaatggactcaasagttggaactagtatgtctgggacactttgtcttcatggtaaacagtcactttatgcaaatcccacttggcttcacttaattaaaaagctgaaaaagaaagaaaattctttgctgaaaaaaaaaacacagtgtgctttttattctatattaacttagtacaggtaaatataaaataaaaatgtaacgtcatacacagttcattaattcacttcattgtaattttatatcagggcaatttctatgaactagatcctgtaatgggatcaggtgagactaggtcaggggtgaaagcagatgct

SEQ ID NO: 1673 - DNA, 600 bp, Bovine  MMBT20973
ccatcaggcttttccaggcaagaatactggagcaggttgccatttcctactccagggtaacttcctgacccagggatcaaaccctggtctcttatatctcctgcattggcaggcgggttctttaccactagcgccacccaggaagccctagaccatttwaagcttttgtatttagatttctaaaggcatttccgaaagctcatccctttacagagcttctccactttcttatgcacaataagacccaattgtctacaaagagcttctgatctgtttctctgcatttcttaatgaagttsstaagacctggaaaggttttgtttgagaagagaactttgccaagtggggtctgcattagtttttagatttaggccagcggtctgaatgggacasggacacttggggaagggtagaactgctttgggtcagcaaagcacaactgagtaactgctgagaaattcaggacagcctgtataaaaatgagtcctgtgatgggttgaaaagtagttcccccaaatatctacgccttagtccctggaacctgtgaatgttaccttctatggcaaaaaaaatagtctttgcagttgtggttaatttagg

SEQ ID NO: 1674 - DNA, 600 bp, Bovine  MMBT18549
ggagaccmayggtgaagtttagaaagtctttgggaacttaaataggtttttcactcagagagaagttgaaacaacacacccaaacctaagagggaggaggctttctgacagaggatgaatccgtgggccctgggaacctgtgccttctgtattttgtcagcagtcagaaatgctcaaagtttaaaatgtaattactagaaatatgaaatgaaggctcatgagccacttgtgaaattgccctagaatagccaaggtgattacaattgaaaagaaatagaaaattttactcgcacaggatasgccaaatttggccttacatattctatgtgctcagtagattcttactgaatgaatttctcatatgagaaatayacagaaaaaaatagatttctatataacttttattaaaaggcataaaataaaacctgaataaatggagaatataataccttattcatggataggtaaactcaatgtcataaagataccacttctcctcaagttcatctatagattcaaagctattccaatcaaagccctaataggttttttttcagggaaaatcaacaagctgcacttaaaattcacatggaagagtca

SEQ ID NO: 1675 - DNA, 600 bp, Bovine  MMBT20000
acacctaagtgtcagtctgaagatgaagacttgatttaagactttgttctttgacttaagatttctgatctwaaggagacaccacaggggacacagccttgacccctggtcagggaactaagatcccacatgccatgttgtacagccaaaagacagaaaataaaagacttctgatctgatcttgcaagcagttcttaaaagcttccacagtttcaatatttaaaaggcgctaaggttggaggtggagtttaaatgctaatgagtgtcaaactggtgtcaatcaaaaataggagaaatttsgttatttcttctattgtcctcagtgctcactttgtcctccagcaaaaagcagtatcctttggagcttgaatcaaagaagaggaaggtagagaggagatggaggtattctgtgaggttatatagtcagtgggaaagtcccagtggtggratggctgaaaggatttgcagaagaagaataccagttctttaatatttaaattggtctattttgctaagacaagaaccactccatttgtccaaattctttgtacaacctgctgtgcacacaaagatcttataaacaggatgtgtgtgatatgg

SEQ ID NO: 1676 - DNA, 600 bp, Bovine  MMBT18880
atttttgccaagaagtcttgccatgtgacatttaaagtgaaagtcactcagttggatacaactctttgtgaccccatggactacacagtccatagaattttccaggccagaatactggagtaggtagatggtcccttccccaggggatcctcccaagccagggatagaatccaggtttcccacaatgcagacggattctttaccagctgagccaccagggaagccctgtgacatttaaagattatcataaagatatagtgggaggaggtagggaagggaagtggaggttgaataaaagasrtaaattctcaaccaccataagaggatgtcaaaagacaatatcttaaattgataaatcaagaaatagctgagtgagcaaattactaaagtacaaagagawaagtaatagataaaatagttagacattgaaagtggcagcctcttaagagcagtatggataagagatggagcagagatccatacrtaccaccaggtatgtcttaaaagaattcatttatttttagaaccatatgatcttccaatctttcttctttcagaccttgaccagttggccaaccctttgtcactgctcaggactct

SEQ ID NO: 1677 - DNA, 600 bp, Bovine  MMBT23206
agctcctgggaggttaggagaatatcttaaaatctctttgtactctcattatttcacatggggcttaggagtttggtgacattttaggaagcaggattttcagaaggctaaacaagaatggattgaaaaggagagactaggatgagggaggaaaatttggggaaattgccttatttttcaggcatgtgaagtaatatgggtctggattagacaggtagatatggaaaggaaaaggaagyratggattcaaaagaagaattatggagagttggtgatagaygaaatacggaggaagagggsgaattaaaggcaaatctgaagttttgagaatagagatctagaaatgaagaagtagtggagagaatcactgttggtggaaggaagatgagtttggttttgaaatgtaggactagaaattagggccacagatgttgatttgggagttatggcatactaaaactgtagcatattagggctagaagggacttcattatcatctagttcaatctccagaggctccaagagattttaacttgtacagcttctcctgggtagatacagtaccaaacctaggaccctgttttcctaatccagtggaaa

SEQ ID NO: 1678 - DNA, 600 bp, Bovine  MMBT19888
ctttgtgttcttgagcggtatcaaagccatgtccacyttggatgttcaggaggtgccttgggggccatttgtgagggggagcgtggctaggcagggtaagagcgcattgcttcagcttcagacagagtggctccaacttggtctttttcacacatcagagttccttggggagtttttgtatttgaaagaaaaaagatcctgctgcttaaaaaagtttgacttggctcatttaactaaacaaagtgatataatctattactaatgccaagccttgttctttggcaattggtagttatgggstttgggttttctatttatgttcttaagattataaaatacctcagtagtttaactgggccaataaacctctcctgagaggtgagcatacttcaagcccacagagaaggttggaggagactggcactggaagaagcagggaatctgagttcctgtgtatcaggtcacttcacctctctggaccccagttttcttttatgtgaaatggaccaaggaggagaattaggcaggctgatctctaaggtccctgccagctctgacagctgtggcttctaaggtggtatctagcaagtacatggcaca

SEQ ID NO: 1679 - DNA, 598 bp, Bovine  MMBT22818
  misc_feature (1)..(55): n is any nucleotide
nnnnnnnnnnnnnnnnnnnnnnnnnnnnnnnnnnnnnnnnnnnnnnnnnnnnnnncaatttcaattattctcaagtgcagctatgctgtttcttttattctgctgtttgtgaaacagcaatctcagtaattgaatattaattttcaccaagaaagcattccaaactcttcttcaaagagggagttaagcttattaattcattccttaacaagaggagaaagtgcatgacttgctgtataaggaataagaactcctaggggccaagaagatttaatcaaggattgaaggggaaggaaaagsgaataaaccagaaggcagaagaatgtgaggtcacctgactttttagaaagagaaaaaaaaaaaaaatttccagagctcagccaaagtgaagtaacaatgcaaagccatcagaagtacaaattcctcctgagatataagctaacgcattgactttcctttattatgccactttaatttctgggaaaaytccaaagcaaaggtttatatttcatgatattgtcaactttgcataagactacttgtgctactcatgacttacacagccatagggacacaattgatttttttctccctcata

SEQ ID NO: 1680 - DNA, 600 bp, Bovine  MMBT17816
aagtatgaatctttgtatctacttattaaagcagattctataaagccctcctttcagaccttttagtgcagttctagtaaaatagatctacccgaaagcaatgaaaaggaaaatgcttgaatcttagtgatagttttgcaaagagaattcattaacctgaagtactcatgcatgtcatttatttaaaagccatttggttttaactttaagctcacccagtcagcacgtgctttcgtcagacatttagggcctaacagggatggatttatttagtatcacagaaaatttcccagggaacastcttctcatcttagggcacaaagtcagactccgagactcagaaccagaccgttggcaagtaaattacttttcatgtcatgttcctcttacctgcccagtggagatgcacaaactcattatctgcttgtcaatgagagaaaaatatatcctgtcttttttgtgtcagtggttatcaggaagcagtgataactgtggcctgcagtttttatagggaaggccctgtggaagatgggagacatgagcgaggcctgggagagtacataggatgttagtcattctgagaccattttttgaggactt

SEQ ID NO: 1681 - DNA, 600 bp, Bovine  MMBT22343
gtccctggggtcgcagagtcagacgtgactgagcaatactgagcacacattttccaaactcagaagcagacacctttcctcatgactggcacttgctaaagaggatgtagtatttaractaggtaccaactactttgcccagcagaattcagtctgccaaacttaaaattctaccctagacagcagtcatttgcatttagggatacagtcataaaaacagctgtaatattaaggtacatagtgccagggaactcaatatttgagagaagaggtaacagcttatctttttatgtagtcccsagagccaaggtaggataataaaacccactgaggaaaattcagagttaaggtgataccgagagctcaagtcagtagcggtcaagaccggaacaaaatgactactctggcagtttgtatgtctgccaaaccatggaggagacaagagctgaggtcatttctaaaaagccgcctatgatggtacacaaaaagcacaaaactttccttagcctgcaccaaaggttgtgtacagtttagataattatagatcctgaggtccagaaggaagtgccctagttaagttgtagccagaaaaataactat

SEQ ID NO: 1682 - DNA, 600 bp, Bovine  MMBT23030
gagtctctttgtgacagttgcatggggtttytgtgttcagtgttaaggaacaatgcgtactggttgcttgagtttggtagtatcacggtcaggacagagtgaggtgtcacagaggtgcctgagggagattggacgcagcaagggcttcacaggatggaaaccctcaaggggtctctstgtttcgaaagtcatttctaaactttgattatatttttttctacgtcagagatgataatctccaaagaactgattcaaggtaacccacttkgtgggaggctgaagcttaaatcagaaaacccsttctttaatacagagtgagaagtggaatctctgcttagtgtgacatgaaaaatccagtctctgtgagtttgctattagagtaagagggattcgttaggtgagactaatgggtagttgctccatggcatacgggatcttcctggaccaggaattgaacccrtgtcycctgcatttcaggcagattctttaccactgagccaccgaggaagccctgtgcttgctcttytgtttgtttttcttggtgctgagagtcacagggatagatctgcctggttgaatctgttgtgaaagctttagcct

SEQ ID NO: 1683 - DNA, 600 bp, Bovine  MMBT22910
ctgcgagtgtggctccgggggctgatggagcatgggagcaagggtccctgatgcaaaggyggagaggaggaggacctggagaaragaaaacagaggaaaagcgatagaaattccatctctcccccaaagccgttcccaagcgccgtgcctttgagagaactcatgcttttgagagtctccaacaggtcagaaagacagatggcaggttatcgtagcaggagggtggggaggttatgaatgtaactatccacagagagaaaagcacagattccgtgcatgtaactcagaagaagatggaasaaagyacccactgtaggaatctgwggggggggggggtattttcaagatatttttagactgagatccccccaaattgccttyatttattctatttttagaacctatttctgtgctgataaaagcaatcttctaataacataaaatttaacaaatatagaaattatataaaactccataatcttttcatccaggagcaacccatgtaaatatcttgtcatgtaccttctagcattccccacaccttccctatgtgtacatggatgtgcacatacatataataactctgagtattataaaagt

SEQ ID NO: 1684 - DNA, 598 bp, Bovine  MMBT21580
  misc_feature (1)..(217): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcctaatattaagaatcctaatatgtacaaatcaaaaactgttctattaaaatattttaccaaaattatactcatatcgsttacagggaacaagtagtacgtggaatgattctgaacagacacacaaagtttgccctttaaaatttgaccaaattctgtatactgcccaatttacaagaaaatacacttctatccagtgaagcagggaaaggaaatatcctcaggattaaggctgcttccttcttagccagctctaaattctgaaaagcacagagcataaggtttttatgtttatttgatttatagccaaaataaagagataagacataatgattcttttttctcatttcagaaagtaaatgcacataagccaatttg

SEQ ID NO: 1685 - DNA, 600 bp, Bovine  MMBT18283
tttgacttatctctctttctatcccccaacgtggacctcttgttttrgaaagaccgatctaagcacatccttttgtgataattttcccagactttcatcttggtctgatgctgtatctgagctctgatgttgcagtgcacctgtgcccaagatttattttcatttccttaatctaacttaatttttcagtttgacacctgccttctatctttcttctggracacacttagagcttggagaaaggagtattgatactatttttagaatgggaaccaaattcccttctttttgacctttatstgttcatttatctgcragaagcttattaacttccattgtgtgctaggaactgtgccaagcacagtcctccaggggtttgtattctaataccctgaacaacattacaatcatttcttttgcttaaaaatttctaattattgacatatcatctagcgatcatcaactttctgtctgtctatccatctgtctattaagacactacatgtagtaaaagggaggtttcaaactagaaatatattttaaaccaaaaacataaatgacaagatgatttaggcagaggttggcaaactaggtcccatg

SEQ ID NO: 1686 - DNA, 600 bp, Bovine  MMBT20114
ggatcccttttggtgggtttctgacaggatggcttcaccgactcgatggacatgaatttgggtagactccgggagttagtgatggacagggaggcctggcgtgctgtggttcatggggttgcaaagattcggacacgagtgatcgactgaactgaactgaactgataggatctggcagcagagggcaatggaggcaggaagcaggcagtgttcccctgttcccttcacgcttcattgtctggctcagcaagtggcaacgtgtccccgtgacacaccttctgccagcgcgagcacctcctstctgagtccagctctcaccgggcccyccacttcctaccaggccagcgtctatcacagcttcccgctgttttcatttctggtgctccgaactctcttaccctgcccactccactgtccagtcccttcgttaaggaatcttctgttgaaccacctgagaagttttctatctcctctgggaccctggttgatatatgcaattataatacatttcaatattttcccatgcaacctacttccctatcagtcatgctcttagtttaataaaatattttccatcattaaaaaagaaattctggagaa

SEQ ID NO: 1687 - DNA, 598 bp, Bovine  MMBT21807
  misc_feature (1)..(139): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggctgcgggctgcgcggtggcgcaggagggcggcagaggacactccctctctgggcatgcaaatcgcggggggaacttcagccaatagtccccggcttgtcaatcaagggcagcagttcctggaggccagaaaggcgtgggggcgctggggcacggtcstgatttcctgctccgcacgtgggcacgtccagacccggcctgaggagccggagctgggacttgcctcggaagaccgcggctaggctctacctggtccggctccaggagcatggccccggcctctctcctcacagcaccagtcaggacccaagtccacaggttgaaaatgtgagagrgaaaattagattaaataaataactctgcatttatatccgaatagagcatagcgagtaaataagtatgcattcatatccgaatggagaataagtatgcatttatatccgaatagcaagtccgc

SEQ ID NO: 1688 - DNA, 600 bp, Bovine  MMBT19183
ccccagcttctgtttctggaggaacagtcttgcccagcgctcrgtcatataataaaacccctttctcagtgccgatgcaacgcatcctccacaaatcctcactttcctcctcctccatgtcaaggatgggacatgcaccagtgtggttggccagaggacatgggtttaatgcaaaaacgggactcatggagggagggaaagaaaagaacgggcgcattcctgctcccagtgcagtttggcagggagtgtgtgctcacggagcaggctcaggaagcaggtatacagagaaacagagggcgstgtcagtctctggtgctgtgggggacacggagtggtggcctggcctggtcttcagtggctgcccccacgagccaggggcttccycttcccgggcaccaggcactgccatcctgcttgcctcttttctgtgaaatgtgggcagatgcaaggccctcgccatgcgccctcccttccgaggctgccccggcttcctccccttctctttcttccatccatatatttctgcatctactacgaaggtcagaaaaacaaatcaatgagaagaaggacccaataatcttgagacctggctcggggatg

SEQ ID NO: 1689 - DNA, 512 bp, Bovine  MMBT20254
tcctcgccagcggcactgcccctcccggggggtaccccagtggaggtgaggaggctgaaggtttagggaggcagctggaaggtggacacgggcagatctgggtgcagggagctggccggaagtgggtgctagggctctgggaaggggctgggggcagcccttggtgggggtggggtgggagtgggcaaggcttcaccattcagggctctgcctcccccagagggctactacctgcacatggactccagcgccttccacccgggcggggtggcccgcctgcgaagcccccctatatgggascagggccccctctgygtgcgcttcgcctacttcatgtttgggctgtcgtggggtgcccaactcaagctgtggctggcctcaggcgccaagggcaagcaccccaacctgctgtggaaacacgtgaacacgcaaagcccctcctggatccccaccgctgtcacggtgcctctggggctcgtcctgcccagccgggtgaggctgcaggcagagta

SEQ ID NO: 1690 - DNA, 600 bp, Bovine  MMBT20290
tgcacgtgttacccacactgccaccacccccaccacacaaagcttcatcatgaaaattaattcttttggaataacagcccttttctgattccccttgtgacctggggaaactcaggatgccataggagctgggcttgggcttctgccttgtgagaaggaagccactggactggrgtcactgtccctccttccctgtccctagcctgggatttcttttctctcctctctctgatagctcggaagcaagcagaacaatgacgtcttcagagaaaaggccatttcctgctggcagtgtgcacrcttcactccaagtcccagagcttctgtaaagaggcaccctcctccctgagcycagatctcctttagtgctataggctcagtaggacaaagacaacacctggatctgtccccgggtcmgctctgacaagattagcctaatctctgctatctgagagaagaggatgtctagggaggaagaatgttctcatttccaggcagaggaagaggttcatggtccccagccttgccaagggtctctgaaatagggtggggtggggcaggatggacagaggtgactttttggcttccctcatccatctc

SEQ ID NO: 1691 - DNA, 600 bp, Bovine  MMBT22993
agaaactaagggtggctttcagagacctgcttcaaacgaggaggctccctaaagctgacggctgttctttagaagaaaaggaaggccrtacaccaacagcawgcctttgttcacccacgtgactttgcctactgcctgcaggtttcatcatccctttggtcccaggatgaatgacaaaggctgaggcataggattctcccaccccagcggccytgggacttcaaagctgggaaacgagygagcccagtgggattaaaaccagaatggaccgctgcacagggcctggtaaccaggaccacrtgaggcccttgtctccagctctgcaactgactgttcttggcctcgacgggtgctctccgtgctcccctgacacctggcttccctcctcatccacagccatctcacctacctacctgcctacctgccaaaggtgtgggcagatgccttagttaacatgtatggcttattccctcagaaccttcggccagcctcggggactcgggaactgttttggttgctttataacagagaattaaaagaaaaaaaaaaagaagtccaaacctggcagaaatgtggcataataatttaatatgcctgcct

SEQ ID NO: 1692 - DNA, 600 bp, Bovine  MMBT20743
gaaccagggggccaggaccacacaggtgctgccaggggcaagtgaggacactatgtggagggacaagtctgtaaggagaatctcctaaactccttcttcctgtgatgggcaccctcatccgcctcaaggggtggggtcagggatcttatcaggaacagcagcacttgatttctaccrtagtttctcatagacatgtaagtccagactcatagttagcatgggggctctgagatagaattggtgtttatggctcttacttactgagccctttctggggctctgtggcaggtacattacctrtatagctcttttaattctcacaaccttgaagttgtgagactaccagtgttacaaaggaggaaactgaggcttaagttagttaatcctagaccacaaagtaaaggatgaaagacaataagaaataacagggagtaggaaataaaattctaaccacaagactttctagaaatttctatttaaagattctgaaaattaagcaatttattcaacttgtgtctgattgattgctttgcatttagaaatatgttctttccttttactactgacttcttggactctaataaccatgattcattctga

SEQ ID NO: 1693 - DNA, 600 bp, Bovine  MMBT22449
catcacgatggtggagaagaccaaggatctaagaatcaacagccctcggcccccttcagctctgtcactgacttcctgtgtgactctggaccagttccttcaactctcaggacctcaatttccrtatctatagaatggggatattaaaagatagtcttcaagctcctttccatctcggggaaagctgtgaccctataattcaactctgcctactctgggtacccagaagcctcgcctggagataaacacacaaagaagtaaataagcactaggatgcctcyagctggaggcaggctagcraatgtaatttctctggccccagcttgtcctagtggtcccagtcatccctgtcctaaagaagggtaagagtaaycaggtgtggcagagaggtactgtccgatgcactgtcctctgagagctgacatccagccttttttccaggctctcgtgtcctagctctaggctcaggcagggtggggaggtgcacagctggcttgcttccctccagccagtccatggatagtggaccctatttcctgccctgtgtagcccccataccatctgatcttgccatccagagaagacagtgtcagatagccc

SEQ ID NO: 1694 - DNA, 600 bp, Bovine  MMBT22446
aattcctgagcctgggatataaaatgtggaaacttcttaaaatcatcgttggtcctgaaatccagttgccatcaattaggagcctgaagctcagagattcaccagagaagctgggggagggagtgagtcgtgtctggtaaacgtgtcccaagctggttggcctggccaggaagggtcccgtaacagaaagttactgaaagttcgtttcgaaaggaacgttctctgctcaccggtctccttcaaagctctgctagtcccagctgctttcccatcacttgccatcactggaagtggagctgrttgctcaaggaaatggtcaggaaagaggggctccctggaccccactctgaaactttctgttggttcactgcacaaagctgatttaggagttggttgtgatgttaacttgccctaaccactcccgctccagggggccagggagcgttaaagacccctgctggcaaggacagctgccactcctgtttgccctctaatctgtcatggctaccatggtcatctttaatttatgggaatgaaggatttcatggtgatttcctgatggrgttcaagggaaggtcgcgtgtgatcagcccggcagca

SEQ ID NO: 1695 - DNA, 421 bp, Bovine  MMBT18800
ccccaggtgactgagactgcagagagtctggaaaccatcaccctggaattctgctccttgagttgaggtcctcaggccagcagcacagcaccacctggggctcgtagaaatgcacgcctactgaaccaacatccacactgttacaagatccccgggagattcgtgtgcacattaaagtttgagaagctgagaggcaggaggagatgaatccaggcagtgggaacttgatcagtgctgatttatgaatgaatgcaggagagaagagtgcatctggggaacaggtagagggctggcctgccrcagcgggaggcaccccttatccttccagataaaagagacaggaggatagtgcaggtacagggtggtcgggctcaggaagctggtgctgtctatttcatccataaaacagaggtgtcacatg

SEQ ID NO: 1696 - DNA, 600 bp, Bovine  MMBT21418
tggatctgactaaagtgacttakcacacacacaggtaagttatatgtgaatttttgagtgcatggaggaccagcactcctaacccccaaacccccacatgttgttcaagtctcacctgtacttactgagcccctactagctgtcaggcatgtgggatacatgagagaacacaacagatagtatccctgccatcatgctaatatgctagcatatgggaacagaaactagtagccacactaaataagcaaaatatataatgtgtagaaattataacacagcctatggaaaaagaaagggcarcacaaggtaagggagatcaagagcatgagaggagagggtcatggtaaacctctctgagaaggaggcatggtcaaagatataaggagatggcgcatatctgaagaagagcatttcagacacagcaaacagtaaaaactttgagtgaaaacaggtctaggaatgactgaggaagagcaaagagaccagcatggcaggagcccagtgagcaggagaaaagtcagagagttaatggagcaccagataatgaagggcctctggccattgtaagggttttcattttttacactgaataaatcagaa

SEQ ID NO: 1697 - DNA, 530 bp, Bovine  MMBT22969
taaaattgaatattctttttttaagtgctattcttctatcttacatgcaagtgttayagaaaagtaaagtagtaacagagacagtacaatgataactgaaaatttaatctttatgcagaacaagtagcgttctatatagaaaaaataaatattttcctattctttgtaagattttcaaacatccctgaaattaagaaattagatgcaaattaggaaattaaatttagttgaatgagatatctcactcaactaaaatcattgtactaacagggcctcatttcttcccagaggatctagggraaagcctatttacttgtcttcttttcgtttgtttgttttctagttcagttcagttcagttcagttgctcaatcgtgtctgactccttgtgaccccatgaatcccagcacgctaggcctccctgtccatgaccaactcccggagttcactcagactcacgtccatcgagtcagtgatgccatccagccatctcatcctctgtcatccccttcttctcctgcccccaatccc

SEQ ID NO: 1698 - DNA, 600 bp, Bovine  MMBT21482
agagttgtctctgatttgaatatatgttggggtgaaatctggaagtactggtttagtgttatttctgtgccaggctgccttaataaagttacgagtatagaatagttcccatcttcttctcagcctacctacctcagcctcttctcatggtctaactccagtgcactctagatacattttgctgattctagagctattggcaaattaacagtgtctttttaaagatcctttcaagtttgaagtactgtatgtggtatggctttgttttgtagagtgtgcagacccaccaggccagctgtrtgagttagagttctttcattgtgatgcttctgactacagagtctgtctgtcctcagttgaaatcagactagctggttttgggcgttgttctgttttgcagtttgtggcaggcgacacatggctgaacaagataagaagggttttattcttgtgttagggacgtgctggggctgggatggaattcagctatgtttgggctctgaatggtcactttggagactcagaattctgttatatcctgttattattttgcagttaaattaacacattcatttactccccatttccccttttcattct

SEQ ID NO: 1699 - DNA, 600 bp, Bovine  MMBT20917
ttctgacttacttccctctataacaggttctaggttcatccacctcatttcaatgaactcaaattcactcctttttatggctgaggcgtatgctccactgtatatatgtaccacaccttctttagccgttcatctgttactgaacatctaggcttccctctctgatttctaagtgaaactaactgaatgcatgccgagggaaaaatgaagagatgaagacagaatcatgtacccagaatggtgagtactggagacatgaagagaaagaagcaaaggatgactgccttcatcaccccggcrtcctcctcttcctctacattctggtctaacttctcactccagccttggccaaccacagggaccaaggggatcaactccatgggttccaggtcctgtcagctgctggcctcatggaaactcttacctccaggacagtttcttccatggctaacaccctacagtagctgaactgccattgtccaaagctatctgctctgtgtatgaagatccagtctcctccaagctttcaactctcctggactctaggaaacatccttgtgtatgttgctttccaccttatatctgctcaccaatcttata

SEQ ID NO: 1700 - DNA, 600 bp, Bovine  MMBT22323
tcatattaaaaaataaattgaatagttttctctccttctaagcagggagagttcttactcttcatccttttgaacctttaagatttttaatatgttgcctattcaaaaaagcaaattaagaagttaaatagaaaggaaagaaggaagggagggaaggagagaggaaggaaagaaatgccagttagaaaagccattgctggagatggagcagagagaccagagtttagattmtgcgattccataaggaagggctggattgcgcgtgaggtgagggacagcggagccaggtgagtggccagrgcttcctcaaggcctctaaggttgtgtctgaggtagtccagggctagaagccctgctcttcctgttctcctctgaaatgcagactcagtctgtactggttcagtgttctctctggttctaatgtgtatttctgaaacatgacattaaactgtaataagtaaatttaaacctcctgagcacattccgtgagcattcattagtttgtagtttatatactgacaacatatatttattggatttgtctttcttcccttcacctcattctgaatgggttcagatttttaacattccctcctcttc

SEQ ID NO: 1701 - DNA, 600 bp, Bovine  MMBT22256
tctcaggatctgcatggccctgcctgtctcatccctttcccctctgccagatgagcgccaccagggtggccattctgaacacaccctgcgtgttccgagtctttgcgtattctgttccctctgcctggaaccggcaactcttcccctacctggagtaaaccctcygatttcaccattgcttcctgctgatcactgggtgtctgctcccctgtcctgtcctcagagaggccttccccraccgccttgggggtgggtgagtctccagcagctgtgctttaccttcctggcaccgaccaggartctggtttgtatactatggattgcctgagcctcctgcttggctgtgggcaccactagggcaggggtcctgccttttttctctgctgttcaatacccattgcccagatccagggtcatagcagacattcaatacaaactcgttcaaggatcgagtgaattagagaaaaaataagctttgggaacgcagagaacacagaggactgtgtacaagaggctgacgttcactgaagcaactattgtgtgcctcgcatttactctcacccacggatggctatcaaattcatctcgcagcccagagaa

SEQ ID NO: 1702 - DNA, 600 bp, Bovine  MMBT11934
acaagtgcatagccaggtgcactgaagttgcttgggaaatctgtagcactgttttgatatagtccttcactttggcacaccaccttgtgatctgggagaaactccccgttcccagcttctcctcatggagggaaagaatatattggaccttaagcctgtctgagggactgacttctttctcacctgtcttagagcactgatgggacctgccatagtgtagatacytgggggtcactgaagaacctaaagaagctggatggcatcctgctgttccagaggagccatgtcacagcagatggraggtgatatagctyggtttcttctccctcagagacaagaatgcagtgtgtgtccagggttctggctttttagtagctgcctgagggacgagtatgtatttagcctagtttgggacactgataatattgggcatactctaggtacatccctgggtgctgctgagaacaaaaaagagctaggtggcatgctgctatttctaaggacctcagtacagaagacagacagcagagggagcaagaatttatcagctcctgmaaaaaratcctttatattagaaatctacacacatgcattgggaga

SEQ ID NO: 1703 - DNA, 600 bp, Bovine  MMBT22050
catgagatcatgcctcataaacctcaaagtataggaagtatcactgactaggctactagtcaatgctactttgctctgaaatctattttttctcttctccaaccaatgactgagtgcagcagaggtactaatacaaacccattgctggaagacacgggattcccttgatggcctgtgttggctcaggattcsctgagcscttgctgaccatttcttagcctgcacatcatgccagaaagcttccactcaaccttccttttgtctctctttcactctaggtcacacttgcttcatggccarcagctctttcagccttactcagattcctctccaatttctctcataggcatttccctaataaaatccctcttgtgtttagtcctcctttggtatctgcttcttggaggacctagaccaatacaccatataatatttgtactatagttatccccatgctatagattggggaatctaagataggaataggttaagcaactttcccaaaacagcattgttggttaagtatacagcaaggatatgaacccaaggatgtgatctttaaatacaatcactcaataattatgaatgtaaattcctgaa

SEQ ID NO: 1704 - DNA, 600 bp, Bovine  MMBT21262
tgagtgctttatgagcacctaccacgtgcaacatattgggcaagtgccagactgccaggggtcagaatgccagaggcggtgtaacttgatttcagtgaggccttagacaaagcatcccacgattcactgataggtcrggaaggtgagtggtataaaagtataatgacatgattttgcagctgactaaagagccatatccacagaggattgataaataactggtttccgttagcaggaagttttccatcagactcatccttcttataccttgctttagtcagcatttttatatatgacttraaggaagaagataagcacaaagtttagagtcatagctaggagatgaaagaggcaagatgaaaaacaatctgaasagcatgaaattcagcaaggatcattattcagttgtgtattttgtttttttaaaatcggyagtacaaattcatggggattcctggtttggcaggagttcttgttaaaaacaagtaggtttttttattgaccacagcttcatcaagaggcattaatggaatgtggctgataaaaacaaaggcgagggcaattcttgaccatggtcataaatctcatgtccagataata

SEQ ID NO: 1705 - DNA, 600 bp, Bovine  MMBT20179
actgcatttattctgctctgtaaaagtccctgagttgaattgtatactatgctggtaaggtaactgaaaggttgtgttagagcaaatggtgtcccatttgctctaactgtccccagttgcccttcccccagttttaaaaggagagcaagcatcagaaggtctttggtttggtgcagtccagtcatgattttgtctgatgtcactgaatcaggaggacagcatcccctcagagatctcagctcttactcacagggtcccacttgtatgatcaatagaaaggattcttaggggcatggccaragacttattactactgtttgttattcatcaattaatatgatctgtgcctattatatgctaagcattgtgttcaatactttacttacaytgttttatttagtaggtgtaattattatctctattctgatgaagaaactgaagttcagtgagactgaaaatttacccaagatcacatagctwttaagtggcagagccagcattcactctctgtcgtgggtgcttcctttccttgtacagtattaggagcataaggaaagatttgtaaagcttccccagcgagatcaccattccgccttcttc

SEQ ID NO: 1706 - DNA, 600 bp, Bovine  MMBT19797
cattgtcctcaatgacttcagacaaaacactgaacactcaaaaggattccatttatctatctttatttatgatttatgatatttataaatatcctctatttatgagcaatgatgacctaaatatttaaaagtaataatttctacattagtgaataaagtataattcttactaactcagaataaactattactttgaatatatagctccattctgaatgttgaatgcttaaaaatcctccagtggtccctattttccagaaaataagtttaaagggcttagtatgaatatgcaattcatgrtcttatcccattatctctcactaacttgttttcttcatttttcaacataactggtatcttcaaggtacaagactaacaggataattttacagatccacttaggctgaactcttatgaccttactctatgaagattttgccaacacacacatgtactgaagcaaaactaatacatgatgaaataatatattaaaaattcttaattttatatcaatatagcagattaacttttctatttttaacctagactatgactttctgttgtgtatatacatatgttcatacacacacacacacacac

SEQ ID NO: 1707 - DNA, 600 bp, Bovine  MMBT22363
tcgtgtctctctccatcggagaccgcgtccctgctgacatccgtctcacagaggtgaggggcccagaccccggtccaggggccgtgcagacacttggcttctcggaggcaggcattctctccttcttgcacacacatatacacagacataggcatgtgtgcacacaagcagaaagttagcaagcaagctaattttaagcacaaagctcctccgatggcatttcataaattatgtattctcatgtaagtataagctaacacgttttggttatatgattttctagcttgtagcctactgcartagagaggaattttatagctgaggaatgggtttatagctgaggaatgagggataagttgcttctagaaacaaccatactgatggcagacagaagcactgtcagactgcttaatctcaaggataacaactagtctagccgtagaaagtagcacaagcctttgttaagagtgcagtttgggacatcgggtgtggggctccatccccaacctttgcgggtctcagggtgtcacaacctcacagaacattccctgaggctgtcgaagatgatcctgaatcctcaagaaaaggaagaaaaaaaaa

SEQ ID NO: 1708 - DNA, 600 bp, Bovine  MMBT15652
atcctggctgtactagttaccagctgtcctgctttggtcaaattacttaacctttacaagcttctgatttatcatcagtaaagtagatattatcataatacctcccttgaaggattgtttttgaagtttaagtgtaaagtttcttgtcaagtactggcacataagtctgaaagactaaagaatagcttcacttgtcttctcaggaaattgaggttaatttacagattaagattcttggctacaagcaaaaaaaaaaaaaaccctgtctctagctaagtaaagcataaagagaatttatcrgaagaagtcaggaatagcctgtccacaggattgaaggaaaaatggagcattttagtctcaggaaggatagaaattggaccagcatgagaaatctaggtagtgggacacagtggacaggctctctagggtgcagctattataatgcttctggtctaatcggtttcctcctttgaaagatgcatctcaagattcaggttcctaggagagacaaagtggtatcaactagggtagtgagacatcttggttgacagtttaggggtcccatcaagactgagagaaggaaaggctgagcaaaaaaac

SEQ ID NO: 1709 - DNA, 600 bp, Bovine  MMBT21970
tccagaatatatcccacatgtctacaagagcatatattcccaatgcaactaactccatttacagaaacccctgaacagcagcagttagcttcttttagtctcaaccccaaatgagtttttagggtctggagatgtagcatgatagggatccttacagcctcaytgagtgacagatgatagccacaataaaaatagattatatgtratgacatacaactcacttttatggcttttgtaggttggacagcttgcatgttacataaatttaggtaattttactctaagatgcattataatggrtaatacccttggctggggcttcttcccacatggcactagtggtaaaccygcctgccattgcaggagatataagaatcatgggtcagtccccgagttgggaagatcccctggaggagggcatgacaaccctctccagtattcttacctgcaaaatcccacrgacagaggagcctggtgagctccagttcacagggtcgcatagagttggacatgctgaaacaacttagcacgcacatgtgcacccwtggcttactaaatatatgtcattatacctactaagtacttagagaatggttgttt

SEQ ID NO: 1710 - DNA, 600 bp, Bovine  MMBT19023
caagttaaaaaccaagtatttccttataaagttctagaaaacaatagatacttacttcgatttattatgtttctgactctggcatgaaacaagaatcaggtttgttttcacatcctrtaatatctttgccagtttactagccagagcctcacaaatatatttccttattaayaccaataygaattttcctcatactgcagaaattmttttcttaatgtttaaaacttgtttgttaagatttaaaaatctaaagtatttagatttttaatgctaagagtagaacactctcattgttctaartagttaarcaaaattattttccccaatatggagataatcttttcccccaagattgtaagcaaactcttactgttgtaaaaatttggatagtacagagaattataaagaaaaattaatgaccctaaaaaaattaatcacattaatctcactacccactgatgatcactgtcaacatttaacatctagtatattcaaatatatgtaaattttacaatataggattatattatttgttcttattttccatctaatgtgattatttttctcatgggtaaatataggactatatcatcttttcac

SEQ ID NO: 1711 - DNA, 600 bp, Bovine  MMBT23037
aaaagaccttgtctgagggtctctgagtggactttkcatgtatatgtgaaaattcttcctgttccaagatctctgggacctgtgtgacaagtggggcaagttgatctaagttttctgtgatttggatatcattctgctgttaagtgccaactccctggggagtttttaatgtttccttgtggtccccaattaatctataagttaagtatgtgagaaggttaaaaccagttttcctttgacttttttagcgaacycttgaaagccatttgatgtcccctgctgagattccaggccagcctrtccctaagaacatcttgcaggtacttaacaatcttataccgaggccttggagtcctgaacagtagtcctccaaactggttttgtgtagtgggccagctttgggccgtagagaatgatccatgttgcctggcaatgaaggatacggttttgctgcctgacatagttctctgtagctataaatgtggggtgggttggtgggtaaaaaagatgatcgagtaaagcyttggtttcccgtttgcaggtttgcaatttctgtggaaatttaaagtatctaacctatatctatagcactaacttaaa

SEQ ID NO: 1712 - DNA, 600 bp, Bovine  MMBT22644
accattggcttgtttgttgatgggcaatccaggcacattcagactcgaggcaatcaccccattttcttatcaattatggacaaatgagagacaggaaggggaatttctagggagaatggaaaaatggtcttcaacacaaaagtgttgtgtgattaggggttatctgtcgaacctcttgcaggatcccatttctcatcgttattgtggatgattgagcatgatattgtggccattctgatggcatctttcagaagatttcatttctgatgttcacttgcctgcttgttcagcaagctgacrtatctgttcaatactgcaccccctccccgcaacacacacaactgatggattttagtagatgtagtagattagtagtgaaaaaaatcaaagaagtttgacaaaaatgtcctcttttgatagaatttattagtcatttgctgactaaatcgatcagctatttttatcttgatttttcttgtttttgtttttagacataacaagttcagctaactaaaaagaccaggtgtctaatcgacttggctggttgtgctgacagttatttgatatgacatcaattgactcaactgacgggaatttgaa

SEQ ID NO: 1713 - DNA, 600 bp, Bovine  MMBT20093
atagcagcactatttacaacagccaaaacaygggagcaacctaaatgtccctcaacagatgaatggagaaataatgggtgtaagggttaaatacactggggacctgggmgccttcccatcacttacaatctttatttttctgggttcaaaacagcttatcaaaaaatgattcatggccacttagtgaattaaagcttgctgacacatttcctcaaaaggaaacatcatttggattattaatacacagtggaataaactcagccataaaaaaagaatgaaataatgccatttgcagcaacrtggatggayctagagatcatcattctaagtgaactaagtcccaaagagaaagataagcaccatatgatatcacttatgtgtggaatctaaactatgatacaaatgaatgtayctaatgacacaraaacagactcacagatataaagaayagacttatggtttcccaggggagtcggggagggatggattgggagtttgggattagcagatgcaaactattgtatacagaatgaataaatgacaaggccctactgtatagcacaaggaactatattcagtatcctgcaataaaccataatg

SEQ ID NO: 1714 - DNA, 598 bp, Bovine  MMBT20178
  misc_feature (1)..(23): n is any nucleotide
nnnnnnnnnnnnnnnnnnnnnnntgaatgaataatggaatgcactaatgtgagagattgtgaaattttcttcagtagagatctaaaaaattaattgctaaactacttcctgggctcttccttaaagagtgtccaagttcatgaattggccaccaggggtcaccagaagaattgaaagggcttctgaggcaaagccataatttcctgttcasgaagaagagggcaatttgtaattctattgttaaagagacttctcacttaaatatttaggattcttttgtcccttcttttatatttaaartttccttgtcccttatttttgatcgtcagttcttgctgcactactctgacctatatgtcattggtagatatttttctttttaattaaatatataaatgcttttttgtaaggtattattcacatttcaaatattagcccatcaccaaaggctgcctttaagtattcagtctaacatcttcctgttgttcttttatattacccatttctttaattacttatttattaccwgtcttcccactttaccagaaaagtagccagagctaacacttaagtagatactctaggcactgttcaagtg

SEQ ID NO: 1715 - DNA, 598 bp, Bovine  MMBT19391
  misc_feature (1)..(16): n is any nucleotide
nnnnnnnnnnnnnnnntagatacaaactttacttttataatacagaaaatagctacacaccatcttaagtagtattcaatacagaatataaaaaaagtcaaaattcaactgagctaagtaggtattatacaaaacatcagaaagcagataatgaataccaaaaacctctaattactggaagcccttttaaaaagtttaaaaacacctcataatgcagcctcaaaaatcacaccattacctttctgacttaatctgagamgtcctacaggtttgtagttcctaataatccatggctccatrgccaactggttcagtagtcactacactacttaacagactcattcaatactgagaacaacaaagctcagtggatttatcaaaaaggggagaattcgagaattcacattttctcaaccaattaaaaaaatgccattaatatcaacatctgggaaacaaatctgataaggttacatgtgtggcgtatttacacttaattgattataggctgttcaaaatcagacaatactgacatggagccatttgtggtggagtcattagtttcaagccattcatgtaccttgaaacgaactcaattatt

SEQ ID NO: 1716 - DNA, 600 bp, Bovine  MMBT20840
taatgaaatggagtattaattgtggagtgttaatttcttcccttcagcagtagctgcttgctttgactggatgtgtttgcagccaaataataaaacaatggggcttaaaaakattttctaggtggtttcagccctctacttttccaaatgagcaaacaggatggggagaagtacagttctatagatacgtattttcagtatcatagcctgcatatgaggcagaaataaaatatgtgcatattttaattaattaattaactggccgccatgggatcttgtgtcacatggaatcttgagctrcggcatgcaaacacttagttccagcatgtgggatctagttgcctgatgagagatccaacgcaggccccttatgttgggatgatggagccttcgccactggaccaccagggaggtccctagaatatgggcaaattgttgaggatgtccatttgaattagaagctttgcttaaaattttatagggaatcaagtcaaactgcaaaatatctaaagtgataacatttcctacaacaaccatcgctttttagttttgccaaagaattgatgcttttgaactgtggtgttggagaagactcctgag

SEQ ID NO: 1717 - DNA, 600 bp, Bovine  MMBT20579
ctttttgtgaccttatagactgtaacctgcaaatctcttctttccatgggtttctccaggcaagaatactggaatgggttgccacttcctcctccaggggatcttcccgacccaggaattgaaccatcatctcctacatcttctgcattgcaggcagattctttactgctgagccactggggaagcctgcaatttagaatctatgatggaattattccttgagttaatgtgggttatatgcatatgtttatgctagtaaccagttctatagagctttttccctttctattttcccggaartgatcaagttctcccaggtctgggataatgtgttattttgtggccaacaccagcaactacrttgtcccagatccttccctattacatttctacctcctcaagggaattaagctactacttaatgtctttattttcacctgattttctcasgcaggacacagttgattccttctgtagcaataaatctctgcatgcccctaccatttctcaaccaaatcactttgcaagtctcaactaacttaactattgacagctttctgttttaaattttctcctttcatcataaacttatgtaaatca

SEQ ID NO: 1718 - DNA, 600 bp, Bovine  MMBT21728
tgcagggggtaactaagcctgagagccgtaacaaaagctcccaagtactgcagccaagactcaatgcagcaaaataaataaatagataaatagttaaaaacagttgtttatgttacgtggatttcccctgaaataataaasagcagctggcagagggcaacgcgtagctcagagggttgaatcctgaggatggacctccggcacagtggaggtgatgctccgggccctgtacctgtattgtagccgtcctggagctccatgatgaagccgtgggcgttggccttctgggcagcctccacyactgtctcgaagggcacggtgggcaggccataggagatgttgtctgtgatggagcgggcaaacagcactggctcctggctcaccagggagatctgtggaggaggaaggagggggcatgggaggccgggaacgcatcagtccagcagtcaccaggaacctcaccagccccgggcctggctgatgcctggggcctcaagtctgaaatctgatcagggcccacggccggcggctgctgcattcagtggcctctcttctttccaaacagtggagtcgactttctgcacaagccctcagcctccc

SEQ ID NO: 1719 - DNA, 600 bp, Bovine  MMBT21732
ttcacagctggcatgaagtggctcctgcaggccttttctatttctaaactcagtaagtaggctccctgggcttccccggtggctcggcggtaaagaatccacgtgaaaatgcagagacgtgggttcaatccctgggtcagggagatcccctagaggaggaaatggcaacccrctctagtattcttgctggaagaatcccatggacagaggtacccagcgggctacactccatggggtgcaaaagagttggmtacaacttagcaactgaaccacaccaccaagtaggctccctgggtgttyacaaacgtgaaacgagactgaccttgtcgaagagttgtacttggtcccgctggcgctttctgaacaagtgcacacagatttgtggcgcacgaccctctgcactttggaaggcttgaagatgctcatccactccacgtcagacatgtggcccggcgcttcgattacgaagttactcgggtggcagcacttggactcccacatgtcgctttcatccacacaggcttcatttctgtggcaacaggagactccaggcctttccaggtggtcctgatagtcgacatccagcttttctggctgctt

SEQ ID NO: 1720 - DNA, 600 bp, Bovine  MMBT19317
gacgaaacgatttctctccttcacccacgcaatactaccattcttccagcctctctttttgaagttggaaaatcccgamttcaggctcaactcgggcacctcctcctccaggaagccttccgtgacctcctcccagcattgcatcaggcaactcctcggggatcccacctgccagagctggacagacctgggcccaggatcctggggatccatctagaaccacccatctcaaagcatggtccagcctcatctagaaacttgtgagaaacatggcttctcagtctccaccctggaccttcygaatcaaaactgggagcayggcccagcaatctgtgttgtaaaaagcccctcatgggattctgaagctcaagtttgagaatcagtggtctaagcagctgcattttctgcatctgaagtgccttatgacctggtcccactccagcagctgctgcaagagggaggggtccgtgtctcccctgggtgccgcccgctaacagagttgttacagactagaactgtctctgacccatcctcttctcgcacttcctggagacactcaaccaattttgaattgtaactttcttttattggcaaagaaga

SEQ ID NO: 1721 - DNA, 600 bp, Bovine  MMBT22200
tataaggtttttggcctgtgtgctgattatttcctggagtatatgtcttactaacccctcagagctgcactgccaactttctgtctgctctgagctagcccatgctcatttctttgcctttgcctatttctaccacactgagctgctaaagcacataggaggcactggaagaaagttatttttcccccacagtgctcttcagctcctagtaacctacttcacttttaccaacacttaactgcagtgccctctccttagtgatgtgttcttttttcccwgagtatctaactattgagaggygaggctgtccttcaccattgtgggggatattgagtgaaagcctagggcatcaactgtcttgctgcagtaatagagaatgtgacagctgcccaaggctacagctcattttgagctctgaagctcactttatattcttttacttttgtcaagttatttttttttttaagagttgttttattattattttggctatgctgtgtggcatgtaggatcttagttccccaaccagggattgaacctcaagctgtcttcaccactgatctaccagagaagtccctatcaagtacttgactgttgtgg

SEQ ID NO: 1722 - DNA, 598 bp, Bovine  MMBT20112
  misc_feature (1)..(94): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgccggtgcagacttgctgccttagaggaaaagccgttaaaagaacgtatttgtgtgtggaacaaggtcatgctcttattggctttctgctgcatggcatcaatataccagatgaggagaatccgtttgctttccctatagccttgtactgtgcacaagggctgcagcacatatatattctctaaygctgccggtgccaaagyacagaggaacccagaggcagggggttcaaaacgagagaagagccaagtgtttgttgtaagaaataaatacgttacctggacacatcattacacttgagcaattggtgatggtggtgggaaagcacgggacttctgaggctatttcacagataaattcccagacgttcccctaattctccattctctcctgtcccagtctgtccaaccactgcagcttgactaatattattaatcgccttcgtgctgctcctcctcctcctgttactaatatggtaacacttcatttatccagcatcat

SEQ ID NO: 1723 - DNA, 522 bp, Bovine  MMBT23177
tggtggatctcatttattggtttttgacatttctttctggttcttttttgttttcggttccccctttaccaggtccaacaatggtaaaaaaaaaaccctacagtagtgggtgtggccctttttaggccagcccaaagccttcagagcactcctggatggccaatagtagcatgtggcggagcttctcaaagctctcataggcaggcaggtccagctgattaaaactagggaaagaagacacatcaattcgtgataaaagatgataaccaaatccctgtgttcccatggtgcccacctgayttctgcctgtacactcccaatcttgtcctagccttgtctgtccttctcagtcccactactggctaccaggcacctaaaatataacctgaccctatcactcctccttaaataccatggcccaaccatggtataaataccacctcccaaataccataccccttgagcctgaaagctccaaggaggcattcagggtcactggtcacctttgctgagttctgctcc

SEQ ID NO: 1724 - DNA, 500 bp, Bovine  MMBT23189
catttgggcatccctaggaaggctgtctcaccgccagcagccgatccccgatctgtaggcgtccatccttctgagcagcacccccctcaatgatcttggtgatgtagatgctattgtctcctgggatgtgctggttgccaatccccccagcaatgctgaaaccgaggcctgggaggaagccagcaaggagtgggagagtgatacaaggagaagttagagtgctcagttaagcccaaccccagtcccccatgctcagccaagccaccagacccataggagctttccccagggatcccaaaygctaggctgtcatcccgtggtcagtaagggtgagatgtgaggtcaagaaagaagactgtgagctgaactggggaggtaggcagggggtgaggggattcccttccacttcctatagggccaaccaggggcctctggccagagcacgggaacctagagggccgcacctttgggccctttgagcagattgacctccatgatgg

SEQ ID NO: 1725 - DNA, 600 bp, Bovine  MMBT18630
aaatatagcaagcagttcagttttgcttgagaaccagcactccattatgtaaaggggcagtgcagggtaaggctggaaaagggacattcaactggacaaatgtcagattaagcagttttacctaatttgacaggaaacyactgataatttttaaaatagggtggagctgtgatctggccactgctttagggagatggttctggcaagaacaccaaatggaytgaagggaaagcaactaagcggaagaccaaataggaaactacagcaaaagtctagatgagaggtaaccagtagctgacygagggcagtggcaatggggacacagaggcaggggcggatggaaaagacactgggtaggaaaggtctataactctgtctaattcggtaccccccagccccatgtggctatctaaattgaatttatgtacactaaagttataaactttgttactggcgtgctgtagtcaatggggtcacaaagagtcagacatgactgagcgactgaacaagttataaaatccagttcctcagtcaatgctcgatagccacatgactactgtattagatatgcggataaagaacattctcatcacagcagaa

SEQ ID NO: 1726 - DNA, 600 bp, Bovine  MMBT22025
tgctctaaaatacagatttgttttttttatattgatcaaaaatgtatttttcagtctttggaatatgaagtttatttatagctttagttccaaaatagcttctgaaatgcattgcccctgtttttagttgtaatgcatgtgattatactttattgaattaaaactcttaacagagaaacaactgaaagcaatgacctaattttttctcttagcaacttggtcagattccaggagtatgtgacttgatacaaatacmgaataacaaaaactggccccactctaatccattcctccctcttyccatcctctccattgtccccatgttaacacgctcccttctgtctccatttggttgctctggtagttcattttgcttctccctctaattgtttcctcttcggcagcttagtctggatatacttgctagagaacagtggagctaagttaaataccatcatcaacagatcaaagtagtaaatacaggtttcagttaaacatgggatatggttgaagaattcctgtttcaggaatggcagttcaaatgactcaagttatacatctttaatcataatgaaatttagcacttaactcaaaattgtg

SEQ ID NO: 1727 - DNA, 600 bp, Bovine  MMBT19337
aaaggctttctttctgtatgtttttttttttctcccagtgacttctttgcttgatttacctactttaattgacatatacttaacatacagtattgtattagtttcaggcatacagcatagtgatttgacatttgcatccattacaaaatgatcactgtgataagtctagtaaccatctgtcccttacagacttattacagtattaytggccatattctgtatgctgtgtgtatcccyggggcctactttataattgaaggtttgtacctttcaacccccttcacctgtttctctactgcyttcagcctctcccctctggcaaccgctcatttgttctctgtgagtctatttttatttgtttgggttttttagattccacatataaatgagattatgtgatatttgtctttcggtctggtttctttcatttagcataatagcctctagatctgaatatatctttgcaaatggcgagtttctttatggctgagtactactgtccccgtgtgtgtgcgcatactcatcttcactcattcatctactgatggactctgttgcttccatatcatggctgttattaataacacatcaatgagtgta

SEQ ID NO: 1728 - DNA, 600 bp, Bovine  MMBT19053
agttatttaagtgttttctcccttaatacctttaaattcaaagttctgcttctttagcagaatttagcaaatctgttctaagactctggcaatctttttacaataagcaagtaagcaactcaaacctatttagcagaagttccttgaggtcccaggggctgtgtacctctttcatatatttcacaaatctttattatatcatttcatgtgtactttggttgacattattttttacctttgtgcagatagtcacaaatgcctccaccgcyggacatataggaaacccacttatggagatayttccttgaggccacaagcgtgttgtcctgcttcacctggaccaggtactggagtgggcctgtgatcgtcttcttgttacagtgccacttcaaggaaacgtgggtggaatcacactcgtatatgctcagcggctgctctggactagacacgttcaggcccaggcagccactgccttccgatgttaaataggcggtggtttgaaacccacttccacagcatgtacttgttgggtggtttgcagttctccagggtcagtgtagatttgctggcttgaatacatttctcgaggttctcactttg

SEQ ID NO: 1729 - DNA, 571 bp, Bovine  MMBT22856
cccctctgtccccaccctggcagccacagccgcccctcagcccawgggtcctccacacagggaccctgggccctccaacctggcatgggaacagagtgccaccctccttcagcaacccccaacccacagggcatgctgccatcagcctggctttgtcccctggccaggactgacctctcccctcctgacacgtggaagtgatggaggtcacacctgggggtggggggcagggggagggagcctagttcattctgcgggttgggagctgggacctgcatcccgctaacatgctcccctgayacctcctgtccagtgtgtgggggcggggggagatggacaaacttaaagtcactttttggggctagtgtgggccatacagtgaccccaggggtcagagtccttatctagaccattatcaggctcaggttcagatggaaaagcttggagcctggaaggggaagaccccgttggagcaaccctgggggaggggagtatctgtgcccagcagtgggacctggcgataggctggcaggccgctcagacccacctgacctgcaagcttcaggaagag

SEQ ID NO: 1730 - DNA, 598 bp, Bovine  MMBT20771
  misc_feature (1)..(160): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagttatttattaatggacatattagccatgtagttcccataaaattgtgccatatggacactttgtccattactcaggcatatttgcaaagcatgtgtccaggatcctttgcaatggctttttgtattcagaaaacygcagacctgggagaaaagaaagatagggggaggagtattaagatgcagagaagtccttgtytctctggggaactagcrtgagaggtgcagacaccagggcgtgcaaactgtggcctgtcataaagcccctttgaatgggaacatggaggagctagagcacctccacctgaggctctcaccccacatttacagatgcttccaggagacttcttccccgaggccctcttcctctctggggagttaccgakccccacccttcaggaaggtgaccaagatgaacaattcccagaaatcagga

SEQ ID NO: 1731 - DNA, 600 bp, Bovine  MMBT19869
ctggttggaatacaaagagttaatgtagaatccttattccagctcggctctgtttccatggcaacagctaagggtggtgaaatcttaaactgaaatccctaggagccagcaggctgccagctgtaaagctggactcactgctcccagcgccacctgctggctgaatgccaccagtgcagctgacctacattccaacctcatttatttgccctgggkacgtggtccagggcagggtcccctgtgctgactgatgatgtgtgcagccttcatcccacaaatcagctggactccacctttccytattacacyctaaacaataactaggcacaaactctagaggcttggggagaagsggggaaaggtgaaggatatacctcacgtgggcttgtttattattagagcaaagtttgtggcttacatacaactggagtaagggcaggggaactgcttcccaaaaaaatataaagaaaaaatagaaatgcagggtgcttcaggtccctaatcataccacaacaggagtggccaaagtcaagtccctgcgagcaaaaatgctagagcccctcaccccttgtgctcagcacagcactgattcttgccaga

SEQ ID NO: 1732 - DNA, 600 bp, Bovine  MMBT19062
ctcttcacgaccccatgggctgcagcccaccaggctcctctatccatgggattttccagccaagagtgctggagtgggatgccttcgccttctccgataatacttcctaatacctcatttatcataccttattggtcatacaaagggtcctattaacatgactctagccctttcatacttctaagttattcacatgactcaagatagatacacagaggattagagaaagtgatgaaggggccarataatgtctcatcagtttatctgaaatagtacctaagacctgtttcttccacttcygtaggaaaaaacagaaatgcatttcccctgaagacagtgtcccagctcttatcggggtgtggtgatactttgacccttattgtgaggtttttggccattcaactgtgcacttcagccagaagcaggaggtggcccccagagcctaaggaactggaacaaagctgattctttgttggtgaccaaaaactatagtgagtcatgacccttcacttcaaaataacatattgaagaataatttttcaactccagaagcaagttaattacataacgtaaggaagaggctccaaaagtcttaaggat

SEQ ID NO: 1733 - DNA, 600 bp, Bovine  MMBT22287
accttaggatgaccttgcctgctgcctgagctgttttcatatcctacaatgcttattgcataatcagaaacctcctgctgaaaatacagctggatgggatagtgtaaatggagggtgaccatggaaaacattgctttagtctcttagcatgaggacagatctcataatgataccagggatggaatgaagttgagaaatcagacacccagagcacgtcaccttgaaacgagcacccttaaccctcactctttggctgtccaaacattgatgctccttgctttctgtgttatattttgtttygtctactgtgtggaacaaaggttggatttacctgcyttgtgggagaggggattaagagcaggtgggaagagcaatgtcacattaggacttttcctgttgtctttgactttaagaagccaggtgtaatgagagtgacggatggacacggggcaatttgataaaattggaatccccacccccccagtattcccagcaccttgagaatctttctctgaagggaaacttggcccagctgctgaacaagaagatagggacacatcattgtacatgctcatacaaagacagaaaacaaattagctt

SEQ ID NO: 1734 - DNA, 600 bp, Bovine  MMBT23224
ctagctgtcagggtgcactctgccccagattggcaccagacgcctctcctgacttccagctcggcaactaacctcagcttttctcctgtgctccctgtaccttygctcctgctccccagttcactgggtccaagattcatcctcatgccctttactgaccccgaggaaggggaagcaaaagttttggtgcctgagtctcggggatgagtgctaaagaggagagggggagagtatgcaggttcctgcttgcaaggtggcaccggggggtggggtagagactccactgagagggtagggmcygggaatggggaagatgagcacacctgtgcctgytaccacctacttaagtaaacatgcaggcaaggtcatcgatggcaagccaggggagggatcgagggtgctctgacaggaaagcagagtggtcagggtaagcaggacagtgagtgcagtgagggaagggtgaaagactggagctctgtaagggggtcacgagttccttctgacagggaggcagaatggcagcaatgaatggaaactgctaaaccccagaggagggtgtttagagaactagaagagggccttcagggaaaagggaggacg

SEQ ID NO: 1735 - DNA, 600 bp, Bovine  MMBT22837
acagcaccccatcgatatcttgttctgttttcccagtgggaacctgacttctagtgggtaacatagcaaagagctagaagagagtttcttgtaagtaaagtggcaggctgccctcagatgccaggaggtgctctgagctggaaagaagcccrtggcctggcaggcccctaggtgtccagaggagccttgtcacagagcatctgtgggtgggtgtcctacctcacgctgccttgggcatgaaackaacttggttttcagtaggcttcaccyttgagagcacagagagcctggcaaatctgytcatttctcrtcctaatccaagtgttggcactgctgtgcattagacgaagcttcttactygaggaagatcaatacataatattggaacatggtcttggagagagagtttatggacttgtaagaggcgttgaggcttttagcctgttgtatataaaacagatcaagaaaaacaaagcagaatacgggggatgggagggccttttgcttagactgacattaacccagaggtcctaagtacatggagggctgaggcaaggtgatctggagggaacgtgttccgggcagtgggaacagcaagtg

SEQ ID NO: 1736 - DNA, 600 bp, Bovine  MMBT21085
ctgatgagatgaaacactccttgcagagaaatattccttacagagaaggtaagccatcttcagctgagagatgctggctgagtataccgtctggtagcggaggcccccaagtcaggaaaggaagtggtccccgtgtcagccagcgtgagagtgggttctctctggagacgccaacctcacggttagtgatrcctggctctccctgcccactctctactgaactccggagtccagagtctgaggagggaaawtaccagagggcctgggacagggagatggaccacatgactgttcacarcycagccaggaacagctcctactgtggaagtgtacgtttctttttgttggtcttggctgttctgggtctcattgtggccagtgggatctctgatctctgttgcggtgcgcagttcttcagctgcagtgtgcttgatcttcagctgtgggacctgagagcttttcgttgcagcatgtgggatctggttccctgaccaggggttgaacccgggcctcctgcactgagagctcagaatcttagcaactggaccaccagggaagtcccagaagtgaacatttctaaacacaatctgaactggagaa

SEQ ID NO: 1737 - DNA, 598 bp, Bovine  MMBT18890
  misc_feature (1)..(65): n is any nucleotide
nnnnnnnnnnnnnnnnnnnnnnnnnnnnnnnnnnnnnnnnnnnnnnnnnnnnnnnnnnnnnnnnntacttacaattgcaggcagattcgatgagtaaacatctgagctaccaaggaaacccttagatataatgttttagcttgcatggagtgtcagtattactatggatggcatacagtcatttacaaaattgtattaaacttcctgtggccggttgcatttttcaaaatcggttgaaatagtatattcagtctcttgtgctcttccaaccccaccctccttacctagtcaaaagatggyatctttgttcctattctttggacctgagtggacttcttgggtgarcttctataactgcacaagaaagtaatgcttttgaagctggctcttaaaaattratacagcttccatctagttcccttactcagagcatatgcctgcggacccctgaagtacaggtgccccgaagtcaccatgctgtggagaccacacagcagacracatgtacgcagagaatgtcagaggaaccccagctgtttcagccccagcartttgaacattcccagactcaatggcaaacgtgctaatgaggaaaaca

SEQ ID NO: 1738 - DNA, 600 bp, Bovine  MMBT22795
attttgaacattactttgctagtgtgtgagatgagtgcaattctacggtagtttgaacattctttgacatcatccttgcttggtattggaatgaaaacagaccttttccagtcctgtggccactgctgaattttccaaatttgctggcatattgagtgaagcactttcacagcatcatctttcaggatttgaaatagctccactggaattctatcacctctactcggctcccttaccatggggtattttcttgggtttcattcaccttgtatctttggttcctagcacacagtctcagtyggcaggatgtgtttgataaataaacgggtgttgacagaggagttacaggttaatgcatcgagcaaacatgatctgggcttcgaaaaagcttaggaacttgatatgacaaggatgaacttagagaacttgctaagcatagcaggtgagaagacatgaaggtgagtgtgtcaggaaatgttcagatcatcatgtgaggttgaaattatcagcacttgaatccatttttaagtgtttaccacatattgattttaaaatgcattcaaaagagtccttttctaccctgaggatagtgtgaagttt

SEQ ID NO: 1739 - DNA, 600 bp, Bovine  MMBT21092
agtgccaccagagctgggagcacttctgcacagagaaactcttcagttcagcctctctgtgcagacagaagggagtggagtctttattagtcccagtatcagctcccagaaatagtgggaattgggaattccagtgaggtcctcccccaaggccagaccactaagactctcccaggacttcagaaagaaggatcacacaatatcttggatcctttgagaaggaagacctgacactcccagtgagcactttctacactttgtctctaatcttcccaacaatccaataaagtaacactgtcygcatttacagtcgaggagcctgaggctcaagagttgtcacagccctctttccaaaggccttgcaacaagatggttgggagccaggattacaaatgagtgttttgacttcaaaaatgcaagttcctggttgcagcccaaatcctcccactgaccttgagaaggtgatcagtgctccaatttacctgactacacttagaaatgcccctttctacagatgtcttctggccatggaaaatgctgactctatctgacatgtgaaagcagagaagagaaactgccttcagggatcatccccaccaa

SEQ ID NO: 1740 - DNA, 600 bp, Bovine  MMBT22257
tcatgccaaggtgcagttgactcatctctgacactttccttgagagtgttttcatggagggagagagattaggaccctggcttccaggtgggattagagggtggaaaagaggtgagggccctgagagaggaaatgtaacaaggaaaagtgagtgcaacctcatcaatttcagcaaatrtgagtttcatcaactctagagtttgtccattgagatgactgatctcaaggcggttaggaccagcaagtggaattgaggtgacrtttcagctcagttggaggtataaggtctcacaatcagaygatcagtcaagggatgaacaaccaggtaaagtggggagcgtgccattacttagagaagttcaagttgaatgcagacatgaatttaggggaatgtaagagcctaaagttcctctgcttccatagaggtcaaccttggttgcacctcagctgggggcagcttttaaagctcttcacatccaaacaacayggagcattgattaaatcaggatttctgagggctgggatctggagcatcagtactttttaaaacttgccttttacaaattctaatgtccagacacagttcttcagaagctctag

SEQ ID NO: 1741 - DNA, 600 bp, Bovine  MMBT18629
gaagaagaaatgggaggcacatgtccaggcagagacaatttacgcaaatgagttagctgctttgtaaaaagttggtaggaaatatagcaagcagttcagttttgcttgagaaccagcactccattatgtaaaggggcagtgcagggtaaggctggaaaagggacattcaactggacaaatgtcagattaagcagttttacctaatttgacaggaaacyactgataatttttaaaatagggtggagctgtgatctggccactgctttagggagatggttctggcaagaacaccaaatggaytgaagggaaagcaactaagcggaagaccaaataggaaactacagcaaaagtctagatgagaggtaaccagtagctgacygagggcagtggcaatggggacacagaggcaggggcggatggaaaagacactgggtaggaaaggtctataactctgtctaattcggtaccccccagccccatgtggctatctaaattgaatttatgtacactaaagttataaactttgttactggcgtgctgtagtcaatggggtcacaaagagtcagacatgactgagcgactgaacaagttataaaatcc

SEQ ID NO: 1742 - DNA, 589 bp, Bovine  MMBT22118
actattctataactcccttatttatcagtgtatcagaaacctagatgtctctaaatgtgagaaaagagaaaagctgtgaagcactcttagcctagattggagcttggaatactcacatttgacttctaaattaaaatgctttggaaatagaagctcctgaagaggcccagtgtgaagggtacacaggcaggmtgagtaccaaaaaggcartaagccaccacagacaggggcacccctctcaccatctgtctttgtrgcatgatgctttgctctgtggcctcagagtcatgccctatcctygcaacctctccatctggtaccaagtgctgtaccagcacattgtgtgttaagaactgccagggagccagaaccaccatggtttctgttttcaagatccaaggcttgaattctgcccacggatcctgtatatctcttggckgtgctgcggatgatttcagcagaaggctctggcacttcttaatcccaggaccagtgtctactcataacctcactcttgctcccgcatctgtggctggtcttcgccaaccagcagcaggacagaaccagctaatttcttactcaggtctta

SEQ ID NO: 1743 - DNA, 407 bp, Bovine  MMBT23192
taagcctttcctcatttctcccgcctctgcttctcctagctattcccaggcaggttcactgtggccaacttggttcaccatagtaacccctgaaccagtcctgtctgaggcaaggaatatcccatcagctttagcagacccaggagctggagaacctatgacaacagctggggtcccgcattggtctctgagtcttcttgctgccaatttgatataagattgggcacctctaagagtgaccttggagatccatgttgcctcttagttgtttcctcttccttcctctccttcccccaaccytgccacccctaccatgttgattcctactcccaaattctacacaatcaccctcctttgtactccattgccggcccaccatcccaccccaactggaccaagatcctgtc

SEQ ID NO: 1744 - DNA, 600 bp, Bovine  MMBT22473
tagagctgtgytggacccatggcaaagccctgatagacatggatytagaagcaaatcagtracttcttatgactttgcttcttcttacaatatatattacagctttctctggtgactcagtgataaagaatccacctgccaatgtaggagacatggatttgatctctgggtcaggaagattccccaggaaaggaaaaggcaacccactcaagtattcttgcctgggaaatccgatggacagaggagcctgatggacttcagtccatggaatcataaaagagtaagacatgacttagcaaytaaccaacaccaccaacctacactgccccgtcccctgttaatggccaaactagtttacctattttgtcctrttcacaacatatgtgcacatgactaggcaaacacatttattgatcaaaagatatttaatctaacttgacctccctttggaagctcatctttctacaacatragtcccttaggtaagagrctgaaaagctttagagcaactctgggtctttagaaattagcctctgaaaatgtataaatatttctgtatacacacatctctgcttattttttgaagaaggttcatagctt

SEQ ID NO: 1745 - DNA, 600 bp, Bovine  MMBT21537
gatttgtcacaggtccagaaaagatgcctaggtagttctgtaaaatgcataattcaccacagtaactgcctattgaagaaaaatgagatggacattgtatacagtgataatgaataaaacaaagcactccctgctgaaacagatttttttttctttgaatcctggaaagagggaaaaaataatattactgacactagccagatttcatattgtcactacaatcaaatcctgcttcatgcttttcagctgcttattctgtgtccatgttcacaaaggtaattggctgtggctgagggagcytgagtgggctagcatgctgtttctttgtgctgtgtgatcgtcttccttctcatgtccctgataccaggattgcttgtgattgttttcagctttctgttagggatggtaggctgtccaccmaatctcgtatctttcagaatagctaccaagaaggctcccaggaagttctcaaaggaatcttccagagttataggctaaaagaatctgccatgcactcaaatcttgatccttttggttatttctacccagcacaaagagaggaactagcaaatttacattttattttgtctttatttaaca

SEQ ID NO: 1746 - DNA, 600 bp, Bovine  MMBT20332
ttttcaactaaagccagtggccaccctggccgatggagcaggttctggtccacagagtgtaggaagtgtcctgtctgcacgtggacaggtgcgtggaggaagaagagccaggtggatgaggctggctctgccaggagaccagatgggcagaggagaatggaggcaccattcttcactcaattctactgcaggacatgctgcagaggggacttaaaccacggtctgctcagacctgccctggtcagggcaaagatgcggcccccgtggcggctggttgtttgttccsacgggagttaggaygagagagtgggcataaatcccaggtctccagccaaaggcagctgatygagggaaaacctaatattcaacttttcctagaggaactggaaacaaaacagagctccagtttgctttcttgtgctcgcttgggtcatggaggaaaaacaaagatggctttttgcagctgacatgaggggctgccggaatgcaggggccgatgcatgctctgaaagggcccccatccttcgactgctgcaggatagagggacggaggccaccggggacagccagggacgtcaccgtgacagacctacagcacgc

SEQ ID NO: 1747 - DNA, 600 bp, Bovine  MMBT20860
tgtgcctacgtgaccctgtggacagagcacacgcgtgagggtaaagcacacagttctggtcacgcagaccctgctgggctacaacgactgccctccaggacctgtgctctcattctttgggcacagaccaacttatgagcctggggtggtcctgaggggaaacattgtttatagttttaagagtttcgtttttttttaatttgaattttctgctgctcgaatggatccagctctgccagcagtaaggtaaatgagcactacagctaaaatgaacaaatgagagtggtgagcagacctaaygcttggtgtcaggagacttgttctgctgcttattcagactgaccctggcatcagctgccctccctgaaaactgctatatcactccctgagaccttgggtaagctaccatattctctgaggaagcatttagcagtactggaaccaagcgctttctttctcggagacgatggggggctaactccattatgcagtacatctctttacttcactcatctgaactaaagttcaagggtctctggtcttattactgccctaacggccatactcacactgacctacatgtccctaatccctccccta

SEQ ID NO: 1748 - DNA, 600 bp, Bovine  MMBT20668
agtccactttttaagcattctattgtcatttctgtccctgttcatggtgggtttacctaggacagaggctgcaacttcaacagtaaagtgtcaagacacaggcttctacattctatagcaaattcagttgatgccatctcagcacaccgacactgctcgcttcctaagggcatggttggcagacacttttattagcaatcaactctgccaccttctgcttatctacagatttaaggccacataatcatcctctgcgtcacagagagggtggggtggaaactaagagtctytaaatccctyctaacacttgcttcttccctaccagcaagattaaagcagtcaacagctgttggcatatgtgcccagaacagacaggctggactgggctgtccagagcctgaggaaggccagttctcagggcaatgctggggaccccaggtctgctggtccaggcctttctctctgagacagtagagggcacatgaccaactcctaggggcagtgagcaggctagggacccgaccacggccaggagggcaaagccagggctcccattcctccagctatgctgaaacagactgagaggagacggtcctgggg

SEQ ID NO: 1749 - DNA, 600 bp, Bovine  MMBT19079
gcattacaggtggattctttaccggctgagccataagggaagcccaggaatactggagtgggtagcctatcccttcttcagtggatcttccagacccaggaatcgaacaagtttctcctacattgcaagcagattctttaccaactgagctatgagagaagcccaccttaaacttacacaacatgatacatcaattatttctcaatcaagtgggggtagaaaagaggtctccagctgcccatcaagcctggccacattgtcscctgcacaggtcctctcctggccccactggtggccctygaggcagaggaaggctcttttcagctgtgactgaaaaggtcaaataccaagcaccattaactaaaggttcattctgagagaatgaggctgggccccaggyggtgccaggcagtatgccctggtgctgacctggtttcccgattcaatccagccctccatatctatctcaatgtgctggatcttcactgtttgtgctcagatcgatgtattagctcacatcatttggtgccagccaattgttgacgtttggcgaggacttagtaatctgatagtttagttcatccttttaagtgggggagt

SEQ ID NO: 1750 - DNA, 600 bp, Bovine  MMBT19318
ttcacccacgcaatactaccattcttccagcctctctttttgaagttggaaaatcccgamttcaggctcaactcgggcacctcctcctccaggaagccttccgtgacctcctcccagcattgcatcaggcaactcctcggggatcccacctgccagagctggacagacctgggcccaggatcctggggatccatctagaaccacccatctcaaagcatggtccagcctcatctagaaacttgtgagaaacatggcttctcagtctccaccctggaccttcygaatcaaaactgggagcayggcccagcaatctgtgttgtaaaaagcccctcatgggattctgaagctcaagtttgagaatcagtggtctaagcagctgcattttctgcatctgaagtgccttatgacctggtcccactccagcagctgctgcaagagggaggggtccgtgtctcccctgggtgccgcccgctaacagagttgttacagactagaactgtctctgacccatcctcttctcgcacttcctggagacactcaaccaattttgaattgtaactttcttttattggcaaagaagaaatttcagcaccggtctca

SEQ ID NO: 1751 - DNA, 600 bp, Bovine  MMBT20355
tggtgacaggtggggaaggggctggaacagacggccactgtagctccaggaatgatcagcctttaaatgacagatgaggttcaggagccatcatgttctacagacgtcagggtgatcastgctgtcactttgttagttcggcgttcatttgaggaggtggggaagatcttagtacatgtcatgggctggtgccagacagttagctggctctgtgatcagtgttccctagaaatgatcctgtttaatctgcaccagcgccttccactgcagcccattttatggatgagaaaattcagcctyggggaaggtaaacacctttgaataaagccacagaactaatacgtgatacttttcaagatcacattaaagcttgcagcaatccaggcgttttactaatcttgtcagccctctgacatcctgggaatgaaattctctgccccccatcctcattccatgcctgtgcttggcaggtaccagcactcaataaatatttttggattgattgatcacaagtggartgaagatggaagtgtggcatctgctgcccagcatgaggaggaaattagctggaccagctcctccgagatcctggggcttacr

SEQ ID NO: 1752 - DNA, 600 bp, Bovine  MMBT20890
gttctggacacagtgctggggaaacgcccacggggtctggtggaaactgcccatcaggggagacacgttctcagcgtggctttgcaagttggcatctccgccttttctgcgcccccgaccagctgttcacctggtgattaaaatatcaagagatctgtgacagttgtctgctggtatttacagaaataatgagtacgatcagagcaaagattttcttacccacttaactgaagttgatatttgactgtggaggatgagagccggagggggaccatgggattcccacaccccagccccgaygttttcatagagtaaatgagggccactggggacacrggacctggcctggccacccggctggttctcgtggccctggccataggggatgcctggagttactgtgttgtgcttttcaaatacagccttacaaatttaaggtgattcatgggaaaatttayatttttataaagtatccatgcttttaaatacaagctatagaaatagtatctttaaaaacctgttttagttatgttcactggcaaagtaggagagacaatggttttacctgcagttaaagcatttttttttttttwwaaagtg

SEQ ID NO: 1753 - DNA, 600 bp, Bovine  MMBT19191
ggagataatcagcggtatcctttatatttttcagtgtggatgtcacatggttgggccatgtgttggcctgggcagccacagttcttgccaaaagtatcacttgagagaggaacactggtttatccgaatagaaatctgtcaacaaccccttagaggaaaccaaacccccggtccactgcctcaggccacacgcttccctcccccaaccaggaaagccccagctcccatctctcggtgacccttttcctctttgttatttcaggcctcagtctcgcctggaacttcttcccaccgcagccygcagagacacggagtgcagtgctgtgctcatcctagatctttcttactggtgagttgacttgactgatttacctacttcagagtcccttccttgagactcccacctcacggccacggcagaacacaagtgtgatgacggggccccgagactgaggggcactcggggggcacatgagatgtggccgggaaggcctgggaccaacacggtgggaaccaagctcaccagtggggtggacccaggcacggacacggcctggcctctgtccaagagggatgcccctgggtcaggctgcctaccac

SEQ ID NO: 1754 - DNA, 600 bp, Bovine  MMBT22779
gttagctaaaaattgtgacttgccatctgcctctacaaggattaactctctagcggctgcagtcgttgatcttcaacacacactgaaaggagttcaggasggagaccaggaatgaggcactctacgctctgggagaaactggcagaacaggccttcaaatagttagatatttttggaagattttatgagccccaattcttccatctcctcatatctagaaaagctctaaaatcattaatggtgacatctgttcctcatgactagcagcaaacttctgccaagacatgtgcttgacggcayacattcaccagttcacctatataccggcctcccccactgtgtctttggagcagttcctcagagctctctgcgatgctgtctcctgggctgtagtcctcattttgccctaaataaaacttaactcacaactttcatgttaaacatttttttttcagtcgatactatccacaggaagaattactcgcttaaggctcatcagaggtgacatcagcatccaacaaggctctaggctcaatcaacaaggttcaacatcaagggaaagagatgttcaaggactaagcagagggaagggatccaggg

SEQ ID NO: 1755 - DNA, 600 bp, Bovine  MMBT19523
aggacattggccatatactagagacggcagagctgtggattacatatagctttgtcaactttctggaatacagttgccatcccagcgcttgactgtctgtgaatttctccacaagggagaagttattcccatcttatataagccactgctattttgcatttttctactgtttgcaattgaagggaatcctaatgtgccacgtctgtatgaagaatggaaatcggaaagatggcactggatagctacatttttctagaaagactgatcttcctcattcgtgtatgagcttatctgtcaccygtgagcacctccgcttgctccccctgctactgctcttattctctgggtggactccgggtggtgaacaagatgtcagcagccaygttggtgctgttgccccctccttacctgagtccccctcagagattccaatacatcttagatactattgagttttgtcttggtgttttggttcatttgcttgtttctttttaagaacatcacaacrttccactataataatatcctagaattcagcacaacggaggaatgaggttttttgttttgttttaaattctgggaaaatagattaaagcagtt

SEQ ID NO: 1756 - DNA, 600 bp, Bovine  MMBT22510
tggcttcaaaacttagtcaaaccttcaagtttcaaagatacttaaacttcctatgtccattcttcccatcttagttctcccaaaatacgggtagttttcaccggtaagtactggctgtttatacacaacagagttccaaactgtaagtcatgtgatacgttttggycaatgcagtgctgcttccaactcgaagcgacartgrcttctgtgtctcgtttacagcaagctaacacaaccaaacactacgtctaakgcacagcrcaatcattcaagctactggacatgctgcttttacttaayaactttacctgtttctgaatgatttcactttgattagaagcttggagggtgtgttcccgcttaatttctatctgttgctgcttcttcttttgctgctgatccctgagttgctgaaccctctgcaactgctcttgcacactggctgcctgcactgcgaccacattctgaatgtggtgagtctgcacagggctgctctgctgaatctgaacgggtaactggagtttgatctgctggggcacaccaccttgctgagcctgtatctgagccacaacctgcggctggatctgggagagaacctgg

SEQ ID NO: 1757 - DNA, 600 bp, Bovine  MMBT20096
tggctacagtccatgggttcgcaaagagtgggacacaaccaagcgactaagcagataaacaaaacaagcattcatagctatgctctaacaacaagtatcaacatratgctgtaaaaactgtggtctaayacattgggagctaataggtaagggctgaccctcctggaagcgagggctgttcttggatgtggaactttcagtactaaaaaactgggaaagtcctgggtaaaccagaactagtttgtcacatgagtcatgaggagaagagatggctaaaagatgctcatatgctcactttgyggagcagaagtttgatagatgctttagaaaagagtaagttggtgaccactaacattaacacagcaactcttagcagtggctgccacttaaggaatgacgtgtctatgtttgacttcagccccttccaaatgatttacatttctaaaacaatacatccatttagagtagaataagccaagtcttattcaggaggcatctaactgctaacaaagagcatgtttcaaagtgtgaaaaacctagggctccagacacggtgagctaactgaaaatgattaaacaaaggatttttatctaaacgct

SEQ ID NO: 1758 - DNA, 602 bp, Bovine  MMBT20303
  misc_feature (1)..(2): n is any nucleotide
nncttgctttgtgcgttggtttctagagaacactgaatactctgtctctttcatgccatgctgcaaagatactattgacttaaaagttcgaatattgatgaaaaacactgtgttagaaattactaagaagaatatctacaatgtattayacagaggttggtgaagtattggagtgaaaaaactgcgtcactacattgattcttttggggtaaggatggggactacaatcttaaaggaaccacaacagaatctttggttgaaacttttctaaatatgcatagtccatgtcctgaacctctgcyatagccatcactcctgggattctactttttctttatcctactttgaatcactatatatactcattatctgtaactgctgttaggattattatgattattgttagatacaaggtgaatatactctggggctaggagaccattgtaattgrttgcctagctattttatagcaaactcttaggtaggatataagattagataaagccctcatacataataagcttttagaattttaattaaaaatgaaacaagaatggacacttacggggaaatactgtaaggatgttattttcagtgttgag

SEQ ID NO: 1759 - DNA, 600 bp, Bovine  MMBT19180
ctaggtccatatcagagttgtagttttgtgatattctcccacccaaaattgaatttaaatcattatattattatttaaagttaatattgttctttttaaaattattttaactcattagtgtgatgccattagtgtgttggagaaagaacatgactacagagatgagcattttgattttattcagtcacatatccggaagttttgtttacagtgtatccttttaatacattggttggtgcartatttctaagctgtttgtttatttaagttgaggagtaaattgatgaacttagaaattcyataaacttttatcttyctacctctggttagaaatttcattttaattcccaagtgtcttggtattttgagatacaaaagcaagtactgaaatatgtaactttgatttgatgtgtttaaagtactatgattaagaaaaataattctcagacttatgcagaaaattctaacaagttagcattgtaaatattctcatttaaaactggtgttcattacttgggggtgggtggtagggcaagatcagtgtttgggtttgtgtgttcttatttttaatatgtttgatatgttaatcatctccagagt

SEQ ID NO: 1760 - DNA, 600 bp, Bovine  MMBT19063
agtatcttaccaagcactcctggcttctgtggacatttargcaatttccaaccttttataatataaataaatgctgggtgaacatccataaccatgccttcgtgactttctctaattattaggaaaatttccaacagctgacttactgggtcaaaagctgtgaaactggatttaaagcttttggtgcatattgccaaatgcttaattccaggaagtctagacagatctgtgctctcactactggtttattacaccatttagtcagagtaaatgacttgtgtttttccctctctaataaaytccctaagaacaaatctttttaatatcttcataattcccaatcagctttcttaaactgtgagattgatcagtgaggctcttctatttattctgaaactacagccccctgggaggggaaaagagccatgaatttgggactagagaaccagattctagtcttagcacttttacaaactttaatttggcaacttgactaccttatgtcttggttttccctgcccaaatgaaaagatggtacgagagtctctatagtacccttcactaagtaaaacaataataacaacaaaatctttacaagta

SEQ ID NO: 1761 - DNA, 600 bp, Bovine  MMBT20300
ctcaaacagaaaggctccctgtgggtgaaaaggaatgtgtctctgatctcagtggcattgtcctgggaagaaattgagatggtgtgtcagaagacctgcatttgaattccaactctggtatttactgtcagtaagaagtaactttttctgagctctggctttttcacctgcaaagtgagcataacaaagcctggctcagaggggtctgggaaagactttyaagaggacaatatatgtgaattgctcattgtaactcaatagcattttaagaatattagttgttggaawgtattcttttaygttgaaaggagtttgggttttggacttgagtacttagtttagttaatctcttgagcctaaggatcttcatgtactaaacaataaaaagattgcaacgtacttttgctgcttcttgtaaggattaaagaggataaagtatgaactgcctctagcaaaaaccatggcaatgcatgtgcttcctgcaaaagcataactctttcttaaattaataaaccatcattatttaaatgttactcraagtgtgtatttttaaataaagaaaaatcaaagaactgcccccactcaagttctgacaaatga

SEQ ID NO: 1762 - DNA, 600 bp, Bovine  MMBT21524
aagccagatggaagaggtgaagagggcaaggtctggggaaagggcaggagctccatgccccctcccagcacctccacatggtcaccatcccagaaccctctctgaacccagtcctcttggatttttatggaggcttccttaaataggcatgattgattaaatcattggccatggattactgattcaaccttcagcccctctataatgaataccctctataatcacaggactggttcccctggcagtcaacctgaatctttaagtgtctccaaaagccrcctcattaacaacaaaagacayctgtaccacactcagtacttaggaaattccaagggttttaggaaccctgcgccagaaatagggaccaaatacttactgcttattataaattacaatatcacatctcctctcagctactgttttcctcttagtgctttgttgcctgctattatccccttcaatgtatttctctaggataccgcaacaggcactttctccttcttattgcatcccrtgggggaaacgggggtggggtggggtggacggaggtgggtgtgaccacaactgtggcgaaaaacacaaaattcacgttaaagcgag

SEQ ID NO: 1763 - DNA, 600 bp, Bovine  MMBT21350
tctcttaatctagctaaggcatatccaaaataaaatgtaaagaagaaaaataaaaattgtcttcatggaagcaactggtcttccttggttgtactgagttatagttacgctggggtgaaataattgatgctgctcaatgagaaaaccaagtgccctcagaacaggttgatgtggcagacactgttgtttgcccttcttgcgaatcaggtagttagcttttgactctgtttagttcttgatttctaatactgacatgccattctgatcatttggcaaaattgaaaatcctttccrtgtttygacaatctggaaaaggtggccattttaatgtagtaaaggaagctgtggggttaatttcactctgatgatgacaatactctgatagcatttaatatcagtgctccttcacaaaactcaatgtccataaaagtacagagttaaaaaaaaagactcctgctgccttccttaaaggcctgttgtgacagtcccccggcccatttctttccctctgtgtccctcgatcgttgtttgtgggacttttcccctgagaaggcatttgtttcgattcacaggtagtgtctgtgataaaatagaactgct

SEQ ID NO: 1764 - DNA, 603 bp, Bovine  MMBT19115
  misc_feature (1)..(3): n is any nucleotide
nnnctttrctgagcttggggaaagctgtggcagttacaaggcacattttggtcactgatggaccgtgacattaaagtcagtaaattccrtttggagacagagattcccagaccttactttcactaggattgargaaatcatagccccwgtccaaaaagaaaaaagaaaaaaagaaactacacaggtctctttcctgaagagtgatattctgaagggagtgggaaggaactaaatcaactaattatgtgtcagatatttattaagcatgtagtgtatgtaggtgcctgagacatgaaaatgaayggtgaataatatattggaggtcttgtccacaaggactgaaatcctcagaccccatgtacatgtctcataagtgccagcacctaattagcttgcaagctaagggcaatgtgctggtcattgcagagaaatacaaatgaatgacattatatatgtcttcctagtytctgcctcttcatcacagtggctaccatctctttcaggttttccatgaacccagccctgaactaaacactttagtctaatttaagccttgtataattgtatcaattattcagtatttatctgatgtgacaggtgagg

SEQ ID NO: 1765 - DNA, 599 bp, Bovine  MMBT19152
gcacagtaacttactgcagaaycgaagaaaggcgttcaaagagaggtaccttcagcatcacactttgagaagtagtgagagtgcaaatacttttggtgacctaatccccattccatcccctttaacttayaccaacaatgttaaaaataatttttaaacaagaacgcatataaacctctgaagaaaccagaagaaawagttcaattcttcccctatcgcatgttttcatgtagttttatttcacatttggaggtgatattattccattaaacttagtagcatttggtcttatactamgayaagatataaaagtagaagggtccttccaaaaatgtcactgatttgacaattttagtagtttcaaggtttagaatccaagaagtaagcttcatagatcaacattgtgatttaaagaagaaaatctaactactttctgtgggcttgtttattttgttcaagtatgaggctttatctatgttttctttgctagattaaagccttgttttccatctgttttagcctcttgttatttaaattgcattttagaagaaagagtagatggtggtggttttgctttacatcagctgatgcttcacagt

SEQ ID NO: 1766 - DNA, 600 bp, Bovine  MMBT19173
actacctctagcgctctgaagtaagttcacagatgcacagacatgctgtcccagcaaatgtgaatggagaggcagctgggttgactttgaattgtgtatataccctcatgctttcattcagagcctataaatgttttctacttctccctgaagggatgaaatgtcrtctaactctgagtctcacacagctggctcagaattgaagcatcagcgcaccactgtygagatctaaatatttatgccacctccttacctcctgtacatttaacaaacaaaagctcttacattttagacagtaaytttctgagagagggactatattttaccaaaatttaaaggcagacgatccaaaccctccccaaacaacaactgccggccacgatgaaaggagctgggaaacattaaggactttgtgcaaacagggaccaaagcgtattcgtccctgtgaccccggctccacgcccgctgcctggcacatgaaggcagatccataaatgtctgctgaattggatttctcccactgctgtgcagcagaaccagctcagccatggggaacagcaagcaaatgggcttatcacccgctgcttcagaacaaaatga

SEQ ID NO: 1767 - DNA, 600 bp, Bovine  MMBT19172
caggtgctaacttcacttcactctgtaattctcccctgtaatttcccccctttccctcacttctgtaatgctggctcactacctctagcgctctgaagtaagttcacagatgcacagacatgctgtcccagcaaatgtgaatggagaggcagctgggttgactttgaattgtgtatataccctcatgctttcattcagagcctataaatgttttctacttctccctgaagggatgaaatgtcrtctaactctgagtctcacacagctggctcagaattgaagcatcagcgcaccactgtygagatctaaatatttatgccacctccttacctcctgtacatttaacaaacaaaagctcttacattttagacagtaaytttctgagagagggactatattttaccaaaatttaaaggcagacgatccaaaccctccccaaacaacaactgccggccacgatgaaaggagctgggaaacattaaggactttgtgcaaacagggaccaaagcgtattcgtccctgtgaccccggctccacgcccgctgcctggcacatgaaggcagatccataaatgtctgctgaattggatttctcccactg

SEQ ID NO: 1768 - DNA, 600 bp, Bovine  MMBT19092
acttcttttgtagcctaactacttatcattttaaattaaaatacacgttttattctgcctggaattttaaaaaagttaggtaacctatttaattaaaaaacttggagaatgaactagaaaatgttttatagggcatttttttgtaaactgatttaaaacttgcatgacttccttcattatgattatactgacaggaaacttgtgttgtctaaattctggaaaagatacatacaacttgaaagaaatattaattttcatccagtcaagtaattcctcagaaggaggaatagctagtctgtygggtcttgtgacttcagtggtgcctttgtaatctagactgtcaaggccaggagattactgtcattttgcattttgtgtattttgaggagttttaytccattttcattctcaattcctttccatttcataagccacaactaattatcttaaccatttccactagtaagaactgrttgtrgytgtggtgttacagatcttgcctgttttctttccaaatttcttatccacatgcttcacgatagtctctcgcctcttctttttgcccccattctctcgttttttgacttctgaggactcctt

SEQ ID NO: 1769 - DNA, 600 bp, Bovine  MMBT20085
caactgagcacacacacacagatgaaagtcaattctaaatacaaatacatggaaaggcagagagtcataaacagaaaaacaaagaacaaggtctccattgtgagtacatccaggccagtgcactgtgttaagtcacaagtactttgagctttgctctgtatcatatttttgatatggtgatatgtacctaccatgtactttgaagtgtactgataatcaaagagagaaaataatcccgtaatagaagagagmacacactttcagctacttctgtgagttaataaataacctggagctttyggtcttttaacaataaagtttctaatgttttccttctagaaattagatacaaaagtcaaagttttgctgtccagtgaaaccagccttgttttaaaaaagagagagaaaaaaagaaaaaagaagctgtttctaggcaaagagcagaggacgtgggaataacatccttcattcagcttcatcccctcaaaagctcatttgtagaaccgggtaaacacacacgttctgcattctatttttgaaattacgttgaggaatatacagagtgttatctgtaaaagaagcaacttttgaaactttagt

SEQ ID NO: 1770 - DNA, 600 bp, Bovine  MMBT22504
ctcctgcctggggaatcctgtggacagaggagactggcgggccacagcaacgtcaccaaaagtcggacaggacggagcgacttagcaggcacagcacacgaaccttctctgtaaattcaagtcaaggtcgtacacgaattctccaggaacatcactgattctgtaacatgttacactcgctcccctttctagggtgtgattttaaggtcttgattgtccccactgctcaaggcaaacgcractgtgtttaatgttacactgaaagtttgaaaaagaactgtttgtgtaaatacttactayatagaagcaaaatgaccaaaggccgctatttttcctcctcttacgaaaaataaatgctaycacgtacatcagggagacaagtgaagccgcataaccaagcgtcaggacaacctgaaaacaatacaaagacacaccaaagtcaagaaaatgaaacattaactgagggagaggttacaagcgttgctgaagcttctcgtcacacatgctctctgcgtggtttctgtttgggtgtgtgacagaccaagaatggaaacggcactactgtacgaaactgcatcagtgtgaaagtttaccaggaat

SEQ ID NO: 1771 - DNA, 600 bp, Bovine  MMBT22486
tggtgttagttctagaaggtcttatgggtcttcatagagccattcaacttccgcttcttcagcattagtgattggggcatgagctagcacatacactggtgctttgatctccagtgggaaccatttttgtacagtgcaacagccctggtctgacaaaggtacaaccaggagtttagtcatctcagggtgaagatctggttaccctaccaatcaaacaacctagactagcttagcagaagttctggttcaagataagagtaatctagarcaggtggtatttagataaacatgaygaatatyatcattaarcaggtttrcatgraatgctgccagtgtctaatccataattctttgcctttatcactttggtgtatggtagtagttacctgtattccytttcttaaagtttctttctttctttttttaatttaaattaccaaagcttggtttgctgtctctagtgtaactcataagtgctagggaattactgtcccttggaagaagtcttcaaccaatgactgatcctagtcagagtataaacaacacaactgtctcaaacagtaagtgggaaagtcactttatacaattcttttacattgg

SEQ ID NO: 1772 - DNA, 600 bp, Bovine  MMBT19843
tctctaggtaagaatactggagtgggttactgagccattcccttctccaggggatcttatcaacccagagattgaacttgagtctcctgcattgcaggcaaattctatgtctaccatctgagccaccagggaagcccacyggaaaatgagtcatgatcatatatgcagtcgtcactcaaccccccctcctcttcaattacctgctgactctggacttagctccatgaaaactgtgaagtcagtcaatttttttaatgtgttmttccactccccttttcaaccaccattgyccctaytctyattcttttctcatatcaggataccttgtgagtctctaggtattcagtttcatctccatctcccatcttgtgcttccttcactktattctccctgctgttgcatgtgaaagatattattaggtgataygtaaatatcagaaattgttatcctttctaaggaaaaaaaaaaactctactggtggacttacatttatataaagtagactagcagatgataattttggcagcaagcaatattacacgtgtctcttatccaaacagaataggtatcctctagcaaccaaagacaacccagatctt

SEQ ID NO: 1773 - DNA, 600 bp, Bovine  MMBT20106
tacaatgttgctttttaccaagtctcatccttggaggactagccccccaaaaagtagccttcaaatacacactaaaacatacagcaaatattcagtaacagcagcaaacgtatcatgatgcccaaaggctttttgtatgtgtattagcaatgcactaatttgacattagtcaaagcactgatctcaagcaaggttttgggtataagattcctacagtgctggcagagttactgaatatacccatgtggctgactctttaattgatttttgcttgtcacttctattctatccaggtatgmytctgagttgcttttgtgctgacatctaatttttctacggtgcaatcagtttctagtaaacacagaaaaaaattaagttcatgagactgtatgcaagtaccactcaatctccaattcatactcacccaaaaacttcacatggtatttaatgtgagtgttggataccaggctcactttgggcaaaaaacacatggaaattcttgcctcatgacagatcctgtcttcagtgatcattacataatctggtaaataacttttgtccaaccaaatgaagtagatgtaaagcaatactactactcct

SEQ ID NO: 1774 - DNA, 598 bp, Bovine  MMBT21585
  misc_feature (1)..(21): n is any nucleotide
nnnnnnnnnnnnnnnnnnnnnaaaaggattaaaatttatttgttgcagcagtttgggtccaaaatctatgtctttataaccactctataaaatgggttccttacattttgaaacttttctgtaaatttgaaacttatgtttttcattacgtggtgtaaaaagaaacaaaaacaatgacttaatctctcttrttttgtgtttctacacttgttcagtatcttttcatgctgatttttctcctactagagagaactagtctggaagcatgtacacttggcagacacagtactttcttttatycccatgtttacaagagawataaaataactcactttactcaaaagaaaactaagataactttttgttttgacttgttcctacttaaggtatggatttgatttgtaaatgttccaaacaycttgaatctgtctttttaactgattgttctcctttttggcgtctccccccccacygccaaacaaagtttaagagaatatattctagatttgtctttagacccttgtggatatttttttcaaggagaacttcttttcttaggagtttattgaacaaatcaaagttttggggaggacctgct

SEQ ID NO: 1775 - DNA, 600 bp, Bovine  MMBT19333
aacagtattatattgaagatctccttttgcaatttgtgtttttactcaacattaaattttgacatttatctgaactcatgtacagggaggtactaatttgtttttgcttttttgtctttttatacattgtatggaggtatgaattatatatggtgagacatacagaactaaactgttacacaggagtgagttttaacaaatgcatgtacccaggtaaccacacttctatcacaatgcagaacattcctctccccagaaagttccctctggtctccttccgctcactccctactcctctcyccaggtaaacactaacctgctttctgccataacaaattaattttactgattctaaaacttcatataagtgaaatagtacagcatgtctttttttgtgctggtctcttttgctcagcgtatttggggtgttcatctgtgtaattgtatctcagtagtttgttcacttttattcctgagcacgttccattgtatgacaacatcacattmtgygtgatggatgatttggggccttataaataaagacttaggaacattgttgttaartcttttgcattcaccctttcatttgtcttcagtaag

SEQ ID NO: 1776 - DNA, 600 bp, Bovine  MMBT22100
tgctcttttattattatttttatgtttttatatatttgcaccaggtcctagtcatggcatgtgggatccctgatcctggggaatgcaggatcttcagctgtagcatatgaaatctagttcactgaacagggcgagaacctgggccccctgcattgggagtgcagagtcttwgccactggaccacccaggaagtccctgctctttttgcttaatgttctctgatcaaggaaatagtttccatgcaattcagctttctgttttcttccaatagttkgcttagtttacatgttttcatacaaytggcttggagggagtattttgacacagacattttctcatttatcagaargctctgractaggcagattycaggctctgtggggagtgagttataagaatgtaagagaagaggatttgcctttatttgtggttatggaaatatttctgcaagactttcacaatgaactttgtcctacaccaactcttctctctcgactgatgcttatagaaactttttgagcatggcaaaaaagaaagtcacaggtattccaactcctccattcccacaactctcagacactatcacatacactcccaatc

SEQ ID NO: 1777 - DNA, 600 bp, Bovine  MMBT23157
agggtagagggttatatatgtaaagaatatgtattttcagcttcttctgatgtttcctaacactcagctcacaaagcatcttttgtcttacctctcggtgcctatcccggtctcgagacttctctctcacccaatcaattgtattgaaatcatcataggtccccacaccagggattggctcctccaagaagtccatcatcctatttgaagaacctattcctccaccattgtatgacctactctctggattgaacagaaagaagacattagtaatacagacactctggacatttttaatayctcttttttgagcaccaggaggtgagcccttaaactatcagatgactacagttagggtatgttgataaagcagaatgatcacctggcaggaacatccttcacattcagaggtttctgtggtttaggcacaaaacgatgagcatctcgaggcagtgtgaatggaaagggacagatgagaatgacagtaaaaagggagaactgacaggagttgaaatacagggtaaaagggtgtatgaaagaaaagacacgagcttggagtagttcagatatttcagtttatgtttggggaggaagacaaaa

SEQ ID NO: 1778 - DNA, 600 bp, Bovine  MMBT23188
gtccatgcttagggcaccaataacaggagtacaaaagagagagagaatgaaagaatctaataagaagctattttattttcaatgtacaagtggagctctgagtaatcctttaaaataagattttatttgcaggtttagtattgttttcatttggaattaggtatgaagaggcactatgatctttccagcacttaaagctacaaaagatcctgatccatctgggtgcctttaggtaagtccctaccctttcctgagaagaaaatacagaagtcaagtattatggtgcccataatgattaaygaccaaattgttggtgccacatagtataaactccactccacccaagccagagaaatacagggacaaatgatgcaaattcaccacccttctcctgtcatctaatcaactccataaagataaaaattgagcccaagagccataacttgaatcctctcctattattctactcttccatcattctgatgtttttatcactttaggtgttcatgtgtctaaaaaaaagggaaaagattaaatttcttgtttctaaagtggaggaaattctagtggacattttggtgtccaaatttccagagaaga

SEQ ID NO: 1779 - DNA, 600 bp, Bovine  MMBT20108
gttcctctgtccatggaattttccaggcaagaatactggaataggctgtcatttcctgcattaggggatcttcctaatctagggattttcaaacctgcgtctctttcatctcttgcattggcaggtggattcttcaccactggcctcacctaggaagccctatctctgccttacttacagttcacatctttaaaatccatatgaacagaccattgaacagtactgaaattgattcagaaattttaaaactcccaacaaacaaaratgcaggactgctttaacacttgaaattctcttctygmaaractagagaggaaaaatgctggttcctcaactctccccattctttgatgtcccctgaccaaaagcatagacatttttttattttaaggattatattactatttaccataagaaacrgaagagaggtaaaacatctttaaaagttacagcgtccggggctctggagcctgtgtctattttgagatggcaacctcagaccctgtgggcatctgtctgtcctgattcctgaggacgcggttcacaaactcctccccttctttctaactcctaaacgtaaaggacaactttcctccttcc

SEQ ID NO: 1780 - DNA, 600 bp, Bovine  MMBT21726
ctgtgtgaaaccatctccaaggctacagcctactcgggaaaggacatttgccagctgcttatcaaatgttccaccaaaacaaccactcaaacagaatgtattagaccaaaaaagacagctatttctgatggcagataccaaaatccttcttgctgacagaaacttgctgtccttagaaagcagcagatgacggatgcagactcgaccaatcctttccacatggagctggctcgcaccttaaaaattgagtgttattcactttaaatgcaaaaatgaacacagaaatgcaaaaaactagcyccagggaagaagttagtggtctcagcgacacacaactygattgttttctatttctggcaggcacaacataccagggtgttctgttgggctttttttttyccccagaagacttacttcctaatatttagaggaaaactaaacaagatctccccacttcctggacttgtgtggacagctgtgccaataacaagcgttattcctggcatcaggggccttgcaattcctggggactcagggtggagacagagaggggtgaggagcagaaggcaagatgggacccaaacagaccacaatgttacc

SEQ ID NO: 1781 - DNA, 552 bp, Bovine  MMBT18896
  misc_feature (1)..(1): n is any nucleotide
nataggaaatcgacttaactgctcatcacactatttaaaacaaagtaaaaaaaaaagttttcaatttagatttcttttatcacattttaatccaattgtatatatgagaaaataataggcagcttatgacaagtttataaagagatcttaagtattgccagcatagctattaagtattgccactcatatcatgagwacctagattgtgtacaaagcataattttaattgttttgtgagataaaaactaaatatagccacaaactcaatttagtctgaaaaaaattaaagcattttaactgytgatttcctcactaagacaaacagagtatccaggttattttttattaagtctaacttttacaagtaaagaaaatgataatcaaataatccacttcttgagacactattcagtcaaaactcaatctctggacaaggtttggaaggatacactatctatattttatgttagtcttttcagcttcagcatttataatatactggaggggggaatctcatctacttactctgggggaaaacctcactgatgatca

SEQ ID NO: 1782 - DNA, 598 bp, Bovine  MMBT22051
  misc_feature (1)..(93): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcgagaaggacccaaagagtggcttcgacattaaagtgccgcggcgcgctgtaggaccctccagcacccaggttctcgttccttgctctactgagtrgggtgacccgtgagctggggaggtggtgggaggctgggagtgaaacgacctcaccatggccaagtacagtctgggtctttttttgctcctttattgcttgtccaagygaatctagggtatagacaccccatgattcccaggtttggtcatttgcatgcagaacttaatttgactgcatcaactcctattcccaaaatgtgggtgaaagtctatgtgtccatatttacactgtgtttcctggtgtttaaatgtgtggttataatttttatgtagggtctmaaaaatgattattcctaaagataaaatttttggaaatttgaaaacatagctttgctatatccctggtcttcagctttcactgctgktctttctcctggcacactcagctccctcctgccccttcaa

SEQ ID NO: 1783 - DNA, 600 bp, Bovine  MMBT19531
atgaatatagttcaaggggtaagtaacagcaccacttgccttaactttgagattttaatttatgacttcttaaattttgcatctttcycaaatatctgtttgtattttcaataataccaattccttatagtattaatcctataaaaagacttcttwaaaatgcatatgtttaattatgtgtattattatatgtttattatagatagtgattctcctaaaataaatgtgattactttttgaggcatatgttcctgtcagtgtatacaacatggaataatggatgaaattctacaacaaaayatgtttcaggtacaaaatagtgaatggaaattactatcgtcgagaacaacaacaacaaaacgtgttctaaaaccttaagaccttgagtacgtttcctaatcccctggtgccttttaacaagtgaaactattttttttttataaaattgtcaatggcttttctttagatttattgggatcctgcttaaatggaatatctgtcttttgtgtttcaacaatatccaaagctttctcatgtattattttcccagtacacatgcacacacatgaaaacgcttacagagaagttcatcagtgtgaa

SEQ ID NO: 1784 - DNA, 601 bp, Bovine  MMBT19833
  misc_feature (1)..(1): n is any nucleotide
ntcttctcataattaggagaattcactgtgggaaaaactagtaccgtcagggatcatatctagattttgttcatctaggcatgaaaaccagatatttctttaacagaattcaaaaacggaatcagttttttattatgaaactgaatcaccttgattatgttgttttaaatgttgagcataatttttaccttaattaaggtaacatgataagcttgaccttctttaacccctaaagaattaaaaatgccaatattagcgtttttattctagttaatgtatttttttctctcttctactttgyaaacatgatggagaatgtttgttgaagagtattttgggaatttctctyttcatttttgaaatctaattyttaatgaaaataaaatccccaatattaggctcattattgctgttctaacattggcttccacaatcatattccacaatcaggaaaaaagagaaagattacataagatcaactttatatacagcatacaattggcagaaattagtatctaaaataggatgtggtgggtcrgtttggggttcagagctttatggctttttaattagtcttggtgcagagccttttcagtttagt

SEQ ID NO: 1785 - DNA, 600 bp, Bovine  MMBT22049
tttgcatttaataaatgaagattattatctttagtatatgttaaagataattagtattttcattaaaaatagaaaatgtctaatactttttgagacattggttaaagcttmttcagccattgtcatttaaatctrtcttgttaacctatttttattcttcccacagtggaatctctagcactatcactcatggctggcatggaacaaagttaaatatcttcagtgtagtaaatacctcagatttaatcttcatacatatacatttccaccatatggagctaagaaatgggactcttattytggtttatttttaaactgttgtctactgtctaaacaagtgggttttatgtgtattctcttgggattattggttggtatatagagttatatgtataaaactttatcaatgcaaagtgaatacagtctgtttacacttatatttcctactgtaagcaatagctttatggtattggtacctttaaatgtaaaatatatcatttttgaaaatgtaattaagatttaaaataaagcactttattcccccttttgcttagtcacagaagttttttatagttttacatactattttccctaaaggtt

SEQ ID NO: 1786 - DNA, 600 bp, Bovine  MMBT22113
aggaatacaaagatgaaaagttacgggcctcagggagctgagtctcaggccaacaggccccaaaatctcataatgtgaaaatccaatgtcatacttacatcttttgttaaagataatactctaaggtttgttcttcagaagcatgaactaacagcagatgatgagccaacagaaaacatgatttcctaagatatgaaactgcctgctttaattctatcttttccataagcaagtgtataattatctccccaaaggctcagagaaaacaagtggcatttgtctatcacaaatggcaaaaayggtaatagcaatttttcactgttgtttagaaaccgatttggcttaggatttaaaacagtcttaaaaaaaaaaaaggactcattctatccacccagcactccaatatataagcgatagtcttggtcaagtgtgatagtttctctgaactctaagagctgtgatgaccaggtaaaaatcaaaatgagcaaacatcacatttacaaagaatggtaatatcaaaaacaatttttgctagaaactaacacaaacattgtaaatcagttatactccaattaaaaaaytaatttaaaattaaaaaat

SEQ ID NO: 1787 - DNA, 600 bp, Bovine  MMBT18615
taatttgcgcatactctatgtatgtttgttatttctcattatttagggacctcctggcttacccggtctcaaaggtgaccctggctccaagggtgaaaaggtgagartaaaataatgtattattacactgttgctatcctaattgcagaggctacrattatgcacattaaaatcactcaaaaggaaatttcaaggaattgctttgtcattctaaccaaggaaaatgctgtcaatccttagcttccaagaggaattcagaaaagagaaaakaatgatgaaaaatgtaccagaactcagtgytatawtagtcaatgttcctttgtaggaaccatatggagaaagcatatggttatactaaaataactattcagaaaataaacagaataacaaagtgcccattttttcatgtttttaaacatgaaaataaaaattttaaactagactgtccttcagatggtaattttaaagatatatgtgctctgttgcatcaaataaagaaaataaaacatttttagagtgacattaatatttttgaattatttttgtttgtaaatatttcttgggtactgaaaaatctctgaagagtagaactcattttat

SEQ ID NO: 1788 - DNA, 600 bp, Bovine  MMBT20081
acatgtgtgtatatgcattcttaaaaagaatggaaatcttgtcacatgctacaatacggaaggacagacttaatatgctaagtgcgagtagtcagtcacaaaagacaaatgcagtatggtttcattcatgtgaggtatctagtgtgatcaaattcataggaacagaaagtaaaatggtgcttgccaggagctgagggataaggaaatggaaagttattgcttagtgggtacagtttcagttttgcaagatttaaaaagttctggagaytggttgcataacaatgcaaatatacttaacayttttgaactgtgcacttaaaaatggctgagaaggtaaattttgtttttttgtcacaattgaaaaatgtttaaaagataaatttcaaatttgatctgtcagtctcagttacattttcaagtgcttggtttcaattctgcagtgcagctctggaatataaattatgtgagtcgttttctgacagtaagtatttgcctacatatttaattgtaaagaaatgaaaaggtagccaatagatcaaacacagaaagaaagaggcacggaaaagataaaacaaaactggtgagaaaatacaggtagtg

SEQ ID NO: 1789 - DNA, 600 bp, Bovine  MMBT20899
cagcatgcagatacagacacacacatttatgtaggaacttgtgtagtttttatgaacctggggttcatccccrgcaaaagtcacagaaatttgtccattcaaagagttgaggttggtgattcaggtcaccctcagagactttgggtgactgtggtgatagccaaggaatcttagagatttctgagcccrgatctcatctcgrcaaactccttcatttttttcagctgaagaaatcaagagatgatttattcagggccatactgtggagtgaaaaccaggtttgagacttaaacttgactyaaaycctctgtagactgttcttycsaaacactatgcttcctgccttgtaggtttggaggacaggagagttaaatacaacacatatacccatagagaacatagggagataagctttacccaaatacacattgggaacctcccaaacaacccatcccagagggcagacaatgtgccttctgtcagcctcttgctgcccacaatcctacaggaactggaagttctccttgatcctcttctcactgaagctcttggccagagccaccacaccccrctgtagctrgtagcacagggctacctggg

SEQ ID NO: 1790 - DNA, 600 bp, Bovine  MMBT20369
aaaacattttattatagaaaatctggacatctataggtaatttactagatttgagcctcttctattttcactttgttagtcaaccatctcctctaatcatcttgagagttcattatatcaaagagtaaactgattactaaaaatatggacatcatagcctcaaaaacattggattctttaaaaactgcacactatatataggcaacaaaacaacactttagaaatcatatcccctggtatggcatcacttttaaaaggttttaaagagttcgaataaaaaatctcaagcacagatccttyatgtttcccatggacaaaatgctattctttctattaatttcatttggctaagaatacatggcyaaaatgctcctcgcaacctaatgctttgtggttaagtgatatacttctaaaatctactcagtggcaatttttaaaattagtacaaaatcttctctatttaaagataggaagctatttcagaggaattctgtaataagtttgtcacatcacaccaggcattcaactctaaagctatattttacacttatggcgcagcaatagcaattggcaaattacactgtttaaaaaacattttca

SEQ ID NO: 1791 - DNA, 598 bp, Bovine  MMBT22024
  misc_feature (1)..(97): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcataccagtaactatattgaaagactagtgtataaaattcccaaaaataaatgactagatggaagagcttcagatgaaggaccaggtgtttaatcactgactttacacaatgaccttagaatacactgcataaacagctctgaaaacgtgagaacagtgagaatgtattatttattgatttgtaattcttttagtaaatacygactctttaggggaactatagattttctcatgaactttaacaacccacaggccagtagagcttctgtttccttttcataaatactgttgagttagcaccagcatctgcatgcgtattccagtcaggggtgtcttacagttgtgtgctctaaaatacagatttgttttttttatattgatcaaaaatgtatttttcagtctttggaatatgaagtttatttatagctttagttccaaaatagcttctgaaatgcattgcccctgtttttagttgtaatgcatgtgattatactttattg

SEQ ID NO: 1792 - DNA, 600 bp, Bovine  MMBT19153
tgtctctaaagtacaacttaaatcacatgtcagagtctgtagtttacttggttaaaaattggtcacatactcaatatgatatgaaactatgtctagtatgacaaatattacttcttcaagaagtttacaatttttccaaatatagtcagatcttgaggtgtttccactaataggctgagatcagaggcaagaaatatgcaaaattcatcacatttttctttgaaaaagagcaagaaaaaaactaactacacatgtaatacacatacacaattatatagaaagrcacatagacccttacgyacacacttttcttttgatctgatattaataatagcaaactcaccaagctccaccctattatattgcaggatcaaccagggaagtcatcctttaccagattatctacttaagaagagcaaagaatttgcatatttcatggaatcaatggataagtaaatatcttgcacagagaatgggcctaagagatcttgataggtaatgtttcagattttcaaaagacaacagattctcaggagtcctattcaacattactccaacagaatgtagctctccaataaaatacctgactgaaagccatta

SEQ ID NO: 1793 - DNA, 600 bp, Bovine  MMBT23166
gggatcaaacccaggccccagcaatgaggaccctggaagtcagctcaaatgtttcagctggagctgagcaagctctcagcccagcctggccctaggcctgtccaggatccatctcccatggctaacccattcacttgaacatggccagggaagacagaggagttgttcccaaacaagtaagaaaagtggtttctcttacctgctgttttcttactctgctgagcagagatacttgcttttgcctgggagygcagctgtctctgagcctgctctgggcctgatgttcctggtactatcttygaacgtttttttccctttacaggcttcttgggcatcacctttttaacgtgaaagtcacatacaatcagtatccatttctcaagtgctttagagcttacaaagtgttttcttgtgcagtaccttaattaacgtcctcaacaagtctgagggatcattatrttacctgtacctaaattacgaagaatctaggaagttagaaggaaatggaatggtctaaatgaagggcgtttccaggattagaacgcttgttttcatgctttttccagactgacaccctcaccaagagaaatctccaagtga

SEQ ID NO: 1794 - DNA, 600 bp, Bovine  MMBT23250
tccatgtttctaatgataaattaaagaaaaccttctttgatcatcactcgaagttgccagtgtacaaactcattaccccactagaattcagctgataaatcagaattcaagttaatgaattagaattcaagctattcaatgaaggactgatagacttttaaaacttaacattttgcaactccaaaygaaaaaaataaaacaaaaaacaaaaacttggatctaaccaatgatcrtggatggatgctaaaccactatgtgaaagttgatagggaaattctggtggcagaatcaggctcatayatttgagaccattgaccaaatctagcatcaaaaaagtgggatagacagacgtttgtgccatgagatgtaattcaatagtaaatatacagcagtacctataaagtattgtttttcaattttctttcattttttaatcagtatagtttatatatagtaaaatgcacacatcttaaatgtacaggtttttcttttttcctagaaagttctctagtgcctcttctaaggcaacctcaaagttgcaggaaacatggggggcagagaaataagttaaatgacatcatgaggaaacagtcaggcaga

SEQ ID NO: 1795 - DNA, 600 bp, Bovine  MMBT20372
ttgaaaactttagcctttagccacatatggtttagcagttttcccagggctcagtaaaagtgtatggaaagttgcatggccttcattttcgacrtgttgattactggttcatcagttgtgacagatgtaccatgtccatgagggtgtragcagctggggagctargagaagcagcgaaaagctacrcgtgagctccttwctttaaactccactctgtttttctgtaaaccaaaatgttccccaaaatagcctatgaactaacacatgaaagtaggaagcaaagacaaaaagtcagatgcyrcagtttggatgttttcagcttgttttctattatttgaagttttaaatgagttgccttgtgaaaagtaggacgttggaaagatttctgcacccttatttttgcttcgtgagctcttaagttatcatcccttaatatgttcagataattgttacttgctttgtaattaaggtgaagggcagacagatgctgtgtcaggaaagaagcaaaggttttcgaagcttcaagctgtggccccagacaagtaacacccctcgagttcctaggagtgctgtctagacttttgtggcactttagaatcc

SEQ ID NO: 1796 - DNA, 600 bp, Bovine  MMBT19077
cctgtgtctcctccattgcaggcagattatttaccacctgacccaccagggaaacctcaataactagtactattaaaaaaatactttggtagcaaatgtttatctctgtcatcttgattaaatgctttctcagattttatggcagatataaactgacmtagtatgtcttagtactagygaggtaagcatttcacaaatgatattgatgtacaactaaatgttcatgataaatatagagtattcattttaagcactaatgtttttcattgcattgttgtgaaagtagcaaccatcaataayagggaaagacagccttttgtaattcactgcccgtgagcataccaggccattggaaacaacacgaacacaggaagcatatcttttcatccactgttttagcacctacgtctagtatggtgcctagcacataataggagtctaataaaaatgtgtcaagtaaatgaatgaattacgtatragtttatttctgcccccagccacacattatatctctctctgcttatgaatgcaaacctaaaataacagytgttaacttaggacagtagcctttactttctgatctggggaaccatgatgctt

SEQ ID NO: 1797 - DNA, 600 bp, Bovine  MMBT23200
aatacttcctgtggctacttttatcaagtttttatcttatgtgtatatctctgactaagttagctcctgggaggttaggagaatatcttaaaatctctttgtactctcattatttcacatggggcttaggagtttggtgacattttaggaagcaggattttcagaaggctaaacaagaatggattgaaaaggagagactaggatgagggaggaaaatttggggaaattgccttatttttcaggcatgtgaagtaatatgggtctggattagacaggtagatatggaaaggaaaaggaagyratggattcaaaagaagaattatggagagttggtgatagaygaaatacggaggaagagggsgaattaaaggcaaatctgaagttttgagaatagagatctagaaatgaagaagtagtggagagaatcactgttggtggaaggaagatgagtttggttttgaaatgtaggactagaaattagggccacagatgttgatttgggagttatggcatactaaaactgtagcatattagggctagaagggacttcattatcatctagttcaatctccagaggctccaagagattttaacttgtac

SEQ ID NO: 1798 - DNA, 600 bp, Bovine  MMBT21596
tggtggagtaaggatcagaaaccagtcaacagatctcatcagcccacatttcagtctctcatcttatacttcctcctgtgtatctcaaaagggatatgggtttttacagttagagatctggaatagggactattggtgttgaatctggttccactacaaccctagccacaccctgagcaaattgctactataaaattacagtaagaatccctattgcttcttttcttcatcattaggttactgttatcmttwttctctagtctctttccatcccagttgctacctaccacacagacctaytgggagttttaaatgccktaatatgtataagacacctatacaataccagttacataatgggtgctcaataaaggccattcttccttcccatcaaactttattgtgctatgaaaaccttctttcaggtcaaagtttattggtccagtacacaaatgatgattgcttactcatagaaattaatcatttctctagtgttggccagcagtgtttgaaaatggtatagacacaagccccagaaagaagccaagatggcagggctatgtatctcccattagcccatccatattttaaccaaacgac

SEQ ID NO: 1799 - DNA, 600 bp, Bovine  MMBT21309
aacaactgattcatttgaaaagaccccgatrctgggaaagattgaaggcmggagaagaggatgacagaggatgaaattgttggayrgcatcatggactcaatggacatgagtttatgtaggctctgggaattggtgatggagagggaagcctggtatgctgcagtcyatggggttccaagagttggacatgactgagtgattgaactgaactgaatgaaagtattggcttaccatagataaaaatgcttgctcttatttatcttattaataagaattggtatgaggagtgaaaaggtcaygggaagagaaattcttggagctacagtttcatagaaatctgggttcatataaactatcactttgagaagcttcctcagccaaggcctgagaaacttgttctttggcatttggggagatctccccactgcttactgttatcaccttgattcatgctcttgtgcttgtttgttttcttttcctgacattttggcatttctcatgtttgatgcatctcatactggtggtgcccttgactgctcttattcaacagggaagaattatttattataactgctcatttttgctttggcaaatctgaa

SEQ ID NO: 1800 - DNA, 496 bp, Bovine  MMBT18843
attctcatgggcgtttttacaggaagtaagcaaagtacacaatattgtgtagtctctgtgttagaaagtatgacatctcactttaaagaacaaaggttccctgtaaagataaacacctaactacaagctcctttaggaatcagtccaaagttattaactgccagagctcatctaatttctctaagttttgacaactaagacaataagctttagggttgatagcactaaagctacactggacggagctccatggggaaagagtacaggttttggtgttacatattcctacggtcaaacctyggcaccaccactcactaatgggattgtgggtgttactcaactttgcttaaacagctctcttattgtaaaatggaaataaatgatccagtctctgtgaagattacacaagatactgtgaagaatgcaccttgtgagtgcttaccaaatgttcattttctcttctctttctttctaaatggtcagctgaattaacaca

SEQ ID NO: 1801 - DNA, 600 bp, Bovine  MMBT21030
acagttcttagttcctgtacatttcttagttattgctttttacactttggtaaattatttctgttccctttgattaagttccctcatcaatataaaagataggatcatgatagcacatacctcataaggtgytctggacattaaattagtatacctaaaactctgtcatttcatwttataagttgtggctaatattaatttgttcaaaagttaagcaaaaacataattttgtcattctgtgagcttcaataattcattaatttgaattcaatttattcttygtaagttgaatatagggcyttggatatcatctgaagtkyaggttacaattaaattgctgattacagaggatcactaaagatatttgtgctatgtaaagaagtctattatctgttctattctagtttttcaatgtcagctgcaatctctctaaaaaagttgaagtcagcctttattttaaaagcactttaaacacttccgtgaaataatttgatgtattggtattaatgtaattctcatggtacagaagaataaatgggctgttaagaatattgaaaaaattagggaacactgaatttaaagcatcttcttcaacttttg

SEQ ID NO: 1802 - DNA, 600 bp, Bovine  MMBT18668
cttagttcccagaccagggattgaacccatgtcttctgcactggtaggcggatgcttaaccactggaccacagggaagccctggctttgtgtctttacacaggactgtggtaaagaagcagagctatggrcagcggcaccttctaaacaaacacagtattgcawgcagcagagcaaactcttggcacaagtgtcccaggcctccccaggcagcaccatgcaggatcatcacagagcaggtctggggcagcccagagatgtggaaaagagggaatgagttatcacctkcgatcctgtcttygcttgacaaaaatcaagtgacagctctgcttgggatgaaatgtggtggggagggagtggggggttgggatggacaaaatgcgtcttgggatctttcccctcctttcctggcccctggtctctcccttgccacattatactcgcatcctccagctgccatggctcttcactgtcctctggctgttgtcaaattcctgactgtcttcaccataatcttgtccaaaaaaattcaccatgattatggcgaccttacttctcaattcaaaaattaaaagtggtctgaaaaaaatttttttctgac

SEQ ID NO: 1803 - DNA, 468 bp, Bovine  MMBT19016
gagaccatgcagcctggcatttctgaaaggacaccaatggccttggtttgccaaatccttcacaaaggaacttgacaaaagtggtcaaatgaattaagtgcaaaygagaatttaatgtccccatttggtagtcagcttgtggggcgtgggggaagcctaggaccaaaattaaggtattccctcatttcagatgcacagaactgatgaattagagctataattcattttyggaaatcaaaaacaaacctgcagaaatgtcacgctgtagtctcatcatcagtctgtyagtgagctgtgatyctgcagcccaggacagtgatctgcacacccyctcatgaattcagcttccccagaaacccaattcctcacctcccagtgaactgaagcttcttttactggagcgagtatcttctaaacctcatctttggctgaaaatggaaggctgctctcactccacattccaggcag

SEQ ID NO: 1804 - DNA, 600 bp, Bovine  MMBT20182
gagaacagaatttagtcatttgcggaggggcaccaggttgggggagatgggtcatatgggaaatgaactgaaaatgtcatgctggtccaacagggatgcaaggacaaaaatccaggtgggctgtgactctaaaacctgtgttctacacttctctggtacccaaaccagaaatgaaagagtcatccttgattctgccttcctcacatttctcatcagttccttaataaatccccttgggtcaacttccacagtagatcccagatttgtctaytttcttccactcccactgtctctcgttaygctatccaataaaccatcatctctccccaggcccaaaacagcctccttcttcatccctctgcccccatatttaccatctaagatccttcctcctcaggacagccagcatgatattttcaagacacagatcgaatggaaacagtcttctcctcaaaaacctattcacagcttcccattcctctcaagttgaatccttacctctttggccatctacaaaactctgagagggcagaaaccatatcagcttgttctcagsgtgtactcacagctcagcatggtgcctggcatccagaagggacc

SEQ ID NO: 1805 - DNA, 600 bp, Bovine  MMBT21687
tttcagagatcgtaactcatgtggttgttcacagtagactggtctgggatggtgctcagatggtcctcaggatggtgcactgtggtttcccaaatgttaacaaaacaattcattggctacctccaaggagctccttgctgtggggcaggaaggaagcctgaggttcatagtgtgatcatacagtgtgttggcttcttgagctaaatcttcattctccccttctcgcctccttgaacctttgacccatcagtcttggttccaatctctaggttctagtagagcaagggtamtccctcttcyacgtgataggtattccaagaaagctatcctgttgactggtcctcctcaaggtacacatccccttccctccaaccattcttcacggatcttgctgttgaagccctttgccaacttggcagtcaccttccttctgacgctttccattgtgtggtggggtccttcctaaaacatgatgaattgcaactggctgtcaccttgacgtcagagataaaggcctgtggagaaggagacacaaactctgtgtttcayrtttataaacrgtaacatgtactcatagaagaatattgaaaaaacagaaaa

SEQ ID NO: 1806 - DNA, 600 bp, Bovine  MMBT20198
caccacccgggccttccgaagtagtgctgactcccctctggcctaagactggtccccacctggctcaggttcctgcctcgttcaaggccgagcaaggtggtgggatgagggtcgccctgtcacctcacccctgccccggtgtggtcctcagccagcagagcggtggatgaaggcacaggatgtcacagcctccctggtccagacgccactcctctggcaactctggaccccagaagctggggctgtagggagctcttgtcctaagagagtgttcggggcggctggtgaacacygtctgcytctgcagggctgagccggatcctgaagacccgtggggagctggtgaagaacaggactgtggactgggctctggcggagtacatggcttttggctccctactgaaggagggcatccatatccggctgagcggccaggatgtggagcggggcacttttaggtaatggccttggtgttcttgtgggcccttcagagtggaggagacacaaaagaagggctgtggtgtttgtcttccagaagaaaatcactgccaggaagcagtcattagatcccattgtctcaggcccagaagcaccctattc

SEQ ID NO: 1807 - DNA, 600 bp, Bovine  MMBT21824
attccacagctgtacagagtgcctgcgagtgactcaaatcagtctctcctcccttctcccttcccatctcagggaagatgaacaaagttgttgttcaagataatcgtggcaaaaaggcagactcgtcagggggtggaggaggggtctcttgttcccttygtaagcttcctcttctgtcagagatactgttcctttctcacctctcattcccagataccctcatcccttttataatgaaacaaggagttggtgctgaccttgactttgcagaaaaggtattttgctctgggccatctctayaaagactctacaggtttccgggttagggtcattctataagtcaagctactaactctggctggaagaggagaagagacctgggggcaaaaccagaaagtactgatggtttagggccatgtagtgtcgggaagggcattgtttcgtgaggccaaaacactcgtcagctgtggagaggactggaacccaggccaggcttggcctcggagaggccggggtgacacaggcaagtctgctcacccttctggcctcagctttctcatctgtgaagagagggcgctgctcgagaggacctgttgtgty

SEQ ID NO: 1808 - DNA, 598 bp, Bovine  MMBT22563
  misc_feature (1)..(179): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctggagaatcctgtggacagaggagcccagcaggccttagttcacagggttgcaaagagatggacatgactgaagggacttagcactcatgcactgccccagaacgcttcccytactcygctcctttttttcatcatctccccaccccaacccatccttcaacaagataacacatgaaacttccagtcagggactcttgttaaatcatggagctgtgtctttacaagagggcttgaggcactgaatgtctgaaaggacagaggaccacgttggtcttctgaaaaatagcagcacagatatacttagccagctagccagaaagaaaggtgttttctgaagcacatggtgagtttctgcttttggtggagagaagaaggttgcaagagtttaccaagaagatgctgaattatctcaggg

SEQ ID NO: 1809 - DNA, 600 bp, Bovine  MMBT19433
ctttgctgctcctgctactaatactattctactgtcaagtggctggcacgccagacggagagaatttttcggtactttgagcttgagctgggcgctgggaaatcctgccgtcctggatttggggccgcacgacgccattcttccagcagaagcctcggcgcccccgcgaacggcgttctggcgactgtggcagccagccccgctttggttggtgaggggctctgcctgatggacatgaaaagtgaatttcgcctttgtgcctccaccctgcagctctctcacgatgaaaatagaacckgytttcatcttgctgggcctgacgaagagatagttcccagactgcaagtcagcatttgtgggcatgattgtgtggcaaaatctatttttaaaactctataagttctcctggtagacaaaatgggtactcttttctgggagcaatgggagactaggtatccatgatgggctgtcaagtaatgaagggagattagctccccacttcttttcactgggagcctggcatccttaagctacctcgagccaagttacgatatggagagttgactccccccgccggcccccgccacccccggaaggagg

SEQ ID NO: 1810 - DNA, 600 bp, Bovine  MMBT15290
tcaactctacctctagctctcagaagacagctttcctcattctgttaaaaattttaaatcttgacaatgaaagatcttcatcctaatgcacattttaagcactgaacacaaccccatactcagtgctaggatttcccattctaggagttctgaagctgcctcttacctagtgctccagaccccaatccagaatacaaactcttaaggacagttcagaaataccctgggctgataattgggttactaccaataaagtcactgagtcagcaggccacttggtttggttgctggtcaaactgyggagcctgaaatcttcttccttccgaatcatgcatgtgatgggatgtacaggctccaagaattagctggtagcagtttttttctcccttaaatttcttttaggagacatgagtcctactccagtacctggattcaggtaacaatcctatgtccagtcctccaactctcctgacacattttcaaggctctgttacccaaaagagccgtattcctaactgttactgcctgcttccagacccaaaggccagcagtcctgtaactccagccccaccccccacttacagtttgttcatttctgat

SEQ ID NO: 1811 - DNA, 600 bp, Bovine  MMBT23145
cctcacaactttccataagactttgacacctacctcacaccttatttctgggtgtctctcttgctctatagctggcccttggcagaagctggattctgcacacattgcccagtgacccctagttgcccaggctctgccactgacctctgtattaaatgaggcaaagggaggttacaaatatctctgaatatgactgtcatcattccagccaagctcctatgcttagagtactgtaattatgttcacttgtttctctcaccaagtgggcagagttctctgaaggaaggaattctgtcttgytcactgctctgtcttctagctcagctcttagttcataggaggtgctcaacaaacgtcagtgaataagtgaaaagataagaacccagatctcctactaaattctggctaaggatttgttattaatataacagactgttaggatgagtaaccctggaattaaatgttttccggaaactaggatcagatcgtatcctactgatttctaaatgaatccaatgattttagaatcatttcatggctccaactaacagcctctaatatctgtctgggacataagttatctgtcctagacctgcaact

SEQ ID NO: 1812 - DNA, 600 bp, Bovine  MMBT21857
ggttycagggtgtggctgctggttggggacccagaccctcgggccctggtcggaagttctgcatggcttgaaattcttcaccttcctgccaggaaagcccctcacctgggtgatggctgtggttaagattacccaagagcaagccgttttaggactgcgaactgggtcagaggtatgaggaagggaagggctttttctaatccggggacagacagggtgtcaggagcatctgggtcccaggatttcagtggaggttgcctccgctccycttttgagcatcctccttttctctgctcctcygtgagactctcttaggaggatttttgctttcagttttgtgcaagttcctcatgcggttgcccgttgtgattggaacgattgtctttataaaagacacttgaaagtcaggttggaacaaggcacggtctctgcagaggatgttaagcatgttgactggaagcctgcctgccaggacaagatccctctgagaacaccgcacacaatctgctattgtctccggggatgagacagtgccaacaaaaaatgcgaagttccagccaagaggaggaatcctgccttaactgcttcaccactaagagt

SEQ ID NO: 1813 - DNA, 600 bp, Bovine  MMBT18798
ccctactggagctgtatgtagataatctcaaattttctatattctgaatgtttccctaaggagtttgagcccttggctcctttcatgaaaaatattccttcatttctttagaaagcatttttttgggatataaaaagtagacaaagttgtatctctcttcttgaaaattctccagttaaagaggggaagaaaacaagaatatacctaagaacagccacccttcccatggctaatcccagccctgacacttcatggatatcaacctggggcaagtaacagtcaagtctcatctgagtccaygcaaggctggaggcttctcggagggcagccctcaagggatccactcactgggcctctgccactctgtccagctccaaataccagcttgttgtccctgagtagtccaggccgtttgggagaaagcaacaagaataggaaatgcaaacctgctcatggtagcttagagctgctcgacagacaaaataaagacacttgagacccttaacaaatagctctgacttaagttattaggtgctgaatttgtgggtgcatcaagtgcaggaaagggagagatggtcaaggacttgtgaccagggctga

SEQ ID NO: 1814 - DNA, 600 bp, Bovine  MMBT19914
ggaagccaatcatctagatagaagataaataaaaacaacctcaaacaattatgtatgaaatcaggacagaaggtagtcttggcagctttcttcctgccctggggagctttcagggcttcctgaccaggggaagcagtggcctggcggcatttatccctgtggccatctgtctctctgctaggactcggttgaggcctataatgatgttgtgaggagaaggaggaataaaagacgggtgtacttccacaaagaacgtttggtgagcaatctaagcaaccctggctagcacatctttagaaygagtggggaattgttagatgagctgcaccatcagtggtcagtgggtgataatttaaaaccttttgtaaattgcagatgcaaacccagctaggagtaatttttggaaaggttaaaaaaaatcctaatcttacctacttttagagtggtcccttcccttttgtgtttatacacagggtttctttaagggaagctatccatcttctcaccatactctgttttttacactctcctctcaaatattgtagatgaaacattgacagcaatatgtccgttttgtcactacatgtggtggcttcagag

SEQ ID NO: 1815 - DNA, 598 bp, Bovine  MMBT19618
  misc_feature (1)..(212): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtcttgaggctctggcttccctttttgatttgtgcattaatgctgcggagttgacagcctgcttgagagaggctgaagagaygygtgttctgcacatctgaaatttattcctttcactctggaagatgggacaccacataacggccatggagaagtaatttttaccckgcaacgatcttggcaccagttccagaaagacatatggacataatctttgggacatttgtagaaccttcccttgaggactgtctttgcaggcttgggttcacttcaagacctatggcactcactttagcttgggtctgtttctacttaagagataaaaagctaaattgtattccattggaagaactaaaaatattaatgtaagagcaagtcatca

SEQ ID NO: 1816 - DNA, 600 bp, Bovine  MMBT20992
ataggagctgagacccagccaaggagagtgaattatcgattcctgtctgcaaatcagtaactgtaaccaaaggaatacgttaggcatattggtaagsagaggatccagaagtcataccaagcrcaatgagggcaagtaatgtttgctccataattatctgctgatcggccaagaggatgaatatgttcttttagctaagcttttctagaagtgtattcatggtgccagcctccatctcctgagcctggtgcttcacatcccctaacaagccccgatgcaggaratgttaaaggtggaggygagattcagggaggtgaagctccacagaccagctccctcccgggttagtggggccatgagacccatctcacaaaagtgtcgaaagggtcgagaagatgaaacatgctgcagcttatgtgattcataggtgactaaaccaagatttacacctcagtctctcaccccgaaacctattcgtttccatcagtcagtttaaaataacaatacatgacctaacaaaatttaagtgtttagttttaataaaaaagactaactataaagaccagaagatttgcaaaaagataaaatgttttgatgggt

SEQ ID NO: 1817 - DNA, 427 bp, Bovine  MMBT19624
ataagagaaaagaataaaggttcatttctctgttctttatttaagaaaatgtgggaaaagcacacatatatattaggagtggagaatcagaatgagaagtcgacaccaygctgtgcagggcaargtggttctgcaattcttcagcagctccaggtgctctgactctgactgatactctcgtaatacctgagctcagctcataaacctccttcagtaaatacctatccaagaccaccatcagacgttcaggtgccaaggacacgaaaagggaatatgaggtatttccttatgtaagacttyacaggttcaacaacagagatcayaacatgaaatgcttcttcctcaattcacctgagaattatcagtgatcctccatgagtaagcaaggcttgttccaagagtgactctcagagcagagggtagacaa

SEQ ID NO: 1818 - DNA, 497 bp, Bovine  MMBT21948
ccctgagccccaaccaaacaccagaggtaggtccctgctgctgatgagccatctgcccaaacccctggactagcacccagaggyggcgggctctctgtgttttgcgatattttttttaccaagyaagaggtctttgtgaaccttaacacctccatgtgtgctgccacgctggagaagtggaagattttccatcagatatttacatggagactaagcgtggcacagggcaagtaaagactttttcctcactcaccacgtgccaggatgaaccagcctttccagtagtatccccttcttttytctgtaatacaacttatgggggtgacagaagtggaggagagcgaatgttaattatctacctattacattagaggcatttgtgtttgctctctaatcctcagattaaataaggtaggttaacatgtaccatacatttacaaaagcaaaatcaaaattcagggtgtaaaagtacagttagtaaatggaggaataaggag

SEQ ID NO: 1819 - DNA, 549 bp, Bovine  MMBT20039
aatataatgaatatataatgttaatacacacacacacacaccgtgcaacatggtttggaagaaagaactctcaataaaaagcaggaaacctagagtcggctctgccagtagctgggtgaccttacgcatgagtcagttacctccactgcaccacaaggcggtaagataaacgtttctccttcaaactgacaccctgtacgtacacgcatatatacatgcttttatttacaggcaaggcgggcactcactagctcataccagtatggcatgacrggctgttcataggccagcacctgttcygattggtctgtcaatgctgtaccagttgttaaacagtgtgaattatcatcctatttacaaycacccccaaattacaaaatgtctaacatgtatatccctgtgtttgcagtctgccttccacacatagtgaggatattccaaagttaaataggccctccttaatctccagttaaaatttaagagcacaattcctttccaactccctttctcctctttcaaaaagagtttctgtacattttctgttctgta

SEQ ID NO: 1820 - DNA, 600 bp, Bovine  MMBT18924
tgcgtgtggaagggaaatgacttttctgggtaactgagggttaactggaagcctgtgttcttctgccttgttgaatttttttttttttttttctacaaatgatgagcatttccccaactgagtattttgaaaagttccaccactttctaaatatgtgaccttggtcaagttacctaacctcagtaacctcagtttccttatctgtaaaaatgcaccgcgcgcygcctctctaggttgtgaaaggcactagaaagaggcgtgtgtgcttgaggtggaggcgccagcaccgtaaytgttctyagtgggtcagcggagcggccagattggctgaagctcttcgtgggtatttagcattatgctttggaatccaatgtgcgttttgtacacgttgacrtggagattagccagaattggcattcatctgcaatttctatcgcagctaagtcctcccaaagagatggttttttttatgatttgctgctttctcataaaakccagtgcctgcaacgcaccaaggactcttgttctgtcgggacctgaatgctgtctttatctgggaaatgtctacagataaagggcagggctagggctcagccttcc

SEQ ID NO: 1821 - DNA, 600 bp, Bovine  MMBT20291
ccccaacctgggatcaaacctgagccccctgcactggtgtagcacagaatctacagggattctggaccagggaaatccctgggaaacatttttggcctgcaaaacttttaccggtctgatgggtcagtaacaataagcattaaaagatagtgttcaagttgtgggtcttatttttattagccytttcactttccagaaagctttatttcttttagacctggataaatccctcggggtccacagacttgttctgatttgcatagctgtccttcgctctggggccgagttgtagcaatgatytctgtaacctacaaaaaagcaattggaatatgggcttccatctgccaccaatttgtgttttgggtaagcgatgccaagaggkatactctgcacctgatatctacctcctttcatcagaaataccccagtaggttcctgctaactttattccgtgcagyatcgcctaccttgggtagcacggagcccaatggagtgacagctagatgcctacctgtgtgcagttgccctatggaggtatgtgatggaagcgaaagcagaaacaccttctgcttttcaggtggggttacgtgtgctctgccc

SEQ ID NO: 1822 - DNA, 600 bp, Bovine  MMBT18959
cattcctttagtcatggttatcacctgtgcagcccagtgcaggttgtatattcattaatactagggtagagactgctacagtgttttatggacaaaattcctatcctgggtttccactgcagctttcatatgccaaggggagctaaggtctttcttaatatcaccctattcaggtgccaccaagacaataacagggcaagaggctgaaacatgggaaaagaaatgggttaagaccacatttgaggataaaaacctgagtgcaaacaatacactaggccaagtgtgatgcccttgttacayaaagtccrctatcctgtggagagagtggtgctcagcctgagaatcctgctactcaaagcccagacccactggtgaccttgcaacccctgggaggtggtccagtggccatgaattcccatcctygacctggccccacatcaacaatgtgcatgcgagtggtggtggtcctgagcggccctgaggtctccaccccttgagtctggggggcctctgacggctgtgacccacagagtgtcctcgggcttctgccctgagaaagcctgcttccacttcctgtcactggaacacctgccaggagcc

SEQ ID NO: 1823 - DNA, 600 bp, Bovine  MMBT23138
ccttccccttctgttctgctcctctgcccttgaccacacacattcatggcctcacgagtcctctgttcctagttccctgggaagtgggaaatgagaaacaggctatcaagtgtctctaaccagcatgttggcacagccaaaattgaagttctatagcrttactgctccactcaagggttcaaggccctrtctatatttcttcctttactctgatccaaccacatggggctttttgctgtccttcaagcacccccagccccacaagtttgtatccatctcagcatgtcacactccctgttyattcatttcaccacaaatagtcttggggttgtatacagcagactcttggtcggctaaaccaacactcattcctaagtcctttctcccttgcctgcctccactacagaaactggaaaactatcaccgcaccccccccaccccaccccagagtaccttagagcaagaagtattggccatgaaagaaaggcaataagtcataagcagagacttctgggatcatttttgccttcctgattatttaaaaagacataaattacaggcactaggactagctgcaaggcagaatcacagagggttctg

SEQ ID NO: 1824 - DNA, 567 bp, Bovine  MMBT20905
gaatgctgaataattaagacagctgaaacacgaggaaagcgaagcaggcacactgggcagtgctgcagccgtcggccccgcccgctcccgggggacccyggattcagaaccatcaggactgcgagtaccttcyaggcggagccacatcagcctccccttcacagctatgacggaggccacacagagctcgccygggttcctggggttcacggcttcaagcttcatgttcttcgtgaatccccgactgaacgatgtctggaagagaaagagaacggacactgagccagcagatgccacaaygagaaaacgctcagcgagagcagagccagctggcgcagcagaaatgcacacacatgcacacgcaatcaagtgcacacgcatatatgtgcacatgcatgcaagtgcacagatcgtactraragaggtgagttcacacgcttatttccccatcacccatgaggaaagaaccacacatgcttcatttgtgtcccagaagagagacctctgcttggctcacagcaggtgcctaataatttctcattttccagctctgggtgcatccctccg

SEQ ID NO: 1825 - DNA, 600 bp, Bovine  MMBT19926
agctggagaggatccagggaagtgccaaccgtgggccaggggcaggggtgtgcactgtgcaaatgggtgtgccctggggctgcccccctcctgggtctaccctccatcccaggctaagatgatgagaagaggcaccagttcatgcctgaccgtccacaaagactccagccgccacagcacaacacgtcaggccccggggtccrtctagcagccctgagtggcggctgccctgtctctgggaagactcagtagcaaagyrctagaaggctgagctgatccctgtctcttttttgctaacaygtaagtagaagtgaacatgttacttccagcatayaggaaaaccaccgagtcaatatctggatggraaacagaccacagacatatgcccagtggctctgttcacaccatgggcgccgatcacagagactgtaatagaaaacaaaggctaagtgacctaacttgacacgtggcaagaggtgtctgacttctcggcgcgccagtctcgcttaagaggacggtgccagacagtctaggaattcrtggcagacacactggcagaagccatacaccatcaggatgacgaggctggaggggaccagg

SEQ ID NO: 1826 - DNA, 600 bp, Bovine  MMBT21903
tccagggcggggttggcctggatgatctggtcctccagggtgccctgcggaggtcaagaaggatggcaggtgagaggcctcctcctcctcctccctttctgcggtacaggcccttgraggacagtaggcctaccttgcctgtggcctgctcctttttgctgcggtcgccaatggcggcaatgaccgcgaagtattggatgactctcttggtgttgaccgtcttccctgccccggattctccgctgttgggacagtcgggcttattaggcartgaacaaacattatttgagaccacaagcytcgagtcaggagagctttatttggcagggggagccctgcagcaggaagccaccrgataatatgcatcccagccacaaagctgtgctctgacatacacagggtcaagggtagcaactaggaaagatgtgctagaagaagcggatttgggcaggtgggagacctgaatttgatctttgagttgggaagatcccctggaggaaggtatggcaacccactccagtattcttgcctggagaatccccatggacagaagagcctggtgggctacagtccttggggttgcaaagagtcatacacaac

SEQ ID NO: 1827 - DNA, 600 bp, Bovine  MMBT20176
atgagagccggaaacatcagataataactctgctaaatcaactctcagctcttatcagtatgcaaaaatctcccaggcagaaatggaggagaagaggtcaaaacatatgtctccactgacaatcatacatctggaaataaaaccaccttacaaaatgacactgattttctactagcccacacaaagctcctgaccacttcacaacagccttgtaaattaaagaaggtatgatttttccaatttagacatygggaaactgaggcagygagcagttacccaagtgttcaaagactcacagcygatgacaggttgagttgggtgaaaaaagccagggggcccaggtgataattccagcattcattcaatccctctgctttcagagggagtacaacacacggtctctactcttaaggtgcatatgacttaattagaaaaataagacrattacacactaaatcaaacagtgcagttgaagaaaaatcaccaatgctaagcatataccctttgcaccctttccaactcaaaaccatactccttttctgaatttacggaattaacaaaaagattcttagtcaacacacagtttcaaacttaaagctg

SEQ ID NO: 1828 - DNA, 601 bp, Bovine  MMBT19777
  misc_feature (1)..(1): n is any nucleotide
natgaaaaaaattataagatatgatgctayttttggaaaacaatgaaaataccaacacattctattatttatataaataagtatctatacagaaaaatttagatagacatattttaaattgctacttgggattaacttgggaggaagagatggaacattataaaggmctaactttttagatgattttttaatttgaaatttttataattggataaaataatcaacawaaagtgatttmgagggttgaggaggggccatgccatgtagcttatggaattttagytccccagagactgaacgyagaccctcagctgtgagagcacagratactaaccactggactgccagggtatttccatgatttatcttttttaaatataagattaggaggaaaaagcacaaatattcaagtatagtaagaattaagttaagctgtaaaagaactttaattcaaaaaagtactctgtacatttacagcactcaacttatcagtgtgaacgtttcatttcaagggtttctgatgctgtatcatactttcttgatctcttatagactacgttaatcaagtaaataaaaaccatctcctttaactcatatcaag

SEQ ID NO: 1829 - DNA, 600 bp, Bovine  MMBT22145
acatccatggtggttaaatctgtgttgtaggattttccatattttataatatgaacatgcataacttttgtaacaaggtgagaagcaaagtacagtgtttcagaaaatggaagagcaagactgagaatagagcaggattacaaatggcctcgtaaaaaaaaaagctgaaccrcacccaatgagcacrgaggaacggtaataggaagaagatctgtttcctcagggtcctaaatgatctcgcctctgcacatctctccagcctcatattcatcttttttttctgctcacgtccttccctcyaactttgcatatctctctttgtttcagcaacactagctgcctttctctcccttgaacatgcaagctcattcctgtctcaggagccttccwctagctgttccccyttctctgaaaagttcttcctctgggtctttgtatggtaggatcattcaaatctcagcccaaatgccatttcctcagagaagcttttcccaaccacttaatctacagtcattctgtaccatatccccttttatattttcatggcacttactacaaactaatgatttgtgtattgtctgcccccattcctgtcccagc

SEQ ID NO: 1830 - DNA, 600 bp, Bovine  MMBT21454
ctgttaaagggacacatacttttaatctagtgttcataaatggatttcagggagaatctaaactacctaaagttatatgaaaaagtttgtttgtacataagtatatttatctggatagaaggtacaaagttttcctcggatcatacatgcttatcaaagtatacctttggtctttgggtacttgaagcttatgtggttcttttgtttgtttgtttttcggtcatgcccctatagcatgcaagatcttagttccccaaccagggagtgaacctgtgaacctgtgccctgcagtggaagcayggaatcctaactactgggccaaagagaatctctgaaccttacatgttaatagtgatccagctgccagttcaaacaagaaatagtttagtrgtccactaaacactaggaaactttagttatcccttgaggtattcacatttctcttaaagaacagctttagggaaagctttagtgatagggaattattaattagtttttaactttttaaatcatgtgtgtattttttttatttttgcattcttccacttagaccttcaggccctagcaaggctctgaaactgggagccaaaggaaaggaag

SEQ ID NO: 1831 - DNA, 600 bp, Bovine  MMBT19937
ctgttctgcctgcactttcttcgtatgtgggtcattaacattgtgtttaggtcagatgagagtctgttccatctgctgtgatagctgaagtaaaatgctgatggagatcatttgagatcgtctctgtgctgctgattgcatgcttgtggctcataatcagaatgatgcgaagtaattgttcaagcgacttgccacggctacgttttgtgtcgttgcaactgtcagcagtttggtcctgctcctctgcctgaagcgtgtttgcccagcgcctgttggatggcgcgagtygcccttcactgytgtgggtgacatcggttctagcatcctcacttgctgccccccatctattttataacctgaaaaagaaatgtctgcttatttagtgggagcaagtgctggcttttgtgttcaacagaatgctacgtaccagggcttccatacagaaatccacatgcttgttgccacagtgctcctctctttttctctttggccagaaaagccaggcagacctggcttagaattcttgctttgtcacctactggttatgtaaccttgggtaggccacgtgtcttgaaccttgttttccttatctgcacattg

SEQ ID NO: 1832 - DNA, 600 bp, Bovine  MMBT18960
tttcatatgccaaggggagctaaggtctttcttaatatcaccctattcaggtgccaccaagacaataacagggcaagaggctgaaacatgggaaaagaaatgggttaagaccacatttgaggataaaaacctgagtgcaaacaatacactaggccaagtgtgatgcccttgttacayaaagtccrctatcctgtggagagagtggtgctcagcctgagaatcctgctactcaaagcccagacccactggtgaccttgcaacccctgggaggtggtccagtggccatgaattcccatcctygacctggccccacatcaacaatgtgcatgcgagtggtggtggtcctgagcggccctgaggtctccaccccttgagtctggggggcctctgacggctgtgacccacagagtgtcctcgggcttctgccctgagaaagcctgcttccacttcctgtcactggaacacctgccaggagccctgagcttccatcaagagtccaattaccatgaggccaccatctacaagcacatggtcaccaggccagctgagctgcaaccccccaggcatccagcagatgggcccaacagagggagcaaggtc

SEQ ID NO: 1833 - DNA, 404 bp, Bovine  MMBT19625
atttctctgttctttatttaagaaaatgtgggaaaagcacacatatatattaggagtggagaatcagaatgagaagtcgacaccaygctgtgcagggcaargtggttctgcaattcttcagcagctccaggtgctctgactctgactgatactctcgtaatacctgagctcagctcataaacctccttcagtaaatacctatccaagaccaccatcagacgttcaggtgccaaggacacgaaaagggaatatgaggtatttccttatgtaagacttyacaggttcaacaacagagatcayaacatgaaatgcttcttcctcaattcacctgagaattatcagtgatcctccatgagtaagcaaggcttgttccaagagtgactctcagagcagagggtagacaa

SEQ ID NO: 1834 - DNA, 600 bp, Bovine  MMBT22144
gaggcttctgcttagaggaaaccaaagacaccagaacatccatttgcctcaccctgtcatgtgtggaaaattttaatttgcctagttaatcgtgtgggacatgggagacagacaggcagaaggrcatgacagcaaagagcacrgttcagaagcagcctccgccgttcaaatcctatatccgcagtyagtactcgggtgaccagtcctagaccaggagcacctgaaacctcctgttcaccttgaggctttcatgccagyacctgtggctttctgcgggctccaaggtgaagcacaagatcygcccccctacctttcaagacctccacatgcatcccttccccctctccagtccactttgtcttctcagaaaaaacctccatctgtgtggtctcttgtggcaacccactcagtattctcgcctggagaatcccatggacagaggagcctggcaggctacagtccatggggtcgcagagagtcagacacgacggagcgattttcactcttttcacttcggggaactaacgtccgatgagccactaaaaaaaaaatgcatctaaaaaaacaaacaaacacaattttgagcaaacaatttaaaag

SEQ ID NO: 1835 - DNA, 600 bp, Bovine  MMBT18969
acacacatggcccccactctcccagccccatgcatgcccagcgccactgcagcctggctgtgctcccaacgctcttctgatgccgcttggtcaaggccacccatgaccctgtcttgccggtccagccccacccactctgcagcttcatcttagtccttcatcactggtgaccactccctccctccctccggaagcactctgctctctcagttcctaaactgaacactttcccagtttttctctgacttcgctggccagtccttcatggggtcctcctttttctgagccctgaatggtggycctccttacaccccattgggctctctctcttcactttccctgctcacttcccaagagatacctttcagtgttgttgctaagtcgtgtctgattcttttgcaaccccatggactgcagcctgtcaggmtcccctgtctatgggatttttcaggcaagatactggagtgggttgcaatttccttctccaggggatcttcccaaccaagggatggaacctgtgtctcctgcacgtgtctcctgcattgcaggcaaattctttaccactgagccacctggatataaacaccattcttgggactt

SEQ ID NO: 1836 - DNA, 600 bp, Bovine  MMBT23309
acagggccgtgggcattactgtcacctgcacaggccctgcccttaagagcaaatggttgctagtgcacaggtgcaatgtggaagcagagccaggactggaggggcgggagaagagggttgggggaggggcggagctaatggccataaggaggcgggatcagaaatgaggggcagggcctaggtttccccaggcaggcggtgggtgaggggcaggggccagggcccagggggcgagcccagaastctgtgtcttacaagatggaggtgaggcccgttgcacttggagcagaggagtcagcyaggtgcccaccctccctgccgagttygccacgcactcgtccttctgaattccttggcttgcatgaggttctgtgaacacattttcctgcttattcatgcatctctcagacagattattggcacctacgctgcagatgttgcctgmaacattaatgggaaagccccaaatactagccagcataatccagagcagcatgttcaaagagtgcaccgtgaccagggaatgtaaggaaggtttaatgctaagaaatatcttaacattctacattaaaagactaaaataaaataatcatctggtca

SEQ ID NO: 1837 - DNA, 598 bp, Bovine  MMBT20541
  misc_feature (1)..(72): n is any nucleotide
nnnnnnnnnnnnnnnnnnnnnnnnnnnnnnnnnnnnnnnnnnnnnnnnnnnnnnnnnnnnnnnnnnnnnnnnctaagtgaccattgctgtcctttatttcctagactgacccccatagttctgaggggttttgtgctatttgaaaaagaaggcagaggcctcttcaattccttagcatgttctgcgtcaccttggaaactaattgtgtatatcagaaattccactctccaatctcaagctcatcaaatgctacagtcctgccccaagtacagcatgcgatgccaactgcctgtcagaaaygcaggtgggtcctcagtgtattgaagataattattgccttttagatattgtaaatggttaagtgcttattaaaattaattacagagaattatcttacctggcagggccagggaatgggatattctggctagtggttcaattgaaagaaagagaaaataaaagatgattgtgctcctgagattcagtctgggtgtgtgtgaggggactggatttttccagcatgttctctttcatcaagaagaccatcacaggataccatcagatatttaagtagcagcaaaatatttttcaggattgt

SEQ ID NO: 1838 - DNA, 600 bp, Bovine  MMBT20006
ttctctataataaagtcttctctggtgtctcagatggtaaataatctgcctgcaatgcaggagacctgagttcaatccctgggttgggaagatcctctggagaagattatggcaccccactccttgcctggagatttccatggataggggagcctggtgagcaatagtccatgggatcgcagagttcgacacgactgaacaacttacacttttcactttttttccccatgatacagggagaaattccagtacatgttggctaaaacgactccagggttgtgggctacatggagttcataytggatatttatcagtgggactacagcagccagtttgtgccaggaataaataaaataatctttaattctctctcctatatcatccagaatttggatctagttggaaggaaaggaatgattttctccactgtgacaatgctttaaccaacttcttgaactcatttagctgccactgccactgatcctattgttttgttttttacatcatcagagtttgatcaaagggttcagaaaaattagaaatataaagagcagagcatgctgtgcgtcagctgctagtagagaacagattaaacaaacg

SEQ ID NO: 1839 - DNA, 600 bp, Bovine  MMBT19686
gcccgggagaaggatggggagggtccctggaggtgacctctctgagcttgtacccacagaacctctggaggttgaacaaacctgtctccagggcagcagcaaggaccagcgggagagaggtttaggctctcaaatcttcatccacttccccgaataaaaataaatagagcagcattctagccatggaaacagagctccaagatgcaaccccaagttctcctcctacccagagggcctctctgagccccagcctgggaattcgggaattcaggaataatcccagactggaccacccactcytcataagagcctgagaaccagaagttcgagagaaacttccatcgcccctgagtatcaacgtcatcgtcacagaggcaatgggcctcacgagcccaccggtcacacggctgtctccattcaaaactgctctgcaagctctaaatttccatttatttatgtttggtttatgccaaggctgcaatggcaagctgctacagttactcgtttgtagctacagagaatccaatttcataaaaatttgtttagctagctaattaatcctgatcttttcattagaaaagaagctaaacaatttccggt

SEQ ID NO: 1840 - DNA, 600 bp, Bovine  MMBT22734
tttactttgggaaatgatttaagttcactatgaatttattctttgctttaaaaatgaggattaacatctcttgatcatttacttttttaagagacaatgtgttaatttgcatggaccagctactttaatccttataaaaatcctgggattcagggattrgtattgagtccctgtctcaataaggaaagcaggacttggagagtaacttgcccagggtcacaaggcaagggtactatacagccagggtttggttcagaaaggtctgctgcagagccsaagcacagtgccaccacattcttytgagtccgaatgggcagttccagctcattttcacattgacctgaaacccaaagttctgcttaacaggcttgggacacacggtggaatggctgaattatattatgaaatatatcatagcacggccctgacagcatgttcctcctctgcttctrgaggccactcaggatatacygagtgtctttcatcactgcatgcatttgttcatattttcagaaatagctagggcaagtgatgacaaakgcatgccgcagtatggatgttgcatcattgtgggcaccgaagtcctgccatcttttcgtg

SEQ ID NO: 1841 - DNA, 598 bp, Bovine  MMBT19689
  misc_feature (1)..(2): n is any nucleotide
nntatgttagcatgtctgggccgttatgtcatttgcattgaccatatgtcggcggtatgtacccaggggttagtcttagtacaaagagggttacacgtccaatggttctggaaaacacataagtaaaagggtgttcaaagggcatgcctcagtgactgtgccttcccagagctcgtctataaaaagattttgcacacttggtcttaattttctgttgatttctaagctctagcaaaccgcaaaacagctctgtgggcttctccaccaagctggttccacagatgcggctgcagcagtccyaagccggaattacgtgcaacagaggaaggaaccgagaggagcggcggtgcgcagtccagagccttacacgccagcccgacaggccttgtggggtgtcagcgccgttagtggtctgaatgagctacagatagcacaggctccagaacacacatcacaggacagcttttgttcttttgcctcttgcttctcctgttgttgttgttcttaatacatttctttgcgaagatttcttagatagccaaggaaaagaaaaataatcaatttttcaccagggcactgtaagtactaaagtacttgc

SEQ ID NO: 1842 - DNA, 600 bp, Bovine  MMBT22399
ccgagtagttgttgacaatgtttttcatctgccgtctgatggatgaggtcgtcatctttacgttctgtgacaagtgcagatcctttcagagagagaagcttccccgtctccggcaggttcgtgctccacagasgttcagtctccgtaacaggtctggagcagggtccctgacggtcatttcctctattggagcctcaggtctgagaagctggaagccatgacctagagaaagaagtaacaaacgttactgtgtgtgagttcccgagacagcaggctctctgcaaatggcaggcaggggtyggccagccggggtggtgagaggacatcctccagcccccgaggacaaaaaggatgccatcttcccttcaaaactaagttaagaacaatactacacattaataaccaatacagtttaaactcaagtttaagcctctggaaggaaagcggtaacactgtaactcctggtctattttcaaaccacttctgctggatctgctctgccacacctggcagacgcccgctagaagaatctcacaccatctacactggctycagagactctctctgaccctcttctcctgacttcttacagagactccc

SEQ ID NO: 1843 - DNA, 600 bp, Bovine  MMBT19928
ctgtctgttctgaggtcccttcccrtctctacagagtgtgagagtgcagagacctttaggttgaccagatgcccaatggggacatggcagaggatttattgtattaagtatgagatgggacaacaygctgagatgctgctcacttctaaagctgctctgattttaagagagacctgtggaagatggtcataggaagtcaacaataaccattgaggattgccacgtgtaccagtcaccaagcttcagtaggctgtgttgctcggactgtctggtgcccgtctgcccttaactttttycccygagtagggaagtcgagctttttctcactatagccrggagagggagtgggagttggtagtccttgcatctttctggagctgatttttccctgactcttttctctgctgcttctttttgtccccactttggggtacaggggctggagcagattttgttatgctgggaggaatgttttcgggccatactgagtgtgccggagaggtgatcgagaggaacggacagaagctcaagctcttctatgggatgagctcagagacggcgatgaagaaacactccggaggggtcgcggagtataggtat

SEQ ID NO: 1844 - DNA, 600 bp, Bovine  MMBT22981
actacgagccaggactcctctgccatttttttttttaaaggcctgctaaacacaatcatgactaatagctttttaatctgatctaagactccactgatcgcagtacacatgccaatttcagaagggttaaaatgtgtgttttagaagtggtgaaacagtaatcaagttaagcccaagccaaccaaaaccacatttcctatttattcggataatgatgccaggcagagagtaagaactaggcaaacatttactgaatcgatggatggtctgggaggcgatattcatctgtaaataggaaaytgcttgcagcctcctgacaaactgtcttctttcccctcagcacctgtccatgccatcaccctctaccatctcctttcgtgaagaaaaatcagttcactgataatggataccgcttcactgtacatgatcatttccatgtcaactagaaatacttatttaactttcctcaaggattcaaggggacgtagtaaatcacttcatgtactgtggacttgaaaatacgtgtaggtgtgaactgggtctgtggtaagactgacaatggcccatttaccagcttcagatgcacaggaggtcttggtg

SEQ ID NO: 1845 - DNA, 600 bp, Bovine  MMBT20475
ggagccagagctctcccctgaaattcacgcgtcgccccaaacccgcaagccaaagaaaccggtccttcatgacagaaaccccagtcctgcttctgaacgtctctcctccgttcagttgcttcctaggtctatgagcccctgaagtcacttggaaagcacaggatcccatttccacaaaattcggggggactttatcctcatcactagactataaacctaaaaacacaaacccctctcccagtggcttcacgctgtcccaggctgagagcactggaaggtccacaggcargcgcctcgtgyccaaatcctcgctgaggtgcttygtactctgtgaccttaagcgagtgactcagccagtgagaggccttagtwtatgcatctttaaaatggggattctcatagtcagttgcaggattggtatgaaagttaaacatggtactgtatagaaaatgtctacatagaaagaaataagtattggtgactatgtcatttgtaagggcttcggaagaatccagatccctcccgttcattcttctccagcaggttcttgatcatttcgagatcttgctccttgatcacttccaaacccatctgctctct

SEQ ID NO: 1846 - DNA, 600 bp, Bovine  MMBT19917
aatgcctgctgactgcagatagaaaaggggtgagtgcagcttgtgagacctgattctgagaygatacggtgtgtgttttatttggagagggagttyagggaagtggatggaatatagacattcggctttaggcttctgagctgtgtgacctggggcaagttacttgacctctctgagcctcagtttcttgcctttctgggtaactgtgaaaactgagtaggagagtgaatgccaatgccatgaggcagactggcctgcgatactgccagtctggtggtcagccttggctagcaggcatgygtcatggtacaaatggaatgcggttgctccmggtggcttcctgcccatggctcctgcgggaattatcgcagtggtcctgttccttatgtggctccttcactgtatgtgctgcagagttttcccctcccttgtgttgttttctgcaaatagcttctatcaarggggaaacacagggttcctttcctcttctttgggcttgtagccatattgggagttctgtcttccctgtcccagatcctgccagagtgtgaactctttggggtaaccgaggcccactgcattggcctcctggccagagct

SEQ ID NO: 1847 - DNA, 600 bp, Bovine  MMBT22138
taaccagtgttcaaacagcaagctcatgtcaactcttggctggaggcttctgcttagaggaaaccaaagacaccagaacatccatttgcctcaccctgtcatgtgtggaaaattttaatttgcctagttaatcgtgtgggacatgggagacagacaggcagaaggrcatgacagcaaagagcacrgttcagaagcagcctccgccgttcaaatcctatatccgcagtyagtactcgggtgaccagtcctagaccaggagcacctgaaacctcctgttcaccttgaggctttcatgccagyacctgtggctttctgcgggctccaaggtgaagcacaagatcygcccccctacctttcaagacctccacatgcatcccttccccctctccagtccactttgtcttctcagaaaaaacctccatctgtgtggtctcttgtggcaacccactcagtattctcgcctggagaatcccatggacagaggagcctggcaggctacagtccatggggtcgcagagagtcagacacgacggagcgattttcactcttttcacttcggggaactaacgtccgatgagccactaaaaaaaaaatgcatct

SEQ ID NO: 1848 - DNA, 600 bp, Bovine  MMBT21279
acagtccatggggttgcacacacctgagtgactagacaacaacgatgcagtcttagcttttgcttcctgacataaagctttcagtgcccttcgtgacagmtactcaggtaaccttcagttgctccagactctataygcaaagttgtttacttgcctttcaattttccataaatttacatttaaataaaagaaactttcaaaacattcttattgaatttatagtgtagaaagaaaggccagtgatctggggaagcaacgtgatacaaaaggcaaaggcaaggagtcgaggatcaaaggacytgagttcctgcaccgcatgaatgatgtgacttytgcaaggttatttcacttctttgattctcatctctcttatctgcagaatggaaatgctgagcacatatctacacacttttgaggataaaagaagatcagacataaagcacttgacacataacagtaagtgtttaataaaataggctttccgccacttcctgtagttacctatttcttcacaaaattaaaatagccacctttgcaatctcttctctatcaaattatttgccttatcaactaatcctcatcctctattgaacctattaa

SEQ ID NO: 1849 - DNA, 598 bp, Bovine  MMBT23043
  misc_feature (1)..(2): n is any nucleotide
nngaaaagaccctgatgctgggaaagattgaaggtgggaggagaagggaacgatagtggatgagatggttgggtggcatcactgacttgatggacatgagtttgagcaagctccgggagttggtgatggacagggaagcctggcgtgctgcagtccatggggtcacagagagttggacacgactgagagayggaatgaaagcaactacatccttggcakcrgggtattaaaatattgaaaatcccatggatggaggatcctggcaggttacagtccgtggggtttcaaagagttggacaygactgaagcgacttcactttcagtttaattttattcctaagaggtggtttattctgtcagtccactgatttaggatggggatggttaaatctcaatctggtctttgcaaaaataacaagtgagaacatttgggattgcagatcttatttaaagaactgtatcacttgaagctgaaattaaatatgcaaatgttaatcatttattttacacaaaccaaactcacataaataatttcagattaacatatgtacaagctattggctcttattgaccctgatgcatttatcaactctcataa

SEQ ID NO: 1850 - DNA, 598 bp, Bovine  MMBT22133
  misc_feature (1)..(76): n is any nucleotide
nnnnnnnnnnnnnnnnnnnnnnnnnnnnnnnnnnnnnnnnnnnnnnnnnnnnnnnnnnnnnnnnnnnnnnnnnnnntgattaagggtgtgggtaaggaaggctgtctcgactgagattagaggaacttgagacgtcaggcttagaggcacaagaagtgcatgtccagtctagtgtagctggagtagagctgggcagggcaagtggagaagaacaggagatgaacaggccaggtggcaagctgcctcagccttcttagggggtggagatgtcatcctaaaggtgatgaaaatgaagtcccyccaggtttaaccagaggagcctgagattgacggtgccttctggaaagacagctctggctgcagcacagaaggtgggtcagggcaagccaataggaagcaatggggtgtgtggggggagtccatttccaagccattgcagcaatcggggcaggaggtaagaacggctgctaccaggggagggaaagagaagagcatttgagagagatccagaaagtggaacaaacatttgagggatgaaggatgaatttggagaaactctaccagaggcttcygcccccatgggaccagagaagggagg

SEQ ID NO: 1851 - DNA, 600 bp, Bovine  MMBT21634
cctcaagcctcgtaggtagagctgcctggccagctggttcctgttcccragtcacagcccgtgatgaagacgaacttgtcctggaggcggctcaccacctgcctctcctggtaccagcgcaggaggtagtataagcccatgaggaatgccatgtatagccacatggcttcgaagggaacagacacacacagagtgaggtgaaatagagtctggctagtaaacagacaggaggaattaggaacatgcatgatgatgcttggccaaccaggttccaggctctctggcatggagttaccaagyttttccagttcactgtcttcagtgagtatgactgactctgacctcawtgcacgctctttggtatacttaggtcatttctaatagatgtcattgcattttaaacacaaacccttaaggatgacaatacttttcccaacctcactttcctagtcctccctgttcccttggcccacctctccactctccacccccacccttaccctcacagattagaaccctkacatccagatttcataattcacagctaaattctttcctttttcatattgaagtctatgacctggatctcctagatctagt

SEQ ID NO: 1852 - DNA, 600 bp, Bovine  MMBT20218
gttttcttatttatgaacattccgatcctgatttgcaaaatgaggaaaaattattttatggaaatacataaaacataagacaacaagccaagagaggagaaagtgggaaattaaaggatatgatatgaagcgagttctgagttacaaaaaacacatttcccatttsacatattcractttgaacatcctagcagctgaggagaatggaaattcattacacgtacaatccatggtttgagaaaataaaagcaaggcggattttctggaaaagcacagctcctttgaaagccacttgctggygattcaygsgagcatcctgggtgacgtgataaaacaagcaccttggggaacctccctagtgggctagtggttaagaatctgcctgccagtgcaggggatgtaggtttaaaccctggtctgggagctaagatcctacatgccccaaggcaaccttaagccctctcacctcaactaagacccaaagctgccaaaaaaaaaaatatatatatatatatatatatattttcttaaataaagctccttggactaaatgagggttctagatttcctgtgaaagattaagccaatggttaaaaggga

SEQ ID NO: 1853 - DNA, 600 bp, Bovine  MMBT19911
ggtcctcggcgtgtgttaggtgattctgtggttgtcactgtcatcttcaactttgagacatgagcattattccagagcctagagaatgccagagacgcaccatctcagagcatgcaggtttaaacctctcagcttctcaactgtctaatctaaggacattagctcttctaaagggtgataggaaacgcaaccaacgtggcctggccgtttggttacaaagagtttctttgcggctgcccgggtcaccaggctgagaaggcatgtgtgcttccttttatgtggagaaactcagctcagccygcrctgtgggcccttccagcgtctgcacatccctgccttaggagccrtgtgacgggccagagggaagtccacttatcctcagcggacctcagggggcatcgagaggtaataaattgtatttcctcttgagtacaggagacaggaagctccaaattggactctaattaactctgaaggaacaatgggtttctccagagcctggcagttccaatggtgtctaaggaggtgtcacgcagccttggaaaataattacaaacgtaatgacgatgcctccgaagtcggtctcctgacgatacacct

SEQ ID NO: 1854 - DNA, 600 bp, Bovine  MMBT20162
ttttccctttcctatttcatgccccctatggtgtgggcaggctaaaaaatcacactttaagcactgcaggaaatctgaaacatgaggacaagtatctttattttgtaggggggaaagcagattctcaaagagactaggtcagttttcccaaggtcatatggctagtgagtggagggggcgagtcccacgctggctgacggtggagtccatgtgctttcagtatacattccagtacctgtgatgccaggcatttgcttaagaycttgctaaggaaagtacaggctgcagatcagcatcacygatgtctcctgggaacttgatggctgtgtggaatctcaggtgccacyccrcaatgctgaatcaggatcttcctttttactaaggtccccaaatgatttgtatatgaatcaaatcaaagtttgagaagcatagacacagggcataataggtagctattaaataaaggcatgatgagtataaaagtaatttttcaaatatgtaggagaggtcaagcagttctgaaatcagtcacttgggagttctagaagaaaccaaaataatggatggaaggcaacatgcaaagagtaaaagagaagagcg

SEQ ID NO: 1855 - DNA, 600 bp, Bovine  MMBT21935
gttacctgtggtttagttaataagttatatgactggagcttgagctggaatgagaagaaacatccccctagcttgacaaagagcttggtttccggctggtgaaccacacattccctggtgaaccgtctgagctggttcacttggaaattgatctgaccaagctccaaaaatataatcaaagtgggttgaaatcactcattttgtcactttcattcttagtttcactatttaaggatttggctgaaagcattttaaggattttgtcctgaaagcatggaattttctatttgtgacaatggyattgtgtgtgcgtgcacatattcagtgtcctgggcttgcctgtacaggcatgttttcagctgaactatttatacctaaaggcatgcagtgattaaagatcacagcgtatggcaagttttctttgatttccagaattgcctatctgaatttgtaggttagtgtctttggagaaatgcaatgtgcatccaactgatcacctaggtagaggaccttgcctcagaaatatctgaggataatttacttagaagaaaccaatatgccttttttttttttttttttttgaggaacaggtgtatttga

SEQ ID NO: 1856 - DNA, 600 bp, Bovine  MMBT19202
agctatagaagtgaaggattttaaagaaggaccttgagcagtggctctcctcttttgtgcacggctttaaaaaggtcgtgttgttgttgttttccctccaccccttcccctcaagaataattaattaatgktgtraaatagatactgaatgctacacattaggaaattccattttaatctgtgtctacattagtttcagggacctacttaatttatattgctgaaaaatgtaaagttgtgttggtcaaatgcaactgaaggacatctcaaacattttcagtaaatttggcttaagtacayttataacagatccaaagggtgtccaggttctttgggcatattgaataataccatttgtggtgccagtgtgtgggccacagtctctgactatcaggtcatagtttttttgtgtagagaggttaactgtctttgtagaaatgataactgggttcttaagatttttaagtgtgtgcataaaagccacatcaaacaagacatacagttgaaaatagaagtctctggtgaaaattccatatatattagtgaaaacaaacagctttttgataaaaagaatgtcttttggagatcaaaaatgtgatt

SEQ ID NO: 1857 - DNA, 600 bp, Bovine  MMBT18968
ctagcacatccagagcagatgcaaattccctgcaagacctgtcccatctctccctagacttcccccatctcagacaatggcacccgctctccaagttatgtaatcctctcttttatcttcttctcttatctaatccattggtaaatcttgtcgacttgctctctaatatatcttgaatccagaatccacacttaacacagcctggaaagcacagccgtagcctcagctcagcatagtcttcagagatactscttttatttgtttgtttgtttttttactttatttttaattgaaggatayttgctttacagtattgtgttggtttctgccaaacatcagcatgaatcagccatcagtatacctatgtcccctccctcttgaacccttctttccgtttttactttcctttcccacactagctcttacccacttaaaggtctcggtgaagaggttcccatcattaaatccattttacagataaggatattaaggaaggttcagagaggtttaaaaacttactgtaggtgtccagctggtaagtgggatctctgggcttctccccacctgcctgactccccaycccacctgccttgtgactgg

SEQ ID NO: 1858 - DNA, 600 bp, Bovine  MMBT20912
cagctcagaaaagagttcaaggtacttcttaacaatgttcttatgaataaccttcagaattttgctctgctggagcayttctcaggagatgttcaggtgaaggtcttcagagtcaaccaccccacggaagaagttgagatattcaggaatcaactcatcacagctttccatgatggacacatggcggacatacagtttggtgttcttctttttgttctcgaagaggtcaaaaggagcccaatgagggatgaacagcagtgctctgaattctaattgaccttctacagagaagtgctttaytgcaaagtgatcttcccagtaattggtaaaactcttgtagaactcaccatattcctccagggtgatgtcatcagggtctctggtccaaatgggcttggtcttgttcagttcttcctgagcaatgtacttctcctttatcttctttgtcttctttttcttatctttgccactatcatcctcctcatctgaacccacatcttcaatcttaggcttctcttcatcatmtttatcttcctsttctttctcacctttctcttcttcagcctcatcatcactgatttccttctcacgttctttctc

SEQ ID NO: 1859 - DNA, 601 bp, Bovine  MMBT21934
  misc_feature (1)..(1): n is any nucleotide
naacattaattgaatgctagcaatttcaggattcttgcaaagtactataaggaatgtgatgttgaacaaatcgtgtgccttatcctccaatagccatctcttaaaagggtttgcaaagtgcataaagagctataaagtttaaggcggtcaggaatttaatacacatgagatattttgaactgtattctgatttagccattgttattaatacttagcattttctagctcttggagattatatcacaccaatgtcttggacccatattttgttttttttaatttttcctatttcaaataacayttgcaaatttgaaatttccaaagtgaatcataacttcaggggaagtgagctctcatgcagggcaggaaggcaaggcacatctttgaaaaaacatccttgacagtactgaagagtaaggaaaagaaagagattagagaaaagaagctgtttgtggtctggctacaaccagggcatctatcaaaggagagactcttaacctttactgctggggacctgttgtcaaaatatgctttaaatgcatgaaataaaatagtaaagaaaaaccagtggaatagaaatatcacagtttttattgtcata

SEQ ID NO: 1860 - DNA, 600 bp, Bovine  MMBT22636
cctcttgccctcaygttcccccaccccacaacccacaaccaccaaattgaggcaacaggtcaacagtcaagtcaaaattgtacccactcctacatgtaaactcatgcaaaaagtataagtgcagatgtacatgcagagtaacatcacctacccatggaaataacttgtctgaaagtcttcatcagtaggayatacaagcataaacttgttatctggcttcattcttgtatcttccatatttccaaacagcacaccttatagcttagctcaaatttagtattcatcataaacaaagacagyaatattttcacattttaattatacttaaaatkaaaataaattatcactgtcgtttttcatatctaatatattcaaacaatgacaagtcagtactatataaactttaataaagttaaggaaaggtgtgtttttccaattttgccttccaacaagaaatcacaattaagcatcttgtgtcccaaggtcatctcacactatcagcaaaccaaaattaagtaagatatgtttaaagaactaagcatcaaggcttggattttgaatcactaagtatgaatattagctaattgatggggacaattt

SEQ ID NO: 1861 - DNA, 600 bp, Bovine  MMBT20467
tcttaaaaatcgggacctacgcttgatcacagcattctaggtaggttttgacagtgtaaagtgaagtatgattctgtcatctcttatgtgagacatataatgtcttaaaattactctgtttttctcacttgtccttcctattaagacaccaactagaactccaaagtctttttcacaagtgttgcttttgaaacacatttctcacatcctgtatttttatagcatgattcttttaaaatttatcaaattcatcttggtgatttccacctagttgtccaacagctaaagtctttttttccycctcagttttattgagatataattgacaggcagctttgtataagcttaaggtgtacacataacaatttgatttatatatactgctaatgataaccacaataggtttagttaacaaccaccatctcatgtgaataccaaaaaatttctttttccttgtgctgagaacttgtatcgtcttctctcttagcaactttcaaatataccatacagcagtgttaattatagtcatcatattgtatattatgtctctagtacatttttatcttataactagaagtttgtaccctttgaccaccttca

SEQ ID NO: 1862 - DNA, 600 bp, Bovine  MMBT21282
ctccctcttcccataataccacttagattagcattaaacatattttcatctctaactttcctttttctatgaagtcatgtgaaccaatttctcctttctgaatgctatgtaattccttcagatctgttaacatatcttattagtctatgctatctacctggaagccatcctgcttttcaatatatatttgctcaatactattcttatctattasatattgacttagagtttaattctcaagggcttattttcatgttcttaggggagaacctcagaaactctcgattcacagaytacagytggatgatgattttacattaacaatatggagatttactactactaactcaaagcgttgttcattgtattttacaaggcattcttagcaagacacaagaacagcagaaatttgcttgacattttattacctctgcccaacaaactcaatctccaaacatgagaagatagttgacctttactattagtcaccggcctttaaaggatttttattattttcttttatgatcacattcttcattccatgaacgccaatttgtgcaaaagaaggtataaggtgcagaacaaaaaggttccaacaag

SEQ ID NO: 1863 - DNA, 600 bp, Bovine  MMBT20939
ttaaaattgaagttttaaacagggctctcattgggtcatcctttcagtccattcgggtctagtttggaagctgacaactggaacaaaaagaaccttgaattcggtgcatactttggttttggtgctgctgcttctcccagtcctcagcagggattacgaaagacctcggtgtgcacggcagatccccgaaattcctggcaaaycgctgcgtttttccacttttctgttcaggaccactaaatgctgagatgtggatgcatacgaaataaaatcaattcattgtgttccaagggttttttytgtttgttagtgtctgtgtaaaatcaccttttgaagcagcaactatcaagtctgaaaagcaattgatgtttccattaatctttttctgggggaaaccttagttctaaggatttaacatcctgtaagtaaagtttaacataacagtattccataagcagcctttttattgtcagaccattgcctgattttaatataataaaaagaagtgtgcgttaatatttaagaagctgtgctcttcttcctcagcatatactttattcaggattagaatttaatgtcttagatgctttggtattcaac

SEQ ID NO: 1864 - DNA, 600 bp, Bovine  MMBT18769
agagttcctctacctggccagatccatgcaggtgtcagtgaggttggtagaagaattgaagtactctctgctggctgccagaaccaagtcaatacttttttcgtaactgaccctgaattgggtttttcctttatgggctatactagttggtggayttattgagcaagcactgcagtgcatcatctgcccagccaggtggatgttctcaaggcgactggaacacagaagactttctgtaaatatctggggaaaagaataaactagaattagtgcttagaaagggaggactcaattctcaayacaatggaagctctgatatccaagtataataaattttaaaaatacatccattctacaagtagaggttgcacaataccatgaatgtacctcaatgacaatgaagcatactttaaaatgcttaattttatgttatgtgaatttcacctcaattraaaaaaaactccctcttttagcaagaagaaataatttaactgaacaaactaatggtaagcatactttcatgtgttacaatgaacacttaagtaaaatacctaaagttcatactcactaaaatcaggtccattagacatactgtcccac

SEQ ID NO: 1865 - DNA, 600 bp, Bovine  MMBT19681
tttgtgaagtttggcctaattttttttttttctttcagtggtgggcttttaagtaatttctctggaattgtattttcaaatatttaggaattcattacatttcaaaacttataaaaataagaaaagcattaatagatcattgctttgggtggtgtgaagctgccactggaaagaggagcaggtgggaagcagtaggcaatttgtagctgggaaggcttcctgtaggtggctcccatggtccacactgacagacggacactcraggctgagatgcagaggtccagatgttagctcgtgacygmtgttgctattatgtattgatacatatttatctggaagaacaaacttactcccaataccgcagcaaagtagaatattaaaatttcctttttccagtgcaactttaagttcaatttcaactttgcacaccatgagctatctcagcacagacccaggcatccctccagacccgyactgaacatggcagtggggaaaatttgccccaaccccagtgagagcccaagacacacggaagccaactccagcctgaaactgcttgtaatttttcattcgcccgagtttcccatttcggacaccttt

SEQ ID NO: 1866 - DNA, 600 bp, Bovine  MMBT23350
ggggaatgtgagttgtaaaaaaataaaaaggaaatcaaattatttttaaagggtttcccaaattttaaaaagaaatgcatatgaaatattcctctaattttaacaagtaataatgtagatacatttttgaaatgtcactgatacactttgcttaggaaattctatacattaagaagaaacaygttaaactataataaacatgaaagatgattcaaaatatcttaaaattgacattcgtttcatgcataagaacttaaaagcatmccattcctgataaacatcagacagtcagtacaattyatttaaatcacgaatgctcagttgtcactaggagctgaaaagaaacaattctaagtttctaaaagaaactacaactagaagagaagactgcacagaattgattcctttggtctactgtaagctaacaccctcaacaagtgtttctgaaatcaagataaaacactacaaatcatgtttttctgtgtttcgaatacttattaaataytgctttaaggttattgttgtttaaaaaaaaagaataaataaataaagtcacctacctggatgacatgaaacataaaccaccttgaaatttccttg

SEQ ID NO: 1867 - DNA, 600 bp, Bovine  MMBT21291
aagtgaatattatttcttgtgactataatttattctatttgaccagaggtcaaattgcttcatctcctccacctgaaattgccatataggcctgtttagtgttgtttaactatcaggttttaccccatggtgacttttgtcatgagtgtgtacgccactattgttaacattttgaagtaatatatggtattactgttaaggtcattctagtttttgtgagggaaactgaccagcagcatcttcttatttagactttctgaatttaatttgtaccctcttatragtagtaggttactttayatccttacatttagttaagttcctgagatatagactcatttaatatcagtaagccttttagcttctgtactgaaataaaaaattcaagcagtaatttaaatttgaacaaactaaatctaaaatattttccattattttagtttaggagaaatctccataagaaataataacttctttctgaaccagaggctaataaartattttaactttctgctgccctggaccttattgaatgtcccacacagtcccacttccatcattatgggtattttaaatgaaaaatctgtttcatttgtgtaa

SEQ ID NO: 1868 - DNA, 598 bp, Bovine  MMBT18980
  misc_feature (1)..(148): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggggggggggtgctcaaagaaatagatttctttaggcttttattattgggacttactaaggtccctaactctgcactttgacaacttttgccaaatttgggaggttcttatattgttatttcttctaatgtattttctgttcttttytctacctcttctcaaactccaatattaggaatgtgttatktttgttttttaactttcctatactgggtcttcgttttggcacatgggatctttagttgcagcacgtgggctccacagcatgtgggctcttagttgcagatgcggaatctagtttcctgaccaggagtcaaatctgagccccctgctttgggaatgcagagtcttaaccactggagcaacagggaagtctcccagataggaatgttaaaccttctggtattctctcccaggtccttcaggatctgtttactttttaatc

SEQ ID NO: 1869 - DNA, 600 bp, Bovine  MMBT20961
ctccaagattcttgggcttcccttgtggctcagttgataaagaatctaccttcaatgcgggagacctgggttcgatccctgggttgggaagatcccctggtaaagggagcagctacccasttcagtattctggcctggagaactctggayagagggaggagcccgmaggctacagtccatggkatcacaaggagtctgacatgactgagcaactttcacttgtatttataaagttcaaattgatatcattcaaaacagtaatttctgaatttatgcaaaaagtcagatttgcaggactgyggtttggccgtgaaaaccacagaccgagttgtaagtgaaaagggctggtctgatatttgcataatctttattaggagcttttattttgcgttttcttatctataaaatgagtaaatatactctgtgggctctaatgtctttttctaacatgaattttctttttgcttttttattgtagtgatagccaagtaagttaggttgtcgtagctgaaaataatttgattccttttttcttttttacagtttgaattattttacagccagcatttcagtggaaggaaacttacatggttacactat

SEQ ID NO: 1870 - DNA, 600 bp, Bovine  MMBT23340
tttggggggcttccctggtggctcagacggtaaagagtctgcctgcagtgcaggagacctgaagaaggaaatggcaacccactccagtatttttgcctggaaaatcccatggatggaagagcctggcaagctacagtccatggggtcgccaagagtcacgactgaccaacttcactttttcttttttttccaactatttttgtgtctgcaagtcagatactatcaagcaaactgccatgtctgatccacaatccttttaaatttttaactcaaagacaaataggaaaattcagtaaattytatctttccagatgttctcagaaagagttataaaacacagttggataatctatttacaccaaatgaattacctatgtgtgttgtgaggtagcaatgaaagactatgatcttctatggtaataacaccctcaatgcagaagccttccctcctcacagtgtgtgaagagtgtgaataagggatggagagtcacctttcattatttcatcaactactggtgttttcacagtattttaaatgcctgatttcaattttacaacaataccaatatttattctgaaaggtaatcacatgttccaagt

SEQ ID NO: 1871 - DNA, 493 bp, Bovine  MMBT19639
atttggaccaaatcagcttgaasaaatcagatcattcttctcagactgaagaaattagaagaccaaaagagaaaagatgtttttacctactctctaagactctgatatttagttctggtattgtaaggaagtactttctgtattagccaaaacaattcttcatattctagactttagctttctgagggcataagtataacccatttaagtgaggaagaagcaacagaaaacagatgttcaggaawacttcaaacagcatgaatgactgtagtattttgctctgccccgttttccataatygttttctggaaacaaaaaattcaatttcctattgaaattaaaatcctattgtggattttgaaaataagcagacttgccttttctaattgattaaatggagtggaaagggaaaaagaagaactggctctttgaaggtacaaatctatgaaaacacttggcatctcccgaagtctttttattgttaataataaca

SEQ ID NO: 1872 - DNA, 600 bp, Bovine  MMBT20570
taggctttgttgagttttattgctgttatattagatttggtaatatactgtattaactgtgtgttcaatttaagctattaagttttaattgtcaaaaacagataaaatggaaaactaaaattttctttctccaaaattagrgaattcaaatatggtctaaaatgtattcatttgtcttatgcttttgttctctctctctgtctcttcaatgtaatataatatgcataaaacaccattttaacyctttagagacatacagttcggtggcctcaactacattcacattgttttgtaactatygccactgttcatctccaaaaggttttcatcatcccaaactgaaattctgcatccacaaaacagaaacaccccactctactcacccccgagctccaaataactgctaccctaccttctgcctttgtaaattaagatggaatttggctattctaggtacctcctgtaggtggaatcatatttgcacttttatgtctagctcatttcacttagcataatgtcttcaagtttcacccctgtagaatataacagatcctcgttctctcttacaggacttttctttatctggataccatgagcatg

SEQ ID NO: 1873 - DNA, 600 bp, Bovine  MMBT21615
atacagtttatgtaaggaattaagtaccagcctcacttactgttgcatgaggcagggtcttaagtgagataggtttttagggcttcaaatacccactttacttcaagagcccaaaagcacaaagaaagrcatcattctgtgataaaactcataactgaattttgcaaattctgaagcagtcagtcaaactgtgattagcctgagggattcagccttcagtaacatacaatcccaaggggaggggctctggtagtggatacagactctaggacaaagggatggaatgtttcccaggaatayatgatctcttgtgacactgttccttatggctttaattggtttcagaacttgcttagtgtgcctgtgcatcttggtgtagctattggacatctctcttttcccttgcttttcttccctgaccaggtgacctatccaggaaggattagacccagactctgtactctccactcttttctcacctccttccttttttctatgcctggtgggagctggacagtttcatctcttgcatgtaagtgtatctgtgcttctagtgttcagtgaagcatgtctatctgaatgtttctcttccttcctgct

SEQ ID NO: 1874 - DNA, 600 bp, Bovine  MMBT19622
ctgttttcaatagcaagtgaattgagtttaattttgcttttgcagggggaatgatggcttctcagggaatttcaaccttttacaaaacaagtatagcacattcaacaaaaagaatatatacttatatctccttatttgagatttctgtrcatatcattaactccctagctgaaaatttttattttgtaatttcagaatcactgtacatagacgttaactctcatagcttttcagggctttattttcttatttttagagagcacataaaggaataaagatgaaatgaactaaagrtatgtycagagttcgtatcatgctgctgagagttgtacatattacttcttataattcagattaaatgtaaaaaaaaaaaaacttcctcataatgatttctttsatgtaaaaatattgataaaaaaagaagtactggatttcttgctctgaagtcttctaaatataggatttttcttagcaactgtatataaatggccttgttgatgaacaaggaaattactggatcagtccctaaagaaataattcccttgatcacaaaatatgttattacattataatcccaagggattccagatgctctttcct

SEQ ID NO: 1875 - DNA, 590 bp, Bovine  MMBT21100
tctgcactcactctgccatctggtgtctttggacctttgtaaggctcgacttctccaagcttgactggccactcatcatagaattcctgaaggcaaatatattgaaacactattaagcaaactgtcctgttacctaccatatctgagtgccattggtttgcatattttatgttaatttataattctggaattttaaagctctttttcagtaatgctgtttatgaacttgtgactrtaaacaagtcaatcttktaaatctgtaagacggagacaataacaaaatgcrtattacagagtcaytatgtggattaaatgaataatacagagcacctaccctracacatagttagaaggagggagggcaagaggaaggaaaagaatatgtatggaaaytctctgaacttcctgctcatttttttctgtaaacctaaaaatactctaaaagaatatggtctactaattaatttttaaaaaagaaaaaaagacttgttgaagacacatagagctaggaagtggaaaagccaagtctagatacttttttactccaaaaagtacactttcccttcttcttttccatgtaaaatgtaatt

SEQ ID NO: 1876 - DNA, 600 bp, Bovine  MMBT23047
aatctagaaaaacggtacagatgaacctatttacagagcggaaatagacatagagggaaaawatatatagacataaagcmgaggaaggggtggtgggatgaactgggagactagaattgacatatataccctaytgatcctgtgcataaaccagatagctaataaaaatcctactgtatagcccagataactctactccatgctctatgatgacctaaatggaaagacagtccaaaaaagaggagatatatgtatacctatagctgattgactctgctgtacagcagaaaccaacayagyattataaagcaactgtattccaataaaaagtaattttaaaaatgatcattaggtgtgaaaagtcaagcttttacagactttctttaagataaaccatttaaatgaaaaaaactccagcacaatatgataaggtggaaagtcactcagtcgtgtccgactctttgcgaccccgtggactatacaggccatggaattctccaggccaggacactgaagtgggtggccattctcttctccagggggtcttcccaacccagggattgaacccaagactcctgcactgcagatggattctttacc

SEQ ID NO: 1877 - DNA, 600 bp, Bovine  MMBT20574
attttgtggcatcatatttctacccatctgacacccaattttcccaagttccctcctacaatggaataatggtcattttaagactttgaggaaatttgtcatagcagtatagttccatttaatgctgagatgatccacttagcagttcgtaaaaatataaaatgtgcctacctgaggtgaacaactgttttgctctttaacaggaggccctagagcatgaataagggaacacatcacartctttttccaaccagttttttcatttggatttcaatcatgctgaatcagtggcaattaccytcaaatagctatttcatgactcttggaaaacttttctttctatgtttcctcacagaaactgtccatgttagttgagaatctagtaactattctacaataggccccaaagaaggaataacacaggaaatgaatrtgtgtatacacagagratgygtatataagtgctcctttatatgaaacttgtgggaaactatgatattattcttattccacactttcccatctgacccctgcctataaatatcatgaactttcatttgcttttacatagcaggaccagagggagagagccctaaaatt

SEQ ID NO: 1878 - DNA, 600 bp, Bovine  MMBT19377
ccaaataattcctatcacatcttatctcttctttgtccattttatattttatgttatgtagaggggagaaagataccygggaaaagtcattttagtggcattgctgagaataaaaggacatttcagcattttttctgatcattaaaaataatgcaaaatatcaggaataaaagaatataacaaaataatagtgactcattatgtcaccatccagaggttgaatatcttgaagcatttctgttttgtctttttgctgtacatttttctccacatgcatagatgtatgtatgtatgtatttyaatttgggagcctggatgctytcttaaaagacaatttaccattttttttgttcggatgtaacacaccaaggataagctggcaactaaaatctcaataatttctacttctgtgtctatcattaattcatagctcaactcaagcagaagggaagttacttagaaaaagtaaaagaaaactacaccccattttgatcctggaaaaactgtagaaattaggagaaatgctttgctgaaraaagcagcaacagtaggaatttytcccctgactacttattcaatcactggtaaagggtaatgcaa

SEQ ID NO: 1879 - DNA, 600 bp, Bovine  MMBT21972
ccactaagctgtaagaaattgtaataacttggatgaacgattgaggttattcacctagaagactcccatcaaggccaccaagattgtgatgaagagctagcagaggtgggcaactgcaaaccctggcacccatccattccagaatatatcccacatgtctacaagagcatatattcccaatgcaactaactccatttacagaaacccctgaacagcagcagttagcttcttttagtctcaaccccaaatgagtttttagggtctggagatgtagcatgatagggatccttacagcctcaytgagtgacagatgatagccacaataaaaatagattatatgtratgacatacaactcacttttatggcttttgtaggttggacagcttgcatgttacataaatttaggtaattttactctaagatgcattataatggrtaatacccttggctggggcttcttcccacatggcactagtggtaaaccygcctgccattgcaggagatataagaatcatgggtcagtccccgagttgggaagatcccctggaggagggcatgacaaccctctccagtattcttacctgcaaaatcccacrgac

SEQ ID NO: 1880 - DNA, 600 bp, Bovine  MMBT19427
gtattttccacagtttctcctcctccttctgatttgttttgccttgaacttgcacaatcaagggagggttggttatgcaaatccctgtctgaattatcacaaatttcaaattggaaggatctgaattaatgaagattttacccaactgcattccatttcagctcttccagataaaatgtgctatggaaaatttggaggcagtccagaagacagcaactaaaatgatgaaaggtttgactaatatcccctctgaggaaaggctaaaagagtttmtttagcccacagaaaggaaggctgaayaaggaattaataatagttctcaagtatatgaagaagtgtgtgagtgacaagaagcagattcccttacttctaatgagtccagaacaagaggaaaatggctcgagaccggggaaaaccatgtgtcatccttagaaagccttcctggctttacaagactcagaacactgacaccttagggactgctccagtggatgtcttatgaacaacctaaacatttacctttttccatggactcatgttaaggtcttgcctgaatgcagatggcatagactaagcgacttctcagcgtcccctctaacc

SEQ ID NO: 1881 - DNA, 600 bp, Bovine  MMBT20277
aagccagaagcatgggtctcacttgtgtcatcccattacgctgtaacttgcagaaacaaccaggggtgatcctgaagtgcagactcccactgccaaagagtaactgagaatttacatgaataatactggtccagagacaaactgagaaagggctcactgggtttacacaatcctgttctcaaccccaaagctgagacctgtgcaagacaccacttttattttaccccatgtttcttttacttttataatgggcaatttacctatgcctcctaattaagtaagacagtaaaggaatgaaaygttgacaaaggctttctgagactgtttttcaaaagaaaatggtttataaatacaatccccactggtgtctgtttctttatgaaaagcatttcttactataaaaaaataaaaagtggaagtaaaagttcctccactggtttcccttaaaaccactgtttttatttaaagttacataataataacctcctttggttctcttgttttaaaactttcacctatttcttctcttagtatgttgactactattaataaaatgtcttgattcaagaacctaggaaaatgcttgaaatgactctaata

SEQ ID NO: 1882 - DNA, 600 bp, Bovine  MMBT21991
aaaaaagaagtgagcaaagggtgacctttacgaaagccaaaagagaactccctgacaccagttcattcaacaaggaagactgaacccagctcagaaggatttttatcaaataaagggaaaagtctgatgcctttgtgacaatacaggtacacacgagcacagctggcccttgtaaacttggaccaccatcacctagctttcacagcctgcagagacaagccaggaaaagttttcaaagtgaaagctaatgtgcagattgtctagggcaactgacacgccaatttccaagaacttctacaytgaattgtggctgggttcaaacatagtgcacacaaacagcttacaaagtgtcacacatttagaattcctgccccatcacatcagttagggctcctttcgtttctcctctttttcctggggagcaaaacagcaggcagcttggaacagtcacgtccacagtttttctggcttcagtaacctgtctctgccccctttctcaattggccaagggaaacgggagatggttccagaactccaccttccttccttcctatcctcttctttttcatcatcctgtttttgttttaaaccttctctacc

SEQ ID NO: 1883 - DNA, 600 bp, Bovine  MMBT19205
atggacacctgagttgtttccacctgttggattttgaataatggtgctgtgaacattgatgtgcaattatctgagtccccgctttcagttctttggggtataaaatctagaagttagaattgttggattatatggtaattytgtgttcaagtttatgaggaatttccctcttttctcatttttgttactggaggattctaccaacctttatagttgagaaattcctagatcctgaaggcaaagtgtttggcagtgtctggcacttagttagtgctcagtatgtagtattacttaggcttycttgactgttctctgccccacagtataccaaatgtggaaataaaattatccagtgtactctctacttaggaaagcacctgtgaactggtctggccagcaagcagatttttcaagattaggtagtcattaagaaaaaggggacttccctgctggtccagtggttaagaatccaccctgcaatgcaggggacgtgggttcaatccctgttgagggaaccaaaatcccacatgggaaactgagcctgtgcaccactactactgagcttgtatggcaattgctgtgtcggtgagccacaatgaa

SEQ ID NO: 1884 - DNA, 600 bp, Bovine  MMBT19491
gacatctatctggtcacttgacatatccaggtttgttatttttatctcaaaaatgttctccctttctttatctaccttaatttcaaatccactttttaggaattcaagcattttgtggatgtcacagccaacgcaattcatatctaaagggttcaaagtgatgattttatatattaatatattatgaaagaatccccattgcctcatcattgatttaattaacatatccaataccttatttatttacattttttgtgtatgaaatatgtaagttctactctctcagcaaatttatattayacaatacagtgttcaactagggtcactgtgttacctattagatttgaatagaccttatttatcttacaactgaatgtttgtgccctttcaccccattttcttttacccacctcattcctgaaacccaccacactattctctacttcwgcaagttcaactttctaagactctatacatatgaatgacagcatacaatattttcttcccctgtctgggttatttcatttggcatagtgcaatgcaggttcatctatattgttgcaaatagcaacatttccttcttttataagactgaataat

SEQ ID NO: 1885 - DNA, 600 bp, Bovine  MMBT20180
gtgtcccatttgctctaactgtccccagttgcccttcccccagttttaaaaggagagcaagcatcagaaggtctttggtttggtgcagtccagtcatgattttgtctgatgtcactgaatcaggaggacagcatcccctcagagatctcagctcttactcacagggtcccacttgtatgatcaatagaaaggattcttaggggcatggccaragacttattactactgtttgttattcatcaattaatatgatctgtgcctattatatgctaagcattgtgttcaatactttacttacaytgttttatttagtaggtgtaattattatctctattctgatgaagaaactgaagttcagtgagactgaaaatttacccaagatcacatagctwttaagtggcagagccagcattcactctctgtcgtgggtgcttcctttccttgtacagtattaggagcataaggaaagatttgtaaagcttccccagcgagatcaccattccgccttcttcagatgaagctatctgtacagccaaaatatcactgaagttttgaatccaaagatcttccttccatcaccttctaccaatacaagatgct

SEQ ID NO: 1886 - DNA, 600 bp, Bovine  MMBT21830
agatgtcagagactcaggtttgatccctgggtcaggaagatcccttggaggagggcatggtgacccactccagaattcttgcctggagaatttcatggacagaggagcctagtgggccacaatccatcgggttgcaaagagtcggacacgactgaagtgacttagcaagcatgcatgtatgtatttagggatatttttgaaatataatggtaagtgttctcgtgtataccccaaatgtggattttgtgtaatggcaatttaaatttaggtgtttgggagccagggcacagttcgtaaaaygagctctcgagatgtcccagttgctcagacagaagtattgaatactctctacattgaccaaagggatggaatcagcagagccgtgacaactctgcaaatggatgaggggtccatgcttgggggtcacccagtgttctttagggaaggaatgtcttcttttcctcaatctaccttcttttctaccactggactcaaagatggaaggatgaggtttctctccttctattgcctcagcttcctctttgagtatgttgcgaggcggaggaaactgttagaaactgaggagaaaagaaaaatttg

SEQ ID NO: 1887 - DNA, 600 bp, Bovine  MMBT22983
aactaattaactctaatattactctattaattagaatgctctaagccttattaaacataactttgctatcttatcaagggctgagcttaaatagttaagataatgtttctttcatgaaaaattcttaattacaacaaaaaaagtctttaacagcccaaaaaagaaagtttcagtatgacactacctcttttagagttataaccatcagacagattttgacagaatgrtaaaataccatataacttacctttgctttctcaatttcttctctaacatcagaaagaaacgattcccatgaaygtatgtctgagtccatgtcagaatacgctgccgaatcactgagagaagagaaaaacataaaactgctgatgttcacttgaagacttaaaaactgaaagcactaaagtacaaatgaaaataaacatttaaagataatgagagaaatatgatcatgcacacatagcaaaaaagatgatttttaaagaactgtgtatcttacaaagtcactacactttaggaaatactatcaactgatctaacccaaagcccaaaactggtggacagagagcatatattctcctgaattttaccttctctcct

SEQ ID NO: 1888 - DNA, 600 bp, Bovine  MMBT20237
caaattggcagccttccttgagtttcattttacttgctaaggaaacaatgaagcacttattctgatgccagcagaattgtgggaagagacttaagagatttgtattttcctgaatctttaatctgcagaagagagcaactacactgaccaagtggcacattattattatttcaataattctttagwtgtacaactaattgaatcttggaaaatatggtgtattcacataaaaattgactcatatgattgcaaaaatgctgattatmacatagatctagaaattatagcaacagaattgayagtaaacaaaaagtaagaccaacaaaaatatcattgatggtgtttctacggrttaataataaaygtactctcaaacttataatttcctttgagggaaaayaatttttactcctttcctcattatggctatctggtggtttgtgacaacaatttcttcttgaaaagtgtctgcaataccagcactcaaaagtcttctcgtcagttttcccggcatctttaaactggacagctccagccctgattatacccaacccttcccacaaacccccatagccctaggccattggcagtgcacattct

SEQ ID NO: 1889 - DNA, 600 bp, Bovine  MMBT19476
ttgttttctgagaggttggattatcatccaatttttacagacaaggagatggaggcttggagtgggtgacttggccaaagttgcacagctggtatgtgccagaactgctcctctgtcagagtccagaaacaagttcctatctacatatgctgtggccctcttcgaacttaacccctcaacatttcaaacaggattcctctggctttgtcctggtctacttttctacctcagtcccttcactccctccacacaaactcaagccatattaattaaggttccctgagcacagtgagctctctyatgattctagtcttttttttacatgctgtccttaccctcccagtgaactacttatccttcaagatccaaatcaaatcacctgatatgaaaagtcttccttaacaccttcttgtccccactcctttggcaaagttaattactcttttctctattatcttcaagattcttgtacatacctttattttatattttccatgttgtactataattaattgtcagagaatctgctacagcaggaagggactttatctcattaccttttttttgttgttgttttttggctatgctatgagatagttc

SEQ ID NO: 1890 - DNA, 600 bp, Bovine  MMBT20020
aaagagttggacatgactgagtgactgaaacttgacttagtacttagtaactgaacaataataaaaccaatttggggtaaaaagaaaaaaaaagtgctacttaatttttagtctgcattctgcttgttttctattacattttactcagttggaacaacacaattagatttcagtatttttttctccattttgttctcctaggctacactgaatatttaaattagaaaaaactttattgatttttttcttttatcatgaaaatgttcctctcttattaggttagtgagcgtatttcttaaycgaacttaaatttccaacctgaattwctttgtagtacaacctaatgtcccatgcaataatattatacctgtatttgtgtcaaatctaattatgaagycttgatttgtgtaatgtgcgagaaattatttccactttccctaccatgcaaacagatcaattttctcattagccktttccatcagtcttgattgctttaaacttatgcttttcatattactctgtttcctggtcaaattttgtccttacttcatgtatagacagatttatcacattttaagaaatttattcatgtggacaaat

SEQ ID NO: 1891 - DNA, 600 bp, Bovine  MMBT19709
caaagctgggctcacctgtctggttctcatcgtctctcctgtctcgtcccacagacgctttcataaggcctggttctcaccaccatttcagagcaccagtgtcttcaagcaaaatatctttcccagctttccaagttgctctcaatgagcacatctagtctcttctttaaaagatgattttattgcagttgtcatatttaaccaatagcggatgtcagggatttgcttcttaagagatgtaattgaaaacacccaaggktaagatttttgctttcttagagggaagatcattatcatcayaaccttttcctttccaaatctcctcttctctttctattttgtaagtcaacgctgacatctcaacatggagtttattttgttgggtttatagctctggcatctagtgtggttgtcttgcttacatgccaccctctgtttttactctggcttcactgtgatcactaagctccgatgtgggtgtgtgagctaaggagaagagcatattacaaagctgcaacgctttgtactcaccactgtttatattgtatgggttttgaacactataatcctaaattagttatgcaactctgcataaggcac

SEQ ID NO: 1892 - DNA, 600 bp, Bovine  MMBT20181
tcaagttgaatccttacctctttggccatctacaaaactctgagagggcagaaaccatatcagcttgttctcagsgtgtactcacagctcagcatggtgcctggcatccagaagggacccagactacattctgggttccagtctcagttcctttgctcactagctacatacttggaaaggacctaacttctctgagcctctgacttctggtctgtacaagagcaataattcctacagtgatgagtaaagttgttgtgaagtttaaatgagatgaaaatgtatgcaaaactctttgaaaayggcaaagaagattctagccatgtaatgaattatttatgccccaacccagggtcaaaaaggaagtgtagtcacgccgactctggttctgataactgccaggtgctttcaaggcttctcgatgaagtgcaggcttcagacaaatgggaaatctaatagacctctctctgcagttggccgcatctccagccagcacagatataattataattagagttttaagagttctgtttcatttcaaaaagattccatggtacagtctgcagtctacctgagatgtgtgtctagaagcagattcctgta

SEQ ID NO: 1893 - DNA, 600 bp, Bovine  MMBT18784
caactgggatgggtagcatgttgatgcccagatttctcccctctggttttggattcagaggcttggttttgccaactcatttaccattggtctgcaggcttttcagctcccagtacaactgttgtcatttcccagtcttgtgactccctttcccatggctatggtagggttttgacagggagtaagttgaaatgtgcatatttgagctgccatcttagcctakgagactctcaagtctctttcaaccattgttcaggtaagataactgggaactaatacaaatccaactgctcttctttyaacatgccccaggtttttcagcaattctcttacagtgtaatagtacctcaaactgaacttcaagtgtgttctaaccagtacagattataattgttacttcttttgtgttagacacccaattcacacttttccaaactgggttagacagggagcaatgcccctcaggtgatcaacagatattctgaaaagaagttgggaaagtaccacatatccatttctcaagtatttataatactataaatcaaaaaagaaacaggcttcattttttaaaccagtttctccaaaacatttgactgttta

SEQ ID NO: 1894 - DNA, 598 bp, Bovine  MMBT20004
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattattttaatatatattttaaaaaggctactcattattgttaattcagaaaacattctagtgtcattcatgttttatctcactttctctttctaaaaggtcaaagagcaataattaagaactaccaagtaccaagtagggcagctaaagactaaggaatccattctgcagaactggaaaaactygtatttgatttacataaggatcctttcttttttcttcattttggttaaatataccagttgcagaaagcattccccataatattggttttgcttctccaaaagaaaagtagaagaattatgtactcttattgttataataatcagtgataataataaatattattaaaatagtaaatattaatgacaaatattatttaaataataacaaatattattattaagtatrgtaataatatgaaggtttggttcttagtaaacaagatttgattatcaagactcttttccaaaaaccttgatt

SEQ ID NO: 1895 - DNA, 600 bp, Bovine  MMBT23053
tcaaaaatcttccatccattcatccactccatctgtttatccttccacccacctgtttatccattcacaaatccacccacaaatccatgcatccatttatttacccatcctcccctcctctccatctaaccatccacccatgcatacatccattcattatctctcattttacagaaatgttttccgcacttgtttccacattatctctcattttccacacatgttttcaggtggcttagaaagacacgtaaagtatataagcaaaayaaacaaagcaagagaatgatgaacaaaccagayggaagtcagctgagaatgaaaaggacaggactcagayagggacataaagtagaaccggggattccatttatccaagcgtgccttcctgtgaccatacctgccacgtgagggtctcamagggcacatcttaacatgttgggttactcgtgctcccaagttggcccctgtctgtacaggaacttctgtttccctgcagtctaaatggggatctctcctaaagtgtttactgaggtctccatcaagtattgatggcatttgaatagacgttgacaaatacagtccgtctctccatttatcctt

SEQ ID NO: 1896 - DNA, 601 bp, Bovine  MMBT21940
  misc_feature (1)..(1): n is any nucleotide
ntttacaggatgatacaattctaaatgaaaaagcagaacacaaaattgtactttcaatattctcttaattatgttacaactgttggagagggaaggaagaaagacaggagggagaagggagagttgggaaaagctamaagattacaagtctaggtgatatgttcaycaatgattttttcttttttgtactttctaaatttttttgtaggaattacatattaatttgataaccaggaaaaagtcataagatatgtatttatatattttggctttagtccttttctttagtctctctactctytcaggctataattcccaacaaagatgtgtagggaaagtgatctactggtaggagtggaaacgatttattctggaaaccaggttgctagggcatgttgaaaaaaattgccttacttccttagggaatgtgaacatttgtgtacttggaattctgatctgttgtcataagctcattttttttaaccaatgaaattatttaaagtgtctcacatatatgaaattaccatgaatggcattgatattttcaaatgctccatgatatgtccctaaagtcttaatgaacttaaagagaaaatgaggc

SEQ ID NO: 1897 - DNA, 600 bp, Bovine  MMBT20933
actaaaaaaagataatgaagggaaagcttgagatacaataaccattctctgtccatggaaataacctgttccctgggttcaatcttgatactagcacataaaaccctggggacctcccccggcagttcagtggttaggacttggcactttcacagctgtgcctgggttgaatccctggtcggggaagtaagatcccacaagctgaacagacaaaataaattaaaaaaaataataagcaaaaacctcatgataagcaaaagactatgggaatccttayagtacagctaacgtgatcatgcygaatattttaatatctaagacattaaagtacatggagtaagcattctgtacactattgaccactgagccccagtggagggtggggtcctgaaggcatcctgggaccctccagactccagaagtcagggagttttttgcagaaagcagtcacttcttaggtctagcccactccagaggatggaggcgaagtgtccaaattcactgccactaaactccccaagaagcactcctgctcttcctgaagtgacttctccaggaaaatgttaacaatgaccttgcttttcagcacttcatactaca

SEQ ID NO: 1898 - DNA, 598 bp, Bovine  MMBT22376
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnncccccataaaattaagcccctaaagcacagcttttgatcacatcactgccctgttacaaaatgtaagagagctccccatttactatgacataaaatccaaattccttagcatattattcaagatactataagaagcagttctaagctatttgtcctggtatcccatctcctcaacttcaactaagtaatctaagctaaaggcacataaatcwagttacgyttcccaaacatatcttacttgtgcattagctgttcagatctmtaatctaggtctgtggaaatcctatctttaggggtcaactcaagtacaaggtctctatgaattatttcctgaggacccaggtcagagttaaatctctcctcttgtacttttataataatgatagctaatacttacataatacaaaccacatgtcaaatactacatatataataacacttaatctttacaaccaccctttaatcaatgaggaaacactttaagggagagttttgtggttttctatcaccacatttta

SEQ ID NO: 1899 - DNA, 600 bp, Bovine  MMBT22672
ataaaggaatgagatagctttatctctgtttcagcatagatagaaaatatacagggaaaaggaggtaagaatgctttctaatgggcaaagtgaccagtcactccaaaattcggaatttgatacaaaaagtagacaccaaaatgccaaatgtacatgtctacttatatgtttgtcatccctggagaagaatattcttttccattttaccaccagtgtacattctccaaaaaaaaaaaatcttgatggtaattttgttttagtaatgaaaacaaaacatctgtacaatgttataattctagytaacaatcattttttttttttcacttcttaaactgtctaactacttagaaaataataggccttgacagttttaggggaaaaaatagtatcttrttgtcttatgtccccaaagacacctgctgagcaatttatcacagttcaaagagcatggcaataggatctcatattaaatgcaaaagtattatctaaagtgtggtcccttgtgtggttagtgaattttgtttgaaaaatcacgtatttattcagatctttgttttagtgttaatcctctgtctgacagcatctcggatctcttggtta

SEQ ID NO: 1900 - DNA, 600 bp, Bovine  MMBT20165
atcatgacactgcttggtgccacctcttagagatctgtcctgtccttcagcagatagtcttcaaacaaaagtctgagactcaacccagttctccaaactgttcaagagatggtgagtggaaagtgggagtgatgtagagggaggaacagatcaaggagggaaacctgaactagtctgctattcatctgttcttgatttattctcattgtgtaaattgagcaacaccctgcccatctatcttgatgtgggaactccatattctatttatttactctatcttcttttttaaaagtaataccyagttttgccacgcctgtgttcctgcttattgcaatgattgcacctgcctttcttctggtcattaagtgccacttcttggtatttattatttagagattctgtcattcacatttttatcaggaatcctaggtctktaatgtcatttccaaccttccctacagaagacagctaccactgagcttctcagtgatactgatgtacctccccatagcacattctttagtatttggtaaatggagcatctgatgggctcgcccctagattatagttagctggtggggtttctgaccttacatattt

SEQ ID NO: 1901 - DNA, 601 bp, Bovine  MMBT20520
  misc_feature (1)..(1): n is any nucleotide
ntctaccatctgaagatttttttttgcaaattgaatgtttgtggcaatcctgccttgagcaactcttaayggcacccttctttcgacagcatttgctcacttcgtgtctcagcatcacattgtttctcatgatacttcacacttccattattatatttgttctggtgagctgtcatcagtgatctttgttactacagatcagtcaaggcttaaatgatggttggcatttttagcaaaaaaaaacatttttcattaaggcaacttgttttttaaacctaaagctcttgcacgctyaatagaygacagtatagtgtaaacataccttttatatgcaccaggaaaccaaaacatttgtatgactcaatatgttgtagtgtcagctttactgcgaggggggtctggcactgaacctgtgtatctccagggtctgcctgcgctgccctggtggtgctgatttccttattcaattcaggtgaagaaagaagttggtgatgcttccatcctgatcaacaatgccggaatcgtaacaggcagaaagttcatggactgcccggatgagcttatagaaaagtctcttgacgtgaatttcaaatcacatata

SEQ ID NO: 1902 - DNA, 600 bp, Bovine  MMBT19376
ttttacaaattaaattatccagaatgctaacatcttgagaaaactaccatcagtggtttagatgcattttgtagtttagttatagtttaaaacattgacctttttgtcttatttcctatatatgaaaatttaaaaaaacactttgaaaaatgtatacattaacatactacaattgtctagaattctacaagtcataaataacactcaatgtttttagtatatttattttatattatagtattatatgagcatatgtatttgtatactgaatattagttacygaaagaacatcattggtcygagattcaaaagagtatgaaaagggggctatatgtcagataatatcacatcttaagtgatttactattatttctcaattaaaatagaagcaacacagtggatcatgtaattcaatatgagttttaattatcaagaaaatcattagttaagtttattgkctattaagatggcttttatttattttcctaaggaaaccaataactgagagagacaaaacaaaaacttttggtttaataatgcactgagcctagtagctcaactgtatagtttccatattattagcaagtgcctaaagaataa

SEQ ID NO: 1903 - DNA, 497 bp, Bovine  MMBT21101
caaatatattgaaacactattaagcaaactgtcctgttacctaccatatctgagtgccattggtttgcatattttatgttaatttataattctggaattttaaagctctttttcagtaatgctgtttatgaacttgtgactrtaaacaagtcaatcttktaaatctgtaagacggagacaataacaaaatgcrtattacagagtcaytatgtggattaaatgaataatacagagcacctaccctracacatagttagaaggagggagggcaagaggaaggaaaagaatatgtatggaaaytctctgaacttcctgctcatttttttctgtaaacctaaaaatactctaaaagaatatggtctactaattaatttttaaaaaagaaaaaaagacttgttgaagacacatagagctaggaagtggaaaagccaagtctagatacttttttactccaaaaagtacactttcccttcttcttttccatgtaaaatgtaatt

SEQ ID NO: 1904 - DNA, 440 bp, Bovine  MMBT20951
agctctttgatgtatattgatcacttttatgaaacacgtgtttgcagttaattgttatagcaatgtattaacttatttggaagttgataacttttcttgggaagaaaaaaggataaatttagatgtaagattagtttaaattgttaatccataatttatccttgagtgtattattttacaattctatgatactttacaaactggaaaaagaaaaaccccaaagctttattatatagataccatctttaagttgtttcattttctgtactttctacattttaccaattttaattgtagccyyattatgatgtgttatggtaaaaccgggcagaatgtaattttgtctgatatttaaaaatgaaaagtatgtaggattttaagcttctaaatatttcaaggacaacattacacatataggagttcatttattcctttttagt

SEQ ID NO: 1905 - DNA, 600 bp, Bovine  MMBT21985
cacccttggtttcgtattccgatataattttttatcatgaaatattttggatgtacaaaaatcataaaagatattataaatgctcaggtaccaaccactcagctgaagaaatagatagaatgcagttacagccgggccccctcccaaggccctttattgacaggaccacgaagcacaaatctaggagctgcaaagccagtagttcagtgatgtgcttaagagcaagggttttggggctgagtagacccagggggaattctgaatctgggcttccttgctgggcacatttagaaaaaaatygtataacctctgagagcctcaacttttttcatctgtaatatggggctgaagagtgtatacctcctagagttgctgtgaagactaaatggaggaataaggtgagtaatagcacttacccagtgctgggcaagtggggaacacccagcaaaggatggaagtggtttctgctggcggttgttgggcttttatatctgggatttggattacagagatgggccccagggggccactttcccacccatccttattccaggggaggcctggggacttgtcaacgccctgaccaggcaggaggacagg

SEQ ID NO: 1906 - DNA, 600 bp, Bovine  MMBT21609
ctgtaattattctagaaagtaagatttctcagtcagcaatgttaaattcttcattctaatctaatgacccaatctgctatattctgcttcctatactgtgttattctgcttcctrtactgtgttatgcttcccatgaaacaaaaatgtctcccactaatgagaaaataggaaaataaaatgggtgtatgttatttgcttttgatttacggggttataatctccaggtcagtgactaattcttttgtgacttctcaaaaatggacaggacatttcagagctcttagtaaatctgtaatcayagaattgatttttgacaagacttgctctgtacagccaagctcttacaaagggacaagataaacttgtaaatcatttatccaagcaccaaggattgtaactatctccaaattctcattttccagatccaagggacatacctagaacctacagggaaaccttgaggaaaacgttcattttctaaggaatagtgacagatgctgagggcagaggttgcacggagagaaacaccatcagtctaactttctgtaccgtgtatcttgactaaaacattaagatgttacaagatgtttaatgacttt

SEQ ID NO: 1907 - DNA, 600 bp, Bovine  MMBT21826
tggaacagcaactacgcctcaataaaatttttaaagaaaatgaaatggaaaatgcagtgaaggaattcagcaaagaataggccaaattagtgatctggaagataaggctcgggaaatcaactagaatttagagcaaacacacacagagatggaaatacagggaagagtttatggataaagatggttaaggaaggcctcaaacgccagttgaactggaattccagagtcagagaacagacacatgggaaagaaggaaataatggaggaaatatttcttcaagctaaagagggataagaatygtctatttttgtacagaaaatgttaaaagcagtcatctctagtaacagaactgtggatgatcttattctactttggcccttgtttagatttccccaaacttcaacaataaatatctattttaaacagtatatctatctcttgtattagaatataaataaaacacagacacatttgacttaaaaaaaccaaaaagacaaaggacctcattatgcttttcattctcagcctctcatttgagtctttaaatagagaaaggtgacttcaaccaaggtcctaatgagctttttatgtggaaataa

SEQ ID NO: 1908 - DNA, 600 bp, Bovine  MMBT21420
attccttctggagttactgaggattttttaatatatacaccatatatacagtattccatttctattaaaaaayttcttaggacatagagcaaacattttgtaaaagagactatgtcttagggcttccctggtgrctcggtggtaaagaakgcacctgccaatacaggagacgtgggttcaatccccgatgtgggatgaccccatatgctgcagagcaactmagcctgcaggccactactattgagcttgtgctctaggaggctggtagctgcaactgctgagccaacgagccaccaattrcggaaggccacgcgctctagagcctgtgctctgcaacagaagccatggcagtgagaagcccgcgcagagcagctaatccctgctctctgcactagtgaaaagcctatgcagcaacaaagaccaccacagccaaaaataataaataaataaataaatatttttttaaragagagaccatgtcttatgtgaatgacaaataatacacaactggtgggaatctttttttttttttgactgctatttcccaaatggttaaagaaaaagttgttgagaattaagaaaccaggattttagtccatt

SEQ ID NO: 1909 - DNA, 598 bp, Bovine  MMBT21753
  misc_feature (1)..(160): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccgccgcccccccgcccccgacaaactgcaccaagctctaaaaattcacatgtcaccatggcctcgtagcttaataaaccacatcaaaagcattttgcaatgatgcttcttcctctatgaaacctgaagccataartggacctgctattaggcgggtaattaagccrctccctgggcccagtggatatgcattcaagctgccaaaagatgatgaaactcgtgccttcctcagtgggatcctcggggcctgactcccatgttcccccagataccttgctccaacaatgagtgcagtcagggagataccagcatgtgaaacttggtttcaagcacaccctttcaaaacccaactgactccagcaagcagcttaccaaatagccatggaggagaccaaaaacacggctttccactgtgctcctgaggaaaaaccagc

SEQ ID NO: 1910 - DNA, 600 bp, Bovine  MMBT22581
tgccagttacttacgtctgtctttaggggagttctttgctcaaaggtctgaagctctcggttgccttggtggtggttacaatgtgaaaagagtaagtaccatgtatattgggagtggtaaatgcaccagcccttatgtactgaatgcagtgacagtgtagccaaatcatagtgtctttaaagcagagacaataggggtgtggtgggatggtgggaaaaggtttcgatttttagtggttgtacccttgctccagtcctacctctgtcttttaactagttctgtgtcatggaacaatgtatrtaactcctctgtgccttaattttccgatttctgggatggaatactgtcttacagggtttgtgggttactgtgctggtgcactacggtgttcagcacagcttcacatgtgtcaagtacttgatgtttgttgctgttatgtctttggttgtgggaagaattcagagattcattaatttttaaacctctggtctaaaaacatgttttgaaatatagtagtgttttggtttagtaagatgtatgtgtaaaaagttttaaatgccagtggtagtggtaagttgtatgaggcaggaggggaagctg

SEQ ID NO: 1911 - DNA, 576 bp, Bovine  MMBT20038
ccaatgacagtaagattataatatataaatataatgaatatataatgttaatacacacacacacacaccgtgcaacatggtttggaagaaagaactctcaataaaaagcaggaaacctagagtcggctctgccagtagctgggtgaccttacgcatgagtcagttacctccactgcaccacaaggcggtaagataaacgtttctccttcaaactgacaccctgtacgtacacgcatatatacatgcttttatttacaggcaaggcgggcactcactagctcataccagtatggcatgacrggctgttcataggccagcacctgttcygattggtctgtcaatgctgtaccagttgttaaacagtgtgaattatcatcctatttacaaycacccccaaattacaaaatgtctaacatgtatatccctgtgtttgcagtctgccttccacacatagtgaggatattccaaagttaaataggccctccttaatctccagttaaaatttaagagcacaattcctttccaactccctttctcctctttcaaaaagagtttctgtacattttctgttctgta

SEQ ID NO: 1912 - DNA, 600 bp, Bovine  MMBT21745
ccgctgtagcctcaggaggatgctcagcacgtccacaaagtgcccgctcttcagcgcttcctgggtcctrcgcacatgcrggaagagayaggagcattgccaggggtgcaaacatgtgccagctgggcttctccccgtctgctatccccactctatgaacgcacarctggtgcatccccttgacctggtgagtaaatctgccacatgccaacccacctccatgaggttgtggttctgagactggctcaccaccccatgagagaggacgggaggccagagagccagggtacgggttagacrtcggggcaccctccatkgcatgcccccaaagagcaacagggcaggtgtcccaaagagcccaggggtctgtctgggtcggggaaggaatgccctgactccacacgagtcctytcacactggcggcatgctgtgctcctcctgggccggctatgggcagagcctctgacaggaccagggaggaggtaggactgttgagcccgagaggagcgtggcctccagctccaggcacccacctcccgaaaaggagccttctaaaagaccagaggaggccctgctccgtgcgggcagagagggtggtgg

SEQ ID NO: 1913 - DNA, 600 bp, Bovine  MMBT18521
ccggagagtccgccccgaacctgttcaggtataagcaaggtcaggaccccacatgtctcactgggatctcaatcagcaggaaacctcagggactacagaacactctgtgcacccaggtgagatgacagtgattcaaacagcgccacagaagaggtactgaattcctggtagctgtaattaacatcagtaacatactggaatcctgggctgagacttggtgttgggccccacctggcccaggggcttgcagacagcttcttaaatccactaaatactgccccagggcctttgcacagactrtccttctatttatctaaaacacttcctgctgtcactcaacaaacccttactcatccttcagagtctcagcttgtgtcactctttcaagtaagccttccctgacccccagttacacactcttgggccactctggaccttgccttgtgtaaacttgccacacttgtagcgtctgccttctgcayacactgcgtgctccctgagcccagggaccgcttctgacttcctcgatgcaggatgcccagcacctatcctagggctaggcacaggaggtatccgggatgtttgtcgattggctggaca

SEQ ID NO: 1914 - DNA, 600 bp, Bovine  MMBT15699
ggtcactgacatgtaacactcacccctccaacaactccttcatgccaaggtgcagttgactcatctctgacactttccttgagagtgttttcatggagggagagagattaggaccctggcttccaggtgggattagagggtggaaaagaggtgagggccctgagagaggaaatgtaacaaggaaaagtgagtgcaacctcatcaatttcagcaaatrtgagtttcatcaactctagagtttgtccattgagatgactgatctcaaggcggttaggaccagcaagtggaattgaggtgacrtttcagctcagttggaggtataaggtctcacaatcagaygatcagtcaagggatgaacaaccaggtaaagtggggagcgtgccattacttagagaagttcaagttgaatgcagacatgaatttaggggaatgtaagagcctaaagttcctctgcttccatagaggtcaaccttggttgcacctcagctgggggcagcttttaaagctcttcacatccaaacaacayggagcattgattaaatcaggatttctgagggctgggatctggagcatcagtactttttaaaacttgccttttac

SEQ ID NO: 1915 - DNA, 600 bp, Bovine  MMBT20333
gatgcatgctctgaaagggcccccatccttcgactgctgcaggatagagggacggaggccaccggggacagccagggacgtcaccgtgacagacctacagcacgctgcagacgagaacctggaagacacttctgccggtggaaggggagcaggctgtccccccagatgagaacaccactgctcatctgtccagaaacttgtttttctcatccgaacaatggggcctctttgtaatccaagagctgggactctcggatcttgcctttggaatggagcagccttcagcaaaagagattaaartgttcatcttgttccttggagcaccgaagcccactccagctgagtggactaacccaagtgcagaaatagggcgttgcacatcagtcggctggggctcaggaggtggaggaaaaggaaaggaagatggacttgagagggagggggggatctacctggtgggggcacaagaggcgacagggcagaaccatccagactcatcagggtggtcaggacgaggccctggaagcacgcccagcatcccttccaaccgccctcgctccccacccccagcttgcctctatggaaagccctcctctggcc

SEQ ID NO: 1916 - DNA, 600 bp, Bovine  MMBT19901
tgccaatgcaggagacataagatcccttggagaaggaaaaggccaccactcccaatattcttgtctggagtatcccatggacagaggagcctggtgggttacagttcagagggtcgcagagagtcagacacaaccaaaacaacttagcatgcatgcatgtgacttactatgtaaagcacagggcccctcccatagtttcctgaagccccctggtttcctccgttgtcycatagctactgtggagaggctcacagaagaagagatgcacaagttcaccggcatagaggaaacttcatctaraaagtgatatttgaccctggccttgaaaggtaaccctctaaccaggctgagactgtgaggggtggagtagaaaagaacaaagggagaaaaggcatttcaggcagagagaatggtcagcaaaagctcaaggtagaaccgactgaaattcttggcaatgtggccacctcgctccagcattttccaggcaaagtactggagtagggtgccattgccttctccaattatgggggtagcagaaggattggcaggggctggaagaaaacttgaatctagtatcattttagagaaaataagtagtaa

SEQ ID NO: 1917 - DNA, 600 bp, Bovine  MMBT21693
tttgaagtgctcagtagtcacatgtggcccatattagatggtgcagatacagaactttttatcctaggatgaggggtgctgtagaaaaagcatttgccccttagagaatctggttgtattttaaaggctctgacaagtcctgcagtaagcaaccggtctcacttggagcccaggactccaaatttacttgcccacgaactgttttaacacctacaaacagttcttkccttaaacacatcaagtgacctttccccctgtcccatggcggtcctgaatatcacccttgttgggattctaacrtctctcttcttgttttgtccccagattgcctcggctccccagtgtttactcctatcaaggcggayataagtggcaacatcaccgtatgtacttggcctrgcagccccagtacccagatcaggattctaatcccaccctggttaccactgccctgctacccactgcaagctccccaggctaaggaacagaaggagacgtggaaaacaggcctggcccccagctcctctgactcaaggctccaggttcttggttctccttgcagtcatgccatccagtcacagccaaactgtgattcacagt

SEQ ID NO: 1918 - DNA, 600 bp, Bovine  MMBT21765
ccaacatgcataactaagcggcrgattttacgtgtatcaacataagggctgtctccagattttctgcagactctttccctccaggaaatacctggaagagctttctattcatcagaggacacgagcactgctagctgagtgagcaaagcaaagctccggcacttaaaattgtttgcctggagctaagcgtcatccatgaaagaggaaggaggaacaygcctgtgtgtaaaatgaggtttacggctgggacaccctggccaggaaactgacgctggaaartcagtgtcacaccaaataaartgttgtcagataaagagggaaagggcatagtgtcctctgattggccatctcagcgaagacttgccacttctcttggacacgacagtaactagacctggcctgtgggactcacacggtgggtttgagttataaattgtcctgtgaacacattatttcccattaattgtgagcgaaactggaaacgtttcaaggccacaaaattaaagctctgaacctcctagcttcagctttatgtgaccatatggtctccattcacttagaaataaaaccctggaaggcaagcgctgaaacaccctacgc

SEQ ID NO: 1919 - DNA, 600 bp, Bovine  MMBT20306
actggataaaacaactctcaactaaaacaaaacaaaaccctttagatcttctttgcaaatcaacaacatcccttgagtagtccgtgcaggctccccccarccccgatcctaccmcgtctgggcacggtgctcaagccagtcctggtycctctttgtccgaaatgactctctcacaggccagccagcccacaggacccctgacaggctggatggccaaactcattaggggaggctggggtgcrggcagagtgcattttgtagacatggagaaagcactgtcaactagatctggggagtccrtgaattgtggcagatttggggcaaagtggaatcaacagggacaaaaataatttaggagacgccctgctgggagctccaaagcttctaagaagatgctgcctgacggcacccagctcagcttgactgtcccacaaatcaagggcacacttggctatggtgatgatagtacctgggcagagggagaaaggcatagaaccacacgactcagatgctttgggccacttctagaatatttattgaagcaggcagtttggaggtatctagccaaattacttaatcattcaactattaatcatttca

SEQ ID NO: 1920 - DNA, 600 bp, Bovine  MMBT23186
gtggaaacatggtttgcagaggctgatagcactttctaattacccacagagaagtgaggtggtggtctggaggccaaggactaaagagatttcaaaagccagtccccctctgtgactaaggcctgcctgatgagctttctagtccttggtctgttcttggacagacctgggtggaccctccccggatagggcttggcaaggtctgagactggagacagggaaatcagggaaccagartctgtatgatgagagatgtgcctgagcttcagcctcctggatgccatagcagcagagtaaggrcagatctttgcactagatgtccttgggtgagcggggrttkctccaggagcatacaggcagctgcaaggccaatgtccaaacctggaatccagggaccagcccacatcaggccagtcatcagggttctccaaagctcaactggtctctaaggagctgctccaatcagggagtcatcagtctagaacatttattaagcaccagatacagggtctgggaaaacacaggkgaacccttgctttctgacagttggcatctctaagctgaaataatgggacacatggggatggcagtagagcttca

SEQ ID NO: 1921 - DNA, 600 bp, Bovine  MMBT19208
tgcctacgctggcacattatggatagatacttctgcgtggcaataagtttctttgtcagtactctcctcaccatacttatttaaagttcacttgcttctgtatatttctggraccataccaagaatactgaattttcataacaattacttagagatgttgtaagagttagaaatgattccatattgttaaggaagaggaaaaagagtcttggaaatagtctccttttgccctaattagagaatggcagatcgtttgtttgtaggctgatattcttccttccctcgtggcagctgttgtcrctcattgttgttcagttgctaaatcctgtctttgtgacccyatgaactgcagcacatcagttttctctgtccatcactgaactagtaaatctccccattcttccctccttatccctaccaaggcctcagagtcttcaacagactgctctaagcagctgcacaggttacttggagttagcagaagagaggaaacccatttcctaaacttggtgttgtgctaggagaacaggygatgagcagagcccccaccccgctggctggctggtcctcgtcctagttccaaagacacagtgacgttgc

SEQ ID NO: 1922 - DNA, 600 bp, Bovine  MMBT18845
agggattgggggcaggaggagaaggggacgacagaggatgagaaaggctggatggcatcactgactcaatggacatgagtttgagcaaactccggtasttggtgatggacagggaggcctggcatgctgcgattcatggggtcgcaaagagtcggacatgactgagcgactgaactgaactgaaattgaggagttgatcatgcagaccactgatttccttttcaccctaattcctggcatyatctcgggaattttgcatccacgcaaatagctagcatcccagtctccaggtccttcacrttctcagctccagggaccttcacctcctatccayattgggctgcccattcccttggtcccacctcctatattacaaccacccaaaaccacttcatccttacagtcttaaccttaataatccactctcacatctttgatttctctagctctcactcaggtcctcccactacacctactctctgacctcatcttgacctctgagctcctaactctacctggctctccacttctgtcagcagctcctgacctcacttcctcccactctacatagtttcgcttccattgttctcgctccagcgc

SEQ ID NO: 1923 - DNA, 600 bp, Bovine  MMBT22447
ctttcccatcacttgccatcactggaagtggagctgrttgctcaaggaaatggtcaggaaagaggggctccctggaccccactctgaaactttctgttggttcactgcacaaagctgatttaggagttggttgtgatgttaacttgccctaaccactcccgctccagggggccagggagcgttaaagacccctgctggcaaggacagctgccactcctgtttgccctctaatctgtcatggctaccatggtcatctttaatttatgggaatgaaggatttcatggtgatttcctgatggrgttcaagggaaggtcgcgtgtgatcagcccggcagcaacaggtgaatctgatcggccgcctgggagggcctccgtgcctgggatccccgctgctggctgatgctctcacagtcattctgtcttcatcagacttgctttgtcctccaccccatactcctgaagctccaacatgtgtgcctcccagggctcctccttccctgtttttctccctgtaagatctgatgtccacctgccctgcccctgcccagctacgcacactctcaatttcctctgaggttgaaaaaccctccacaaagtggc

SEQ ID NO: 1924 - DNA, 600 bp, Bovine  MMBT18467
aaaatgacagtagtttaaaattcatggggactttcctggtggcccagtggttgagactccaccttgcatcccaggggatgtgggtttgattcgcgggggcagggaactaagatcccacatgacttggggggcagctaagcccaaacgctccaataagagaagtccttgtcctgcaacaaagacccagggcagccaaaaaaaaaaaaaaaagcaagcaacaaaataaagcagcagtgactgctcccagatcccaggcacrgtctagagtggatccatcagagttctgacaaaggagatacrgatgaagatttatgtcaaggagtgggctcatgtgctcacaggggctgttaggccaggctgaagtctgcagggcagcctagcaagctggaractcctgggccagagcagacactgccatccaaccacagaatttcttcctcttgggtcccagctggactcttaaggccttcaactgactagatgaggcccaccaactctcctggatgatcttcactcagagtcaactgatggtggatgacgacccacctgcaaaacgtcacagcagcacctagggtctggctgggttcctgggtcccacag

SEQ ID NO: 1925 - DNA, 600 bp, Bovine  MMBT23267
caccgcatactggatcttcaacacccttgacattccttctcacgtttcattggtcagagtcagtcccatgggcacatctcacttcaagggagtggagaagtacagtcctgctggtggtctggaggagccgagctgagtacttggtgagcagaaatcatatccacactcatcttcctctgggtttcttattatgtgacaccatagctctccttatcattttagccaatttcaggcagtgttgtctgttatctatggccaaaaccatgataactgaatgctgctgctgctgctgctaagtcrctcagtcatgtccgactctgtgtgaccccatggactgcagcccaccaggctcctccrtccatgggattttccaggcaagaacactggagtggggtgccattgccttctccgaactgagtgctagaacacccaaatctcaaaccagaaaaaaatcccctatakaaattctatatccagcaaaacatccttcagatatgaaggagagatttaagacattctcagataaataaaaagtgagagaattggtcactagcagatctgccctaccagaaattctaaaggtggtctttcaagctaaaa

SEQ ID NO: 1926 - DNA, 600 bp, Bovine  MMBT23203
ggagagcacatcctcggagagggtgggaaagacaggaagaaagccgtggagcttgcactgcccttctcccagcacagcaggcagcaagagagcaggcggagttcacttgagagggggagagagagagagagagagagagcgaaaacgacaaggagacaaaggagagcagggaggacccaggccactgtggaccagataagacaccacggccaaagcatgggcttagcaccaacaccatgagggttagaggcctggtactcctgctcgttagccaagtggcgttggggtaaactgcttgarcctrcacctcagtttccccatctgtaaaatggagctaatgatgctggtgttaccagcctccccaggcagttgtgatctcataatatatgtgagagaggataaaaaccctaagcaggacatcaccattagatgttttattattcttacaaaatattatcagctacctcttcccacttcaatttcacaaaagtctcaggatgtgggcacagccagggttattatgcttgttttatgaatgagaaaacaaaagcttagagaagtgaagtgatgtgcccaaggtcacactacgaacaagtggta

SEQ ID NO: 1927 - DNA, 600 bp, Bovine  MMBT20286
gggtgggggggtgcaaatcccagagctaattctttgtatccaggcaggaacagagcttcctgatcagacacctctctaagaaggtagattttttttcttaatgggagttcaacattgagggatagacagcaaagtcactcactcacagtctcaagccaacacggtacagcaggttamggcagtgagggaccagtgtgagcggtcagaagcctatccaggccaaaagcaggtcactcaagaactccctaagaaccaactgctgtgcagctttctccaggatggtcacagtggtgcggtttrtccagacaaaccacagggaytaggtcgtgccctgccctaagtatttcaagtttcccagytccacgacgaactccccaagttcactatccctgggccctttggactaggggacaatctgtcactatttcaaacttcctggtccctctccagcctgcatttatgtccccagagaattggggcagcagttggccagactcaagattgtgatgaaatggagtaaacagtgggtccttgtgtgtgtttagaaattaaatgaactctctttggagtcatgggtactcctagctctgcactaggagt

SEQ ID NO: 1928 - DNA, 600 bp, Bovine  MMBT18889
catctgagctaccaaggaaacccttagatataatgttttagcttgcatggagtgtcagtattactatggatggcatacagtcatttacaaaattgtattaaacttcctgtggccggttgcatttttcaaaatcggttgaaatagtatattcagtctcttgtgctcttccaaccccaccctccttacctagtcaaaagatggyatctttgttcctattctttggacctgagtggacttcttgggtgarcttctataactgcacaagaaagtaatgcttttgaagctggctcttaaaaattratacagcttccatctagttcccttactcagagcatatgcctgcggacccctgaagtacaggtgccccgaagtcaccatgctgtggagaccacacagcagacracatgtacgcagagaatgtcagaggaaccccagctgtttcagccccagcartttgaacattcccagactcaatggcaaacgtgctaatgaggaaaacagatgacccctgcatcatccctgcctcacggcaaccaggtgagagaccctgagtgagaaccacctagcggggcccagcccatctccagattcctgagagac

SEQ ID NO: 1929 - DNA, 600 bp, Bovine  MMBT15123
accatcgccatcttcatcacctccaacatcaccaccagcatcatcaccaccaccacctccatcacctccaagatcgtcgccaccgccaccaccaccttcatcacttccaacatcaccaccaacacctccaccaccaccatagcctccagaaccacttccatcaccccatcatcaccactgatccctgctctgagcccacttgctttattactaagatgcaagtgaatgtcctagtatctgggcccccaggcaagcaacgaccctacattccagtgtgagtcttcagaccctgactgacarcctttgtacctcagtactcagtcccacagccaagacccatccccagatgatgagatgtatccaccaaaagtccggcggtggactaaaactcactgagatcctgttttcaagccctgtgtaatctgcatgtacctggatgctcctcgggttccctgatgaacccaaaggtgtcacctttaaggtaatcacatgacttatggaaagtaccctggatccctccaagccagcagcagggccttcccactcccaggaccccggacttgcgcttacataacccttgctggaagtctgagctgacga

SEQ ID NO: 1930 - DNA, 600 bp, Bovine  MMBT19641
tctacataggcatgttcacatgtaagtcagtagattctatttgtgtaattgccgtaagtcacgtgttatattaccatcagtatctttttatagtttgtattactagtttgatttttatcttttatccacgaagtgtttaactttgtatggctgttgaatcatttttytttctttgttcatagatttacttgtctgatagttgttaaccaagaatasttatcacagtctagatgactgcatatgacagtgcatcaccagtgtgcagtcactgtaggagaggcagagacacacacacccagrcttagaaaactgtcagtccctgttgtgtgggatgtggagttaagttcacgcaccacacagcatccatctgggtcctgtttcacatttacatctgcagctgatgaatgggatasagatatacataagacaaagataaatgtattagaccacgagaaagaacttagtcatttttgaaataaaagctttattgtccatacccagatattaaggaattctcatttgttgattttcctcctcatgtttcagaagttcacagatgaattatttgttgttatggtctgaaacccttgtacaggaatt

SEQ ID NO: 1931 - DNA, 598 bp, Bovine  MMBT21447
  misc_feature (1)..(5): n is any nucleotide
nnnnnttaagtgctcgccagctcagttgttaggaawggaggtaaagctaaagattgaagacagcttgacaaaatcctacacaccatccagctgggctttacacattatgagatgtggtaggacagaatgagggtgtttaaaaaacttattgctcttatgttgctgcggggcgttgggctgagctgggaatatgccagggggacttgtgctgcttgtgtaggtaaacttgcaggacttcagctttcaactccatccartccttcctgtcagattctcttaaccttgtcctgtcccttgctragcactgacattttcagagcagaagraaatcatgttaaatttatgtatggggagggggggtgtctgtgtgttttgctagactctggtcttaagtgtttgggctcttttgattagttccgtcctgggtttgttttgtcgtctgagaagagcttataaataagtgctggttaggagtttaatttggattctcatgttctctggccagcatggctgcggttggttctttgtggtgggttacagaagagcttcagccccttctgagcagccagagggccccccgagtagcatgctgctgctg

SEQ ID NO: 1932 - DNA, 600 bp, Bovine  MMBT19644
attggaaaagactctgatgctgggaaaggttgaaggcaggaggagaaggggatgacagaggatgagatggttgaatggcatcaccgactcaatggacatgagtttgagtaagctctgggagttggtgatggacagggaagactggcatgctgcagtccatggggttacaaagagttggacatgcctgagagactgaacaggactgaactaaaaaattgtgggtcctatcttcacatcttcatctaaacctaattatctcccagaggtcccatctctgaagatcatcacactgaggtcagrgcttcagtatttgcattctgggggacataattcagyccatagcatcagccaacactactgcgagtgtagctgttaaaacctggtttgcacacctgatttgacaaagcacattgtcaacaactatcctatatctcacytctccatatttcaaataaaagcaatatctcaaatctggtgtgtgacgtaggttacttatgatttattgaatgcaatttgacactaagtggataaattatgctttacatcaaaaaatgtcaatcactcagatcttaatttatgatccctttgagatttatataa

SEQ ID NO: 1933 - DNA, 600 bp, Bovine  MMBT22162
ccccgacgagagtagcggccgaaggcgcccaggggcccgcggggagtcggctttagggaccaacaccaggcaggagggagtcctgggtgccttagatcggggcgaattccaaggagcatctcatctagaagtggcgaggagagcccgggatccactcatccagcgaacgtttgctggatccttggcgctttccccgacggctcggtctttatctcgcgctagatcatcgcgaggagagattattactgaaatcctgggagggtcagggactttaaatttgggractcattttgagaccargccctaccacgtgctaccgaaggaaagccatttaccctctctgagcctcagtttctcatcttgaaaatcagggcgagagccgggggaggaatggttcatttgtaagtcccccttctgtagtcagagggtttgggaaatgtcgggccaattctgggacaatgggcgggtgacgagaccccgtgacccgaacccgggtcttccccgttcttcccggggcaggtgtgaacgccatgctgaggaaagtggccgtggcggctgcgtccaagccgcacgtggagatccgccaggacggggaccagt

SEQ ID NO: 1934 - DNA, 600 bp, Bovine  MMBT18892
cttcctgtggccggttgcatttttcaaaatcggttgaaatagtatattcagtctcttgtgctcttccaaccccaccctccttacctagtcaaaagatggyatctttgttcctattctttggacctgagtggacttcttgggtgarcttctataactgcacaagaaagtaatgcttttgaagctggctcttaaaaattratacagcttccatctagttcccttactcagagcatatgcctgcggacccctgaagtacaggtgccccgaagtcaccatgctgtggagaccacacagcagacracatgtacgcagagaatgtcagaggaaccccagctgtttcagccccagcartttgaacattcccagactcaatggcaaacgtgctaatgaggaaaacagatgacccctgcatcatccctgcctcacggcaaccaggtgagagaccctgagtgagaaccacctagcggggcccagcccatctccagattcctgagagacgacaatagtatatgattatcattgcttcatatcatcaackttggggtgttatttcatgtcacaatagattaccagaacacttctagatagaagtgtgggggg

SEQ ID NO: 1935 - DNA, 600 bp, Bovine  MMBT15924
aagccaataaaaaagataagaaggagagagactgattgggaaaagattcctttgggtggcaacgtggaaacatggtttgcagaggctgatagcactttctaattacccacagagaagtgaggtggtggtctggaggccaaggactaaagagatttcaaaagccagtccccctctgtgactaaggcctgcctgatgagctttctagtccttggtctgttcttggacagacctgggtggaccctccccggatagggcttggcaaggtctgagactggagacagggaaatcagggaaccagartctgtatgatgagagatgtgcctgagcttcagcctcctggatgccatagcagcagagtaaggrcagatctttgcactagatgtccttgggtgagcggggrttkctccaggagcatacaggcagctgcaaggccaatgtccaaacctggaatccagggaccagcccacatcaggccagtcatcagggttctccaaagctcaactggtctctaaggagctgctccaatcagggagtcatcagtctagaacatttattaagcaccagatacagggtctgggaaaacacaggkgaacccttgct

SEQ ID NO: 1936 - DNA, 600 bp, Bovine  MMBT21729
tagtcctaattaccagaacacagtcataattaaatagcactgggtgctatgccaagcagtcattcagaagtcttcttgtttttttgctggtttcggggtgaattctttaacaagtttcttatcctgaggtacattccagtagattccgccatgttctcgaattcaaacggcgttattccggttgcaaacttgctcatgtcggggatagcactgtgggccttcgtggctgctgcaggactgcagtccgcatgaaggagctgctggctgctccctccattcctgacctcactgtttgactcraccctgccgtggtcatgagcacctttagggtctacctgagtggactcttccttttccttctggccaagcaaagcagtctcagaatctgggctcaaggcttgttcctcttccgatttctttgcagcagtgtctagtacctcggcctcccctggcacctgcctttcgggtgtttttccctctggcacagggaggtcaggttcgtttggacaaggtgaagaggccaccgaattcccagttaaaggtgtgtctacaggaatatccgaatcactgttgacgctctcagcctgctccagggccgcc

SEQ ID NO: 1937 - DNA, 600 bp, Bovine  MMBT20351
gtgttccctagaaatgatcctgtttaatctgcaccagcgccttccactgcagcccattttatggatgagaaaattcagcctyggggaaggtaaacacctttgaataaagccacagaactaatacgtgatacttttcaagatcacattaaagcttgcagcaatccaggcgttttactaatcttgtcagccctctgacatcctgggaatgaaattctctgccccccatcctcattccatgcctgtgcttggcaggtaccagcactcaataaatatttttggattgattgatcacaagtggartgaagatggaagtgtggcatctgctgcccagcatgaggaggaaattagctggaccagctcctccgagatcctggggcttacrcggcgagaggacacagggatggggaagcaaccaagaactaaggaggggagtaatgggggaaggtgacagaagtgaatcagaatgagtaaagaaagtagacagaaaaagcataggaagtaacagaaatgaagtgcttggagttagaaaacagtttgatctcgcytatatacggaatctaaaaaagtccagggcataaaaacagagtgaagatggagggc

SEQ ID NO: 1938 - DNA, 600 bp, Bovine  MMBT23183
aattacccacagagaagtgaggtggtggtctggaggccaaggactaaagagatttcaaaagccagtccccctctgtgactaaggcctgcctgatgagctttctagtccttggtctgttcttggacagacctgggtggaccctccccggatagggcttggcaaggtctgagactggagacagggaaatcagggaaccagartctgtatgatgagagatgtgcctgagcttcagcctcctggatgccatagcagcagagtaaggrcagatctttgcactagatgtccttgggtgagcggggrttkctccaggagcatacaggcagctgcaaggccaatgtccaaacctggaatccagggaccagcccacatcaggccagtcatcagggttctccaaagctcaactggtctctaaggagctgctccaatcagggagtcatcagtctagaacatttattaagcaccagatacagggtctgggaaaacacaggkgaacccttgctttctgacagttggcatctctaagctgaaataatgggacacatggggatggcagtagagcttcatctcagctctaccactgctttgcatagtacagatttt

SEQ ID NO: 1939 - DNA, 596 bp, Bovine  MMBT23160
ttatccattccatgatgtagattggaataagtgagcagcagggtgaagaggtgcatctgtcacagggtgcagagatgactattgaaaatactgtattcaaatcytagtccagattgtgttaacaaacaaaaaaawgtcaggtgtatgtggtaaagaacctaaatagaatttcaagaaattaaaaatagtaattgaaacaacaaatccaatggagagggtaaagaactgaagagagaactggcgaactggatggtgtatctgaggcattatcctggaagaggcacagagaggcagaaggaraagttgaaacattacacagcagggagaccatgtgaaccattcttgtcctaataaattcttgtggagtatactaaaaagttgaaatactatgtataacttatatacagataaaaatggaataaacacctgtacttactgtccagaaaattagtagtacctttgaacctgcttgtatgttccttcccaattatgttattatttatcccttatgtacactatacctatagttttaggtatctgatatattcatactaaaattttaaaaaggatgccctatagtcttctttatttattta

SEQ ID NO: 1940 - DNA, 600 bp, Bovine  MMBT21717
actgtgaccttgaacaagtcacttagcctctctgagcccatttttctcatccataaaaaaaggacaattcacagatgcccctcccagggttgataagatgcacagagtagaaattcattaaataccatctccctttaacatttctctttattctcccataattcagtactcctacatttaagacagagatgactgtagtccttactatctgaagagaattgaatagttgccaaaagccctttcacataatagccagcagctgcctccttggggaactggaggcttaaatgggacattgcrtatgaaatgctttgcaggccttggaagaaaagggacaagagaaaccggagggttattattagacatggaaacgggagagcaggagcccacacatgcctctcgtataatcaaactgacattgaggtttacagtgcattgaacactgcgttccagtccggggagctaaaaatggaaacctgtgaaaacagcagctgggttaaaaagrgagcaggcctggagcggagggcgctgagcgggctcccaccagccagagagcagaaaggacaccggtcttcgccacctgagctgagacagcagcgg

SEQ ID NO: 1941 - DNA, 598 bp, Bovine  MMBT21090
  misc_feature (1)..(170): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttgggattgaaacgtaagtgggataggaacgtagttatctggtttctgtgcaagggactggcgagaacaaaaggagaagcaaacagaccactaagaaggtactgtagcagttcaggagagggacartggtggttaggattatggcaggagtgctacagtggatggattcaagacacacttcacaaacagayccagtaggccttggtaatggattagacacgggggtaagggagagtgaggagtcaaaaaaaaaaaaaatccctacgtttctggcacgagcaattactgaaatggggacaaacggactttgaaaggagtggaagaagagatcaatggttcaactttagacatttgaaattactcaaagggaatgtctaatgggcatctggttctgaaacttaaaggaaacttctgagactgaaga

SEQ ID NO: 1942 - DNA, 601 bp, Bovine  MMBT21821
  misc_feature (1)..(1): n is any nucleotide
nggtcaccaattagtctttgatttactctgatgtacttagaggttttttagtattaaaaaagscttgcagctgaaaatttacatttaaaaagtaattaatgccaattcaatgaagaaatcctcagtttcctgtagaatcacattgaacttcaagcccttttaaaggatggaaagaattgatcatcagctaagaggtgcttccttggttctctgttggacaaaattctttgtccaggtaaatggacatcagacmccttcccacttctctttagctttgtccccatcactcttcatacctacrtgtgttgttactcagaagacagcatttgacgaacggttactgtcaagttccattcctccctgttccagccgagcgcttcccagacacagacggtcaccaggacagtgactcaagcagagccgcttgcgtctgatgtcagctgaagtcctcccgcccatccctttactgctttcttggtttctgagccgtcatacacagagttatctcccccgtgtgaactcaccgtctcattctccatctccctctgtcaccccccaaaacaagagcccctctttggggtgggagggtgtgagggcctga

SEQ ID NO: 1943 - DNA, 600 bp, Bovine  MMBT21456
actgtgaaccaacgaccagcagattaataggatgtgctgaggaagagccgcccgctcacccactaattgcttgtttacgtaactgatgagcatggcactcattacgggttgttagcacatcaaggcagtgtctgctgatactgggaaaggcctgaggtttgtggatcttagctggttgtcagcaggcacagtagctacttctggggtgctctacccccacagaactgccacggatcgagagtttagtttcaggcatatgacctcacgtaattmcatagcaagcctgcgaggaagggactrtcatccctgttttagaactgaggaaaccctgggtcagagacactaagtgattcacataaggtcacacagctcatccatggtaagctccacagcgttaaccgctctgctgaacagcccccacctccaacacctgccttcatactcagtgatgtcatgaatgcaagtgatgtcatgaatgcaagtgatgtctgcatctttcatgcaatttattggacactctatgctgtgtgctaagtcgcttcagtagtgtcagactctttgtgacaccatggacagtagcccgccaggctcctctgtcca

SEQ ID NO: 1944 - DNA, 598 bp, Bovine  MMBT19203
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacatgagaacctcgatgactagaaggaatcagtcttctgaaaatctagaggcctcacaggaggaacagatgatacacaagccctcaggctggaaagagtttggcgcatttcagaaaagtaagacagccagtcagcttgaagcacagtagatgggaagagggacaaaatgaagaggcaggcagggrcaaggtcacaccatgcctcatggttaagagtttggattttgctctaaactagggagttacatggtttgattttgagagtgaattacggggagaagcagggagactgctggctgctgtaggctacccagatgagagaaaacgctgctttgcaccagagagatgagtggagatgaagaaaggataatgaatgtgagatgtccttggaacttgaagtcaacaggactcaatgaattkatgtaagaggtgaagagcaaagagaggaatcaaggataacttgaggactttgggcttgatgggg

SEQ ID NO: 1945 - DNA, 600 bp, Bovine  MMBT18520
tatatcatgcctttactgcttcttaggcagggtactcaacttctctgtgcttcagtttccttgtctgaaaaatgggcatatgatagtacctrtctcatagggtgttgtgttgattaaatgaatcaaatatgcataaatygcttaagacactgtctggcacatagcacatgctgtgtaagcatttgctatgctttggtttcctctctataacctctaccatattatgaagttcytgaaggcaaggatcaaattcttttccactctcctcccaccctacactctgggacccagcacaggacrtgaggcagagaaggagctcagtaagtgtttgctaaatgaataaatgaatgaatatgttttaaatgataacttgtataatccattatagatcttccacaggggaaagtgagggggcattaaggaggtggcagcttgtactggtcttaaaggacttcagtagagggaaaggaagttggcacagggtctcacatttgggttaggtggaaatgagggtgggagcaggtcatggggtcttgaatgcagggtgaggggttagattggatttatttgcagttagcagtgtggaaggtctagaggcag

SEQ ID NO: 1946 - DNA, 600 bp, Bovine  MMBT21699
tgtaacaaatycaacaaaaactttaaaaatggtcccacatccaaaaactctttaaaaagataaatgggatggggaaagctgaataaaccaggattttgataaagggaccctcaagctttcccctcaatgttactagcttaaagtaaataataacaggtcacctcttcagggagctttccgtgtgccagacgctgtcctaagagccctgggagtaastacggtcgatcgttaacccatggatggttgtaaaggtgaaagaacagtttccatgttgcccagggagaagggggcggagccagracacagtcatgactagtttaccccagaccccgggcacttaacatcccacacctgagagtgagacttcggtctcagaagggaccagatgcgcccgcttccctttgatctcttgcgcgttttatcctttgagtcctccgactagtttggaaagaagcaagtctttgaagccgcatcagtggcaagggcgagacctgaggggtgttctaagctgtgaagagaatactttattttccgtcctctctggcctgaagctccacccacctgccaagggcccgcccctttcccccgcccaccacacgt

SEQ ID NO: 1947 - DNA, 598 bp, Bovine  MMBT21743
  misc_feature (1)..(82): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnntgtaggaggactccgggagccggggtgccaccagcccagggtggttgcagatccgctgtagcctcaggaggatgctcagcacgtccacaaagtgcccgctcttcagcgcttcctgggtcctrcgcacatgcrggaagagayaggagcattgccaggggtgcaaacatgtgccagctgggcttctccccgtctgctatccccactctatgaacgcacarctggtgcatccccttgacctggtgagtaaatctgccacatgccaacccacctccatgaggttgtggttctgagactggctcaccaccccatgagagaggacgggaggccagagagccagggtacgggttagacrtcggggcaccctccatkgcatgcccccaaagagcaacagggcaggtgtcccaaagagcccaggggtctgtctgggtcggggaaggaatgccctgactccacacgagtcctytcacactggcggcatgctgtgctcctcctgggccggctatgggcagagcctct

SEQ ID NO: 1948 - DNA, 600 bp, Bovine  MMBT21483
tggaccaaagtgggaggagagctggtcctgggacccaaattgggaagttaaagctgatttagactgttgagaattttgcctgacttagaaataaggttattccttacaccctggctctgcctatgctgggggtagtaggctttctggctcatctgagcatgtgtgatgacagtggtaattcagcttgatgattcggagcacacattcctgacttctaggccctgtcccgctggaagggaggcgtactggctctggaaagcacactgagtgggcctggagccagcccacatttggacctcractgttaagggctgtccttcttgcacctgtggctgcctgggaacgcagcggccagagtttctgtcactttagtgacggaagacagccttyaggacagctggtgaaaaaagatacatggcctccattgcccaaacaggcagtgatcccttgccacccagccttgtttaatgcttcttcactgtgacctcggcttatttctgttccttgatttgtaaagggagaaatctagtgtctgctctggcccctcagaaatgttttttgacttattcaggcagtaatgcatgtgaaaatttggtgctc

SEQ ID NO: 1949 - DNA, 600 bp, Bovine  MMBT19493
ttaatgttaaggtcttcaggtaggattctgctagatgtgaaaagatgttcatgggaaaagatttcctttttttctttttttgagaaagaactgttcacatggggaaaaggggcagaagaaatcaagaataaaagcatttgtgaggacctccttggtggtccagtggttaggaatccatgctaatgcaggatacatgggttcgatccttagttcctcccacatggtgtgtaggaactaagcccatgggccacaactgctgaagcccacgagccctagagaccacaccaagagaagccaccrcaatgagaagcccatgcatcacaactagagtacagcccccactcgttgcaactagagaaagcctgctcacagcaacagagacccagcaccaccacttccaaaaaagtgtgtgtgagaatagtgcaaagacatttcagtttatgactttaccaccacacagatatacacacgcatattcacaacatacatggagagtcccgtccagtacctccccattttggaacggatacaataagctggcagacagggcagcaagatactggtgtttcagcctcctccaaccctcccagataatttcca

SEQ ID NO: 1950 - DNA, 600 bp, Bovine  MMBT18796
cctgaatcctaggtcaggccctgccacttcctggcataacctctctgcacctcagtatacatctctgtacaatggcaagatgtcaggttatgccatttcacctgtccctcgaggttgtcatgagaatccaatgggccatagactgtaaaccaaggcatatttagaaaggggaggcccctttgatagaaggagaggactsggkcgagggcagaaggccatcctgtccagggatggtaccccaggttgttggggaaccagtccccttcctagtttgattarcttgtgaacaggctcccaccrcagaacaggagccattccaagtcccattatcctgcacattctcaccctgcagccctgctattcacttaaacaccgcagctcccragtacattttaatctctgatcattagttacaagattttcttgttaattctgattcagcagattttgctgagacaacgctcttttttcccttttcattttggtcacgctgcacatagcctgttcagacagacaataaatctggtggctaacctccctcccgaggatgaatcatccaaaactctgcaaaggacacagccacgggggtggccacaggga

SEQ ID NO: 1951 - DNA, 598 bp, Bovine  MMBT21731
  misc_feature (1)..(58): n is any nucleotide
nnnnnnnnnnnnnnnnnnnnnnnnnnnnnnnnnnnnnnnnnnnnnnnnnnnnnnnnnncagcctgtgctgtgatgaaaagaggaagtggtgtgtcaaacgcaatgtctgttgcaaacgctgcttgcatttcacagctggcatgaagtggctcctgcaggccttttctatttctaaactcagtaagtaggctccctgggcttccccggtggctcggcggtaaagaatccacgtgaaaatgcagagacgtgggttcaatccctgggtcagggagatcccctagaggaggaaatggcaacccrctctagtattcttgctggaagaatcccatggacagaggtacccagcgggctacactccatggggtgcaaaagagttggmtacaacttagcaactgaaccacaccaccaagtaggctccctgggtgttyacaaacgtgaaacgagactgaccttgtcgaagagttgtacttggtcccgctggcgctttctgaacaagtgcacacagatttgtggcgcacgaccctctgcactttggaaggcttgaagatgctcatccactccacgtcagacatgtggcccggcgcttcgattacgaagt

SEQ ID NO: 1952 - DNA, 600 bp, Bovine  MMBT23269
ctagcagttagttagctagctagcttctttatctatttaaccaatgtttggaggactttgtatgcaagggcaccccagaatcatttattaaatccttgtgttactgtcctagatacggcataagtttttttaaaaagcaccaattaacctctctatggaaacttctgtgacattcccagtatattttgatattgcaagtcagagttggacaaaatattasttttgtatttttcatactctgagaaaagtccttagaactcyatcacttgatgaagcttgccaggagcagaagaatcactragatgtggatccaaagcctgacatgctgagcttggagctgctggtattattcaggataggcaagatgctgctgctctacctaacaacccccaratgttagagcaacagaagtttatctctcatgggacagacccatctcttcatcctcytcctctgaaaaatctggctttaccatctagaaagtcagtcaccactgccaaagaaagggagaagatggagcaccgcatactggatcttcaacacccttgacattccttctcacgtttcattggtcagagtcagtcccatgggcacatctca

SEQ ID NO: 1953 - DNA, 600 bp, Bovine  MMBT14556
ctcctctccccacaccctcaagagccagaggaccccatttcctggcctcttcagtcttcgggaccctaatccccctaccctaagccccaagccacttcccctcccttccctctacctattaactctttctatatagccagattgattatagacagagtccaggccctgctttccttcgttgctgtgtgaccttggacaagtcacctagyctctctgaatctcacttcctcctctctataggggataatcctcccttggaattctgtcctagagattaactaataactgacatcacacccrtggatgtgttcacaggtatctgaacatgtgagtgtctcacaggcctgaccacatgggatgggcgagctgtttggcaccaaggtggtgaagggagctgccatttaaaaccgacccacactttatacgagtttccccaacggcccgtaagcaccacttaggttgcaagccaagtgccctgtcctttagtccacgacctatgacataaaaatacaattcttgggggacaggcaggggcttcatgttggcctctcttcatgaagttacagcatctgaggtcctgaggcaggccttaggggagag

SEQ ID NO: 1954 - DNA, 600 bp, Bovine  MMBT22966
cggccgggggacacggcccgggataccctggagctgatctgcaaggtatgaggccacttggggttgtttgygttggaggactcyacggacactcagatgcgggtggcagaggaggaktcttgaaagaacacctttatttcataacagagcagtgttggatcctcttgtgatataygcataatggatggatgtgatttcttccacactaggaggagagggawtctcttagtagcttcttgcaacatgtgttcttgatagatttgtgcaaagcctmttatgtgctcattgcacaagttgtaragaatttaggtaaagaacaaagccgaaaattaaggcacccttgctcacaaaattcagaagtcacctcggtgaacattttggtgtttgtccctggtctctgtttgccacaagcacacatacgtgtattcagtggcatcatatyatgtgcacggagcttcccaggtgtctcagatggtaaacaatctgcctgcaacgtggagacccaggttcaatccctgggtcaggaagatcccctgggggagagaatggctaccctctccagtattcttgcctggagaatcccatggacagaggagcctg

SEQ ID NO: 1955 - DNA, 600 bp, Bovine  MMBT19212
ctgaaaagtgttatcacagacaacattgcatttctccttgcaatatactttcgtattctacagagctcaggtgatctatcaaagtcagtagctgtggctaatatgtgctctgtcctcccagaattacataaatgcctaagcacaggtgctgaggtttgctgccagagctatagaagtgaaggattttaaagaaggaccttgagcagtggctctcctcttttgtgcacggctttaaaaaggtcgtgttgttgttgttttccctccaccccttcccctcaagaataattaattaatgktgtraaatagatactgaatgctacacattaggaaattccattttaatctgtgtctacattagtttcagggacctacttaatttatattgctgaaaaatgtaaagttgtgttggtcaaatgcaactgaaggacatctcaaacattttcagtaaatttggcttaagtacayttataacagatccaaagggtgtccaggttctttgggcatattgaataataccatttgtggtgccagtgtgtgggccacagtctctgactatcaggtcatagtttttttgtgtagagaggttaactgtctttgtag

SEQ ID NO: 1956 - DNA, 600 bp, Bovine  MMBT19985
ttgaactattctattttaaggataggctgacattagtagttcatgtcctgcaaaacatgtgaaagttaaactcttagggtattgagttacttcttttaaaatgtagtcagaaatagggctaaatagatagtagtttatataattgactcaagaatttttgtgatggtgatttgattgtagcctgagtatcatkctrtgcatatagataatgtctaagagcacaaagttttactgttactacttagaattaagcagcaggtaaatkatcgtgtttgagttttaaaaccatgagttatgagrttaaacaagattacctgatttttctttcagcgtagttttggaagagctaccgcctataaatatttatgaatgctggaaaccactggctgccttcgctaggaaaaaagtatttggttgtacgttttgtgatctttgtaataactttatttacatgacagaaactagagaatattgataatacttggtagataaaaagccaaatggttgaaattcagagctttgattttgcttcagttcagttcagtggctcagtatagatactatttaaataaataactttatgatcttcctgaggaaggg

SEQ ID NO: 1957 - DNA, 600 bp, Bovine  MMBT22468
ggcactccttccactgcttttcacctgacacctaaggttgtctttctcttatcttattattctttagcatccaggttcactattgtgtttactattgaagggttttgctatggtgattaaggacctaaagctgataattaccctatgatttacaagcagcacagtggctgatacttcccaaatattgctgtacaaatattacccgtatgctgtgtcagctttttactcaccttgagagcaatctccccttagttttatggcacattaagtctcattttggaatgaattgggtttgtaggrgtggaattggttacattagagtaaaagaggaaacagcagggagggatgactggaaagttatacaatagaagcattagaagaaaggaaagaagagggtaggaatggggtagagagctttaaaggagagttttaaaataataaactagtagaagtttggtgacactctgggggaagaagagaaaagttaatgtttattatatgtccacgtgtctccttgtaactttaaaccagatactgcactgaactggactcctcttgaaatctttcaacttgccttccacatgcttcaccattattcaa

SEQ ID NO: 1958 - DNA, 600 bp, Bovine  MMBT22469
caaattgcatagtaaacacaacagagaaatatgggaggagtgtagaatttagtatcccttgaattttaattaactcatttagaaaacagcaaaataacagattgttgctgaaatacagtaattctgttcttcagggaagatttttattgagtcatagaatttttttttttcccctctataaaggaaaattcaggatctaatattattctgttctgggcaacttctcagcaaaagttgctgagacaagacctatgatgactttcattttcatggaggtggaataatttcaatttggaagtrtctgcaaatatgggagtgtggacatattatttccagatccaatttgaaagagtaagaactttctgacttcacactctgtgcttattctagataatctgtttggattggtccaaracagagagagagaatcagtttaaacttgtgctttgctgcgcttatttcaagcagtattgtttccacaggttttcaaactattgtcatgttatagcctaatctctccatggcattatgatattttataaayatctatttgaatagttattttccctacaataccacaacattcttgaggtttatgtc

SEQ ID NO: 1959 - DNA, 600 bp, Bovine  MMBT18717
acttgggtgggactgtgactgcttgcccatggcacccggtgattgaatctgctgtcaccagcatcctgataataatgaacacccaggctcaacgaccgtgattatgattatcataattgatgtgcaggagcagtgtgtggggatcattacagctgaactgtacatcagagaaacaggcctcagttatgggtaattttactcttatgcattgattgggataaaatatgcctttctctttaaacagaccagcttcatataattttaagaatctttctgtacacgctgatggatgattatgtrtctgctgaaaacagcccccgacygttgttagttttgtgttgtttcgtttcattagcaaatgtaaacaattaaataattmagtgtaattgagggaaaatattttgcttaggaggatggtcttcaataatcaaatattcagttyaagtgctttttctgtctctctgacgatctatctgggactgaagttcttcagtgttctccctctgattatccttgtacctgaattccagaggtcagcaaccatcagggaaaatataagcgtatacagttttttattataaagtattgtgcatttgaata

SEQ ID NO: 1960 - DNA, 600 bp, Bovine  MMBT21455
ttgtacataagtatatttatctggatagaaggtacaaagttttcctcggatcatacatgcttatcaaagtatacctttggtctttgggtacttgaagcttatgtggttcttttgtttgtttgtttttcggtcatgcccctatagcatgcaagatcttagttccccaaccagggagtgaacctgtgaacctgtgccctgcagtggaagcayggaatcctaactactgggccaaagagaatctctgaaccttacatgttaatagtgatccagctgccagttcaaacaagaaatagtttagtrgtccactaaacactaggaaactttagttatcccttgaggtattcacatttctcttaaagaacagctttagggaaagctttagtgatagggaattattaattagtttttaactttttaaatcatgtgtgtattttttttatttttgcattcttccacttagaccttcaggccctagcaaggctctgaaactgggagccaaaggaaaggaagtagataacttcgttgacaaattgaaatctgaaggcgaaaatatcatatcctccaatatgggcaagcgtacctctgaagcaaccaaagtgc

SEQ ID NO: 1961 - DNA, 594 bp, Bovine  MMBT20007
tatagccagagaaaacctatcctgttaaatttaatggcaacacttcaaattaatgagccatcattcctctgatgtgaactcactgtaatatgccactggaccttcctaggagcttgcactcagaactgcagaaccaatctctcctcrctaaaatatatgcaggttctgcactggggaacgaaggcagtggaatggattaagcggtatctgaaggctgctggagatttagagagcaaacacaacaygtgtcctggtgtcccttttcttcaggtaaagttgcaagcttgtctgaaaaattgraattgcttctgtaggttacataattaaaagtaagctggggataacaaagtttgccttgaaagagctagaaaaacccatagaataaaaggctggtaactgataggaagtatgaaatcaccccgagagtccaactaatgaaaaggaaagaggttttttagattggagccaggttctaaaacttggattcaaagccactattcaactgaaatgtggccatctaactgtggaccaaccatttctccctccagcgtcttattctggaaaattgggaagggccaggtttgatcttccctg

SEQ ID NO: 1962 - DNA, 600 bp, Bovine  MMBT21725
atgaaacttctaatgaggttttggggtgtttttaaatggatgagaacaacacagaagtcaactaaaggagtgtgactctatatgaaatgagtgaggaagatagctgtcaaaattactcataatccattacattctgggccttataacagcagacctcagaaaatgtttcccttactctttgttgattgtaaagatacatttacttcaaaagaaatcagccttcttatttggaagggctttgaaattcaagcatggggtgggcattcagtagactctaaaatcgcaatggyagcaaaaatrtgtattctgagaactgcacagacaagaaacttctattaagatattacagattaaagtaccaaaaatctgctaaatttgaaaatttttaaatttgcatttgtcatacatctagcagtggtttgaaagcatcaaagccatttaattctggggtcttattaaaaaattcatatgaatcactgtcgtcgtttagtcactaagtcatgtctgactcttcgagaccccatggactgcagcccaccaggcccctctgtccacgggatttcccaggcaaggacactggagtgggttcccatgtccttc

SEQ ID NO: 1963 - DNA, 600 bp, Bovine  MMBT22477
gcctagcacataataggtacataataaatagatgttgaataaagggaaggctcaatgaatgaattagttgagtatttctggatggaaggaaacagaaattatagttttagtactctgggtatgtctgaaagagagagaaaattaaagaaatttgggggaatttcgagtgatacggtggaggctagtagtggtagttgcttctaaaagttgtatggtagcatccacagtccccatattcaagtaacatattatcagtacaaaagacttccctatccagcctctcattttctcctcacaacraatcatgatgtagctggtataaagactgtcatgggagccagggctagagaggtaaatgatttgacttattagtgtcagaaccaggcctggaactctgatgtcctatctcctggttgaagacatctccatgactcatctccactttcctttccatattggggttttacaaaaatgttcaataggtacttagtgtacctattgtagaaggtacttagtgtagaagggaagagagtgggttggatgtaagttacagaaggtgggaggcaacctgaataccctctttagtaggaattctaatca

SEQ ID NO: 1964 - DNA, 600 bp, Bovine  MMBT20234
aagaataatatgtggattaatagcatcttgtaatattacacacagttggtattaatgtaaattgctactaggacatttaacagagcattttaaaagctttaaatatatttctttgaattgaccattatgtgtcttagaatttgtctgaatcctaacaaaaagtgagaaatcacctatatgtccattaatagaggatttttaaaataattcaccatttagtcattcttttaaaacgatgttaagtgtgtttcttatgaaaaggtactcaaaggtattgatatgaaatagtagcttacaaarcagtatactgtataataacatgcatactcattaaaaaatgtatagccatgtattacatacattaaaaaatcaattaaatacataagtttaacaattatttcccaacaagggtaattatgacttttttggtattcttctacttatatattagaataatgagtttctttagaaggaacaattaaactttctttttggaaaaatgaaacctaagcaatatgtctataactaggggtagctctttccttggggctagttctcattaattcactgccagaggcaaactaccttctactctatctg

SEQ ID NO: 1965 - DNA, 600 bp, Bovine  MMBT19909
ttattcagctaattataaagtactctgaagaacttcttttttaagcaaatctttataactgacatgagtttgagaaaactattaggcaaatatgaacaaaactgcactagaaactgaaagaagctgaagaggcatagcctgcactttattcttgggaagctgctcgggttggaaaagaaagaaggaatcacacagcaaattagcaaaaggcccacatcacagagagattaagagacccactaacagctgatattgggcaaaaagaaatatgccccrgatattaagcagaagatgctgatratacagacatctggaataartggagtggaatgagattrggatgtcagtattggagccaaaagagttacccagaatggtaaagagaagaccaaaggatatttggagatgtctggaaacatggagacatgttgattatagaagtgggctgacctgagatcaataagaaagttcatctaacttgcaattccatactcatatagtttctgcttttgtaagtcagacattgctgtcagtaaaaggaaaaaaaaaaaaattaaagttctgatttggtcaggatggtaggcagaataacagcttccc

SEQ ID NO: 1966 - DNA, 600 bp, Bovine  MMBT19903
agtgaaagcgaagtcgctcagtcgtgtccgactcttagcgaccccatggactgcagcctaccagactccgtccatcggattttccaggcaagagtactggagtgggatrccattgccttctccacctctttacakgactttttcaattaatccaccacccattgtttctacttactttagtaaggtcctcttttattttgctaatttaaccacatttcacttcctcctgttactctacttcccccaaggcaaacccctctgaatagtatttattaagaaagctctctatagcrtgactaraaaatgctggcaactataaagatagcaagtctttgcattgtaactgtgagtagtgataaggaatcctaacaacctgcatacattaagatttcattctggcttcaatttacttctaaccctgttatcatctcatgacattytgcactactaggggaagaggttggctaaagtygttggtacagatgtaatttatggcaatttaaactgagtcaagaagttaataactttgaaataatgcatgcacctcacactgagtttaatcagggcttattaaagatgagttacatgtgccttttygcc

SEQ ID NO: 1967 - DNA, 598 bp, Bovine  MMBT18497
  misc_feature (1)..(123): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattttttctttattatatgccttctatctgcttatattttgagtgaaaatagcatgctctgttgtggaaatcaattaggatgtttaatcagcttattataaattatataattttgtgtgctgctagcttttttttagtatgtggaagtatgctttgcagtgaggtgttcttggtrtaatgttaaagtattgagacagtcacatttttttccccttacatgtgtctctctctgccaagttaaaaattttaaacatcttaaaaaaacccacagtggtatgtctctataaaatcctaacttaaatttagtgaattcttggattaattacttaggatttcattttgattataggatgaattgaaatctagcatgtttaaagatttttattatawgagaactgctccgtttcttacagttaaggaatatttgtggaacattcaaatggaaaacatttattattacttttgttttatac

SEQ ID NO: 1968 - DNA, 600 bp, Bovine  MMBT18716
atacaataaaacagaatttataactaatttataccacaatacaaatgtaagctttcaatctagtcagaaataatcatactatatatttctcagaaatcatatgtagaaactatgagcacaattcaattgctgtaaacaactcacagaagatttataatagcaaatgtagatatttaaatgagtctacatatttacctagtacatagcccccctttttaacaagatgtaaatatcccatttcattatttcaagtcaattttggttttacttttaaagatattcaaataggcataatttagratttttttaaatgaaacaaacactgagatctatatatagtcttttcaggtcaatgacactggtctgactcaggagtaaaatgttctaataatgagaatcttttgctactttaggtattagacacctttaccaaaaaggtgagagagattgagaagggagtacgacaaagctgtttactgtcactctrtttatttaacttatacacagagcacattatgygaaatgctgggctggatgaattacaaggcagaataaagattgccaggagaaataacaacaaccttagatgtgcagacaata

SEQ ID NO: 1969 - DNA, 600 bp, Bovine  MMBT23284
tatgtggagtctaagaaaacatagcaaataaacagaaaacagaaaaaagcttggccacctagtgtgagctgactcattggaaaagacccaaatgctgggaaagattgaaggcaagaggagarggcrgtaacagaggatgagatgtttggatgccatcactcaatggacatgagtttgagcaaactttgggagatagtgaaggacagggaagcctggcgtgctgcarttcatggggttgcaaagagtyggctgtggcttggtgaccaaacaacaacattgtaactagacttatggttggtratcattttgaaatgtttagaaacatasaatcactatgttttgtaacaggaaagaatacagtgttgtagatcaattacatttcaaaaccaaccaagcaaccaaccaaccaacaaactcaataaaaaatattagatgtgtgattactttagatgaaaacatgaaaggagaaggacttggatgaaggtagtaaaaagttataatcttagtcaacttattctcacagcatgtcccagttgcctagagaggatcaaatagaacatttgacacacacacagacccacaatgtaactaaataagcac

SEQ ID NO: 1970 - DNA, 600 bp, Bovine  MMBT18477
tgcaggtttgtatttcttctcttctgaaggatcctgacggaggaggaaaaccagccggcagccgtggacatagagtgagtaatggtgtcggttcatctctgcagagagaaattctactggtaaaccrccagcttaactcactactcaccagacagcttttgcagaaactaacacctgtgcccagccatttttattctggctggccaaaaattaattctgttatttcacgaacactttgtgggttattacattcaatagttacacctgacacatctgtaaatcttctccagcaccgttgartttcattttcactttctacatgagaattaatcactaaggttttttgtctgttagttgaatattcacatcatctgaagtataactatattctgaagaactaccatcttatgagaytccagtatacatgtcactcagacaattagagaaagtatctgcattaaaattcaccgaagaattcttcttcactcaaaatttcattatgcatcattgtaaaaaaaatttagggtaataaacttgtrtttacaatatacacaaggttggaacaaaaatctaagagcgaaatgtgaataacaacaatcg

SEQ ID NO: 1971 - DNA, 600 bp, Bovine  MMBT21438
gttcatgaatcaaataaaaatcccaaaagaaaatatcctaagttttatacccaaggacaggctaactttatctgtctgaacttaacatttgcataccccttctgaactgtacattggtttaatatctttctacactgatatctaccatccacaggtacatgaaagcaacatttgcctatacatctgcataatagattatgtccagttaattaagctcataaaacacatgatgagctgcaactggaaaggcagacagggggctaaatcattatatcaattctatatgaactcttgattttrcacactgaaggcaatggggaagaacagaactattttaagcagaaaamtgacaaggatcagatctacattttagaaagatcattctgacagcaacatggaagatggattagatgagggacaaatttggaggtgaagagactttaggctgctcaagttattaaagtgagaaatgatgaaggtcaaaagtaaagccctgatgraagacactggagaggttaaggacacatttaagcactactgcacctgggaccctagttaataattttaaaacccaaagaatgaaaacttaaattctggaat

SEQ ID NO: 1972 - DNA, 600 bp, Bovine  MMBT23118
gccacaagaataacaccggatgcagagaaatttgtgtggagtgattagtttccgtttctctgcccacactgaagaaatggagtctatttatgtgagaggctttcctttgagttgggcccatctaatgccacatttgtgtcttacaaattctgaatagtcttttaacttttaatagcacaatatattaaccactctcgtaattgcatagataaaatccacgtttcacatgarcatttaaatgaatgcaaatcaacctaatggcctctcctagagggaggattatcatgcagtgaayatttrctctaactgatattatatatgcaaatgagattttaattttgatatactttcacatggacatattttcagttcaatgcaaatctacttatagtgtatcattaaggctgaatcagtctcttttctagtgtgtctatgtgtgtggttaatgttgatacagacgatgaagcttaattttcagaatatcagatgctctattctgctcaccactctcccctttcccgcccccaatgtcagcattattatggaaaactttattttttagatggggacatgatgtcttacctacctacatatattttt

SEQ ID NO: 1973 - DNA, 600 bp, Bovine  MMBT20297
tggtcttcatatttgcctctgaaatttcagattcagcatcagcaggaaaccatatttgaattctttatctaataatgagaatgaattgtctctttcttctctggttggcttggttatgggtgttgtgagaggtaaggtctgtatcctggctcataacagaattcgtcgtgactgtaagggtatgaaccatctctctatactcagctgtgttgactgaccacaggcccttttagtgtgcaaatgtggatagattttgctcactctgaatgagctgatgttgggcaggtggataacatcayrctacaatgaaatcattckctctctccrtggcctccacaatttcccatttcaaaagaccccctctccttttctatttctaagccccaccatgcatcaagggcttcccaggtggctcagtggtaaagaatccacctgctagtacaggagacacaggtttaatccctggattgaaaagatcccctggagaaggaaatggcaacctactcctgtatttttgcctggagaatcccatggacagaggaacctggtaggctacggtccatggggttgcaaggagtcagacatgactgagcacaaaca

SEQ ID NO: 1974 - DNA, 600 bp, Bovine  MMBT18579
tggcatcaccgactcgatggatgtgagtctgagtgaactttgggagttggtgatggacagggaggcctggcgtgctgcgattcatggtgtcacaaagagtcgaacaatactgagtgaactgaactgaactgaatagatgagctctgggaatgagtaaaagagagttccaagggataacaccaacattacaagtatagaatgctgggaaacttcagggtaccatcccaatgaaagaggaagatctaataaaggaaattaaaaagtgtccagaaagataggaaatgagtagtatgctttaarccaaaagaggaaagaatgcccagaatgaaaatccaaccatgactacctaggcctgatgatggctccattgcttactcactatgtgatgggcgagtaatttaatctctttgtacctcagtttcctcgtccttcaaggggataagagcgtctactttataaagctgaggggaggactaaacgatttaatataagaaaagtgcagagcagggccaaggacaaaacaaatgttttaaatatataaatgttaataaaaagaacaaagtgctacagagaaactactttagatagttgatgaatgcc

SEQ ID NO: 1975 - DNA, 600 bp, Bovine  MMBT19176
gcagtcaccatccacagtgatactggagctgaagaaaataaattctgtcactgtttccatttttttccctatctattttccatgaagcgatgggactggatgctgtgatcttagtttttttgaatgttgagttttaagccagctttttcactctcctccttcacttttatcaagaggctctttggttcctttaggaccataacaaaatcatcttacctcccattatctcccgcgaggtttattgtggtttatcaagtggttacatgcattaatgtgctggctcttttgctaatggrggarttccttgcatggaggggggtgtggttaaggtaatagcaccatttctgaaaacaaaacacaaagccttgtttctctacgggagatgttttcttaggtcaaagagaggcttctcagtcttactagagcttcagagaagctggtggaaggaattctgttgtccagggagacagagtctgttctgagcagctgaaggcatcagggcggaggcccgggtgaggtgtggggaacagactcaggcatggcctttcctcctgagcccctcactccttgcagtggcagattgctactgttgtttggtca

SEQ ID NO: 1976 - DNA, 598 bp, Bovine  MMBT22501
  misc_feature (1)..(32): n is any nucleotide
nnnnnnnnnnnnnnnnnnnnnnnnnnnnnnnngaatttctgcagcagcagctccggatcggcctgtggtccagctctcattgagggtgtgaggggggaagggcaggtaaggccagggtagacaggacccggctcctgcagggtgacactggctatggtttgaatctccaggatccaacaatgccagagggtgtgagggccagaattcagatgcaggctgtccccagatgacccccagccacacttatgttttaaaattatattcttactgtgaaaacatgttgtgaaaacagcatgaggrtgactttccaagaatgtgtttcaattgcctgtrattctccccaggcctgtgcacaataattgcttacaccttttctgtgatcccttctggtctttgtctacattaygcataaattggtcatagctctgatcctcctgtccgtatcactctgtaagcgctctgcctctcctaaatggtgytgcttgtttctacatagcgtgcataattatccatgttaatagctgcatattatgtaggatcatttttaattaacaacagcaccctgggttaacagttcatcgttctgccaagaattact

SEQ ID NO: 1977 - DNA, 600 bp, Bovine  MMBT21697
gagatatgtcatttatatattttttaaaagctgtctaatagaaaagaacactatcttcaaataagatgaaattaacagtgagaatcaggcagcagtatctcccctatctgtgtatatctcaaccgagaacacttgctcgaagcacgcaagaaacaacagctccttcattcaccacacctgggctggggaattccacagtttcacatttacaccaaagacaagagtgaggaactagttctctaaagggaataaagcaacaattcataatgttgyaacagtatcaaaaacatgcaaatacaraagtggggtttaattactcacttcagcctctgcttctatcttgtcctctttcaccattttttctaccattctctcagccaggggcagaaacattgtttttgaaaggttttcatcctgtgctgatatagactggaggagaaagatacatgtttcattctaatttcttccctgtttgcactatttatattatcgccacgcagactattattgtgactctggcccataattaacaaaccactatgtcaaatatcagacctaatttgaatttaccaagaagatacattagagatggtttgcttt

SEQ ID NO: 1978 - DNA, 600 bp, Bovine  MMBT19621
atgcaactgttttcaatagcaagtgaattgagtttaattttgcttttgcagggggaatgatggcttctcagggaatttcaaccttttacaaaacaagtatagcacattcaacaaaaagaatatatacttatatctccttatttgagatttctgtrcatatcattaactccctagctgaaaatttttattttgtaatttcagaatcactgtacatagacgttaactctcatagcttttcagggctttattttcttatttttagagagcacataaaggaataaagatgaaatgaactaaagrtatgtycagagttcgtatcatgctgctgagagttgtacatattacttcttataattcagattaaatgtaaaaaaaaaaaaacttcctcataatgatttctttsatgtaaaaatattgataaaaaaagaagtactggatttcttgctctgaagtcttctaaatataggatttttcttagcaactgtatataaatggccttgttgatgaacaaggaaattactggatcagtccctaaagaaataattcccttgatcacaaaatatgttattacattataatcccaagggattccagatgctc

SEQ ID NO: 1979 - DNA, 600 bp, Bovine  MMBT21088
aacttaccctatctaatccacagcagagaaccaaaagacwtggagaaaaaagcttcttccaaaagagataagacaaaaggatatttaacaccagggttaaaaagttctagtctgaaccaattgtggcaattttcattcctcctgccaatgaatgctttagcaataagcatctgatgcagttctggccagtaagacaagagactaagtttgctgaagagattctgggaaaggttttcctgggctgatgaaaaaagacacccaagtgaaaatacgtatttttttcaggcaactttgggtttraattgttaagcagaactatgacagccatcttaggaccacgagsaaagagaaagtctaagaggacaacccagcagaaaaggagcgactgcactaaccgacggaagacctgggtctgaggtgatgctacttcagttcagtgctcagccgtgtccaactctgcagccccatggactgcagcccatcaggctcctctgtccatgggattctccaggcaagagtactgcagcaggttgccatgccctcctccaggggatctttccaacccagggattgaacccaggtctcctgcattgcaggagg

SEQ ID NO: 1980 - DNA, 600 bp, Bovine  MMBT23245
tgacacaagcttaacatcacaaatgggtattcattgtattgccacggcaataagccctgcattggtgaagaagaggtgactgcctaaacttttktgctctaaatcttgctttaaacacataccacagaaccagaaaacaggaaagttccattaacttggtcacacagagcttccttgtgcttcaaatattgacctaggaccagctcctatagcatcatgccagatgtctgaggtccaagagagcaactgctggagaattattgcactgccatgccttatactaaagcatgaaaagcctarcacatacatacatggagagaacaggtaaatgatacatgtatacacttcgtaaacactaaggtcatcaggaaataaggcagacatcaaattttaaaacaccatatatgccacagccacaggaaatgaagttgagggggctctcagtatacccaaagtggtctccctaaactaaagagcacacatctggaggggttctcatattaaaacaaaaaagtatcaagggaaatcttgctaaattcttgtcatcttaaatgaagtttcctctaaagcttaggtttgtaccatgtcctgaaagggatt

SEQ ID NO: 1981 - DNA, 598 bp, Bovine  MMBT18855
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnnacacttttccattttacattacagctgctgctgttttcatccttcggtcagcgttcaggaagacttgcctggcttcctggggcacttagtcactcctccctctggctggcacagacctgcgctgagccttgcttagaggattatgtcacattctctccccagccagaccttgagttccttgaaggcagaaactgtttcttttcacctttataacccaatgtcgaccactrtgcctgccacaaagtagggattcaataaacactgaattaatgcgagaaggagaaaacctttgataatgtttttgttctgatgtttyctgccatttttatacacctttatgtagacacatgggacttcccagtggtaaagaatccacctgggatgcaggagacacaggtttgatccctgagtcaggatgataccctggagaaggaaatgacaacccctgccagtgttcttgcctgagaaatcccatggacagtggagcctgatgggctatagtccatggggtcacaaaaaagtcagaca

SEQ ID NO: 1982 - DNA, 598 bp, Bovine  MMBT18888
  misc_feature (1)..(20): n is any nucleotide
nnnnnnnnnnnnnnnnnnnntacttacaattgcaggcagattcgatgagtaaacatctgagctaccaaggaaacccttagatataatgttttagcttgcatggagtgtcagtattactatggatggcatacagtcatttacaaaattgtattaaacttcctgtggccggttgcatttttcaaaatcggttgaaatagtatattcagtctcttgtgctcttccaaccccaccctccttacctagtcaaaagatggyatctttgttcctattctttggacctgagtggacttcttgggtgarcttctataactgcacaagaaagtaatgcttttgaagctggctcttaaaaattratacagcttccatctagttcccttactcagagcatatgcctgcggacccctgaagtacaggtgccccgaagtcaccatgctgtggagaccacacagcagacracatgtacgcagagaatgtcagaggaaccccagctgtttcagccccagcartttgaacattcccagactcaatggcaaacgtgctaatgaggaaaacagatgacccctgcatcatccctgcctcacggcaaccaggtgagaga

SEQ ID NO: 1983 - DNA, 600 bp, Bovine  MMBT20993
agagaacactatgggaagagatatgagtgagtctgagagcaagagccagtcccagccggtcaaggggactcgtgagcgcggagcatctgggagctaagaacagcaagtgaggaccagcgtgaagcgaggtgctggaraaggaagggcagagatctgctcattacctgccttggtggaataggagctgagacccagccaaggagagtgaattatcgattcctgtctgcaaatcagtaactgtaaccaaaggaatacgttaggcatattggtaagsagaggatccagaagtcataccaagcrcaatgagggcaagtaatgtttgctccataattatctgctgatcggccaagaggatgaatatgttcttttagctaagcttttctagaagtgtattcatggtgccagcctccatctcctgagcctggtgcttcacatcccctaacaagccccgatgcaggaratgttaaaggtggaggygagattcagggaggtgaagctccacagaccagctccctcccgggttagtggggccatgagacccatctcacaaaagtgtcgaaagggtcgagaagatgaaacatgctgcagcttatgtgattc

SEQ ID NO: 1984 - DNA, 536 bp, Bovine  MMBT21039
tattattgtccttcaatcagatttgtgttttcatattttcataggtttatttctctccgagaaatgtttacattcctttcattagagtatctcacataaaagatggttgaaagtatatttgttaatttttttattccttttaaaatttatcacctaactgaggaaactgcacctagtgttcaataaaatacattatcgagtcacctcatctggtttaaataattaggttaaagtaaaagaagttaagaaatagttgaacataatttgcatttaacataattttctataggggaaacagtrttttattataagaaattaaatttattttgtgtccaagtatttctaagaccaatgagattgcttttaatattttaattaataatggacaatatttattgaacagctgtgatattcttagaactgtcattaatttattacttaaactgtgtcatgtaatcataaaaaacatactgacttctattgacaaataatgtaacaggcatagtgatgtaaataacctagagtttgatgactgt

SEQ ID NO: 1985 - DNA, 600 bp, Bovine  MMBT22104
gcatgtgggatccctgatcctggggaatgcaggatcttcagctgtagcatatgaaatctagttcactgaacagggcgagaacctgggccccctgcattgggagtgcagagtcttwgccactggaccacccaggaagtccctgctctttttgcttaatgttctctgatcaaggaaatagtttccatgcaattcagctttctgttttcttccaatagttkgcttagtttacatgttttcatacaaytggcttggagggagtattttgacacagacattttctcatttatcagaargctctgractaggcagattycaggctctgtggggagtgagttataagaatgtaagagaagaggatttgcctttatttgtggttatggaaatatttctgcaagactttcacaatgaactttgtcctacaccaactcttctctctcgactgatgcttatagaaactttttgagcatggcaaaaaagaaagtcacaggtattccaactcctccattcccacaactctcagacactatcacatacactcccaatccctgcaatataccccaccactgggatataatcttaatttgtaaagttgtcctccat

SEQ ID NO: 1986 - DNA, 600 bp, Bovine  MMBT21444
aatgacacaaaagacttttttctagtttttatcactaacttttgtaaattataactgttacacatagcctaaatgctaatatatcaatttttactttttgaatgaaatttgttcattcattyttctatttagtcaatcaayaaatatttattgaggcactgtgctgaatatatttatggatggtgatttacctcttttcactttaaattatctatatagacaatgagcactgaattatgctacattttacacaaaaggtagggatttgcttccacaacctggcaggaaacctttaagcarggcataaacggtattcacagttttgaattagatcagaaatgctctgctgaaaccaataatttggggtttcatttttctttttatcttctttattcttattccagctataaatcatatcactacccattcattcttctaagacatgggaacatttaagtggaagggttctgtttattctttccccaaaccagtgactaaatttaaataaaatgttctttgagggttgaaggaacatgccatttcttttaaagttgtcaaccctctaaaaaaaagtttcaaaaaggaaagccaaaaggagtg

SEQ ID NO: 1987 - DNA, 598 bp, Bovine  MMBT23103
  misc_feature (1)..(58): n is any nucleotide
nnnnnnnnnnnnnnnnnnnnnnnnnnnnnnnnnnnnnnnnnnnnnnnnnnnnnnnnnnttttatttccccctcctcagtactacagggtacaattctacctttcaagtggatcatacaattaaaatttaattcttaaattaagaggcaatgttaaaagtgttgtattttaaatccacatagaggaaagtcttctaacagattatctaagaacagactcattattatcctagtttatatgaaattgaacatcctttgggcagctaacattacttctctccttgctgtgggctttatgctcrggactcatcttcagtaggaggtttacctgatgagctgaggagtgctgcagcatccggccttggtggagaggttcgcactctggctgggtgagtatggaatgctcatagttattcttcctcattgtcttatgttcatgtgtcttcttaatagacattcatgcagtgatgaggctataaacctcctatgcagatggcagacccctctttgaaggaatatttgcaaaggtccctgcccaattgacagcagtttattccttcctaacacacttatttgcttgccatagagcaatgggaggta

SEQ ID NO: 1988 - DNA, 600 bp, Bovine  MMBT21895
gcggtaagtattagagagaatcaatagccagtcgctagtaacagaagctgtgtgtttrgagctgagtctctatgctaagggctgtgtacatataatctcrtttaacacttgcaacaacacaattagatgctttaatccctaattccattttacaggctaagaagctgaatttagttgggtagtttacccaagataatatgcctattcatctatggaactgggaagcaagcctagaagaaaatagttcctcctgaaggagtcagcagagaagacaaacaatgggcttaggttccaagcaarwcaggtgatagaagtatctgacagtgactataacacaagtaaatgcacaaaataagttattaaaatgagaacaagactacccaaatgatccagatgcatttgacaaagaaccaaatgcaatttctaaaaataaaaaagcatgctcaatgaaataaaaatcccagtgggttaggcacayaaggtcccaattgagctaaagagagttagcggacagatgaagagagaattaatgaactagaagatcaatctaagaaaattatcaagaaagtagcacagaaagattaggaaatagaaatatag

SEQ ID NO: 1989 - DNA, 600 bp, Bovine  MMBT20373
tgaaaactttagcctttagccacatatggtttagcagttttcccagggctcagtaaaagtgtatggaaagttgcatggccttcattttcgacrtgttgattactggttcatcagttgtgacagatgtaccatgtccatgagggtgtragcagctggggagctargagaagcagcgaaaagctacrcgtgagctccttwctttaaactccactctgtttttctgtaaaccaaaatgttccccaaaatagcctatgaactaacacatgaaagtaggaagcaaagacaaaaagtcagatgcyrcagtttggatgttttcagcttgttttctattatttgaagttttaaatgagttgccttgtgaaaagtaggacgttggaaagatttctgcacccttatttttgcttcgtgagctcttaagttatcatcccttaatatgttcagataattgttacttgctttgtaattaaggtgaagggcagacagatgctgtgtcaggaaagaagcaaaggttttcgaagcttcaagctgtggccccagacaagtaacacccctcgagttcctaggagtgctgtctagacttttgtggcactttagaatcca

SEQ ID NO: 1990 - DNA, 598 bp, Bovine  MMBT19415
  misc_feature (1)..(121): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagctgcatagcaacgcccaccgttcaggagtcagcaaggaccaaagaaaaacagcacaagttcaactgaaagagtgaataagcaaaataaagtgaatccacattaaacaagcaagtccctttagtgctccccagcccaggaagcaatagcagaggggaaatgaggtcaactctgcrtatttggaaaaactattccacctgtacttctacagaatgagactaaccaatttgggaacttcagtagcctgtgacacattatctttgccarttgaaattttgtaagtcttgccttttttctctccatcataatttgatagtaggtcagcattatttgatagagatcagcattgttactgaaactaggagcataaagggtgagatttataactcacccatctagattaaaatctgtctaaaggcatgacatggcactgcaggcggtcctgaggaaggagcagatgcgtgtccactccct

SEQ ID NO: 1991 - DNA, 598 bp, Bovine  MMBT19414
  misc_feature (1)..(30): n is any nucleotide
nnnnnnnnnnnnnnnnnnnnnnnnnnnnnnacaagctgcatagcaacgcccaccgttcaggagtcagcaaggaccaaagaaaaacagcacaagttcaactgaaagagtgaataagcaaaataaagtgaatccacattaaacaagcaagtccctttagtgctccccagcccaggaagcaatagcagaggggaaatgaggtcaactctgcrtatttggaaaaactattccacctgtacttctacagaatgagactaaccaatttgggaacttcagtagcctgtgacacattatctttgccarttgaaattttgtaagtcttgccttttttctctccatcataatttgatagtaggtcagcattatttgatagagatcagcattgttactgaaactaggagcataaagggtgagatttataactcacccatctagattaaaatctgtctaaaggcatgacatggcactgcaggcggtcctgaggaaggagcagatgcgtgtccactccctggagaaggtggtggagcagaagactaaagagaatgatgagctgaccaggatctgtgacgacctcatttccaagatgaagagaatctgacgc

SEQ ID NO: 1992 - DNA, 600 bp, Bovine  MMBT23100
agtaaatccctagtgacctactgtttttcttttctagtgaagtttctccaagcataatcctatcacttttgacttgaatgaactagtcactgtctccagatgtgaattatagcaccacatagaggtttaattttctttttgtttaatttgaccttgagcaatcataaaaaggcaatatgagctccagttctaaactttatgcatcttgtaactactccacccagaatgattcccaagagaccttgtgaagtaaaagaaaaaaaattggccaaattttcctmctctacttttattaccccrgatattttggcatctctttcttcctmtcagtcagtgcctctcacactctagtgcacaacctagatggacaaccctatgcatggggagaaacttasaataataaatcccaacatcatcttctggctggattccctgctctaatgcttaccacaatgcctggcacatagttgacagtcatgtggtattggttgtttaaactactaactcaatgaattaatgaacagaactgccacccaaaagaaaaacagagtgcaccttccactgtcatttgtttggagttcaattcagggccagaagaca

SEQ ID NO: 1993 - DNA, 600 bp, Bovine  MMBT18518
caccttgactgcagasggcagttttgggacgtggttaaaattacaaactgagagacttctctggtggcccagtggttaagactccatgtttccaatgcaggggctgcaggttcgatccctcgttagggaactaaaatcctacatgctgtgcagtgctgtcaaaaaataaaataatagtaataataataaaaagactgcaaactgaatttatatcatgcctttactgcttcttaggcagggtactcaacttctctgtgcttcagtttccttgtctgaaaaatgggcatatgatagtacctrtctcatagggtgttgtgttgattaaatgaatcaaatatgcataaatygcttaagacactgtctggcacatagcacatgctgtgtaagcatttgctatgctttggtttcctctctataacctctaccatattatgaagttcytgaaggcaaggatcaaattcttttccactctcctcccaccctacactctgggacccagcacaggacrtgaggcagagaaggagctcagtaagtgtttgctaaatgaataaatgaatgaatatgttttaaatgataacttgtataatccattatagatct

SEQ ID NO: 1994 - DNA, 600 bp, Bovine  MMBT20387
tggtagtatggtattttagattcccaacacatgtaaaatttaggcagattctaatggtatgaatgacttaaagatcattttctgagtgcttctggttcttactcactaggctactgaattgcttctgtgtataatggcaacccactccagtgttctttctgggaaaatcccatggacagaggggcctggagggctatagttcatggggtcgmaaagaaytggacacaactgagtgactgagcatatagtttgagataggaattaatcatatcaaagtccagaagtaggctttaaggcaarggaattaataaacttcaggaccagaagggcccaggatagaccaacaaacattatttcctgtcaagtcttactctaaacycaagctggttctaagagcatacagcatatttttttaagtacttagaagaaaagattcaacaatcacttttagaagccaaattccctgatagctcagttggtaaagaatcttcctagaatgcaggagaccccagttcgaatcttgcatccggaagatctgctggagaaggggtaggctacccactccagtattcttgggcttcccatgtggctcagctggta

SEQ ID NO: 1995 - DNA, 600 bp, Bovine  MMBT19908
tgatggaaaacatggtataaatatagatattttattcaattttcctccaatctgtcacctactgagatgcaaatgcatatcgggactgataattagagatcattagacacacatctgtatttggctgttgcacaggggtaaagatggtggcaggaaccagatgttggggtgggaggatattatctcagttgttggcrgtgggagtctgaaacaagggggcagcaagaaagccacaaacaaaaataatcagagaagataactgaaatgagcgaggctacagaatcaaattggttgagggarcttagtaattaagaacagacctttcactggtaaagtctattacctacagtagcactacatttttgagttttttaaactcttcttgagagagcaaacacaaacacatctatatgcgaaggaaagctgtagtgcgcaggggtatatgyggaagagggtgctgagaaataaaatgaggcttgctagattctattattcttgctagataatcaaagctagattctttcacttcaaaccatcagaaacatttctactttcctttcctgagttcctacacatatttatttcaaaggtgaaaaaaaa

SEQ ID NO: 1996 - DNA, 600 bp, Bovine  MMBT18519
gcctcctctccttcctgtctgtctgtctgtcttcttcgctgtgtctctggcgctcgctgggtccagctgggtgctatgcgagcacagcgacttccggggccgccagtggctggtgggcagctgtgagatcaccaactggctgacatacagcgggacccagcgggtgggctccctctaccccatcaagcaggtgggtatcatggcgggttgagcacatctgggtcagcccgtctggctgtgtgtctgtctgtctgcgcgtgtcccacatttcccaaattcagtgtttatgtactttggtcrtaatttttgtcctactatgattcctcttgaaccgttacgtctttaatattttcctctaaatcaactcacttttttcttttttaacgttatctttatcctaaggaataatgtccataagatcgtgggtttgatgtgtgtgtgtatgatttttccttaatagacactgataaacacattaccattactttttaaacaagaaggcttatccacataagcctgaaaattatctcatgtaccacccattagcgagcacgcctcactttgccacgccgtgtctgtacctatgtttctgtgtgtctg

SEQ ID NO: 1997 - DNA, 570 bp, Bovine  MMBT21460
acaccttccagggggaagttgggcaggaaaaaccagactttgtgtgtacagctgaatattttctctaacttcatcctatgaaaataaaaaattattaaaaaccgatcttcttttaaattaggataataccgcggtttaaaaaatagccttgtcataagtgcttctccctatgaagtgcttctcatagaaaaatatacaaaatatatttacatttataaaaccttaaatagtaaactgtaaacagaaccgagtaaaatccaatgacttaatttaacaggttcaggaaccgtcttggggaaragaagagaagaaacatttgatgctgttttgaccacatcctaaggagtaatcagggcagtagtgtcatttcatttcatttgctttagccacagattttgcacaggtggcagaggtccctcgatacaaggtggtctagtccccaagttttgggccttgaaatctgattagtgttctgccttcaactggacactgaccatttaaaaattaagtcttcctatgtcttaacaaggggaaaataaagttaccatgtcctaggaagggacccagggg

SEQ ID NO: 1998 - DNA, 600 bp, Bovine  MMBT20241
tgctcccctcaaatttcttctcctcattccagccagaacttgggtacacaagcaaaacttctcatctctgcttaaaaccctttgactctggtccctgcctggacttggagaagagtagtgatgctcagagttggctgccatttgaatcaactaggaagctttttgtgtctcctggacataagcttgcatttcaggtgatttggcaatrtgtgtgctgtgtttatgagttgactccccrccckatcaaaggaatgataacagagaagagccttttgtgatgtgtcagatttccagccgacrgtgtcatgtgcaatgcactttcctgtaaatgctaaataaatacttgttgactgatttacaaggtcattttagatctagcttgaatactaagtcaaagtcaggctagaatcattatttatcatatcactatttctgcaaaccttttctcaaggtctggggttggctttcctcttggagccaggtcatatataatattggaaggcttttttttttttttttttttaaacaaaaatcagaatatgtcttactctgaaacttgcacatacagtataatgaatcttcaagcttgtgtcctttcct

SEQ ID NO: 1999 - DNA, 600 bp, Bovine  MMBT20324
ggtctgccattttctggctgtgaaattttggacaagttacttaaccactttaaaccccagctttaagaagtaaattaaccccagtaaattaagaagtaatagcagccacttcgtagagttgttatgaggctcagatgcagtgcaaatgtgtataaagtattcagggagtcacctggtatactataatagacactagaatagttgccaatattatyagcatacaatctgaggattctgtcagccaatcattagcaatctgttgtttgttgggacatgccagtgttctccagttgaaatcartagcaatctaaaaatggatagattattcctcatttaaatagtgtgttcatataagtgattgcttggatccttatcagaagttgctgttactgaaaaatgataaggctgactaaattgtgatagttgtcagttactaaccaactcccagaaatgaataagaggaacctatctctagttcctagtagaaggtatggacaaaatagtaggtgaaaaataatgtcttgaacccccaaattaagtaagcttwaaagagtacaatacctcaaagggtctttgcggtttaaaatttgtatgctgaga

SEQ ID NO: 2000 - DNA, 600 bp, Bovine  MMBT23219
ttcattgttatgagataagaaagaactgaagaactataatatattagaaaaaataaaggaaacatcacagatatgactaataaatgcaacgtgaagtcttagattgactcatggaaaagaaaagggatgtaaatacaaaaactgatgaaatccaattaacctccattgtttagttactagtacttatgtgaatttcttaattctgactattttactatggttatgcaagatgttaatctatgacagaagagacaagaatatacaattgaaaaaaagcagtctctttaataagtggtgccrggaaaactggacagctatatgtaaaaatgaaattagaacattccctaacaccatacacaaaaatgaactcaaaatggattaaagacttaaacgtaaggctggataatataaaacccttataggaaaacataggcagaacactctctaacataaatcgcagcaagatcttttttgactcacctctgagagtaatgaagatagaaacaaaaataaacaaatgggacttaattaaaatttataaagcttttgcaaagcaaaggagaccagagacaaaaatgaggtactatgtcacactggtca

SEQ ID NO: 2001 - DNA, 600 bp, Bovine  MMBT22499
aaatagtcaggctataacagagacagggatagactttaaaagcaaggaagctgagtggccatgtgtgtaacatgtttgtgcccacctggaatcactcaggttaaaaatgaactcagaagttgcagagaaaaakattccttccatgtgacttaargtagtttctctctaagggcagggtcaagattctggcaawaaggaaagggaacagcaagtatgtcaggcaccgtctggggccccatgggatggcacatggttctgccaggaaatttacattttccatttctctctgatacaatcatrcctcccattgcctcctgaagaaatcattatgaagaaattagtcacccaagacctacatgaaaagcagatgtaaaatgcaaataaaccccccaacactgaggctattctcttcgccccaaaagaatgaggaaggttctcaagagttatgggaaacagcacccacttaggccagacacctccacttaaagcaaagccattctgatggtcatccaatgctagaaaacattctaacactgggtgtgtcgcccatgctgcaacaacagaagccccccaaacaagtgccacaactagaggaagccc

SEQ ID NO: 2002 - DNA, 600 bp, Bovine  MMBT19646
tgttataatacctgatgtgttagtactgcttcagctgaaattcctgtcctctgtggacgtggataaatgttccaagcagtgggactgttcccatgcttctgatagtagttctcagatgcccgaggtctttcaaagaaacttgaggctaaagaatcctgatccaagactccacaaccccaatcctagataaaacactgaaatttattaaaaaattaaggtataaacagatgaaagaaaaaaaaggagttcagttctaatgttaattaatattaaagcaaataaaagtatgatgatcagcargtaaaagcaaatgatcagtcgacgggtatttaggttgcttccatgtactagstattgtaaaaactgctgcaatgaacactggggtgcatgtgtgtctttcaatcacggctttcttagggtatgkgcccagtagtggggttgctacygctctccagtagtgggtatttgttgcagtagtggatgatacagtagttcagttcctagtttgccttggctttcaaaagaacacatttgagtcagtcctaatgaggtagatgaacctattatacagagtgaagtcagtcagaaagagaaagacaa

SEQ ID NO: 2003 - DNA, 600 bp, Bovine  MMBT20238
gcacttattctgatgccagcagaattgtgggaagagacttaagagatttgtattttcctgaatctttaatctgcagaagagagcaactacactgaccaagtggcacattattattatttcaataattctttagwtgtacaactaattgaatcttggaaaatatggtgtattcacataaaaattgactcatatgattgcaaaaatgctgattatmacatagatctagaaattatagcaacagaattgayagtaaacaaaaagtaagaccaacaaaaatatcattgatggtgtttctacggrttaataataaaygtactctcaaacttataatttcctttgagggaaaayaatttttactcctttcctcattatggctatctggtggtttgtgacaacaatttcttcttgaaaagtgtctgcaataccagcactcaaaagtcttctcgtcagttttcccggcatctttaaactggacagctccagccctgattatacccaacccttcccacaaacccccatagccctaggccattggcagtgcacattctgttccagcagatgcgaggctgggtggagaaatttgcagtcttaaagaagtac

SEQ ID NO: 2004 - DNA, 525 bp, Bovine  MMBT20702
tgatagtcatgtgaattttctactatcaacaaagagttcctgtctccactaaaaatcatctgctcattctcttgccctaggccatctattatatagacttcggattacagttaaaatattattaaggctacctttagattttcattttcccaaatctaacacaaatattayatttattttctggaagttgaaaaatcttagtataagtagccattttttccayrttatttgtcacttgatgagttctacaaaaagaaagaaagaaagaaaacaagaactacctttattgttatttcattragaatagaaagatcacttttaagttgcatgccattcrgaagcaataatgttggtttcttttatttaaactttaaaatttggtataataaagaatctaattgggacaacaaaagtaaaacatgtaaaaaataagctacattttcctcccaaactctgtgcctcaaccttcctgaagagtgccatcctctcccacctgaaacaatcgatctattttggtttcactca

SEQ ID NO: 2005 - DNA, 370 bp, Bovine  MMBT18840
ggggggacttgcctgccaccaccgcctggggtccttccagtgggcctcttcctggcttgggaggaaaggggtgcagggcaggggctggccgtttgggagatgcccccactgaaggcatgaaacacccagtctgctgcaacccagggctatgagtgaccatgttgccgccctttctcctgcagtcatcctatgccgtgtctctgctgcgggagtgcgtgaagcttcggccctcggaccccaccgtgcccctgatggccgccaaggtctgcatcgggtccctgcattgggtgagtgattccrgtcgcagggcccaggtcctggcagcttcctgcaggagggtggcagcaggtgggtgcgtcttgctgtgtgt

SEQ ID NO: 2006 - DNA, 600 bp, Bovine  MMBT21701
taaagaaggaattaaagacagagaaaatgcttagaagggtgcctgccatgtggtaagtgctttgcaggtgttgggttaccactttttaattgtcagcatcattatcatttatcagctggggaggtacacattttttgagatttttttttttcctatggaataaggcagggaactggggctgaaccccccacacagtggctctttgagggatctgcatgagagaacgcaggagaaaggggcggtctgttggcttgagtgcagcagcctgcccagagggtcctcccttggggagtgggtacragggcggccaggctgcagccccaccctgggggccagctctgcagtcacctctatctcggcgtagctgcccccagcctcaacgtgttccccgtctgccacagtgtacttcaccagcttcccagccgaaggggatctcaggactgtggggtcattctccttctcaaacacgcacgtcttgttgccaatggtgattcggtaactggagagagaaggaggtggtggggacactggagggtaccatctaccaaggtgccggagtcaggcttctgacagtgtcttccctccctaacagcagccagg

SEQ ID NO: 2007 - DNA, 600 bp, Bovine  MMBT23163
tccacgaggttgaagaactggtgcttgtccagctcagtgatacggacacaacgccacgtctcatctcagccccgcagattctagtgacctcgtttttgcgcaccgcttgagagcagtttccggggcaccccaggaagagacccggctgtggctcaagaacacggagggcccttttgagaggttgtgcgacgcctgcgtcacagtgcttgacgcccgctctcgagactgagcaggtggtcgtcatggagacccgaaacaaggatggcgcctggcccagtgcgcggccacaggccacgagcrgagcgtcrgaggagggtgaggacttccaaggccagccgggcatctgtggtctcaccaacctgggcaacacgtgcttcatgaactcggccctgcagtgcctcagcaacgtgccacagctcaccgagtacttcctccaaaaccgctacctagaggagctcaacctcagcaacccgctgggcatgaagggggagattgcagaggcctatgccgacctggtgaagcaggcgtggtccggccaccaccgctccatcgtgccctacgtgttcaagaccaaggtcagccactttgcgtcccagttcc

SEQ ID NO: 2008 - DNA, 600 bp, Bovine  MMBT22838
atcgatatcttgttctgttttcccagtgggaacctgacttctagtgggtaacatagcaaagagctagaagagagtttcttgtaagtaaagtggcaggctgccctcagatgccaggaggtgctctgagctggaaagaagcccrtggcctggcaggcccctaggtgtccagaggagccttgtcacagagcatctgtgggtgggtgtcctacctcacgctgccttgggcatgaaackaacttggttttcagtaggcttcaccyttgagagcacagagagcctggcaaatctgytcatttctcrtcctaatccaagtgttggcactgctgtgcattagacgaagcttcttactygaggaagatcaatacataatattggaacatggtcttggagagagagtttatggacttgtaagaggcgttgaggcttttagcctgttgtatataaaacagatcaagaaaaacaaagcagaatacgggggatgggagggccttttgcttagactgacattaacccagaggtcctaagtacatggagggctgaggcaaggtgatctggagggaacgtgttccgggcagtgggaacagcaagtgcaaaggcccg

SEQ ID NO: 2009 - DNA, 600 bp, Bovine  MMBT20472
tcttcaggctgaaggagtttgaatccatggtagcccaggaaaagaaagagaaggaaaaacaaatggcagccataaagataaacactaaaaatatttcaccttgaaagtttatgcaaatatgtgcaacctcttcaacaacatcttaaagtttgctggggcccaaggacaaattccaggactttagaattgcaaccagaatgaaacaggttagacattaatgacccctttggccgcagtgttttccacagactcatagatagaaacgtggcaaagcacagcttcatcacacaagctstgacrcattccctaggtcagcttgccctttcatctgctctgagcgtcgggatcttgaccatgaccttgagatgagtccagctgattcaggtatatttctgcctacaatctatccaccaatatctaagcttatgtccttttgacarcaatgatataattttttgagaatgattccatccactgctctgtaaataccaaatccagttgactccacagtttttcagactactcagcatccttacatcctcccccatctgtctgggtgtcccaggtagattccaggtggacaggtaaaccaagcccgac

SEQ ID NO: 2010 - DNA, 600 bp, Bovine  MMBT21198
ggcagttccctgtggacccagttatatctttagagatagttcttgtccaaaaatagcaatttccttcttggtgaacgatacaccaccaagatgttctgctttcttgacttcctcataaaaatttccaaatcgccttacaacaattctgaaattacataccctggccaccccaaatacgagacagagtagtataaggggagagagccccagagcagggctgggcatgcttgaaaactcaactggccaagtttccttgttctagctctgcctccctgatgaaatgggcttaatgcaagacarttggaatggcctctcctcctggctccgacctgattgggttctgtaatgctaagtgtgagacctcatctttgcaaagatacggcaaagaccagaagtaaccacacaaacagcaaatatgatagacggccctgctctgtgtgtggacagcaagctcagaagtggctcggggagtccgtggctgccctaggggcgggttgtggacatygcctggcagtttttctgtgcaggtggcatcagtggttaacgacagcccagcctgtcccrtctcctctggagcgctgccctgcacctttctacccc

SEQ ID NO: 2011 - DNA, 600 bp, Bovine  MMBT22903
gttgtgttaaaaacagacctgagcctgtccctcctctgtttacttctacgctgtcgtttatctgtgaggtccagactccttggcgtggcagccaggctccagccttccccctccctcccacacaccttttattctggccaccctggaaggtgcagtcttctcagacacccttctctctcattaggaacagctaaatcctgtgaggaaaatatgttgacacccttctctctgtcccttggctcaacactctgtttaggctgccagtcccactctttctggctcagacacatgcccctcacrctagattttggccttctcatttgtctgcatccgtacaccttcacacccatctctttcaaagccccgtgctctcactggagtggtttcttcrtatctgggctcatctcctgtagagtccaagctatggaagtcagctcttccatctttctcattcatcttggtgtgctttgcaccggccatagagtgccttaagaaatgttggggttgaaaggattgtcagcagtttgctctgggccctgacaatagacgagtcatggttcccaactcacattctcagggaggaggaatggtagacacaca

SEQ ID NO: 2012 - DNA, 600 bp, Bovine  MMBT20451
ccaatgtctagcacaaggcatggcatgtattgggcgcccacaaatttgttgatgtaatgaacacacttagtaatcctcatttaattatactgggggttttcagattggctgttcataaggtgttaattttccctcaaagatgctgattatccttttggaagactgtcttttcagtaatccccagtyctgagtgtagccaatttaatgtcagagtcttctcgcatgagcacattcaattgcactaatactaagtataaaactgaccgacactgacttttgtctgtcctgtctggagcctgrtggagggtatgtgaaaccatgaattgatctgaaagcagcagcagtaggaagaggaaaagagaagagcattggcagccctctgttcttgtcttggaaatcccattttgatttctgatggtaccaggagatgttgacacaggagcatctgtgtggcactggccatgggaatgctgcccaagcacatgaggaaattctcagaaatgtctttgtgatgggaggagagacagttcttagatatctgtgtcccatctgtaggcatagtaactccttacaaattcaacctgataactcagaggccca

SEQ ID NO: 2013 - DNA, 600 bp, Bovine  MMBT21927
ttttaagcttttttttttagataaaactattccacagtatcactaagaatgtgttatgaaaactattcaaagcaaatataaagcagtgttattaagactcagagatattaggttacttwtataaataaagaacattatttacaaacattatttgctttwtcatagcctggctaacctagaaatttacactgtaacattctctaagcaaacttacctctcacaatgaygttggtggacttttttgcagggtttcccacattattattggcaatgcagctgtaagtgccagcatcttctgargtgatggcaggtatggtcaaagttcctccattcaaaacagtcttttcaggcagagtcccaaaggacctgacccatgtgagagaaggtacaggctctcctcctgtcgtracacatactaatgttatggcctctccaggatttacaacaatagggtcatccaccaagagtttaattgacggagacgctaaaagacaaacaaaagaacatgcacctatttagatctactagagctagacttcaacagtatgctttatatttacacaaacaattaaaatgaaatactgttctcttgtgccaaag

SEQ ID NO: 2014 - DNA, 598 bp, Bovine  MMBT20773
  misc_feature (1)..(82): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnaaaagttatttattaatggacatattagccatgtagttcccataaaattgtgccatatggacactttgtccattactcaggcatatttgcaaagcatgtgtccaggatcctttgcaatggctttttgtattcagaaaacygcagacctgggagaaaagaaagatagggggaggagtattaagatgcagagaagtccttgtytctctggggaactagcrtgagaggtgcagacaccagggcgtgcaaactgtggcctgtcataaagcccctttgaatgggaacatggaggagctagagcacctccacctgaggctctcaccccacatttacagatgcttccaggagacttcttccccgaggccctcttcctctctggggagttaccgakccccacccttcaggaaggtgaccaagatgaacaattcccagaaatcaggacagagtgcagggcagccctccctgtgacctaggccttagctgacsttctggagtaacagggyccagagggccaggrtg

SEQ ID NO: 2015 - DNA, 601 bp, Bovine  MMBT21303
  misc_feature (1)..(1): n is any nucleotide
nctgaygatttgcaattttgaaagtagccaaaggtggcaaggaagactccgttggtcatattgacatgtcatgggacactgatgaacttgccagacttttcaatgaaaacaaggagttaccctcatcatctgggtcattatcatatggtcagggagcaatctggtcacctcagacaatgtggactagtctttttttttttttttwaagtatttatttatttgattgcatcaggccttacttgtgayrtgcaaactctttagttacagcttgtgggatagagttcyctgaccagagattgarcccgggccccctgcattgggagcatggagtctcagccattggaccatcagggaaatcccaatgtgggctgatctttaagaccaacacaacaaacctaggagcagtctaattttcagtgtgtcggaatgtggactcaggtttgaattgtaggtgaattgcgaggttatcagtcaatttgttatatcttcattactttgccaactgccttgaggtggggttggagctcaagagaagtagttggatttggtcataagcagagagaacctgactcctgcatccctctttctcactgaatcctac

SEQ ID NO: 2016 - DNA, 600 bp, Bovine  MMBT19112
cgcacagtgaagagctttatcttctatttaaaaactccatggacaaatccatcaagctctttgacaggtaaattaagcagggttccagtttccaaggagcccaactcatattccccttcaggagcttaactggctttaaaacctgcctcagaatttatgcgtctcggtcttcctcatggtcagagccaactcactgggagccacccacagctactgctgtttctcctggatgwggctattcctgtaacaggcagacttttcttcttgaacaacccacccagagggtaagtcattcctttrctgagcttggggaaagctgtggcagttacaaggcacattttggtcactgatggaccgtgacattaaagtcagtaaattccrtttggagacagagattcccagaccttactttcactaggattgargaaatcatagccccwgtccaaaaagaaaaaagaaaaaaagaaactacacaggtctctttcctgaagagtgatattctgaagggagtgggaaggaactaaatcaactaattatgtgtcagatatttattaagcatgtagtgtatgtaggtgcctgagacatgaaaatgaayggtga

SEQ ID NO: 2017 - DNA, 600 bp, Bovine  MMBT19663
cttattcctgaaggctcctaaactggcctcattctatcattagtagaaatgcctgagtccctttcaacctctgcatgatgttctccaggtatcagacaatcacaggtgaaatccttctttctctaacaactgacagccctcttcttggctgagggaggggaccctgtgcttgccttctcccctctcagggccctctgggcaaagcgcactgcccagcggtgggcagaagccccatgcartttggggatgagcctctgctcygtgtgtaacgtgggcagacacctaaccagcaccaccacrygcatycctctgccctatattttgacctcttcctctcatcgctgctraagtcctgtctggggagcacatttcagtttgcaaagtgccctggaaaacaaatatttgcttgggattgtgatcctgctggatgtcaccatgatggggcctagaaactggggagagaggcgggaaacctgggggcggccaggttccacttaccggcacctccactgactgcatggccaggtcgcatggaggcttcagggcccgtggccgcgtggcgtaccagaaggtggtgagcgccgcgaacgcgccgaagcc

SEQ ID NO: 2018 - DNA, 600 bp, Bovine  MMBT22897
gtgccttctgtttacaaatctgcaggcgagcctatttgtcagatgaactcagtgtggagaggagagacttctagttttgtccttctagaagaagaggcagtgtcacttccagaaactgaactgaaaaaccaataaatgatatctcagctgatctagattgtacctgtcattggcttgggacattgagaacttcctgatggctggagacacttaggcaggagtgcagtgaccatgtgtcaaggatattctcatggggactgagcagagagattaaattacgagacttggaggtcctttccrtgtccctgagtctctgcgtgtgtacagggacaaagtgtacgtcaggggaacagcacatggcgagcacacgaggtcccaggatcaggaagaccctctgctcctcacactcagcccttccatgccgaaayccttgtttctaaaaacaagggattaagttcttaggtttaaggaaacacaattgagtggatgctgtcatttgaaatcgagttatgcattatccatgcccgggactccctggcaccctggccaacacagcagacaccactgtcacctgggggcggctgtccagaagtgggcagc

SEQ ID NO: 2019 - DNA, 598 bp, Bovine  MMBT19215
agactctgaatcgctcatgaagctcagacgtgggcccacaataaaaawaaaaataaagacataatatagaaacaaaaaaagcaacagtgtgggaatcaaggaaggtagtccttactttttctggatttatctaggctgtaaattccttgagggctgcaaccaaatctgtcttattcgccattttctcagtagtagacaacagagggctccataaaactttggcgaatgagggaacaagtgaatgatttctgatcagagagatctagggcagaagaagcctctcattggacatgatgttcraaattggtttagaagaacaaattgttcttcacgttggacagtgggatacttgagaccaaacatctgaatgtcctggaaggtgaacatctaaggcgcattcagtcaatgatatttgacttcggaggcaggagtgtagatgaggatggaagatgagatgggaaagataagctggggccagatggtgaaaagtgtggaaggctttttatgaattatttgtagcatcagtctattctagccacctgctgatagcactaaagtgtagaaaagattcccacaatgctaaagcagacttctcttg

SEQ ID NO: 2020 - DNA, 602 bp, Bovine  MMBT22690
  misc_feature (1)..(2): n is any nucleotide
nntatgcatattaactatgtttaatatgaactggaaaagaccctgatgctggggaagattgagggcaggagaagaaggggaccacagaggacgagatggttggatggcatcatcgactcaatggacatgggtttgagcaaactccaggagatggtgaaggacagggaagcctggcatgctgcagtccrtggggtcacagagagtcagacacgattgagcgaatgaacaacaatctgagtcgtctraagaaaagtgaagatttggagtctggctggataccctttccatgggctcttccygtrgacaactctgtctcatgaatcatattccatccagaacctatctcctcccctgtatcctctctcaagttgttgtctgcaaggaggcatggatcttagctatttgaaactacccaattaatgaagaatgttggactctactcaacactaaatctactttataactttttgatgttttttatctggtgtctcaaacttctttaaaaggaaaagaatttcaaccttgaaaatggcatcagtaactactgaggacttttcttgagaacacaaagccacctcttattcataattagtttttcccag

SEQ ID NO: 2021 - DNA, 600 bp, Bovine  MMBT20685
tttctatgcatcagtagcccacattaaaaaaaataaaattaaaaatactcaagctttcacacttagccattttaaaatataaawaactatacagcatsggtgcacattgggaatggaaaggataaccttttcttgcagtccaaacaaatgtcttaatacaactggaataataaaatctaccaaataccaagttattatagacactcttataatttcttcagaaaaatgaattcctggggtccttgatagtcataagctctcagttcctcctctcctcagtcccagtgaaggtctacatartttcaggacaattgtaaaaaccctgagagaaaggaatgctcgttgccgcttggccaatggccatccagatagatgctacatatgtaagtgtgatttattaaaatgattgagtcagaatcttgttttggtctgtttgtttgccactgtggctaggctgggaatctagaaagcatattctttcccctgcactctccctccacctcaggaaaaagagagcagcattatttgtaaagactctggaaagtggttaagcgctaagttccagggcctcagaagcccttagtacagagcaaatgatca

SEQ ID NO: 2022 - DNA, 600 bp, Bovine  MMBT21670
gagaagatgtaatcaatgtgtcaaatgattgtggggggaaaaaaaaaaaaatcccagtgttcccctttagggtggatatgagtcctggttgtagagaggggttcaaacagttcaaaactcctatcaaattccggaggagagaggagaatccaggagttctaattcacacaaatgccatgmagctttcacagggcctccctttcccttccgtctacaggaaagtgagtggtattcaataaccaagttctmaaaccacagctyagtggggaaataaatcagagtccatggaaacggagtcarggagaagtcatgtactctagatcagaacaaagagaagctctggatagaacaagatagggggaacaaaactgcagtaaatatccagacgtgctaaggcaacrctcccagataaaaacaaacaaaactaatcaacccttaagagaaaggaacctggcgtgcagaggaatgataaaacccccactcttaaagaaaacataatccaaagcacaaaacagaattcctcagaaggactttgtgctatgaatcaagttaatgagaacatgcactcagaaaaatatgaactcaaagatgggatgatag

SEQ ID NO: 2023 - DNA, 600 bp, Bovine  MMBT21973
ttatactggccaaactttgaaatgtgctatttatttttacaggagcaggagaactgattcagacacttcaggtatggaccaaattccaccatatttctttgtgatcccttgtatcaagccgtcacctcagggccctggaacagacagagtagctaaaaacaaaggaatcgagccagacattttgaggcattccctttcctgtctttgcttccttctgagagtctgtcctacagaaatggcctcaaagactacattcatgctatctttcaagcagtaggcaccacttkgcttttttctgcrctgatagagttccctagttcccaggatctctaactcacagggcaggagccactcccaagctagctctgcgagcagaatcaaacatgatatggcctgttactcctgctgatttggaagggaagtgatcacagctcaatttcttggtaaatctaaaatctgctagcccctcttttcttcctgcttgtgtctttgtcttctgctctgcggtcaggtgatagaatttaatgttttcttctggcagctttttctttacrtattcccacatctcggggtcattaactggcaacaactgtttgaagt

SEQ ID NO: 2024 - DNA, 600 bp, Bovine  MMBT20095
ctcagagtgaatmctgyttgcacrttagcttttgatwttttagaaacaatcctggtggctcagacaataaagtatctgtccacaatgcaggagatccgggttcaatccctgggttgggaagataccctggagaagggaatggctacccactccagtattcttgcctggagaatcccatggacagaagaacctggctggctacagtccatgggttcgcaaagagtgggacacaaccaagcgactaagcagataaacaaaacaagcattcatagctatgctctaacaacaagtatcaacatratgctgtaaaaactgtggtctaayacattgggagctaataggtaagggctgaccctcctggaagcgagggctgttcttggatgtggaactttcagtactaaaaaactgggaaagtcctgggtaaaccagaactagtttgtcacatgagtcatgaggagaagagatggctaaaagatgctcatatgctcactttgyggagcagaagtttgatagatgctttagaaaagagtaagttggtgaccactaacattaacacagcaactcttagcagtggctgccacttaaggaatgacgtgtcta

SEQ ID NO: 2025 - DNA, 600 bp, Bovine  MMBT21989
ccagtgctgataaactctcataattcactcgaccaggggctgccctgtaaacagtgaaaagatgtaaagagaatccactgctggctgtacttttcatctgcatattggaggattcagtgacttggtagccacaggaatgaaaactagtgactcacaagagctctgcaaatagtgttatttttcatttccctgtggtgttgctattgttctcaattttatggatcacacaagttttcaccagacaaccttgttcttcccccgctgttttgaaaccatcccaagtrtagcccagggctgtcrtctcccattgggtcagtgtgagctcagcccagctcctcaaatccctcggttcctctggtctgtctggagtccctgttggagctttgttgtgggagaggaaggcagagagcccacgccttgcccagacagtctgaggcctggccrtggagcttgcagttccctagacactcagagttggacttggccagccattcctctgttgttacttttcagaggtaataagtgagattaattgcaggccaatctccagaagagaaggtagtcagggccaaatgcagtcacatgtttagaaacctgagg

SEQ ID NO: 2026 - DNA, 600 bp, Bovine  MMBT19703
tatttggccgcactggtcttagttgagatgctcaggatccccgaccttcattgcagcgtgcagggttctttagttgtggcctgtgggatttagctccctgaccagagattgagcctaggccccttgcattgagagcgtgaaggtttagccactggaccactgtggaagtcccaaaaagaactactgtaacacctgggtgggaaatacaccyggaatacgaagcgtgttccactgtgagcctgaggatggaggtggcgtcttttgttggaaggcgtttaatagygccccgtagcccggagryggcaccgtaccrtgcggctctgtgtgcttgtactctgttacctcccaagcgctgacactcaccttcaccaccttcagtctcagcattttattcttagagtctagaatgtcaggcacatttctctcattgcgtgcaaacctccaaattatgctggatcctgggagcagtggggaaaagattgtctggcgccttcatttcagaacccctgtgtggacacacagaggtgcacctccgttcacagtgcacctcgggtgggcgtcttgtggcagaagtaagggggagtttcttagccatcaagg

SEQ ID NO: 2027 - DNA, 600 bp, Bovine  MMBT21223
tcagtttccagtttgtagtccacaggtttttttttttaatgtttcacacctgsagctgctagccagtgaaggaggacgatacctgctttagcacaaaattatgttatacgtgtcattcattcatttcttcattatttattggagaaggaaatggcagcccactccagtattcttgtctggaaaatcctgttggcagaggagcctggcaggctacaatccaaagggccgccaagagtcggacgcgaccgagctgctaagcatactgcctgccactaccgcacgtggccgacagagggagcrcaaggattgctgctgaccccgggttgacacccaggctggctgctctctaccagaccacccygtgcgggtcccctagtggctctagtcagacctgcctggcgaggcctgagagaggtgacaagtcacaggaccagctcctgggcctggctgttccgggggctttgtaaacccaggcccactccgggggggttggcaccacttctgtttgtctgccctctagtctgatggctggctgtccctccctgcccttagccggtcaccgagccgctgagcagagccgtgcgcaggggcctttgccac

SEQ ID NO: 2028 - DNA, 598 bp, Bovine  MMBT20785
  misc_feature (1)..(49): n is any nucleotide
nnnnnnnnnnnnnnnnnnnnnnnnnnnnnnnnnnnnnnnnnnnnnnnnnacatcaaaatggtgttaagaatggaggagggaatgatgctactttgttgcctttctctgattcagagggactggcacccaggaccaagaattgggactggagattcctctgccacctcaaccaaccacatctcagggtaatttatttgatgtctacctccatttctcagacagagaccaaaggtgggcccctctagagagtgagtagtgagcagggcaaatgctgagtattattaacaagtccactgagarcttgaaatcagccaccagtgacgctggttttggtgccaggcaaagcccttgcaagcagtcccactgggctgctgctgttgcgatgggctacaacaccagactcccaccacctacctgattccccttctgcctccccagccaatggcagtgcacttctagcagttgcctctttgcatgaatctgcaccaaaattaaacccatcaactgtcaaccccgttgctggggctgctcccatgtcagcccatgtcatgacaaccgatgatagaagtgctgctattcaggcttcatggggagcatc

SEQ ID NO: 2029 - DNA, 600 bp, Bovine  MMBT18441
aacagtgtccatgagttacctgctccccctggaagcactccctcccttcccacttcctcctccttctcccccaccccaccactaccttcctctcagcctgagcaggtggggcccagtgacccgcccccaggacgcctgtctcctgggcagccgggtgaccctgtcccgccagtgcttggtcatgtcaccaccgagcccgtaatgagagtcaggacggaggatttatgagctcatccaggctccgcgtccgcacccggcagaggtgttttcagaaagcctttcccccacctccttccatcraaagaatggactttctgttctagctactcgtggatgccataaatcctggcatgtgtgtgcgtgcgtgtgtgtatgtgtgcgtacgcgtgcacgcgtgcacatgygggtgcctgcgggcaggacagcccgcacagcttggtggctggacgtgtggctctgaatcagctcaagaaggtgtctgggtgagaaggatgagacctaccactggtcccagcactgggctcaggcctcttctgcgccgagttgcagtagcagaacatggagccgaggggccggactcccaggcttgctccctcctgg

SEQ ID NO: 2030 - DNA, 600 bp, Bovine  MMBT19780
tccttgctacagatattttatargcaatgcttaaaagacatcatttaacactgtattttctattgataggcccaatgctgaaaatttcttggaaactaaaacaatctgcccatttgtttaaaaagcttcagtctttgagggtggatttgatttttgcaaatagccaaatgccactgagagttaaataccatgaacaagacaggtgactacatggggtgaaacagcttttttgcaaagccaaagtgtacctgaagagttatcatctascgtaaactggtcacaaaaagagtcctcaaaatrgccttgggagcaagagcatcactggtatcacgtgacctcctatggcgactgcttaaaaggaaacactcattttcatgcataagatctgatgacggcttaaaaatctggtttcatttctagagcatggctgtaaattaagtccttggaaatgtgtgtcttattttaaaaatagtatgttaaacaaaatatggagtgttygragcatagcagttaccaatccctctttaagcaaagcrctactcattaccttatctgttttgtaattgaactatggccaatgaaatgttracgtttattaac

SEQ ID NO: 2031 - DNA, 437 bp, Bovine  MMBT19894
gatgggtcagtatagccacaggctgctagcctctgggattgatgggacagggcagtagatggaaacactccattatctgagacatgagtgttttcagccaccatccagtccacgaagggatgtggtcaaggtcagggtgcactggatgtgacttcatcctcggggttacattcgcagaggtgtccagccatcgggaattaccttgaatggayggggaaatcggtgtctttcggaatgtggcacgacccaygaggcttcctctctagtttcaatgcgagacctgcctcctcctgaggtgcracgggaagtgggatccctttccagacaaagtaggggaatcgcccctcaggtcgagatcaggaggggagaaggggctcagattaagttgtgcgggaaaactcggtgttcctctcaagtgagacccgtgtgtcggggaa

SEQ ID NO: 2032 - DNA, 600 bp, Bovine  MMBT15670
tctattctaagccaagtccagtggaaaagttggctacaactgtaatctgttatcagattccccctggccactttttattaagatatgaagaataaactgaaagtgatgaggagatggggtctatttaatttgatataaaaaccatagatcattttttaaatgtcactgacatatcaaaggaaattgataaaaatagtgaggacaattttccagatggagagaaacccattttagcacagagaagctcactgtgtccaaacttatcgtgcagaaaggcagcggtagaagatatagctcccrttacaagaaagaggcaaataaccagaaagccaagcaacaccaggaacatttttaagaaaagatgtgctctgtttccctttcctgagagtctcattattagcctctacctgaaaacacatcaccaaaacggaagctcacatcacagttgctgtgcaccacgtgtagccatttgttagtcactcagtcgtatacgactctttgtgaccccatggactgcagcccgccaggctcctctgtccacgggatttcccaggcaagaatactggagtgggttgccattccttcttccagtggacaact

SEQ ID NO: 2033 - DNA, 598 bp, Bovine  MMBT23305
  misc_feature (1)..(147): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatggccctattgtggtcagtaaccccatccctacccccacgggaaaggagagtaagactggcagtctgttctgcctgtagctcttcagggtggctgggtgcctatctcttcctgggatttcataaagatcttgggatgaaagtggcagcrattctgttcttgccattmagtctagaggaccctaagctttaatgtctcatttcctgcctgagaggttcatcaggatgcagagctcagatcacttctttttttggccaattgcagctggaacttyatatcccttttattatcctctcctgctacagaatgagtctcatataaaattataagccatctctcgttggccctatttcaggtcagtgggtatgattttacctgaggcatttgcatttagactgccaaacaccatgaaaccccactaccattctgatcttaatttacaccccca

SEQ ID NO: 2034 - DNA, 600 bp, Bovine  MMBT22088
cattcgagactcctcttggcatggattacttttcacttgggaagatgtgttcatcgacatcacattttctgaagaacatcttaggagggaagtcaaatagggaaactgaataatgcagccacatctgttcattgcacatgcaaaatgctggctggttcgctgattatactcacctctcctccaaagaatctgtatttatgagcccactcaggaaagataacactggcatcttgcctttcaggcaaaagcctgtttgtgctttacttgtaagaaagcacaaggaaagaaatgggscgtcartaacactgcagctgggctctttgaggtgccccaagtcagagagagggaaacaagcattccattcaacactaaaatgcatgkgctgccctccagagcaaagctgcctgtcctcagcattcaccttgataatgttgccacaaacactgaaattttggtggtcgttacacatctctggggtggcaaagcaagaagtcagactgcccagggcaaggccaggtctcccacagagcctggatgagagggaggtcagatggatggtaaatarattggcaagaagaagcctgaggggacttccctggc

SEQ ID NO: 2035 - DNA, 600 bp, Bovine  MMBT19067
tttaccaactgagctattagggaagcccagttgtacctataggccagtctgatgccatgttttggcaacttgtccctgctccaagtattgttatgtagctttggctggtgttccactattttagtccaggaagtagttgaaggcacacacattttggctgcgtgcagattactctgagaatagctctcctgctccaggattgcaacaagcctacaacgcatcttttgaaaaaaatatttcccctttgccatcactggttgagacaggtcaggtctgacattgccaagggaaccacccgarggctttcctcaactctctaatggctgctggcttcatagaattttatccgtaattaaatctattttgtctaatttaagaacagattctggtaaagatttcagtttcagtgtgaaagacaggtagagttctttttagctgcaaacagtttagagctgtataatcttttactctcattttgtttaggtttttccaatttgactttgggcgtttgcttaatctttttgtgtctcaatattttaattttccaaaggagcagccaatttcaaaaacgtttgaaaaagagtatatattgttctaaaa

SEQ ID NO: 2036 - DNA, 600 bp, Bovine  MMBT22299
ccccacctgctgctcgatgcggccaaaaagaaaggattttagtatttgagccatcagaatggctgtatatcagctgaccatcagacctgagatgggagcaagggaatgatacaatcagatttatgctctgaaaagtggctctggtcacagccaatgtttgttcgccaggtattaatagattgatgggttataggattttagaatggatagggacctgggctgatttctttccacacagtttccttctcagactgggcccagccagaaatcacttgcttgcatctggcccctcgttccccrtgactgaatgtatccccagctcccccatgtcgtctgctcttggcccctgcagcccgagctgcctctgcccgagctagctgtctgtgctcggctctgtctggacacgcctgctgtgccttgctcttttctccccttaccagcaggagaactggcaatcttctgggatttaattacaggttccctgagggcttttcagcccttcacaaggctcctgcaggctgtcgctgggagcgtgacaggagcgtgcagtgatgaacagcggctccccggcatggtggctgtacccagtggccagcccac

SEQ ID NO: 2037 - DNA, 600 bp, Bovine  MMBT18967
rgtgaggactgccaaaggtcagccttggagcatgctgccagctccatgggaactaagtgttctctgtgggggctgaagagcatagataatgctggactttagcgttcaagtcagcagggctaagtgtgacttttgtttgataagcttggattttatgtcgttaggagcaaacaaaccataaaatagctgtgtgttttaatgggcattttggagcgcatcccagcttgtggggctctgcccaaggacaagagtgaaggaggcaggcaccgtgggagggggctgctcggcttccatacaccrcccgggctgtgagctgagccacgtggacaaacgtcttcactgcttagagcttccctttccttatctgaaaagtgggacacagccagcctcatttccactctgtcaatcaggaactaccgtaatgacccaaagcctctccacttagaaggctctrtaatgatgaaaacactaacagtgatcatgataaccaacttatcctgacaccacgtgccaggcgagatgctaagagctttattatcttttaaaattatcccagtttatatatgaggaaaatgaagctcaggcaagttcaaaactatg

SEQ ID NO: 2038 - DNA, 600 bp, Bovine  MMBT21902
tcctgacggtcttggcgttgccaaaggcctccagggcggggttggcctggatgatctggtcctccagggtgccctgcggaggtcaagaaggatggcaggtgagaggcctcctcctcctcctccctttctgcggtacaggcccttgraggacagtaggcctaccttgcctgtggcctgctcctttttgctgcggtcgccaatggcggcaatgaccgcgaagtattggatgactctcttggtgttgaccgtcttccctgccccggattctccgctgttgggacagtcgggcttattaggcartgaacaaacattatttgagaccacaagcytcgagtcaggagagctttatttggcagggggagccctgcagcaggaagccaccrgataatatgcatcccagccacaaagctgtgctctgacatacacagggtcaagggtagcaactaggaaagatgtgctagaagaagcggatttgggcaggtgggagacctgaatttgatctttgagttgggaagatcccctggaggaaggtatggcaacccactccagtattcttgcctggagaatccccatggacagaagagcctggtgggctacagt

SEQ ID NO: 2039 - DNA, 600 bp, Bovine  MMBT18949
ctaaagccatgtaacttccactaccatcagaagccttcacatactgaaatttaaactgaaataaacgtcctggtatttaaaaacgaaaaagatacacaccaccacaatatgaagcaaaagttataagaagctcgtaaatacttttgtttctgctttttatacctcagtcaaaggtgatgagtttcttaaaaaaaaaaaaaaaaaaaccaaaaacccttgaagtttggattttccagttttgcatcacatcctgcttcaggccaccctaaaacaaaacaagaaatgaacaaacaaaacccrccatccttccaatgcattctctgaggtctgcagcttgaaggccactggttttccctttggctcagttctcgtgtttgcctcttctttgccaatatgtttatcttcctcactttcaaactgcatttcccgtccagaaacactacctcaagcattatatttagcacttcgcacagaattcctcctgctgcatcaggaaacagagccctgtaagtggagggtgggatcccagggtcaaggtgtttcctggataacagctccatctgagctctgtccaaacttccaactcccttgccgtccact

SEQ ID NO: 2040 - DNA, 600 bp, Bovine  MMBT19328
tcaccacaagctttaggaacccccttamcctgatcaattcatctaagagactctgggggaaaagaatccccatctgcactcaggtgacatttcagatagcttgaaccccacctgccatgtaccttcaccaagggtgtgcatgtgtgttgaggaatgcttttgctaagaccacatatgaaagcacatcagagacctgtcagttccctctgcttgtacctcaacagtgccgctgagagttgacaacgcatgttctacttcctccacgatatatgcctccaccaccatcaggagtgaaggcargtggtagaaaccatccatcaaggatggaaccatctccccttcctctctggaggctctcagcaacttgcttattagcccctttctcagaagaggcagtcaataaataaaatgaaattygaaaccaaaattatgaacatttacacctcatttttttttctagcagctrgaactttcagggaataaaattatatatcttctgattagtgattaataaaagacaagtcacaattctttactgcattaaaaattgcactttaaaatgcaaaatcagtcaactctctcacttagggagcagagggg

SEQ ID NO: 2041 - DNA, 598 bp, Bovine  MMBT20196
  misc_feature (1)..(53): n is any nucleotide
nnnnnnnnnnnnnnnnnnnnnnnnnnnnnnnnnnnnnnnnnnnnnnnnnnnnngggataaacgcttgcctgctgcccgggcccagctcagaccctgctcactcctgtgtgtccagggggagactgaatgtgcttgcaaacgtcatcaggaaggagctggagcaaattttctgtcagttcgactcaaagctggaggcagctgatgaggtaagacatcttatttcttttagaaactagcatagctccaacctatgccagatcctggcttcatttatttctccagaaggacttatggggtccrggatcctctataccactcacaaaaaaagaaagtggccagtggctgacctcccagagaaaagagagacaagaggcctggcagcccccacagttttccccgccaggggtagggatgtggtcctctagttgagggacctgcttgtaccgtgggtggagccattctggaaaaagcctttccatccttctaggaatgagcgttctgggtgtagaaataacacaagacagggctgtcasagagagtaagtgtctccctgcctaggtaaaagcctaactgtttgtgccggcagggttctggagat

SEQ ID NO: 2042 - DNA, 600 bp, Bovine  MMBT21945
ttgcagtaaatgtgaaatctggtattattaacaaatattaagaacaagatagcagagtaattaaaattgcttccaggaaattttaattccctttggctttaaaacatggcagggaaaagcaatctggttactgaaggataacatcttttgcaaaggagatagttgcaaatcttgaaagcaagaccacctcagaagttttgaaaacacaaagccattaaagaaattgcccataattctgagtgaccatcacaatcctgattattatggaatgaatgtatgccttctcccaaaactgatacrttgaaaccttactcctcatgtgatggtatttaggaggtgggactttgggatttgataggattcaatgaggtcatgaggatggagcccatcatgactgggattaggacacttataatgacatgggagcttgctccctctgcttggcttccaatcatatgaggaagatacaatgagaagtcagcagtctacaaccaggaagagcactctcaccagaatctgacaatgctggcaccctgaccatggctttgcagaccacagaacggtgagaaataaatttttgttggttataagccacgtgat

SEQ ID NO: 2043 - DNA, 600 bp, Bovine  MMBT15375
tccaggccctctcttgtctttcttttcttttttcttcctccgacttctttcacacttttcttaggactcatggactaggcattcccactgtgccacatttttctaaatctttataaccacaatgaaaggctgcttagtaaaggaaaaccaatgggacaagatattgattctcaaataggaaacgagacctctgaatatcaaaatcaaatatctcacacaaatatcaaatatggttttttcaagttattttatgactagaagaaaattgcattaaatgtatagaaaggctscagtmattarttaataccatcttttcaatatsgtaattgaatggaggaagggcagacttttcaacaaatagtactggatccatcatgaaaaaaactcacacattatacaaaaattaacactaagtggattatagattaatgtagaacatcaaactgtatgtttttagaaaaaatacagataatatttggatctaggactaggcaatgggctcttagacttgataccaaaagcacaagcaatgaaagaagaaattgatacattggacctcatcaaaattcaaagcttttgccctcagaacagtgctgttaa

SEQ ID NO: 2044 - DNA, 600 bp, Bovine  MMBT21920
tctttcatgggaaagggagaatgaacataccacaattgttttttgataaacttgagatgggggccatcagtgaaatatagctggactgaacaaaatggttttgccaggggataagaaaatgataagggaggacacatggagagtgaagcttattcatttatctgaattttcctgagagaagctaaatttcagcaagttgttttgttttcaaaacatctgcccaatttkgttcttctgtgtttcttacaatcattttgatagcactgcttctgggtttgcatatatggaactgattatttrtctcagtgggagtgggtacatttaaatttcttcccrgctatggagaaaaaaaaataatgagctgctttatgatggtacaaagaggggtcaaagagatccaaatattagagagaatcatttccaaacacatcgtgattgctatttcttaaatagcagggtgatacttattttaatgctgtttaaatgcatcaggattcttccatactgttctgtgtacatgtatttatgggaatgtctacattctgtgcataatgcatagaattttgagctaaacatgtttcatttttacatagttatata

SEQ ID NO: 2045 - DNA, 600 bp, Bovine  MMBT21608
gagggaatggctgcccactccagtattcttgcctggagaatcccatggacagaggagcctgggaggttacagtccgtggggttgcagagtcagacacaactggggcaacttcgcatgcgaatgtgcatggtagcaccttgttttgtggaaaactatttggtcaaataatctaggctacaacacaactgtaattattctagaaagtaagatttctcagtcagcaatgttaaattcttcattctaatctaatgacccaatctgctatattctgcttcctatactgtgttattctgcttcctrtactgtgttatgcttcccatgaaacaaaaatgtctcccactaatgagaaaataggaaaataaaatgggtgtatgttatttgcttttgatttacggggttataatctccaggtcagtgactaattcttttgtgacttctcaaaaatggacaggacatttcagagctcttagtaaatctgtaatcayagaattgatttttgacaagacttgctctgtacagccaagctcttacaaagggacaagataaacttgtaaatcatttatccaagcaccaaggattgtaactatctccaaattctca

SEQ ID NO: 2046 - DNA, 600 bp, Bovine  MMBT18682
gattgatttgcctaaaggaaatgttttctcataaccagatttgattactatttattttttccatttaatcaataaggtcagttaaaataatcaatgtaatttagtcaagtaaagccagctataatttcagttcattttctgatttaaaaaattaataataataattcattcctacttaagattggagaaatgcttttataaatgcttgatataaaaataaaacatgtactgcagttgaaagtaagaaaaggaataagtaaacatgcatttcatgaattaggaaaaagatttttaagtccragtttagtttgagttctaactcttatacttagatgtgtaatctgaggcacaatactgaattgtccagcctcaattcctcattcctccaattataaaatgaggacaatggtaaccaccatgtaggatggtcacgaggaatctggatatgtatcatgtgtataaactcatcatatcatatcttacagttagtaagcaaatgaaagttatcacttcagtatagacagggtaaatcatggatgacactgaagacccacacctaacaaatttttgcacccaaatgttaccagagtctaatgattt

SEQ ID NO: 2047 - DNA, 598 bp, Bovine  MMBT18612
  misc_feature (1)..(55): n is any nucleotide
nnnnnnnnnnnnnnnnnnnnnnnnnnnnnnnnnnnnnnnnnnnnnnnnnnnnnnncttgttatcagtagttatcttgacccttatcatattattaaaaccagcttttcctctttttgttttcctcggataataatatgattctctaatttgcgcatactctatgtatgtttgttatttctcattatttagggacctcctggcttacccggtctcaaaggtgaccctggctccaagggtgaaaaggtgagartaaaataatgtattattacactgttgctatcctaattgcagaggctacrattatgcacattaaaatcactcaaaaggaaatttcaaggaattgctttgtcattctaaccaaggaaaatgctgtcaatccttagcttccaagaggaattcagaaaagagaaaakaatgatgaaaaatgtaccagaactcagtgytatawtagtcaatgttcctttgtaggaaccatatggagaaagcatatggttatactaaaataactattcagaaaataaacagaataacaaagtgcccattttttcatgtttttaaacatgaaaataaaaattttaaactagactgtccttcaga

SEQ ID NO: 2048 - DNA, 600 bp, Bovine  MMBT19803
atatgtaaataccaagatatgtaagtatttaaatatcagaaaagatttcacatagaagtagargatatccataatgcaacttactatctgcctaatactacagcacaatccaaaaagttagtgctacctgtcagttggaaatgcccaagaaataagcctttccccaccacactgaagaagcctgagcaggtctagcctgagtagcctggtctctgtcaagagatttccacagcagaagacagaattcaatcagaattcttcctggaaaagcccagtttgcctctaggccatcttaattcrgatgaaactgaactatgatttaaaaagaaaaacacaaatatttatagagttccctactgttatggagctgtcctgattgctacagggaatagaagatgtttttacaagcgctctatattttttaaaagaaattcatgttcacacaaaaatttacaagtaaattayaggaaagttagaaagccattgcaatagggaaaagtgatgaaggcccagcgtaggatagtaaaataggaatggtgactggggctttgaaagacacctaagaaccagattagtcttagtaaataaatgcatttagag

SEQ ID NO: 2049 - DNA, 600 bp, Bovine  MMBT19804
tgcaacaaaattaacaaaatgaggaaaactggcaaaagcactaagagaaaatatgggctgtaataagaataacaaaaggagtggggcagggtgggggctggagatgcattgggtctgactgaatcagaaaagatttcctgaagaggggacatttacgctaaaatctaaaaacgatgcaatgcttagattgacaggcatttggggaatatgatcctctgaagcagtaaagagcttgccttgttaaggagttgaaacaagaccaggatggctgaggcctagcagacaggccatgawaaaacrtgagggtttttcctagagcattgagaagcaattgaagatagttagagaaatgatttacatggcctagttacatctggtatatttttcttagttcctaaagcaaagtaattaaatattgctaacttaaattttatttgccctgaagttttccatgatgcatttgaaataaagttttcaccaaccttcattgtttgaacatgttaatgctacagcgaaacttgatttgcttgactgtcttccaaagatcagtccttactgatctctcataaaactcagaaccacttaagcatcctagctcaa

SEQ ID NO: 2050 - DNA, 601 bp, Bovine  MMBT23087
  misc_feature (1)..(1): n is any nucleotide
naagtccctttaaggtatcttcacctttttttaattcttgtttctttttgttgctctgattggataagtcccattgctgtatttgagttcactaatcttttcttctgcttcatgtatcagatgttgagccccgctattgtatttttcagtttcattactaaatttttcaggtctgtagtttctgtttggtactttcttacattttctacctctgttgaaattctcaatttgttgatccattgttctcctgagtttagtgagcatctttacgatcattrttttgaactctttatagagtaartcacttatgtcagtttcattaaggtctttttctgaggcttcatcttgttcttttatttggaacatatccctatttcttcattttccttgattctctgtgttggtttctatgcattaggtaaaatctacgcctttccaagacttgaaggagcagtcctgccctgctcttggttgtgtcttgaacatatgattgtccaagcagcctactttattcttagtgcctccaaggaggtgagcgtgtgccagacctgtcactgtccccaagagggcagatcttagcacctggattcaggctgattag

SEQ ID NO: 2051 - DNA, 600 bp, Bovine  MMBT21630
aacaaatatgccactctggtggggcgtgctgaccacaggaaaggctacgtctgtagggaagcagggagtatatggggaatcgctgtaccgtcctctcaattttgctggaaagcaatcttaaacatttttggaaaccaccaagaaaagtaaattgttccaagtttattctcagagtgcttagaaaagagcctgaaaaattaagcctgaagtagaatgaatactcattgcttgtatttcaaatgtgaagacagaaaagcatggtatagcagaaagtccagctttcaaacaagaaytgttgtrtctgtgacagagctccaatctaattatgccctagccactgatttttctatcaccacttcccctttgtttcagagacagcatccacgaccttctgtccatgtggtggaggaagaaattgcttcccagaaaggcttagcccactgcattttactagataaagaaaaaacaaaaagccattcgactctgacaagccgattattgtctatggaggagtaaaatgcctcccttaggactgcaaggtacaatatgttcaaacctttaaccactgctctgccatgagctgctatacgtgctcataca

SEQ ID NO: 2052 - DNA, 600 bp, Bovine  MMBT20455
tttkggggaatccrtgaactattatggaccacctcacctgagaattgcacttacacacaaaatttggcttctatgaagtcagaaaatactctgtgatgagatggatcccaggaaatgaatgcttgctctgacccagttcctgctgattgcattcaaaggacagtcaaacttatcttccttcaygatctcgcctttattgcttcagatactcaaatggcttgaccttctaaaatatggtattcgactcctgtctttggttagtaaaggatttttctaatattaatttagttacttactgcrtcatccatatcttggcattgtttctataccttaggtcacagggaattaatttaatccttcttctatgtgatgtctcttcccatatgtaaagacatctatgacaaacycagctgcttccatctctcttcttaaaatgagcatccctcagatctctcatctttctctgactcagtagttacttgtcaacatccctcttaaaaatcgggacctacgcttgatcacagcattctaggtaggttttgacagtgtaaagtgaagtatgattctgtcatctcttatgtgagacatataatgtcttaa

SEQ ID NO: 2053 - DNA, 600 bp, Bovine  MMBT21644
atgctattttccccatttaattatgtgtgcatttataattaattatgagtatcaattgaaaatatcaaaatctctcagatcagatatcatctctatgaagaaagktgggttgycatttgtttatgaagtggtagtgcactaatgcatataaatatatttataccttttccctgaagaaatcccttatactggactgtgaactttacccttaaaggagtgatatttttactcatctttgtatttacagcattgagcacagcgtctgacacggtacattttacagacaagataactgaaggraagtaagaaggaaagaagtgagagaagcaggaggggaagtggttgagtgggagggtgggtcttctgaagacgagtgagctaaatttcatttttgaagcagtattttcaatatgaatagcataaatattcccacgaacacttggttagtagaatctttaattcagtgcaaaaccaagaaccaagtgatcttgaggtttattcataggtaaggtaagttgaagagcaaatttttttgtttttgcagttaaagacaactctgtggtaaaaaagattcaggagcttcaggaagcgtgaaggaga

SEQ ID NO: 2054 - DNA, 600 bp, Bovine  MMBT21540
gtggtgtaagacctgcaaattagaacrctaagtctttccctgacatctagtgtcaatgtgtgaaataacagaccaggaaccagccacwcttgagaatgaagatactcatcacggagcactccttaagggttggctcttggccccagccctgaaggatccatcaagaagcagctggcagcttcacacctcacaggtagccctaagacagaaggatcgaggtgggatccraaacatggaatgcattaatttccttcttgtraaatatgcctgactgacccaagactgacatagcatcctttrggtttacttatcttctggctggaaaaaaaaaaaaaaatcagaaattatggcttcggtcttcataaactgttttcttattgcaggtcattttactctgagtcctctccaactcattctctaccttcacctgacctttttactcttaatttctctgctatatggaatttttacacaatgtacaatataggtcaacggatgtcaatggagaaaaagatgggtgggaatagtttctgacttctgtttcttgacacttgctatctagcaccaggaatgatgtactgtattttttagcagagggat

SEQ ID NO: 2055 - DNA, 600 bp, Bovine  MMBT21565
aatacaggcatattttagaccacctgcggactctaatctacgcaaatttatttggtacaaactcccttctacgtcaccttattcagtttaattccagagaggtttactgctaaggttgagcagccttaataagagaacagctgctctcatgggggctgccctgaaaggaaaaagaaaaaaatgagcttttgttagcttcttccctgtgaattcactgccatgaatgtgtatacctttcagacggaatagtcaccttgagcagtagagtatgtcctatgtctgattcaagtccatccttcrgccrgtgattcacctataaatgtcttgactcaaagaattaggttaaaaagtatgttaacatgtaaagattctcaacagtaactgatctgaacttaactgcaataaaaacaaygtagaaatagacaaggagataactttggtagaagagtaattttcaaggtttgctcttaaatattaaatagatgcatatgttttattggcttctatagaaagaattcagattgttttaaattttagtttatttcccttgttgagaatcttataattgaagaaagtgatattatactccatgcratctgc

SEQ ID NO: 2056 - DNA, 600 bp, Bovine  MMBT21518
gtgactctgtgtctcctgctttggcacgtgggttctttaccattagtgccacttgtgaagctcttcaaattatataatttaggtaaagatttaattaatataggtaaagatttaattaatataagtaaagttcttaacacaatacccagctcatagtggttctcaataaattactggggtgttttttatctatttttttcattaccatcatcaccatcaagatacacrtttgattacatgtttgactttcacaaaagcaattcatggagtgatccaagccaagtcaatacttcataagarttacaaagggaatcctcactccctgtattgctcaatatttgccctgcttccagtctcatggctggatcaatgaggcacaaagaggtgagccttaccctcagcaacatagtacgcagcaaacccggtgaaacgctcctcgttggagaagtccgaccggaagatcacctgcaatttactgtatgggatgtggaactctttcaccactggggagtttgaattcttgttggtcctccgtccacagagtttcccttcttcatggcctcccgacattatctaagagaagagtcaaaagaacccagg

SEQ ID NO: 2057 - DNA, 600 bp, Bovine  MMBT22953
tgccaaaaaatgcacattacaaaaaaaaaaaaaaaagataatgagataatttagaagaaaaaaaaactttgtctactaaggagaaaagaccctgtatgggactcagactgaacaggatcttcatggtagagtaggccagccatttggggtagaatgtaaagttgttcattaacctctcagtattatcattcggtgatcctggaaagatgacaacaataacagaactgaatcactgggggcacaaatagttctgctttgtaacctctttttacacagttctgacatgcccaagggaataarttttcctattttcctaagagagaagtaaaaaccacagaagcagtcagagatgaygatgaactyagaggagtgactgcaaagggaatgacttccctaaggtggtcagaggtcaataagactggtcaaggaaaacagcagttcacacagcagaccacagcaggtggattggtgcagaataggaggaacacagacaaaaaggcacagacatgttaagggaaaactaggtcagtgatgtataggccactaggcagtaatttagacttttgtgcgacactttactttggggattcctagggtcac

SEQ ID NO: 2058 - DNA, 600 bp, Bovine  MMBT21352
ttgttttctcttaatctagctaaggcatatccaaaataaaatgtaaagaagaaaaataaaaattgtcttcatggaagcaactggtcttccttggttgtactgagttatagttacgctggggtgaaataattgatgctgctcaatgagaaaaccaagtgccctcagaacaggttgatgtggcagacactgttgtttgcccttcttgcgaatcaggtagttagcttttgactctgtttagttcttgatttctaatactgacatgccattctgatcatttggcaaaattgaaaatcctttccrtgtttygacaatctggaaaaggtggccattttaatgtagtaaaggaagctgtggggttaatttcactctgatgatgacaatactctgatagcatttaatatcagtgctccttcacaaaactcaatgtccataaaagtacagagttaaaaaaaaagactcctgctgccttccttaaaggcctgttgtgacagtcccccggcccatttctttccctctgtgtccctcgatcgttgtttgtgggacttttcccctgagaaggcatttgtttcgattcacaggtagtgtctgtgataaaataga

SEQ ID NO: 2059 - DNA, 600 bp, Bovine  MMBT21554
aaacaaggcaaatgatttggcttttcatgagtcaatacatgttaccaatactgcctagttgttgattacaagagaagtcagtatggagcttaaagtaactcaggaattggcctctgtgaatagactccgtgcaacaactcccaataagataattttttttaagagaaaagacttttaaagaacttgagaaaacatcagtgctaactgaagtggtgtctgcaaagatgtgttgtaacttaatggtggtaagggcatatggagtagaaaatggtttactgggcaaatttacaaagcttgtrraagtataaaatgtttaaaatcaatctttatgcattacatgattcatcagcaggtattctgggggaactatttgaatctgtcatgttactgaactagttaagtcagtggtgaatttcatttactcttgcagttttaactatcattacttccagtaagtttttgctaggaatggaaactgaatatcctgacttgcccagctacacagcagtttgatatttgtaggaaagttttattgcaatttttttttagctcagaaccaacactgaattttctctgaataggtatcatttttacctatta

SEQ ID NO: 2060 - DNA, 600 bp, Bovine  MMBT20694
taccatttcacttgctgcatcattttataattacctatttctgtctccctgcttgaagacagggactcctatttgtctccaaattccaagcaccttctcagtgctgggcagaaggctgacaaaaaaacagtgtttaatttaacaaatgactatgctaactggcagttcagcttctccaataagtcatcagttacagcatttttttctctaaacgcatcctaaagtatcttatattgaatagaatttacaagttaaaggacaaaaaaattaataatttgcctaacaagtctttggatggtrtgcacctaatggaatcagtaatcttcatactcctttggcaaatctataaacactttaaaattttcaaattataatataaaatatgaaaatgatctgttggagatgatcaaatccactgagctggacagagtaatatgtcagcacctctgctcacatctacagcctggagctttgtgaaggtaagcagcaccttcatcattctggcattctattttagtctaagtctacatcagaagcctgccagggctcagtgctgataacaaagcactatcgcttttcaaagtgacagagcacagtgac

SEQ ID NO: 2061 - DNA, 600 bp, Bovine  MMBT21555
aaaacaaggcaaatgatttggcttttcatgagtcaatacatgttaccaatactgcctagttgttgattacaagagaagtcagtatggagcttaaagtaactcaggaattggcctctgtgaatagactccgtgcaacaactcccaataagataattttttttaagagaaaagacttttaaagaacttgagaaaacatcagtgctaactgaagtggtgtctgcaaagatgtgttgtaacttaatggtggtaagggcatatggagtagaaaatggtttactgggcaaatttacaaagcttgtrraagtataaaatgtttaaaatcaatctttatgcattacatgattcatcagcaggtattctgggggaactatttgaatctgtcatgttactgaactagttaagtcagtggtgaatttcatttactcttgcagttttaactatcattacttccagtaagtttttgctaggaatggaaactgaatatcctgacttgcccagctacacagcagtttgatatttgtaggaaagttttattgcaatttttttttagctcagaaccaacactgaattttctctgaataggtatcatttttacctatt

SEQ ID NO: 2062 - DNA, 600 bp, Bovine  MMBT20080
ccaaacatcaacacgaatcagccataggtataatgggtgatggtccctcccacttacagctccctcccacctcccttcccatcccaccactctaggggtttgagttccctgaatcatacagcaaattaccattggctatctattttgcatatggtaatgtattagaaaactgaagtacagagaggctaagcaatttacccaaggtaccacagccagtaagacatgcggctgtcatgggatgtggcagtctgattccagaacctgtcccttcaacactgtgattattagggagtggagtargatttgttttactacaaaccagttgtacatagatagtagtaggctactattttcaactgtttaattctttaattcactgtgtctcaaagtaaatgtttgggtctccaatatgattcatctgagtggtgttttttgtttgccttttcagcacatgctctccaaagtgggaatgtgggactttgacattttcttgtttgatcgcttgacaaacggtaagtcacccaaaagaattttcactaaaatacacaccataaaatgggattaattttgtgaaaaacaaaatttatttttaaacactgt

SEQ ID NO: 2063 - DNA, 601 bp, Bovine  MMBT22816
  misc_feature (1)..(1): n is any nucleotide
ncttgaaagtaaaaagacggaatgtttcatgtcgttatttgcaaagcaacygaacaaaaggtgagcaagataattaagtgccttgstgctgagtagaatttttcaaagtgggttgattagaggtctttcttaaaaaaaaaaaawttaaacatctaagtctaggaaatctagttgaaacagctaactcagttataaaggtggagaccagtttgggagaaaatcgacagtattgtgtgtatggtggcakatgttcacaatgatgagtttaattgtcagcaaaatcctgatcagttctgaatarttttagcattaatgatattttcctgtgttttaggtttttgaaaaatgggaatccaagcagacttaacatgtgatggcactaaatagattattttccagtgccttggttcctccatttttcagttgatctggataaataggacttgattcttttattttcccttttgcctgaaaaaataccaaaagcgagtattatcagtcttattataaaatgttatttgtaactgccaggcgaaaatgggatgtcatttcttatatctgcattttgtgtttcaagacatttctgatgataacatgagga

SEQ ID NO: 2064 - DNA, 589 bp, Bovine  MMBT21549
cactttacamagagaggtaggtacaaatggcaagttgctgtatctgtgtaatactcagacgtggtcctcacccattccccagagcccactcttcattcctgtataaacagagtggtttcaacaggatcttagagtatgcctcagtatttaccatttgcaaatatggaatctattaaatcacgtcttcagttcaataaacatctactttgtgtacatcactgtgttaagctaaagaagagttagacagctgagggtaatggccctgttccctaacacagtaaggargacataatttagaarcttttgtttaacatgaaaaactaaccataaatccataaaaaaatagaatatcagggatgaagtgtcatgactgctaattttttaatggcttaggaaaagacaacaraaggatgaagtattaatagatgtgataaaatgtcagtggctgattctagatcatatttgggtatatagtttttcttttctgtatatttgaaagtttatgtaataaaatttaaaaaagggaaaaaagacttaaccataaagagcattataaaactctacaaaagatcatttcaagggtatatag

SEQ ID NO: 2065 - DNA, 600 bp, Bovine  MMBT21536
gaaacttagggagaagtaatatgcccacaatcacaccactagttagcataggagctaggacttgggactatttagtctgaccccagagcaggtacactatactattctatatcataaataatggattcatttaaaataacttattaatttaatatgactgatgtgattcagtactataggcctttgacaaaagaaatcagaaagacygctttaaatcatttgagagcaaaaaaagaccaaattattcattctttttagaatgaccgcacatgtacatcatagcttaatgataaaataatraaaattatttcataaggaatcataatctgaaatattaatactataaaatgctatgtaatatactaattctattaaaaatatatttataatcaccaaacttattcccagcctttttgaaaaaacagttgtcttccatccaaacccataaaatcccacaaatccrtaatatttgtgtaactggggtcatattttgaaaataacttacgtgattttttttttctcctctgcctgcctggggaakcagttggccttggggatagagaatgtggcactcttcagagttaccaaagtgatgggaaa

SEQ ID NO: 2066 - DNA, 483 bp, Bovine  MMBT21548
acagagtggtttcaacaggatcttagagtatgcctcagtatttaccatttgcaaatatggaatctattaaatcacgtcttcagttcaataaacatctactttgtgtacatcactgtgttaagctaaagaagagttagacagctgagggtaatggccctgttccctaacacagtaaggargacataatttagaarcttttgtttaacatgaaaaactaaccataaatccataaaaaaatagaatatcagggatgaagtgtcatgactgctaattttttaatggcttaggaaaagacaacaraaggatgaagtattaatagatgtgataaaatgtcagtggctgattctagatcatatttgggtatatagtttttcttttctgtatatttgaaagtttatgtaataaaatttaaaaaagggaaaaaagacttaaccataaagagcattataaaactctacaaaagatcatttcaagggtatatag

SEQ ID NO: 2067 - DNA, 584 bp, Bovine  MMBT19886
ggaagcttagagctaaattacagtaaccacctccaggtgcatggaaacacttgtttatctatttctgttagctggtctttgttctattctttttcacaaaggctttgcaggagtagttgattgatagacgctaaataaatgtagcattatagcatgttctccttgacaaactgagcatcctgaaaaggggtaaacatcttatgcccacacaaatatgtatgtctctctgttctatgctagacaccaggtctacccacttggagtttacagtcactacattatgatcttctgaagctactrcagagtctttacaaatccccaaaagtttaggtctctgatctagaaggcccataactttaagaatctgcctccaaaactcaagactctttggaggcagcaggaattcttatactaacacggccattaccagtgtcagcatagcatagctggctcatcctagacttaacattttagaacaagaaggcaccttattcaatttaaccttataaatggggggaaccaagaagagaaatggcttatttaaggatacattgtaagctcatggcaggctcaaggtttcctga

SEQ ID NO: 2068 - DNA, 600 bp, Bovine  MMBT20945
ccctcgcttctaacatcttcagccaacggaaccgaactacactcagagaatactctgactgaagagacagaaggagagacaaaaagaagagataaaccaaggtcatggctgaaaaacttcagatacttttgcaaatcagaccgaaacagctatatcagctaaaaggtcaaagcatcttataggtaaagtcccagtggctttggtgctggaaagtatgactcctgccagaaagctccattcagatctacagaatgatggcttttatctatttagtcctacacctcccaaactttatcatcrttgtcttctaattggtcttgatgccaggctcaagggcctaatgaaatcagcaagcacaactctgaacggaaagaagaaaaccaacttgtgtttggcatttgataaaatgcctgtcctagagaagattcttgacagccccttggactgcaaggagatcaaaccagtcaatcctaaaggaaattaaacctgaatattcattggaaggacagatgctgaagctgaagctccaatactttagccacctgatgcaaagagccgattcattggaaaagaccctgatgctggggaagattgaaggca

SEQ ID NO: 2069 - DNA, 598 bp, Bovine  MMBT19790
  misc_feature (1)..(104): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacttgatggacatgagtttgagtgaactccgagtatggtgatgggcagggaggcctggcatgctgcaattcatggggtcacaaagagtgggacatgactgagcaactgaatggaactgaatgttctaatatggttttatttctcattgtattcctgttctttgctcaatttccttatcgtttttcatgtctcarttgttttgcagaagttcctcctaaattcttgatgctaatcccttgtcagttgtagatgttgtaaatatcaaagtacagactgtcaccccatctgttaactttgtttatgtggttcattgactaaaaacatgaatcttaagatttatactttgtacacctttgatttaaaaaacttagaatactttctctactccaaattcccaaagaggaatttttaaaataacagtgaagagaaagaacaaatttcccttcatttcttcccttggtcagcattcatagtttataaaggcagcatttt

SEQ ID NO: 2070 - DNA, 600 bp, Bovine  MMBT22066
tttgaaatctagttggggtaaataccagtttctccttttttgttaaaataatataaatctgtatttgctagtacagtcagccttctgtgtctgtgggtgctgtgttcacaggttcaaccaaccacagattgaaaatattcagggagaaaaccctcagaaagttccagaaagcaaacttgaatttcccatgctctggcagctatttacataatatttacattgtattagatattaatagagatgatttcactttatggagatgatttgaagtgtatgggagattcctgggcctatatccarataaaactgtagttcaaaaagatacatgcacccctgtgttcatagcgctattcacaatactcaagacatggaaacaacctaagtgtccatcaacagagtaaggcataaagaagatgtggtgcttatattcaaaggaaaattactcagccgtaaaaacgaaggaaataatggcatttgcagcaacgtggatggacttagattatcatgctagatgaaataagtcagaaagagaaaaacaaataccataggatatttatatgtggaatctaagaaaaaatgacacacatgaacttatctgtg

SEQ ID NO: 2071 - DNA, 549 bp, Bovine  MMBT21271
aaaaataagtctatgaaatgtgtcttgcaaacttgatttattaatagatattcatgaaataaacctactagctatagagtgaaacaatataaatttctccctgcagttatatattggtatgcaattggtacaatttggtgatgaaaaacaaataggcatgagataaaaattggagccttgggctttaaggtaggagtgaaaatacatacacatataaataaaaatataaggaaaaaattgaactgaaawactaggcatccacaaaataaagatagaagattggaagcaaaaccttgggtrcttatattttctgggcaggaggaaaaawttgaagaactttacattctttaaatatagcatagtgaatttacatatgtaaagattatatatatataktagacagcaaacttattagacttatgtatattttaagagatttctgtaaggtaagaaactgctactgttgctgggaacaaaacaaaaattcctgccctcatgtacattatcgtctgcacaagtattgttcgagtacatataaaacatttacaa

SEQ ID NO: 2072 - DNA, 600 bp, Bovine  MMBT21552
aggtattctgggggaactatttgaatctgtcatgttactgaactagttaagtcagtggtgaatttcatttactcttgcagttttaactatcattacttccagtaagtttttgctaggaatggaaactgaatatcctgacttgcccagctacacagcagtttgatatttgtaggaaagttttattgcaatttttttttagctcagaaccaacactgaattttctctgaataggtatcatttttacctattattaatgaaaactgaatagatttgaaaaytaggtttgcagcagatttgacrtttcttagtaaatcaacttaaaaattgtaaggcaaaacagcacttatatgtgaaatttacacttgcaacaaaatcattatgacaaaactaatcttgtttaaatcacaagtaatgtcaagccactttatccacttcctatgctgtcaagttaaaacaagaagcaagatatccattcctacacaatttgcagtgggtatgtttttcaaactcaactgctgtttcagctacatttttggatccacttaactgtacaaatgaggagcatccatctaatcttcaatacaaagtaattaatctgca

SEQ ID NO: 2073 - DNA, 600 bp, Bovine  MMBT19056
ctgaaggcaacctagaaactaatcccatcaccataaaacctgagactgcaagccatgtggcccgagcagttctcctgggttcctttaccctattctattgctctctgcccaggcagcccttcccaataaaatctcttgctttgtcaacacatgtgtctccacaggtgattcatttctgagtgttagacgagagcccactttcaggccctggaaggggtcccccctcctgcaacaaaatgagagtgttcatgagcatatttgcctggcagtgagaaaaatctttgtgtttttattaaatcrtattaaaaatattcacagttaactcctactcacttgctcagaggagtttttgtcaacactttagtgagatttcttggctcaggcctttgtctggtcattgatatattaaattgtggcttaaaaaatatatgtatatatatatgtgtgtgtgtatgtgtatatatatatataattgtagtttttaatatcccccaaaccaaaagcatttaatatatttatataaatgwgttataccatatataatgctcaataaattgatgttttaaatttcatcagtctacttatttttataaaatttag

SEQ ID NO: 2074 - DNA, 600 bp, Bovine  MMBT20633
ctcaatcaattaatctatctacctatctacagtccatggaatcacaagagtcagacgtgacttagagactaaaccaccaccaaccrtctatctatccagctttgatatacttgttgctgaagaaytcagcaaacacaatgcaaaggattcctgaagccagccactgtgtaaggcatggagacctttctgtctctagaagtattcattctccctaggtccactgcaggctgtttttaaattaaggtggatcatacacatacaagacctacctcaaagttcattattggattaccgcccttrgcatcaagggaggaaccacactggttaaaatgatctggtttgctccacctaagaatctccggggttttatagttgacctccaggtactatctgacttatctttagaactctagtgcttccttcyctaaatccctttacatttaacaagtaaaaawatacgtactggcayaacatgccagtacmtagtagggcctcaataaatatttattaaataaatgaatgtttattattttcatgcctaattctgacttctgaagacagtgctaggtgtatctcctacttcagtccataaagaaatat

SEQ ID NO: 2075 - DNA, 600 bp, Bovine  MMBT18614
aacatgaaaataaaaattttaaactagactgtccttcagatggtaattttaaagatatatgtgctctgttgcatcaaataaagaaaataaaacatttttagagtgacattaatatttttgaattatttttgtttgtaaatatttcttgggtactgaaaaatctctgaagagtagaactcattttattttttttwaattttttaagcaccaaaaacattgtcttggattatagccaattagcaatgttgttctagtttcaggtgaacagaaaggacttggccatacatatacattatccartgcttattaaaccaaagaattttctgttgtttatttcaccaatattaaatttggtcattattggccttttagttaaaggaattcgctttaagtaaacacagcactgaaggtgatgctttcagaaagcattttgttcaataatatatattcctaatccttaatgaaagtctcatataatacaatcagtaaaggatcctattaggtgaggaggaaaaggttcttaatcctatattttattcagaaagggttaaatttttaatgtattttttattcttatatttcatgtatttaacgcagtta

SEQ ID NO: 2076 - DNA, 600 bp, Bovine  MMBT19854
ccctacttgcttgctctgctcaagccaccaactgtagacagcaccagtcctgggcaaagaccaggcagaaagggtcatgactttagatgcaattataaataaaaattcttacaccaaacctgaattttagcaaagacaagaatccacagagtatgatgtagtcatagaaaatgaaaaacacatcttgcccagagataacgtagatcctcgctgccttctacataaaccaatgataactgataagagatttagcatttcctcagactsaggtacatatagaggtacatctcctcacagaartgctatcaagcccagggttcggatcagcttggaaccacctcaatcataccatgttcctgtacgtgctcctggcttgtgygtcatgggtcttggaaagccattctgccccgatgaagataatcagtgggtctacccaggacaatcacacrgcagtctgtgctgagattgagaaagaactcatggctgacaacgttacatacaaggtaagtctgggtcttcatcaaatatcactttactctcagtggccctctgtgtttctaaccaacttttcctgcttccagggctccttcgaaaggcctc

SEQ ID NO: 2077 - DNA, 600 bp, Bovine  MMBT20518
actcactatgagtaatccatactttctttataatagagtaataaaactgtacagtctcccccaaaagactaaaagaaaaacataagccacccattcagctaaggaaagcagaagcagctgagaaggactgaactaaagcaagacagcttcctgaacactgctggatagggcatcagattacaaaaagggaaaacctaaaggtctatggaataatagagtgcagccagaagaaatttaaagggaaaggagaaagaaaaaagccttgacagaataatggcagccaatgccagaagccagtcrtcttacagaggagtcgagttacagaatctccctggcttcagaactggaagtagaccttgccccttttcagaacggtaaatcatattagaacacactgtactgtccgtctgaccaaatatttgtcaaacagtgagtaattgtgaagtccttaagaaattccaattctgacgcaagatggagaataagaatcttttttaaagacagaaaaaataacctgttttctcccctatttctcaagtgaatgtcatgacaagggtcacactggtctactctgggtagatcacgtgaccatcactcact

SEQ ID NO: 2078 - DNA, 600 bp, Bovine  MMBT18585
ttaagtgctttcactaactgaaaaaaaaaaaaagaagtacatttagaaggcattttccaaaagtacctaaatcagtctcaacttgtatgacaaataataaatttataaatggagttaaatttttatcatgggcatcaagagtagaaattgtcattcattaattaccaaagaatatattgcaaatggtactgatattatcagtaaaatctgcgtggaagtcactgattatctatgttatatgacaatttttattttctatttgtagtgtgaaatatagcaacaagctataaaacaaaggartcagaactgggaaaatgctacttctctgagtcactttattgccctctatggcttttgatcttaaaatatctgtaaaaatgaaagtaatatagagtagaaggcatttggaaagatttaatacttttacttacattctaactttcccatgtggtgataaaatgatgatgatgaagaggctgatgaaaaatgtattgagtattcacttcgtacttggcacttagtgctttccatgcattttactctagtttttaacaccattttggatggtgaatgcccaaatgtgtcacaattatgtaatga

SEQ ID NO: 2079 - DNA, 451 bp, Bovine  MMBT20865
caaaatagaaggaataggtccccttatattagtcactrcatgtacagagcattttcttactaaatttaaaattttcaatgccttaatgataaagacttatttttattttgcttcattctgtactttaaatatgaccctagttgtttctttgcaattcctttgttcccttcctcatattctttcttttgggcttaaatattaaagggagtcttatcagcacagcttgtttctagaaaggggaaggttgatgtttcttttgaaatttccccaaaggaacatcgtgcttatagctttgctccrtgtatagagattgtgtagtttcgtgatgtcggacctcctatcggccatgagtaactgagtgaattcaagatgacagtattttgggattagatcttacatttgagaattttatctgaaattgccaccacatgtacagcaccccctcccattt

SEQ ID NO: 2080 - DNA, 550 bp, Bovine  MMBT20509
caaaaaggatagatagtcttagttcaataataaagcctggtccgagagccttctatctttaaataaagtgctccagcactctattacctgtgtacagcccatctttgatttccaatctaagtctatttttgcttctcrtgattagcatacaaatgtgaaaaaaagaaaaaagtggttacatgcgtgacgattaggacatgcctttgacttgaatgtcagtgttctgtcagcctagaggtgaggaaatgaatggccatttgcgggctccttcgaggtgcatcttgtctgaaaatgactccratccatctccttttatttgcatgctwagttcatcacacagatcgcaagtctataagcatatatttgttttaaaagaaacaaagggcaacagcatgcagcaacttgttaatctgtaggagggggcctttcccttccttctgcacaggagctttgagtccaggatggagtccacacgtgggggccctgccctttcaagaaccacatgccaggtacagggatgggagggctgagtcctgacacagatgtgaag

SEQ ID NO: 2081 - DNA, 598 bp, Bovine  MMBT21528
  misc_feature (1)..(56): n is any nucleotide
nnnnnnnnnnnnnnnnnnnnnnnnnnnnnnnnnnnnnnnnnnnnnnnnnnnnnnnnttaaaaaaaaatagaaaaagtggttcaggaggagaaaaactggctttaggttgaccctgaatgcttactggctggggaaggcatcgtgacatgaagctaattgaactctgctttttctgtagcttttaatatgctgttatgaaaagacccgatgaacagtgcttttctggcatcgagtctctgggaggtgaacagtgataaatggcagatcaggaagctgaagggcagaaatcaatacttgctrtttactctgtagtaaattatgagaagctctggacgagagggacagatgctggttctcaaatcacactgcttgaactttagttgtttatacatttcctctctccccgaggatctgagtttctatttttgccatgtatgccctaaacatatggggctatccaycaggacaattaaaaaagtggcatgtacttcaacttaatatctgtattttcttctctactttctctagcttttctaatgatggctagcatcatttgttttgttgaaggaaagcctttggattgcaaaatggattaaac

SEQ ID NO: 2082 - DNA, 600 bp, Bovine  MMBT21910
attctgaatactccctaactaggaacactgcattacaatttattaccttactgatgacccttcaaatgtaataaagaacccagtaaatcagaataattgataattcagggtcatttgaagttcagctccacattatgtaataatgtgaaaaaatacatcgaggtaaaatttacctttatacagaatgatgtatktcggcacttcagaagctcccatttacaatcaacarcagaaatactacgtaactggagactggaattcagggctggtattctagcatgattaaaaataattcccacrtttattaaagctgaatctaattgcttatactgtaaaatttagatcgggggatgatatgcattaaaagtaatttatgttccagaactttcactaattcagactgacataacttccagataattcatacttgtgaagttttttaatcaaatactcaaagtaacagcattaccattgtttattaatattgaatgagcaaaataacagtgcaccaaaagttttgttttagcccttgtaatttaaatgatgctataattgtccaagtaggttttcctattatgaatatagcaatagataccatta

SEQ ID NO: 2083 - DNA, 600 bp, Bovine  MMBT18966
atgtcgttaggagcaaacaaaccataaaatagctgtgtgttttaatgggcattttggagcgcatcccagcttgtggggctctgcccaaggacaagagtgaaggaggcaggcaccgtgggagggggctgctcggcttccatacaccrcccgggctgtgagctgagccacgtggacaaacgtcttcactgcttagagcttccctttccttatctgaaaagtgggacacagccagcctcatttccactctgtcaatcaggaactaccgtaatgacccaaagcctctccacttagaaggctctrtaatgatgaaaacactaacagtgatcatgataaccaacttatcctgacaccacgtgccaggcgagatgctaagagctttattatcttttaaaattatcccagtttatatatgaggaaaatgaagctcaggcaagttcaaaactatgcccaagctcacagcgtttgtgagtgacagtgccagacccagcgaggcttcccaggccttgctcttagccactaggctttgctgtggagggctgaggatgatgatgtgagggatggcagtgatgaagatggcgatgatactgatgacggtggtga

SEQ ID NO: 2084 - DNA, 547 bp, Bovine  MMBT12665
  misc_feature (1)..(1): n is any nucleotide
ncattaattgctttaatagtttaaaatttatgcaaagacagttcatccataattatgcatgtattatacctttgggcatatgaaatgtaagacaattttctataatttttaagggcaaggtaacagatgacttttcagacttttttccagaggctatcaacaaataggttttttttttcccttcaaggaaataattttcaaacttatttcccttaggaggtaccccaggggcctcagagggtgttagaggtagtgaaagaaggtattatgtttaatccttcaactcacttcacacagagtrttaaactatttctaatagtgatattcttcacaaagtttggggtttaccacgaccaaaacacagatagaaaactattgctttaaggcaacctctagggtgtctgtctcaagatatataggaaggtatattgaaattctcagaagccatgtaaaaacaagtttaagtcatttcaacttaaaaaaaaattatgcaattctactattttaggatgaatgtggtgattccaaaaataaaaagcagtaataa

SEQ ID NO: 2085 - DNA, 600 bp, Bovine  MMBT19128
aggtcttgtttgggaagagagagaggtgagcttgaaggtaaggacaaaggcagattcctgttctgacctttcgagatgtgtgacttggggctggtttccctaagtccacgctgaaccctttgctcttgaacacatttagagatgccaataaatgccttgccagatcttgttaggactcaatgttctaacatgttggtttcctttcttccttctaactgtagcccattaggataaagaggacaaaggaaagaaagactttctcactcaaaaccctcatcaaaatggaactatgaggtatgrtaatacttgatgctgtaaatagggtttgacgatagataagcctcctctgtttcatttaacacacattctttttatcatttggaccagaaaggtggttgcaggacactattaataaaggaaccatcttcagcagagattctaggaataaagattttgacaagataaggagaaaagctggtgctgaagtcccctctttgtcaataggttgaaggatcctagctagaagcctttgcctgttacatgtcccgaacacatgtattcatgcaaattaatgaccactcattttcttttccactctct

SEQ ID NO: 2086 - DNA, 600 bp, Bovine  MMBT22361
cccaactagaatgtaagcttaatgaaggcaggsactttgactctttagtcctttgctgtatcccactgctggagcagtgyccagtacatcataggaactcggttaatttgttgtgtaagtgagtgaacaatgagtgattttcactcatccatccatttagtgcataccggttgagtgcctacagtatgcaaagacaaagacatcatagtccctgccttctaggacatagcagtcttgaggagatagacataaatagatacagatatataaacagatatttatgaagaagatttgcaggtrcagtgatagagttatggcccggatgttttctcaaatacagtgtcagagaagcagcagataatatgctgacattaagtatactccyttgcttaagaattgaagccacaaataaatgtgtgtgtgtgtgtgtgtctttagtgctttggcattataggatttcatagagtttggagaaaggctcaaaatagcttttcagtgatgttacagtatgacagaaaggtgaagaattcactttctttcccctcaaatgaaatagaagcagtggcatttctcccaggtgggcccaggcattgtacaaga

SEQ ID NO: 2087 - DNA, 600 bp, Bovine  MMBT23049
tttgtgtgcagaatggcaaattggcttccaaagctaattctgctggaaataaggggtcttgggattcgcgcacaagaagaattcaaattaagcttgtaaactcttaagaaggtagtagccatgctcttttattcaccgacatacattcaggacaattacagagctgtagtgggcacgttgtgaatcttgctcatagaaacgtttgaaccactttaagatgaccataaaaaggaacacaattgtgccatttgcagagacgtggttgaagctagagactgtgctacagagtgaagtcagttrgaaagagaaagtcaaatagcgtttattaatgcttatatgtggaatctagaaaaacggtacagatgaacctatttacagagcggaaatagacatagagggaaaawatatatagacataaagcmgaggaaggggtggtgggatgaactgggagactagaattgacatatataccctaytgatcctgtgcataaaccagatagctaataaaaatcctactgtatagcccagataactctactccatgctctatgatgacctaaatggaaagacagtccaaaaaagaggagatatatgtatacc

SEQ ID NO: 2088 - DNA, 415 bp, Bovine  MMBT21980
attgaaatggcctttctgtcaagtatggtatttataaaagttttctttgatgaaaagcctatgaattttgtgcaaacaacccaggcagggtcttagattagcgataacatttgtataggattttatggcttgatacgatactttacactcgatttatttgacccttacctgtgaatacgcagtgaaattcacattttamtgatgagagcaatgtagggaaggtgacttggcatgcttctgggcactagtgggcattcagcatgtttgctttaaaagaaagttagcaaaggaaaccagcarggtatttaacttgttcgaagtcacccagtaaatagtgcatcataccaagaactgaatttgcttctttaactaaaatattccatatgctctcattgtctactgctgtctttcaggc

SEQ ID NO: 2089 - DNA, 441 bp, Bovine  MMBT20512
ttttaagacaaggccatggccttagtcatgacttatgcagggttccccagtaaaggyrtgtgtgtaggaaaccctgcctgtttgcagacacacaaaaacacaacgtctatagccctaaggaatcctgtagcacgaaacacgtgtgaccgtgaaacagcgtgtgtgaagagaaaacgtgtgtgaggagaaaacaaacagacagcacttctaaaacttatttgaccacggaatcgttttttggttttttttcatataataaaactagtggtcccattctggtttagaaatacagggaccttrtatttcatggcttcgatgaagatgacctgattggggattgtccaacatgaatgaaagaaagaggaggaggagggggaggggagggcgagaagaagaggaggagggagacagacccagtgaggggaagagactccgttccca

SEQ ID NO: 2090 - DNA, 600 bp, Bovine  MMBT21667
tatatagcagattctagaattaacttaaagtaatcatcaagctacttgctgttccctcttctggaaacataacatgacaattttggggaatggatataaatgaaggcaaaaatattaatcaataacagaaggcctcttcatgaaagtattgtgtaacatttcatgtttggtattttgagagaaaaaytttcaattttattgtgctgcaaaatatataattatataagtcatcctttacgatgaaggcagctgatacamtgtrctatcacatctttgaaagtggctttaggtaggctggartaactctttgtgccttgccaatgctggatttaattcttctctcatataaaaataccagagtttcaagatattgaacaactgtttattttctattaacctacttaatatgaagatttgttatttcatagaaaaatcaaccttatgccatacagtgttaacatcaataattataaaagagtgaacaaaaatctctcacttttagctgttatctatttttaaattaaattatatacacaaaaaagaatattggcatcaactttaaattctgttaagccttggacaaagaatcatttttatgtc

SEQ ID NO: 2091 - DNA, 600 bp, Bovine  MMBT21523
ataaaaggatgtaactcaggaaaagccagatggaagaggtgaagagggcaaggtctggggaaagggcaggagctccatgccccctcccagcacctccacatggtcaccatcccagaaccctctctgaacccagtcctcttggatttttatggaggcttccttaaataggcatgattgattaaatcattggccatggattactgattcaaccttcagcccctctataatgaataccctctataatcacaggactggttcccctggcagtcaacctgaatctttaagtgtctccaaaagccrcctcattaacaacaaaagacayctgtaccacactcagtacttaggaaattccaagggttttaggaaccctgcgccagaaatagggaccaaatacttactgcttattataaattacaatatcacatctcctctcagctactgttttcctcttagtgctttgttgcctgctattatccccttcaatgtatttctctaggataccgcaacaggcactttctccttcttattgcatcccrtgggggaaacgggggtggggtggggtggacggaggtgggtgtgaccacaactgtggcgaaaaac

SEQ ID NO: 2092 - DNA, 600 bp, Bovine  MMBT18943
ccattgtgtctagatggtgaagagaagatggtaatatgcttattaataggttttcagaggttttgctttgcaacttttggacaccatggttaccatgtttacctggttcttagtcaatttcaaccagctctggtgacatttcctttatgtattggctttcacacagttcaagactctgatgttgctgtcacatttcttctcttttcygtgctgtgtactcatttttggacaagaaacattagcttgcagtatttttcaaagcaggttgaaaatgcttgagtagtcattttgttggaggartttatcacaggcgagagagttttgcatgggaaagtatgtattttctgatgagcaatcgctttgcatttatttttgcaggagctgcccccaagaatctaattttaggtatcatcaccagggtccatgtgtgtgtaattttgacgggatctacattcctttcattgttgaaattagttgaatgattctgtaattggctttaaaatgcaaaggagatcctcttgtagctgtattttaatttgccgagcttgggcttctgccactgatgtttatttttcctgacaagactgtaaaacgtgtggg

SEQ ID NO: 2093 - DNA, 600 bp, Bovine  MMBT19234
ttggcaaattaatgagagtcttgataggagtattcttgtggactattttcaatttagtaaggtatttccaagtttatactaataaataatttctatttatttaaagtgttgttgagaaagaacaaaagatacataacatgcctttgtttctgaaaaaaaaaaaatacattcagtaatttcctagtgtaacacatgtccagagaacacactgattatctttcaagtgtgttgtacttcaaatggcatgacctttagcctgtgaacctgaaatgatcactcttttgaacatcatgggcactratatcatgttctcctacttgaaggcacattaaccagaatgattcatccattcatttcattattatttatgcatgtgtgtgttcaaacttttgtcagttgtttccttcccattgactakgacccagacagtactgtcagtatgaatattttcatgaacaaaacaaaacagaatgcaatcactytgtttctgctttaagtaaagtcattcttggttttgttttgttattttatcaacaaaatgaataaatatatgatttataaaaaagaagttgatccaacatcttcatgcagttattctgt

SEQ ID NO: 2094 - DNA, 600 bp, Bovine  MMBT21566
caggcatattttagaccacctgcggactctaatctacgcaaatttatttggtacaaactcccttctacgtcaccttattcagtttaattccagagaggtttactgctaaggttgagcagccttaataagagaacagctgctctcatgggggctgccctgaaaggaaaaagaaaaaaatgagcttttgttagcttcttccctgtgaattcactgccatgaatgtgtatacctttcagacggaatagtcaccttgagcagtagagtatgtcctatgtctgattcaagtccatccttcrgccrgtgattcacctataaatgtcttgactcaaagaattaggttaaaaagtatgttaacatgtaaagattctcaacagtaactgatctgaacttaactgcaataaaaacaaygtagaaatagacaaggagataactttggtagaagagtaattttcaaggtttgctcttaaatattaaatagatgcatatgttttattggcttctatagaaagaattcagattgttttaaattttagtttatttcccttgttgagaatcttataattgaagaaagtgatattatactccatgcratctgcctgt

SEQ ID NO: 2095 - DNA, 392 bp, Bovine  MMBT22378
tcaactcaagtacaaggtctctatgaattatttcctgaggacccaggtcagagttaaatctctcctcttgtacttttataataatgatagctaatacttacataatacaaaccacatgtcaaatactacatatataataacacttaatctttacaaccaccctttaatcaatgaggaaacactttaagggagagttttgtggttttctatcaccacattttaacttccattaccatctgcaaagtacaaatacaattcccaccaaaccaggatcttaactgaggacagataacagggtcrttttcatctttgtcaccaaagcccaaaacagaaccatgaaataggtgatattctttaaatgattgatgaatttaggtaattccctttgtact

SEQ ID NO: 2096 - DNA, 436 bp, Bovine  MMBT20464
cgtcaaataaaactaagtgtgttcataaaaagaaagacctgcttacctggttactgctgtaaaattcaagtgctttaataaaagagattgtgcatgtagaacaaaactatgttattgcaatcaactgaagttcagtccactcactgatgtactcaatatttgttgagaattcaccattggtatgtccttccagccagcatacatccattcaaatgagtagttactacattttagcatcagtttttttatattggattcaatcggagattggcaaacagactagacttaggtgggacacarttcaagaattaattcattcaatcactgattcaccaaatacgcactgagacctgtcatggtccacacattgtactaactaataggaatacagccgggataagataggtgtgatccccgctcgaaggagttacactta

SEQ ID NO: 2097 - DNA, 542 bp, Bovine  MMBT20102
aatatttctatttcactaaactgttctttcaaatctcttgcacaaccgctttcagttatataggatttatcacaggaattgctggccctaaaacataaaatattacagaattgaactttatcatcctatttcatatcttccttctgtcctacatttaaatttggtcattgaggaagctgctgataatgatgtcatacatggtagaaaaccaaggtcccttaaaccatggtaccttttaatgatggtggaattaactgtttaaaacagtttgcagatccttggagatcaaagtgagtgccrgctcttaacaggagcacacgtactcctttgattgatctatggattggaatggaagtgatatatctgtgaagtaaaaactggggcaagattcgttgttcagccactaaagaagctcattttactctgcacagttgatgtggtcttacttgttcagttgatattttggcatggctcacataggccaaatatttcgagactcattttctcatacttttgagcttgcagtatttcataaaggaagt

SEQ ID NO: 2098 - DNA, 600 bp, Bovine  MMBT20457
gtatatgtcattctagtgaagtgcttttagaaattggttccctagtgaaggaaggattggraaacttagccctgtaagaaaaatcggcaggggaaatgtcaaatcactccagttctttgtcctcaagctctgacccaataattctgggtcattggaaagtgacctaaaaatataaagactcaaaatttcattcagttgggtacagtttcaaatgcaaacaccactgcatctctgcatgacatttagtgtttccttttttactcctcaggtctttgagtcccaggagaactcttcaggcargttttttacggacatacaagccaaatactttgagagtgtaaataaaacaacaacaacaacaaaacactttcactttagctcmtgggacccaactgtttcagttgctgcagcaggtagaactttaaagacaagcacaaaccagaggagaccagattctacattaatgttaggtcttcagttacaagctactttggagaagagtctgcagaactctaaatctcagccttggtccaaaaaaacaatacatgactcaaagcatctttcttagaatcgagggagaatgccgctggggcctggtgg

SEQ ID NO: 2099 - DNA, 575 bp, Bovine  MMBT20667
gacaacaggtgttcaataagtgacagataacacaagtgatgatgatgaagttcctcaggcttcatcagtgaacaatcactgttccttaaaatcagcctctcaggggtattaaaactaaatctagctttggagattcctagaatcacgtcaggaccacgtccagcttcttggacttcgtctttcttcctggactatgtcttttgagccttttaacacctaacctattttgctgctgttgctttatattttctggttgaggacagtgagaacgagaaagcaatgaccrttaaacaaggcagrggaaagatgatggaacaaagcaaggagggcagcatcactcaggaaggagagcagcagcttctgccaagttggggaagggggagggaaagctcacgggccatggtactcaccgcggcccaccaccaggcgtgtgggatactgggtgaagttagtgccctgcacgtcgtgctccacggagtagactgcggcagcgaaggtgaggatgcccatggtggatgaagagcatcaggcagcccacttgctggtagcactggcgcagcgtgaagccaaaggcg

SEQ ID NO: 2100 - DNA, 558 bp, Bovine  MMBT12813
gaagtaagtagttctagacagtaaggcagattcatttgcgggtagttatggcagctcagatttgaggggcagtcaaggttcctggcctcgcaaaagaggctggaggctggtttctctctcccggttggctgggccacacctctgccccatggaagtgtttgtggatccaacctgggcctcgtggtctgtcttctgtggatgagtccagctggcatggtccacgtggcacttaggagagggccacagcagagccggactcgggttcagggtctggccatcctgagctgtaaacagaccacrgaggggccgtggggctcctgctctggcctggctggtggcggagggygaatgggaaggcratcgcatcctgggccggaggaatcaccagcgtcatctctctttgatttaggttggctcccatcatctgagactcagcagaggcctggaggccagcgcccctgccttcgacaggtagggccgtcaagtccatccttcctcctatcagacagtggggtggggggccagggagggccagaagggggagaccccaaatgtgca

SEQ ID NO: 2101 - DNA, 598 bp, Bovine  MMBT20500
  misc_feature (1)..(111): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctggggtgaaagttctccaggagaaaataattcatggcctcatattcctcaggggcccttccgctttcaaattccagttacacattcaaatagctgttacccgagatcaggggccagacatgctgagggcctgcccacgtgggcatagccagcctgtcctaaccagggccccgcggtgtggggcrarcacacaggggctcagcagagatctcgtcaccacgtcccaggaattttctcagcccccagayrcaggaggtgaggtcaagaatccagaattggacatcgagctagtcatcttatcattcaataaggaaaattccccataaacaaagaagacatagaataagtggctcatgttaaggacaattatttatatgttatgaaatgtctgaactccgtcccctgagaacaaactatcttgatgtatttcttcagcttcgctgagaaaaattccacaataataaacatgagatgtcggccctttt

SEQ ID NO: 2102 - DNA, 499 bp, Bovine  MMBT20118
atttgaggggcagtcaaggttcctggcctcgcaaaagaggctggaggctggtttctctctcccggttggctgggccacacctctgccccatggaagtgtttgtggatccaacctgggcctcgtggtctgtcttctgtggatgagtccagctggcatggtccacgtggcacttaggagagggccacagcagagccggactcgggttcagggtctggccatcctgagctgtaaacagaccacrgaggggccgtggggctcctgctctggcctggctggtggcggagggygaatgggaaggcratcgcatcctgggccggaggaatcaccagcgtcatctctctttgatttaggttggctcccatcatctgagactcagcagaggcctggaggccagcgcccctgccttcgacaggtagggccgtcaagtccatccttcctcctatcagacagtggggtggggggccagggagggccagaagggggagaccccaaatgtgca

SEQ ID NO: 2103 - DNA, 600 bp, Bovine  MMBT19069
ccagggtattggtaaattatgttgatgaccagaacagtgctgtgtcatacaagtgtgatgtgagccacatacataatttaaaatttttaactagtcataataaaacattttaaaagataaaatttattttaatattatatttttaactaaatttaacttagtgcaaaatagtatatttttaatatttaatcaataatttaaaattattaatgaggcatattacattctttttttacacaaaatcttttgatatctggtttacgcttcacaccacagcatacctgaattgggactggccayatttcaagtgctgaatagccacaggtggctagtagttactatcttggacaatatggcttaaatgttttactaaaacaatttttttwaaaaattggcttcagttgaacctatttatttattcagtatgtttgtgaagctatttaaattctrtttggactgtatttcattagtaacatgacaagtttaattacttgttttagacttagatgagattgtggctttaatttcctaacatttggtgaattaatcatatagatgagacaaaattgtttgatgctccacttagctatgtcagatttg

SEQ ID NO: 2104 - DNA, 600 bp, Bovine  MMBT18450
aggctttctgcttggcactgagcagtgagcatgcctatggtcctctcacgagcccacttttaatctcattgacctctcgttatactacagcacataaattcagatttggagatcttatgttccatcataaattgggctggcagacttccgatcaacaagataaagctgtctcctgtgaggtgggtgttttattagtcttggcctcagtgctgcaggcagtggaggtggggcgggggmgggaggtctctggaaccctcctgtgctgtttcagatgggcctgatgctgctttttgccatcaygggtaccatggcatcccctagacccccatccccatagcatcagaatgagcagccacagctggacccccaggctaggcacgggaaggtcaatagggagaccccatgtgcacccaggcatgtgtccatgtgtgcccctccccctgtggtggakctttgtgagcttggccagagccagagtggggttcaggggtgggggaggcagctgcacatgcctgggcatcctgagggacaaagggctggaggaggggcccagagaagarcatccaggacgcagctccagagacatggcggcctggcctg

SEQ ID NO: 2105 - DNA, 600 bp, Bovine  MMBT22065
attcaaaggaaaattactcagccgtaaaaacgaaggaaataatggcatttgcagcaacgtggatggacttagattatcatgctagatgaaataagtcagaaagagaaaaacaaataccataggatatttatatgtggaatctaagaaaaaatgacacacatgaacttatctgtgaaacagaaacagattcacagtcatagagagcagacttgtggttgccagtgaggaagagcagtgagagggaaggactgggagtttgggatgagcagatgcaaactattatttataggatggataaayaacaaggtcctactgtataccacagggaactatatccaatatcctgtgataaactgtgatggagaagaatgtgaaaaagaatatgtatatgtataagtgaatcactttgctgtagaacaraaatgaatgcaacattgtaaatcagccatacttcaataaaaaaataaagttcaattcatcaagttcaaaaaaaaagtgtatgggattatgggccgtgggttctgtgcaaatactgtgctgttttatctgagggacttggtgtatatatatggggttcctggagcagccccttgttgatac

SEQ ID NO: 2106 - DNA, 600 bp, Bovine  MMBT19807
accacactgaagaagcctgagcaggtctagcctgagtagcctggtctctgtcaagagatttccacagcagaagacagaattcaatcagaattcttcctggaaaagcccagtttgcctctaggccatcttaattcrgatgaaactgaactatgatttaaaaagaaaaacacaaatatttatagagttccctactgttatggagctgtcctgattgctacagggaatagaagatgtttttacaagcgctctatattttttaaaagaaattcatgttcacacaaaaatttacaagtaaattayaggaaagttagaaagccattgcaatagggaaaagtgatgaaggcccagcgtaggatagtaaaataggaatggtgactggggctttgaaagacacctaagaaccagattagtcttagtaaataaatgcatttagagtacragagaggagttargtgagtcaaagttgtctcatttttaatttggagtagatgagataacattaaccaagawagaaaayacaggaatacaaaaaggttttggtcaggagataacacattttttttactttgctgctttgatttttaagatgggatttgaggg

SEQ ID NO: 2107 - DNA, 600 bp, Bovine  MMBT21387
cacggaaggccacatatatattatacagtctccttattaccaatcaatttgggaatatgatgagatcaatgagtggatttccttcacagamgaatggaaagaagcacatatrcgcaatatcatatataaacaaatattcatggaccaaagggcaagaatccggacaccatcccaagcgcgtcctgagctaactggccttcccaccgtcatgtctgtgcttctgcattttatcctctgcctgcagtacccatcttttattttctcacctaccaaactgctacttctccttcagatttaaayttaagctttgccgtgtctgtgaagctgtttttttctgacgcttaacaaaccctaaaggtttcttccttcaagcttattccctagtagcgtttatcacttggtaactgtaggtttgcaggactgtttaaccattgatactgtggattcttgaaggcaaggactcaaaatcttttcacttgtgagtcatcattgcctaggcattgcaagttttccatgaattttacaaataaggaaaaatgagatctagaggagtgttaagagacttagccaagctagtcagtggctgtaccaggcaagagc

SEQ ID NO: 2108 - DNA, 600 bp, Bovine  MMBT20770
attcttcttcttccccagacaggaaaagatgactcagcattttatacataaatgccaggtttgagtttgaattccattctgtattaaaaagaaagcgactgaagaattctggggaaaactgtgatgtgtaaaaacatggtatggtcaagaagggagaggagcagtcaggggaactgcaggattaggcaaaaggagattaaacccccttgatgaaaagacattctgaagaaatttcacaactccctaattccagaaatatttcatgggtactgtttgagaaacactcaaccaagtgttggygcattctgtttgaaatgtcatcctcttacttcattccctggtgaacaactagtcatcctttctagaggattattttctagtgtgtgcccagctgagaaccctttgagatacctccttgctggcagttgttttgtacaatgtggacaagctgtacccttcctctcaggcacaattttggctacatctttgagaatttggaatagaggcaggggtagggacaatcgctgcctataaccataatttgcagactcagaaattgtctacagtcatcttcctacatgggcttccctgtagctcagc

SEQ ID NO: 2109 - DNA, 598 bp, Bovine  MMBT18793
  misc_feature (1)..(130): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctttgttatctctcatatatccggtgtagtaactgtgagattgagcagagggtcagatgcccatgtttccttggtgatgctgctgaggctcagagaggccaagtaatcatcccaacactctagtccatagaaagagcagcagccctgctagcgtcagagcaatcgaygaggaaactgaggctcgaagagcaaagggtccatccaggtaatctgatacctagcctgctctgctggtcacgtgacttttttcttatgtctgccctcagggatttacctgttcaggccaggaggctggtggacctgatgaagaatgatgtggtaaatctggggaaagtggcatctgggcctacttgaggtaggatacccagagcagggagaggcgggaggaattatggagacggagagttttggctctgggggaggatggggacacacgggaatccagagaggccaccttaaaaaaaa

SEQ ID NO: 2110 - DNA, 561 bp, Bovine  MMBT15021
agaacctaccctcacacactctcctcgtaattaaatgtcagatgtatacaatgcagtaaaataattagcatggcataattaccgttcagatggactccctcgtatatgccaaacacattgctgtactagagcacaagctgttaaaacaaattgagttacttaatttttacatgtggcagcctgttttatcatttcctcagatgcaaatgcttcattaatgatgcggtccttctgcgcgctcaaggctccgggctactgcaaagacagagcctttggtctccccgcggaggccctgcagaygaaaatccatgcaccctcctcttccacacgtgccctctccaatctcgtctccacagagtagcccagaggatatttgaaagccataaatcagatcgtgtcacatgcctgcttgaagaccgttcagtggctcccacttagataaaggccagaggccttctggagggagcttcctgaccgtcgcaggcctctctcttcccgtcactgtgctccagccacactcgttttctttctcttctttgacccaaggtcaaagggctagta

SEQ ID NO: 2111 - DNA, 600 bp, Bovine  MMBT21671
cacttgttcccagtgcctggattagaataatgcctggcagagaagatgtaatcaatgtgtcaaatgattgtggggggaaaaaaaaaaaaatcccagtgttcccctttagggtggatatgagtcctggttgtagagaggggttcaaacagttcaaaactcctatcaaattccggaggagagaggagaatccaggagttctaattcacacaaatgccatgmagctttcacagggcctccctttcccttccgtctacaggaaagtgagtggtattcaataaccaagttctmaaaccacagctyagtggggaaataaatcagagtccatggaaacggagtcarggagaagtcatgtactctagatcagaacaaagagaagctctggatagaacaagatagggggaacaaaactgcagtaaatatccagacgtgctaaggcaacrctcccagataaaaacaaacaaaactaatcaacccttaagagaaaggaacctggcgtgcagaggaatgataaaacccccactcttaaagaaaacataatccaaagcacaaaacagaattcctcagaaggactttgtgctatgaatcaagttaatgagaaca

SEQ ID NO: 2112 - DNA, 600 bp, Bovine  MMBT19939
cgactstggattgaatccatatcctctgcactggaagayggattcttaaccaccggagcctcaggaaagtcacatccatgacattattaaccaaagacattattagcaataggaagaagcccctagtcactgagcatttattatgtgtaaggcactgagctatgtgtatcacaggttattttcctatttagctctcagaacaacctcgtatggtataggttctttttatttgattgaggtatgacacagtgaactgtctagctctcaagtgtagagctggatgagtcgtgacaaatgcaygcatctgtgccccttgtctggccatgaccayggcaggcttgctcaggcccctkcccactcaattcccacaccattcgcactagctgtataacctcagattcgttttatctgctcaagaacttcatataaatggaatcatgcagtagtgtgctcctctagctctggcttctctgattcagtacaatgtttgtgaaattcgtccaaatgggtaagagtgggacacagtccttttccttttttttgttgagtaatattctattgtgcaactactaacacagttcatcattctcacactgaagg

SEQ ID NO: 2113 - DNA, 511 bp, Bovine  MMBT22555
ggtggggcctctgaattacagtcacaagaaggcaggtgcaggtcaagggaggggaccaaggccctgggcagccagggaagaaaaccagaaggggagaggcgaaaggggcacccttagatcagggcttaggagatcccttcagtcctccaggcccctcacccaagacccaccttccggaaactgactcagcccctcttgctgcttttgaatcccttgctattmgcaagcagcccctgggccccaaccgaaacacggcagctcaggattgttacgcaaattgactggtggggccctgagccyggctaattcctgtgtcttaatgagtgggaagatgaggtttttattcatcactggggctttaaaaattgcagtaaagtggcccactttataaagaaaaaaatcaatagctaaaagaaaacaggagtatgtaaatggacagagtgacaaaaagcaggccaattacccccccaaaatgagacacagttatggctccattaactcaattatattt

SEQ ID NO: 2114 - DNA, 600 bp, Bovine  MMBT18986
gattaagtgatcagtaggaattcaaataacattacctcatattaaaaacatcagctaatgatagcatcaaaaataatctcctaagaagagacagaggatttggaaattcctttaaagaggaagagatgtcttttgaagaatttgaggaagaagcgaagcagaattaaatgataaccaagaaatcaaggctgcatggtaaactcttgtgaagtgaaagatgtgtggtatttccccaaatctaaaagagttgttatggagtgaagtttgcatgctcaacacacagtgaggccgacaaggcgmaacatccgagtttggagcagagaaaggtttattccaaggccctgggtttcttgtgcctaataagaccccaaactcctggatgggtttcagcaaagcacttttaarggccaagagagggagagggagggctgtggttagttgttgcagacttcttggtcttggaatcaagaccgagactgactttgttcttgcagctgtccacataggtcagatcacagtattccttttaaacctccaataagacaaatattattmtctgttctgcaacattttatctctgtatgattggaccctaaaagg

SEQ ID NO: 2115 - DNA, 600 bp, Bovine  MMBT18885
aaaaccatctcctcggcctccccaagtagtgagtgctttgagtgctggtgggtcttatctccccaactccccaacttccttggtctctgagcccaaggaaggctgcagcacagaccatctcccttgttcaggcgccctgtatctgccctttcccagatggattttcatcattttcttacttagagctttgtatgttaatgcagcttctgttttcatgtaaatctagttttttgtttgttttttaaagtatttatttatttcactgtgttggtcttagttgcagcatatgaactcttgttkcggcatgtgggactagttccttgaccaggaatcgaacccaggccctctgcagtggagcatggagtcttactggatcaccaaggaaatctctaaatctagtttttaatttaagaattctcactcttcaagtataatttttaatactctgttctaacactctgttctggatgttttctattaaaggaaactgtatggttaaaattattaaaatttagattgtatcagagcttatgtatttataaacatattggtgcaaggtgtttagggtcattgggttgcaaggaacagaaatttaattca

SEQ ID NO: 2116 - DNA, 600 bp, Bovine  MMBT18838
caggcagcttcctcattaagagcactaacaagggcttcagcttcctttgacgtctggccaggacttgattagattcccaagctgctcctttgcatttggccagggaaacatcctgtcatttaaagcagcttctgcaggcagctgacctcgtgcaccctgggctgaycgctctggtaatcttgtttgtactctctctgcttcctgcagagatagcaaactgcagggaaggatggcagtgacaagctggtgataatagggactcataatagtggtggtgactggtgtgtggagtggtacttkctgccagcctggcaggtgctgtctgtccctgggggccccccgtgaacctcaaaaccttatttgatgggtgaggagtaggaagcatgtgtcatatcgagccattcatggttggatacatggccttgaatccataggacttgaatccaggcctgtctgacattaagaccctttccttaaccatacatagaggtaccgttgtctctctaagataaaattttggggtattcaagaatattgcgtgcacctcagcatagacaacactgacctaagaaatcaacgagaatgacattcattggcatc

SEQ ID NO: 2117 - DNA, 600 bp, Bovine  MMBT23184
tacccacagagaagtgaggtggtggtctggaggccaaggactaaagagatttcaaaagccagtccccctctgtgactaaggcctgcctgatgagctttctagtccttggtctgttcttggacagacctgggtggaccctccccggatagggcttggcaaggtctgagactggagacagggaaatcagggaaccagartctgtatgatgagagatgtgcctgagcttcagcctcctggatgccatagcagcagagtaaggrcagatctttgcactagatgtccttgggtgagcggggrttkctccaggagcatacaggcagctgcaaggccaatgtccaaacctggaatccagggaccagcccacatcaggccagtcatcagggttctccaaagctcaactggtctctaaggagctgctccaatcagggagtcatcagtctagaacatttattaagcaccagatacagggtctgggaaaacacaggkgaacccttgctttctgacagttggcatctctaagctgaaataatgggacacatggggatggcagtagagcttcatctcagctctaccactgctttgcatagtacagattttccc

SEQ ID NO: 2118 - DNA, 579 bp, Bovine  MMBT19900
cctggattgagagtcactgatctgaagcccccatccaagaccaaatgggccaaataattctgacggacactcaagttgacgaacccctgacctatgatattctttatgaaatcctcctaatggacaccccttctatacacacagctcttcccagggttacaggtggacaaagagaattgattccttttcccagatgaggaaggtgagagacagagagaggaaatgtctgctgcagtcacacagcgagtcagcagcagcaatgggctcagtacctagtgggtgcctagcgcccctggcatmctaggcccatgccgagcacccctggactcaaagtatttttgcagaagtcatggatttgacatctgggtgacccagagaagtgctcccacactcggtacctcccactagtttgtgacagtgagttctccttggctgcctgtatttgagcaggcaattctcatttcagagttggaagatccagtttagggaacttgggcttctcaaactccactaagttccaagatcacccctgaaagcttatttaaagtgccatctctagggccctagcccccagagagg

SEQ ID NO: 2119 - DNA, 562 bp, Bovine  MMBT19006
aatgaggaagaaacagtaacgtaaagctttccagggctctgaaaaggtgtggggttatctgattggccatcagtgcagccttgttacagctttcctgtctgctttttatagccttctcctacctgatggtggaatctggccggtcacgttgtgctgctagttggggatgtgccttttcgacccttgacaaattgtccactctcagatgctttggatgaggaaagctaagagccagaagtgctccagaagaacaaataatctctgatgtggggcaggagrggccaygttttgatagaaatkaaggcaattaggactatgaattgtataggacctattttgactgcttagagaatttgtttcctgtttgggtcaaaggtcctgcctggtgtttgaggttactgagaggacagggtggtgatgttgagtttatgtttagaaccctcagtgcttccaaggttctggtcttccccggaccctgtgagagcccccgggatggagggggatggcaaagcgcaccgcagaggagggccagggccagctgcagagcccctccggtgacgca

SEQ ID NO: 2120 - DNA, 600 bp, Bovine  MMBT21974
taaatatctgcggttatactggccaaactttgaaatgtgctatttatttttacaggagcaggagaactgattcagacacttcaggtatggaccaaattccaccatatttctttgtgatcccttgtatcaagccgtcacctcagggccctggaacagacagagtagctaaaaacaaaggaatcgagccagacattttgaggcattccctttcctgtctttgcttccttctgagagtctgtcctacagaaatggcctcaaagactacattcatgctatctttcaagcagtaggcaccacttkgcttttttctgcrctgatagagttccctagttcccaggatctctaactcacagggcaggagccactcccaagctagctctgcgagcagaatcaaacatgatatggcctgttactcctgctgatttggaagggaagtgatcacagctcaatttcttggtaaatctaaaatctgctagcccctcttttcttcctgcttgtgtctttgtcttctgctctgcggtcaggtgatagaatttaatgttttcttctggcagctttttctttacrtattcccacatctcggggtcattaactggcaac

SEQ ID NO: 2121 - DNA, 600 bp, Bovine  MMBT22539
caacaagttgacagctgattacatacaacttttgttgtggagcctggatgagcctctgtgtgtgctccactagctccgctcaagaccagagtgcacgctgatcatctctcctgggagctgctcccagcaccaaggtcatgcctctccgtccrtgcctccccttggcctgtggcttgcaccctgatgccctctctcctctgtttctcctgtttccagctgccttgttattctgctgagaggagacccagcgatgccttcttccattgtaaatgctccagctctttcctatttattctctcktgaccttccagaaaaactgtcctgtgtgaaggctaacccagaatagctgagtgcttagattctgaaaagaaagccaccactgagagtttccagtttggaacaataaaatttgacttcttagggtacccagcagccttgagatacaaatttttcttatcgtggttctgctttaaatgcaccttgttatggggactgtagtcctgcctctgattggggtgagactcattggtgatctgatgaggccatctctggttcacagtcaaagcctggttgttcattcccctgtggaatagctgttaa

SEQ ID NO: 2122 - DNA, 600 bp, Bovine  MMBT18794
tccatgaaaatcttagatttgcagaaaagttaaactagaggagattacgtatgtgtttaccaggatggctttgtgcaggaattgcagtaatttgaaaacctgaatcctaggtcaggccctgccacttcctggcataacctctctgcacctcagtatacatctctgtacaatggcaagatgtcaggttatgccatttcacctgtccctcgaggttgtcatgagaatccaatgggccatagactgtaaaccaaggcatatttagaaaggggaggcccctttgatagaaggagaggactsggkcgagggcagaaggccatcctgtccagggatggtaccccaggttgttggggaaccagtccccttcctagtttgattarcttgtgaacaggctcccaccrcagaacaggagccattccaagtcccattatcctgcacattctcaccctgcagccctgctattcacttaaacaccgcagctcccragtacattttaatctctgatcattagttacaagattttcttgttaattctgattcagcagattttgctgagacaacgctcttttttcccttttcattttggtcacgctgcacatagcc

SEQ ID NO: 2123 - DNA, 600 bp, Bovine  MMBT18829
ggcccacccagctcacctccaatttctggcctccgccgatacagcagcacccccacattgatgaaagcaaaaatggtgaagagagtgacagaaaaagctagcgtgccaggggacactttgaactgttccccgttggccgcgtggtagatggcggcgatggaccaggccacaccgatgcccaggaagacgttcaccgcgttgctgcctgtgacgttacctatggatgcgtccgcatactggtcctgggtggcggccactttgcttgcaaatgtgtctgaggaggaagaaaaawaagacaakgcgcgattagccayttacagaggtctgtctgtggagtgctggaagctgcagccgtgtactctggaatcaagccttcggttgaaaccctgagaccaggacagagctttgttcgctcaagtcccagcctgtgtcgtcagaacgagaggatccctaggtaacaggattcgagggcttggtggtgggcgagttataggcgactttggtcaagtccttttccccacagataccacagttctttgttgatggtaacaattctacgagggtagtaaactctagaggtaaggatagtcggctcagaga

SEQ ID NO: 2124 - DNA, 600 bp, Bovine  MMBT22836
cagcataactgcacagaaggtacagagtcccttcatccccctgccccccgacacacacagcaccccatcgatatcttgttctgttttcccagtgggaacctgacttctagtgggtaacatagcaaagagctagaagagagtttcttgtaagtaaagtggcaggctgccctcagatgccaggaggtgctctgagctggaaagaagcccrtggcctggcaggcccctaggtgtccagaggagccttgtcacagagcatctgtgggtgggtgtcctacctcacgctgccttgggcatgaaackaacttggttttcagtaggcttcaccyttgagagcacagagagcctggcaaatctgytcatttctcrtcctaatccaagtgttggcactgctgtgcattagacgaagcttcttactygaggaagatcaatacataatattggaacatggtcttggagagagagtttatggacttgtaagaggcgttgaggcttttagcctgttgtatataaaacagatcaagaaaaacaaagcagaatacgggggatgggagggccttttgcttagactgacattaacccagaggtcctaagtacatggag

SEQ ID NO: 2125 - DNA, 600 bp, Bovine  MMBT20949
agccacctgatgcaaagagccgattcattggaaaagaccctgatgctggggaagattgaaggcaggaggagatagggaagacagaggatgggatggttggatggcatcattgactcaatggacatgaatatgagcaatctccgggagatagtgaaagacagggaagcctggcatgctacagtctatggggtcacaaaaagttggacacaacttggcgattgaacaacagggattggatatggagctctagacctgctattgctggatttttcccacaatggatggctctgcagctgggakggagaaattaccatctgatacccatgggggctccctgggttcctccaaaacagacagagaaggtctgaatatactgaccttggagaagtgactctccacctccatttcaaactgtcctctacttgattagcttcaagaaacacatgcttaccaaagattaggccaggcatcagggctgtagctagacagaatccctacactgtctagagcagaggtccctgacttttttggcaccagggatcagttttgtggaagttactttttccacggaccagaagaggagtggtggcttcaaggtgc

SEQ ID NO: 2126 - DNA, 601 bp, Bovine  MMBT23185
  misc_feature (1)..(1): n is any nucleotide
ngggaaccagartctgtatgatgagagatgtgcctgagcttcagcctcctggatgccatagcagcagagtaaggrcagatctttgcactagatgtccttgggtgagcggggrttkctccaggagcatacaggcagctgcaaggccaatgtccaaacctggaatccagggaccagcccacatcaggccagtcatcagggttctccaaagctcaactggtctctaaggagctgctccaatcagggagtcatcagtctagaacatttattaagcaccagatacagggtctgggaaaacacaggkgaacccttgctttctgacagttggcatctctaagctgaaataatgggacacatggggatggcagtagagcttcatctcagctctaccactgctttgcatagtacagattttcccctctgagcctcaatgtcctcatctgtaccctgagaaaaagtgggggaatcgatgcttcataaaggcctatgaatctgaattggtaaagggggttcagaggtcatgagaagggatgtatagagcccagggtctcagagcaggcagagttgggatgctctttctgagcctagaaggggccctcctgtc

SEQ ID NO: 2127 - DNA, 600 bp, Bovine  MMBT20104
actgccagtgtcttagtcaactgttcaagaataaattgagaaatacgtaatcatgctgtaatatttcataagatagaagtctggactgaacctgtagtgatgtttcactttatattggagtttttcatttgtttttgttttaagctgaactctttgcatccactgtgtttctttcctgggcacaaaaaagaagtaacatgattatcctcctccttgagtcttggtttgcccagaacttattacagcaggtggagcagtgacctcagtgatcagggcattccggttggtagataagactcktccccgtattcacagacaagggttcctgtggttgttggatcttaagtgcgtttaaaactataaggagctgtttgttgctttgatgaccagcatgtgaactgttctatcagaaactgtagggaggatcaccccaacacccstaatcctgaatattcttgcctgagtctcagcgagggggtcacaagagccatggcaagaaaaagagtatgcacatagtaagggcaagagggaactggggctcttaatgtatttggagaagacatgtggggacacatacatattgaaagacaccattaataa

SEQ ID NO: 2128 - DNA, 600 bp, Bovine  MMBT20918
ggtgagcacacctggataggtgcacatagggaatgatcctgctccaggagagaaaggaaggagttacacggctttcttcccctcaccgccctgccccctccaccctccaggcggccaaaactacatcgtctttgggcaccccagattggccacggtctcactaaatgacccatggagggtccttctttctgtgattccttttcctcaagtagaccatgggcaatgtcggtctgtcccagcgcacctaggaagggtcccggaactgcacagaagccctggcaggggcccctgctgtgcaamagcaacacccatcagagccccttggaagagattcctcaaagcctaacccctaaagggcagagaatctgctgtaatgctatgttttccccaggctgctctaagggaccattctcacatctttcaagcccgtccactgaaaagaggagaaaaatagcccttcctggttctgtttcagccaagtcctagcactggaccccacgtgtgccacccgccagacggcgtctcccagggacagactcagatgtagggaaatccatcctgacgcctctgggccagcgacaggaaagcatttatttctgc

SEQ ID NO: 2129 - DNA, 600 bp, Bovine  MMBT22647
acatggcaccgctgcaacttacattgcccttctcaaacaggtcggtgttattcctgcagttgtagagcagccgctcccctgtgtcccccacgtcaccgtaaaggcagagatagacgttggcatccgttcccgcaccttcgagttccccagtgcacaccgtcacgcggtaccgggccactggcaggtagagggrgagaccactgactgccagcccctgctcccagcrctggccctgctgctccccactttcaagcactgctttcccctcctccatccagctctcatccagggctgaccttkctccttccctgggctgcctcaggacaatgaagggccagctcagctgcgaatctctgtcccagacacttcagaggttcctgctcctggctaatcatcagaactccatgggaaatgtttataagaattccgattcctgggccctgcctcagacttctcaaatcctagttcttgagctggacgcctaaaactgcattgttcacaagctcccccaggggactctggtgaagctggcagtgtttgaggaccacaggtctaattcaaacattttggcacttgattccattccagcccagtagactt

SEQ ID NO: 2130 - DNA, 598 bp, Bovine  MMBT19619
  misc_feature (1)..(128): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtcttgaggctctggcttccctttttgatttgtgcattaatgctgcggagttgacagcctgcttgagagaggctgaagagaygygtgttctgcacatctgaaatttattcctttcactctggaagatgggacaccacataacggccatggagaagtaatttttaccckgcaacgatcttggcaccagttccagaaagacatatggacataatctttgggacatttgtagaaccttcccttgaggactgtctttgcaggcttgggttcacttcaagacctatggcactcactttagcttgggtctgtttctacttaagagataaaaagctaaattgtattccattggaagaactaaaaatattaatgtaagagcaagtcatcattatgacacatatcaatttctcacttctgaggtggtgcacagaagcagggccctggataataacccagccatgattaggagaaa

SEQ ID NO: 2131 - DNA, 600 bp, Bovine  MMBT21962
caccttgcactatgcatttttggcaatttaggaggccaagcaaaggcccttggcttttgaacttttctgctttcttagtgtttcccyatgagataagatgttaaagggctagaggatttctctttaaagatttctggtgaggagatagggaactgactgatactcacatgsctgctgcctcagcaacttcaagtccatatttctcctttcccatgaagcctctcttgcccgttttgtttaaaatcacagcctgttccaacaccttatactaaatcccctttactctggtttgtctcccckagaaatgattactcctggacatgcagtattctttaccacttactgtgttcatcgtctgcctccattgtctgccgtaacatagactcctcaagggcaaggatttctagctgttttattcactgtgtatccgaagagcctagaatgctgcctggtgtgtagttaagtcttgacacagagtccttgtaagaatgagctaacagcccagcaaaaggagagatgatgtagtgtcatggtgaaaagcttgagctttggagtcaaatgatcctggatttgaaccccagctttgcgacttaccagctc

SEQ ID NO: 2132 - DNA, 600 bp, Bovine  MMBT18922
caacttctcggaggcctacgtgtttcaggtgacaacatgtcccagggagaggtgacaggaggtgactttcaaaccgcaaaatgacatttggacttccattcaaatgaggggtggtggcatctaaagagagaaaggctcactccatctccaccagtttgcaaggccacgrccaccagcaggrcctggacgctggccacccacacagaaggcacgcaagagagctggggaagcygcgtccaggggaccgaggtgagtctgggtttgaggacagagactgggctttgcttcccgttggcaagmggcaaatacagatcactggtaccactccaaacgctaggcttctcgctgaatccgagtgcaaaatgacaatggtttccaagcgactcctggaaataaactgtgggtaaatagcatctacttaaagcctggaaacccagcttcctttggtttgtgtttttaaatgctttgacgatgtggtttgcttctctccaagaacaaaaagaaaaaaaaatagtaaataaaggctgacagcggagtgagatctacagctgagctctgcgtatcgtccgccgtcacctgggggcggggcggtgggggacg

SEQ ID NO: 2133 - DNA, 598 bp, Bovine  MMBT19630
  misc_feature (1)..(241): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtcaggtataaaaggcgtcagagggaggggagagcacgcgggctggcagaaggcaktgtgactagtgagcagtttcgaggacatccttcaggtcaggaatgagggatgtataagactgagtcctgtcttcctttctcaaatactgtgtgaaaagacacttacctctggtggtggttcttgatcattcttccacgatgcatctgatcccctatccctaggggaacaaacaaaggtcaaagggtcaaagtacttattaagattctgttaagtgcttataacctaatagcatggaaaataaaaaagcaaaagacctaagctcaatcttaatttgcaatatataagacaataagagaa

SEQ ID NO: 2134 - DNA, 600 bp, Bovine  MMBT22395
attcatcttacccttttccctcaatcttactttccagtctgcaaggcattctcccggatgagaagcccaggctggaaggagctactctagtgaccaggggctatgctcttggggtctgggtcctattgggaatcagggccctgagcacaggagggcccagaccgcccattgcaggggtcagacaggttcagggatgtcccccaggttggcctctggcaacygtgactctcagggctgcytgtctgcccacacctgtctgcaccaccaggtttttatcttkcctgaagtttctaagaggckccctgtgtggagagtgtgtgacagtgattctttcacaagcctgagggtgtgtgagtgagctgtgcctggcttcctgctgactaggatggggttgccaggccaggttgcgctcttggcactgcccactgctttgctggcctctgggccatagcatccatcactagggtcaccgtgctccctgttttatcgcctctttcatgaggttgggatcagtaggaggtccagggtcctccagcacagatgactgaaggccgggtctctcagtccacagatggactggatgcagggttcatccaagac

SEQ ID NO: 2135 - DNA, 600 bp, Bovine  MMBT18926
tccttatctgtaaaaatgcaccgcgcgcygcctctctaggttgtgaaaggcactagaaagaggcgtgtgtgcttgaggtggaggcgccagcaccgtaaytgttctyagtgggtcagcggagcggccagattggctgaagctcttcgtgggtatttagcattatgctttggaatccaatgtgcgttttgtacacgttgacrtggagattagccagaattggcattcatctgcaatttctatcgcagctaagtcctcccaaagagatggttttttttatgatttgctgctttctcataaaakccagtgcctgcaacgcaccaaggactcttgttctgtcgggacctgaatgctgtctttatctgggaaatgtctacagataaagggcagggctagggctcagccttccaggtgtcccatcgcacccctcctcctttcccatcctccctactcacaagccaggacccgcccctgggccgagggtagccgggaaacagggagtggggagtcttcgtggaccactgagaaggcaggaaggccttgggggggggaagacctgggcaggttctagattctcagcaagtgtagggggtgctgggggag

SEQ ID NO: 2136 - DNA, 598 bp, Bovine  MMBT22377
  misc_feature (1)..(38): n is any nucleotide
nnnnnnnnnnnnnnnnnnnnnnnnnnnnnnnnnnnnnncccccataaaattaagcccctaaagcacagcttttgatcacatcactgccctgttacaaaatgtaagagagctccccatttactatgacataaaatccaaattccttagcatattattcaagatactataagaagcagttctaagctatttgtcctggtatcccatctcctcaacttcaactaagtaatctaagctaaaggcacataaatcwagttacgyttcccaaacatatcttacttgtgcattagctgttcagatctmtaatctaggtctgtggaaatcctatctttaggggtcaactcaagtacaaggtctctatgaattatttcctgaggacccaggtcagagttaaatctctcctcttgtacttttataataatgatagctaatacttacataatacaaaccacatgtcaaatactacatatataataacacttaatctttacaaccaccctttaatcaatgaggaaacactttaagggagagttttgtggttttctatcaccacattttaacttccattaccatctgcaaagtacaaatacaattcccacca

SEQ ID NO: 2137 - DNA, 600 bp, Bovine  MMBT21592
atagttttgttacacagcagtatataatgaagcactccccatcacccttttagaagcaataataataatgagtatcattactgtaagaggaaaatggaaaagatctggaataaaaaagacaaacgtcattctaacaaaccgaggatactggacaccaagtctggcatctggccctgsagtgaacagagttctttctatcctcttactgtgytgcattgtgtatcatgtgtactcacattatcaagaggtttggcaagtctttacttacagtgcatgaccaccaaggactaaagtcctttmtactggcagcgtgtcactcacagtgtgaaacaactcagttcacaccgtgagtttctgagaaaatatttctcaggtcttataggagctgatcagcttacagagtcaactgatatcaacaagcacccagttgactcccaaccaatttgcgcaaaaattaagattctcaagtgggttagttttcgcatgtgaggctttcattgagatgctcttgggttctttcacattgccccaggactcatgccttgggagccagtttataaataaataagttactctattctcaaaagactctagttggaa

SEQ ID NO: 2138 - DNA, 600 bp, Bovine  MMBT18848
tccacaaaacatttaataaaatgcccagggtgcttagaatcttaatacaagttcacagctttaaaaaaaaaaacaaamaaaaaacactgcattgagccaaaaaaatgagttacatgctgttatctttacaagtcacaaaatgagagggctagcgtaagaaagagggagaagagcacaccaatgttaaaagagaaagaaagaaaaggtttggatatcactgtgcattattgtctttgaaaatagatacttgtccccacaaagtcttctgatgacgtgaaaagaaagttctaaggaatttckatttgtttgacccgctcccactgtccacagctcactcagctcacccagtaaaccctgagggtctgtttcactttttccttcccacacaagcatcacactgacagtgtggcctttccaaaccaccactggaaacttcaactgaattgatcatatatcaggccaatcttgatgccagaaacctgtgacattgtccctgccaggaatgacaaccctcatctgccaagctggactcattgcctgggcaagtgaagggacaaaattttcacttcactccatctggagcaacaaattcaggacaca

SEQ ID NO: 2139 - DNA, 604 bp, Bovine  MMBT21836
  misc_feature (1)..(4): n is any nucleotide
nnnnataatcttgaggatgaggattcatccagtgaattatggggagacataaaccttcagtctatagcatcatttcatatcttcttgctatctttgattattttagcacatacaagtcataagtagcttgatactaaaatgataaatataagcccattcttgtgaaaaattttaatgtatatggatgatgccacttttataattttattttcagtaaactgatagaggtgttattatctgttcttagatcctaatgcaaagtmasttttagagtctcatagctaaamgtagctaattttagaakagtgacacatcacacaaaataattgtgcccaaaagactaaatttaagttaatgctgcaagagagttgaaggtttcaagagttccaactttcaaaacactttctatagtaactttaggcttttggcactaatatcaacaagtagtttggtgaagaaatattttcagtctaagctcaataaaagtggatctaaatcaatgtgtatactttgctaaatttagcatattaaatcacttttggatttagaaagttgtatttaaactctcaatttcagagaaacttttcttttacctttaaattta

SEQ ID NO: 2140 - DNA, 600 bp, Bovine  MMBT18613
ttgttttcctcggataataatatgattctctaatttgcgcatactctatgtatgtttgttatttctcattatttagggacctcctggcttacccggtctcaaaggtgaccctggctccaagggtgaaaaggtgagartaaaataatgtattattacactgttgctatcctaattgcagaggctacrattatgcacattaaaatcactcaaaaggaaatttcaaggaattgctttgtcattctaaccaaggaaaatgctgtcaatccttagcttccaagaggaattcagaaaagagaaaakaatgatgaaaaatgtaccagaactcagtgytatawtagtcaatgttcctttgtaggaaccatatggagaaagcatatggttatactaaaataactattcagaaaataaacagaataacaaagtgcccattttttcatgtttttaaacatgaaaataaaaattttaaactagactgtccttcagatggtaattttaaagatatatgtgctctgttgcatcaaataaagaaaataaaacatttttagagtgacattaatatttttgaattatttttgtttgtaaatatttcttgggtactga

SEQ ID NO: 2141 - DNA, 600 bp, Bovine  MMBT23289
aatcataacaaaacataaaaaaacataaaacaaaacataaaaaacaaaaacaaaacataaaaaatcataacaaaaaatcataacaaaagaaacataataaaaaatcataacaaaagaaaacaaagtgaatgacaagcactggaaacaggatagatgtgaataaatatgaggcatttttagaatttttgttaaaaggtaaccctttaaagctaaaataatgtcaatgtagtacaggatctataacacagacaagcaaaagcttcataccttttgacrgcacaaaggatggagtgggagaaktaagagcattctgtcgtgaggttcttacattacatgtgacgtggtataatattctttgaagaatctctgtattatgttaaagttgaatattgtaaaccataaagaaacttctaaaaagataccagaaaagaaatataactaataatacaactgagaatataaaacagaacattataagaaatgcatactctattcaaaatgtagcagataaagaggaatgtagaacaaaaactaaagatacaaatagaaaagaaatagcactaaaacagaaaaacctgacagacttaaatctaaccatat

SEQ ID NO: 2142 - DNA, 598 bp, Bovine  MMBT18981
  misc_feature (1)..(108): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggggggggggtgctcaaagaaatagatttctttaggcttttattattgggacttactaaggtccctaactctgcactttgacaacttttgccaaatttgggaggttcttatattgttatttcttctaatgtattttctgttcttttytctacctcttctcaaactccaatattaggaatgtgttatktttgttttttaactttcctatactgggtcttcgttttggcacatgggatctttagttgcagcacgtgggctccacagcatgtgggctcttagttgcagatgcggaatctagtttcctgaccaggagtcaaatctgagccccctgctttgggaatgcagagtcttaaccactggagcaacagggaagtctcccagataggaatgttaaaccttctggtattctctcccaggtccttcaggatctgtttactttttaatctttcttttctgcattgctcaggttgttttcttcctattag

SEQ ID NO: 2143 - DNA, 601 bp, Bovine  MMBT21899
  misc_feature (1)..(1): n is any nucleotide
ntggtgattggcattctgtccctggctgccagccgcccactgggcacgcacacaggcagtgccatcgatttgtatgcagtgctaagtcattctttcgcccagctggctctgtggcagaggtgcctgaccacagccytgatagcagccaggaaggaatcctttgttgaactgttcactcaagtgcttgacttttygactctgtttgctcacagatctgctgtaaaaactatctaaagccattcctctttctaaattcttcattatgatctcttcaggctactttcrgacatttgattttccktctctaacagacaagtgtttgatgttttgcttatttgtttgtttgtttktttttggtttgtttgyttgacaggaacccaaagatgagttacatgttttaaaactaccatccttcatattgcttaaagtttctacagtttatgaaggtcagcttgatattacctaaatactggaagtaaaccaagggacggatattggaatttatacttaacctctatacaagattttcagcacatgctcatgagaaaaagtataatataagactaataaagatacatcaacacatagagctctggtcttt

SEQ ID NO: 2144 - DNA, 600 bp, Bovine  MMBT23246
agatctgcataactcagtaaaccagtattttccaaatgaccaatataagatatttcagaatcatgtgaaggtaaaaaagatccatcctaaataccaatatacaccaatggatttttacagagtaccaaaatttcattgatatggtttcagattccacattgtgccttatcttttaagaaacctccacctgctgagttctgatgtaatatcaaagaataccatggttatttgaaaaggccattaaagtacctcccttttccaactgcctgtttatgagaggtcagattttcttyagatatktacttcagacagcatatctaaacagactgaatggagaagcaagtgagaatccaattaaattctgttaagctagacattcaacttgcaaaatatgtgtgtgtgtatatatatatatatatatatgaaatgatacttgcaacttttattttggaaaattgtttttttcattaaaatgctattcatgttcatgtgtaataagtttattatacttttagtggttttaacttcagatatagtaatactgataaatatagcctatataaacaaaagttctttggagtccttaatcattttttagag

SEQ ID NO: 2145 - DNA, 600 bp, Bovine  MMBT20042
tttttgctattaaaaaaataaggctaatgaaagttatacataagtttcaatttttccttctgggtaactaacttctctcttatatgagtgattaagccctaccaaatgattgcatttgtacattcactaatcaccaccaaggaatacctaatcagcagcataagaactataaccaaagcccgtagatattagctcttaattgtctgaaaaatactaacactcagtttatatttttaaagaaaaataaacctctaaatttctgatttcattcacttaagttagagtcttcagaccactttkcaggagagtggaggggggtgaaaactaagctatttccaagttgaagatgaatctagtcaaaagggtatgatctctaagcaatctcctaattcccaaggatatttacaagacctgtgacctcttatcaccaaccaattcaaatgcataaaactaatcagccatcaaactgaatttattttaagatggtttgtatatttatgtatacagaggacaaatacaattatgcaattaggaaattcaaggaggaaaaggaggggaggttaacaccttgggagcatactcatgagtcaaaggccttga

SEQ ID NO: 2146 - DNA, 600 bp, Bovine  MMBT18781
aggcttggttttgccagctcatttaccattggtctgcaggctttccagctcccagtacaactgttgtcatcccagtacaactgggatgggtagcatgttgatgcccagatttctcccctctggttttggattcagaggcttggttttgccaactcatttaccattggtctgcaggcttttcagctcccagtacaactgttgtcatttcccagtcttgtgactccctttcccatggctatggtagggttttgacagggagtaagttgaaatgtgcatatttgagctgccatcttagcctakgagactctcaagtctctttcaaccattgttcaggtaagataactgggaactaatacaaatccaactgctcttctttyaacatgccccaggtttttcagcaattctcttacagtgtaatagtacctcaaactgaacttcaagtgtgttctaaccagtacagattataattgttacttcttttgtgttagacacccaattcacacttttccaaactgggttagacagggagcaatgcccctcaggtgatcaacagatattctgaaaagaagttgggaaagtaccacatatccatttctcaag

SEQ ID NO: 2147 - DNA, 600 bp, Bovine  MMBT18528
ttttggattttaaagaagttaaagtgtgatgacattagaacagatacccaacagcaacgatgacaaaaactctrtatctccttcttgaaaaaatactccgcaagtgaaaaaaaacagaatggggctgactataaagctattgatcagtcctctgtttcaaacaaaaagaggaacacattatctcacttctccaatatgtttaaacacagaaacacaaattcacraattattaactgcacaatcatttactgttttattagtctacagcaataaggtagaacatcttttgtatcttctaamagtcagaaagattcaaggcacttcaaatttcaggtggcttgtgtacagttcccctgcaaaaacactctcccaacgaacaccagccagacctcttcctgtttttcaacctcgtatgtttactttcacatctgctgtgaaagataaaagcaacaatggggacatcaaccacatgtctgcgtcctaccaacccggaaatgaagctctgaagccagaggtgctgtgaaatgggtctttagaaaactcacacgcaagcttaaaactcttacagcgtaggtctgaatcaaatccaaaggtagacaa

SEQ ID NO: 2148 - DNA, 600 bp, Bovine  MMBT19324
agacgaaggcttcatgcctacctaatgttaaaaaaaaaaaaaaaaaaaagctcgtattataaatccatgcagaaactccagtgttaaaagaaaaacatgccactagcccaagaagtagacactatcattaagcaatctttaatcagaagattaaaagatagttttctagatagtgggtaatgattattttctagaataggaggaaaagctccgaaacaagtacaaaggaaatgaaaamacagcgctgttaaaaaactccctacaagttgcaatgtgaagaggaactacatactagaaggktcatcttggaatgcaaaccataataatatttgagagaacagccattacttgggaaatcgagagacatccgagcacagagcattcaatacagacagtctagctgaggcaactgaaaatgattcctctcaatcacaaccatagttaattatctgcatgctgaagctcaatatagtaaattcaaagaataactgtgaaacgtggacatcccaatctaactgcattgtgggttttaatggaaaagaggaatttccagttatattcatcaaggtcactggcaactagacacttctcttttgagaa

SEQ ID NO: 2149 - DNA, 600 bp, Bovine  MMBT20565
tgcaggaaatgacctgcaacagatctggcatcgggaaggccctgctgatgactgtgtttgcatygagctccgtgggacccgaatcactacaaaagtgaggaagggcgtggcatgggtgctgtagggctatatattgcaaagcaatgtgcgttcctctctgtgtattaggtttcagtggccttaagaggctgaaagtgtattgaggagmgcataaatakatagtaagcaaatagaatagactaggtcctctaggtccatttgtgaatctttatggtaagcacctcaggggctccaggcttkcttgcaatcaaagtcaagaaatatttcacattcagaaatactttttaaactaaaggttttgattgtccccacataaaattttaatagcatattagacctaaaatttaaactccaagatgaagtattgggttggccaaaaagttcattcaagattttctatgagacagaaaaaccagaactaccttttttttttttttgctaacctaataaatcaggaaaacagattttgtttcctgccttcaaaacattaaatgccttgtcagatttatgactcccaaagtggaatggcagagccactgc

SEQ ID NO: 2150 - DNA, 412 bp, Bovine  MMBT23201
  misc_feature (1)..(1): n is any nucleotide
naatttattcttataagtatcaattattacatttagggttaaaatccttttcttaattataaaaaatatgtttgttgcaaaaaaaaatttttttttatatagaaagtcaaagaattttagaaatcacttgtggtcccacaactccttgattaccactgttgacatcttgtttttaccactttgttttcaataatgccagatttacaatgaagaaatcttggatcttctatgcccatctcgtgagaaagcccctcaaataaatatacgggaggatcctaaggaaggcataaaggtgtgtttktctctcatttgatgttattttcaaatgttggccacttctaactgttcacactccctttatttgccactgtggttttaaatgactgttagtacctcagtcttttaagttctg

SEQ ID NO: 2151 - DNA, 600 bp, Bovine  MMBT20381
aggacatgtgaggtgatcgcaggtgtactttgctgatgggaggggcataccgataccgtatattagaaagaaatgtgcacaaatataaacacctttaaaagtcctcattcattggtccaataatgctagttctaggaatccagccagaggaactatcccattggtgatatagagtggtatgttaaggatactcactgtagctttatgtattatagtaaaatattgagaaaatacagacatgatcaaggatgggaaatatcaaaacacgttcaagtacttctatatgatggaatcagactkccagtgaaggtgatgctttagatgtawttgttttctaagttgaaaagtaattgctctgtgacaacctagagggtggcatgggatggaaggtgggagggaggttcaagagggrgggacttatgtgttcccatggctgattcatattgatatatggcagaaaccaacataatattgtaaaacaattatcctgcagttaaaaataagtttaaaaagaaacacaagtaatacatgcatattgtttaaaggtttaaatagtgcaaaagagctgaaataagaaggaggtctctcaactcattggag

SEQ ID NO: 2152 - DNA, 600 bp, Bovine  MMBT21073
ctccattaagttgcacagtgtttttttacaacttctctttctagttgtgggttgtaaattttccytctgctgagtcctgtagctggctgactgtttctcattatatttgtaggcctcagggaaaaaaaataggcaattcctttatttgagaatcctgacatttattagcataataaaactctcaagatgagattgcagttttccagacagtaatttcatttgcaggacaacttacaaggaatttattttaaggccaggtaaaacctaaaatctatgagacatgcagaaaatgcgggcccmaaataaaaggaaataaatgagctgggcatgggaaactcagctgttgtctctcacaagttaattaggggtgacaggaacaacagctcagggaatcgagttctcaacccatcctggtctgctttcaaagctgctgctgaagagaagtttcttcttgttagttcctcctaacacctagcaaatcatcacatcctatccccttgacacttgaaaccatcrtcactgttaaagcagttgtcaccagcaataccttccatttcacrggactctcatgtttatcatttgactgacctgccaagaggc

SEQ ID NO: 2153 - DNA, 600 bp, Bovine  MMBT22048
gaggacccagtgcagcaaaaaataaacaagcaaaaattactaaaaaataatcatagaggaggaaggagcatcagccctcagccacctagcaatggtggaacagggattcaaaatcatggcaaaggaagccatgmcaaattacttgccagctaatttcagcccacttatwcttggataatagtggtcaactccattacttctctgggataatacatgcagttttgacataaaccttcaaagctttgracaaagacattcagtgttcgccaggytatgattgttggaactttgttctaggakctattaataaggctgctatgaaaaaagaggttctgtggttgaataactgggaaagactacacatgacaaacccctttgtgaacagtgataatgcatattcacatggtaagggctctggcagcctgcagctaagaaaagtactgagcttgcttaaccccgtttcctaaacgtattccagcactgagcacttattagtatttcctcaaacaccagcttgggggaaactggctttttaaaaaaaagtaactaatgatggaagttacaggcaccctaacacgattgtgaaagagccattttggc

SEQ ID NO: 2154 - DNA, 488 bp, Bovine  MMBT12374
ctcagaccccccagtgtttcaccgaagacaatgctcttacatttgtagtggtttttaatctgataagactctaatttgcttaagtcttttaaataagggttttaaatgtttctagccattttcttattgaatttcctctaattccctcaagatcataaagtatatgcgtaaagtaaatatctcctcccactgcactgacagccgatgacctataactaagtcaatatgaatccagttcttttctgcccaatatgtttactaatcatattccaataccttttcttaaacctcggcatagckacagtccccacaacagcacatgctcatgccttcatatcacaaagaaactccatcacatcagagaatgaaagattctcctccacagtgaacatactctcttccttgtttcttcaagtttcaaatcctggagttacaatttttgggaaggactctgagggttttcaaaactcagaagagctagaagctcc

SEQ ID NO: 2155 - DNA, 600 bp, Bovine  MMBT15552
tcatgtattccctggaatcttgtgagcctacaaatagcattgtaattatgacttcaaattttcataaaatgctatcaaacctgaaaacctcccacaattctatacttgattctaaccacaggttgattgtctttaccgtgatctcaaaagaggaaaatacactttgttgaaggaatatgattaatcagttaatgaatgctattttccccatttaattatgtgtgcatttataattaattatgagtatcaattgaaaatatcaaaatctctcagatcagatatcatctctatgaagaaagktgggttgycatttgtttatgaagtggtagtgcactaatgcatataaatatatttataccttttccctgaagaaatcccttatactggactgtgaactttacccttaaaggagtgatatttttactcatctttgtatttacagcattgagcacagcgtctgacacggtacattttacagacaagataactgaaggraagtaagaaggaaagaagtgagagaagcaggaggggaagtggttgagtgggagggtgggtcttctgaagacgagtgagctaaatttcatttttgaagcagtattt

SEQ ID NO: 2156 - DNA, 600 bp, Bovine  MMBT13096
ttagatggatctcctcttatactattcctaatgtggaatgtttaggcgagaggaggtgaaatattttaaggttacaatgagttttaactgactgtactcaaaatattcctgctgcatttttattgttttctagtggtgaccttttattggctttctccccttttgtttttaccttctaatcactttaaataagcccaggtatgattcagctaccttttaatttttttcgctatcttctgttaagtccagatctttgttttttgtacagatgaacttactgaactcacttgcatatcatakaattgtaagtttggttgtgttgaacatcatttctcaattgccatctacacagacttggcttctttgccttgaaaaatagccaagatttattgagcattttgcacatgtgccatagactgtgctgttatatatattaccttattccatttttaactctctgaagtatataaaatattattaccatattcattttacaaacaagaaaactgaggtaacaggagaagttgagaaacttgcctaagttgcaactagtggagtgagtctgggaatttgggaatcaatcccagacagtgtaactct

SEQ ID NO: 2157 - DNA, 602 bp, Bovine  MMBT18864
  misc_feature (1)..(2): n is any nucleotide
nnggctccttgcctgttgcccaatcagtaaggccaggcattttatgcattaggtctccatgcccatgaattcagtgacagtaataaactggtttcagagggacgttgaagctaagctcaagtataaaccacagtggtacacagcagtaatattacatgtttcttgaaacacacctgaaaaggcaggaccctgctttacaaaatcatytgccaaagtatgttcttcaaaacactagttctacaggtgttawaagctcttcttccttgatccctacagaaaagggttctatggccaagtaaatktgagaaatgaaataaaattaaatagcgttattcactgcaggatttttcagagtccttaatakacgtgttaggaacctccaagtcttgtttagggtttgatatgaaatatttcctgatctcacttcactatggaacccttctttagtgaatcaattctggggattagtgttcagtggaacacatcttgggaaagggtgtccaaacatgcatttttgtgttagacataattagtgatgatatttaaggttaagaaatgacaaacacagcaagaatatattttagaaatggcaatattcatta

SEQ ID NO: 2158 - DNA, 600 bp, Bovine  MMBT20544
tggttgctacatttttgttttctttctacctagttctgcttttctgtcatggcttacaatatcatctttcaaagacaatgctgaaagttctctggggacttgtgttgctttattgagtaatctttgatcagattgtaatggaaatccctgmaggtgatataaaatgtgtacatatatttgaatacataaaatatgtattttttttatttcatccatctttgacatgtctaaatatggacttatttagcatsttggcctcmaaacaacaggctcatcttgggggcatatttcaaaagagtkatgattttaaaaattgatgatgaaaataattggatttataaattctttgaaaatcagggatcctgtctcaacagcartagtaaaaactgctactgaagtatacagaaactgagactaaagatgtataatgtccttgtcctattaaatatgttttaaattgtgttaaccatcatgatattcacaagcttggatggcttaaatgtttactactaatacagttgtttatttaaactgagagataatttgtatataaaagaaatatgtgattctacctctattgacatttataagtccaacgag

SEQ ID NO: 2159 - DNA, 600 bp, Bovine  MMBT23173
tgtctttgtaagtcttgagaactaagaatgctttttatgggtttcagtggttgaaaattgtttttgaaacagcaagagcaaaagaaggttaatattttgcagcacatgaaatttatatgaaatttaaattgccatgttattaatgaagttttattgagatacagtcacatttattcattttaggtattgtccttggctgcttttgcactgcaatggcagagctgagtagtcgtgacaaagaccacaggacccatgaagatgaaaatatttactctctgaccctttacaggaaaattttgmtggcccctgatttaatggaatcccttcctgtcaaattaagtgagaaaataatcacaggatttggcaaagtcactaagatgcctggtgatctgttgttagggattttcatagtaagttttcctctcatcctttgattttccgcttccaacttaaaacttcctaagaagcaattcggtgagaccatggttcctagaacattcacctggaaaaattgacgagaccttcaaggtgagatataattctctccaaggttggggaggagaaatggctgcagggactcaaggacttcccggctttcat

SEQ ID NO: 2160 - DNA, 595 bp, Bovine  MMBT23578
attatcaattcargcttcccttttgttatcctgttagtacaatctcctcaacctaggaaataggagtcatttgagttttctttttttcctcccagagttggagaccaaacctacaaccaagaatacgataccaacagaggatttttctaaaaaacatttatcacaggatgccattgtagagaaactcacagagaatggtctatgggaccccataatgggaggattatggaaatggggcgacaggatactgagactgcagtatagtcagcagagtcctgtaggccaaaaaacagttaaacmcaagaaaatccccactattcagaaaggctttgagtttggaactgttcttcttccagaaccagaagttatcacagaagagccccatggcaaataccaaacacatgatggaaattttacagagggtttagatttgaycacagatacccatctgaggaaggaaatttgcaaggatacagaaggcagcaaagtcayaagccctgcctcagaactcactttagagaaaaaacccaataagaaagaaaaaccctataaatgtagtacatgtgaaaaggccttccgtacaaggtcattaaaa

SEQ ID NO: 2161 - DNA, 600 bp, Bovine  MMBT23488
acaatggtttccaagagctatcaatcacatctcttttaaaaaagaaaacattttcatttctgaagggctcatacctgacaactccaattaatgatatttccctaccccacccgcaaatcactatactaaatgcattatttcaccttagaataggaaaatttaaaaatgtaattaaaaaattacactctctatatattaatattttaacggtcatgtttgatagcaaaattacaaaattaaaaccaaattctacattcaagggacaaatgtcttcactgttttatttaagagtctattccmttctttgttgttttctatctccatattttaaaatgatgatcaaaggtcaggagtcaatccaaaaaaccaaagagcttgtctgtgatgccctcccacccagctccctgatcatgttaattctccctttaccctcctccctttttatctctacgctcatccttttcgtcacgtatctttacattcctttctcaccatattattcaattacgtctactcgttacacccagtccccctttttattctgaacgctacttgacctatacccttatattctaacgtcaattattaaagcctctcccc

SEQ ID NO: 2162 - DNA, 598 bp, Bovine  MMBT23477
  misc_feature (1)..(1): n is any nucleotide
nccgcatgcacggcagggatttcggattgttgtgtattactcccttttccattcagagcctcctatcacttgcttctagcaacacagayaggcattaccttctctactgcagggcttgtctattgatgtmagagaaatctaggagttggttttgtcctctgcgtctatactgagccttagtacgctcagctagttttagtaatttctaraacttaacmcacagacccagaattatgaaggcagatgtgatatggcggcagcactggctctgggcactgccacgcactgctgaaagtggastcggagtccatctccactgtttgctcatcgcaagtgctaatctcggagcaggggtcacagtcacggtgccagtaggagccaggcaggaagccatggtgtagagtgggtggtgtggaaggcagcagggccgggtggagagtggcagcctggaggacacacactgagtagatgaggccactcacatcctgctctgcttcatcactgtcacgtggcggggcgtttaaaacgttattcagctggaaacccatctatgccccgaattcagcccttgggctgccagtatttctcttctctgcct

SEQ ID NO: 2163 - DNA, 598 bp, Bovine  MMBT23582
  misc_feature (1)..(207): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgatatgagaacagtgggaagtgttgttgggggtgatgtctggtttgtggagtaaatgggaatcaaggaagtagttayagcttttgaagaasctctctaaagaatttgactctaaaaggaatgggaaaaggaagaaatatttgagaaacttggattgtagaagggttacygggaataaattttttttaataggaagaaaactccttgaattactgctatggttctttgctcaatcagccacccttaaccctacccccttcttcctagaaaataaggccaatytgcaagcagttaaaaacatatgttcattatcaattcargcttcccttttgttatcctgttagtacaatctcctcaacctaggaaataggagtcatttgagttttcttt

SEQ ID NO: 2164 - DNA, 598 bp, Bovine  MMBT23509
  misc_feature (1)..(155): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcattattatgacatttaatcccacttgtaattgggtcacagcttaaatctaaccatcttcctgggctttccatgactgatttagcccatactaatatcccatttcttttcttacatatcactcatcaactttatcatactgstcaacaactgtcattcacctaaataaattatgtaactgtttcttttgtaagccttacctcagtgagactgtaagctccctacagccaagcactgtgtcttaaacatcttctttctctccatgtcatctattamgcttgatcacttcttaatgggtagaaaagaggagaacactaagagtgggcacaaggggaacagtccctatgaattaaggtgtgtgtatgtaygcatatgtgtacatatattcttttttcagtttcctaaacaaaattttccrattggaaaatactccattctact

SEQ ID NO: 2165 - DNA, 598 bp, Bovine  MMBT23363
  misc_feature (1)..(73): n is any nucleotide
nnnnnnnnnnnnnnnnnnnnnnnnnnnnnnnnnnnnnnnnnnnnnnnnnnnnnnnnnnnnnnnnnnnnnnnnnggttggaattctctataatctatagtttattatgtcacctaccagttacagtgacttctaactccttgtttccaatttttaatactacttcttcttttctgtttttacatcctgagctttgaccaagccttgaacagtatcaacagtaagagtgtaccctttctcttgctctgagtcttatkaaggggaaatctatggtgtcaatcaccctttaggaaaagatgacyatgaaggagtctctctgattcatctcttttgcagtgtctccctcaggtcaaggagcagaggyaccactctggctggagacckgccctcagcccacctcagtcccagcccaatttatcaggcccttccttaggcttctcattattacayactaaaatgtttggttttgtctccacagggcaggccragtcttcacagaaaattgaagacttgatggaaatggtgaagaagttgcagaaaggtcacgtgtctcctctataactgaggctcagcccgaggtttggagtcaggcagaagtgg

SEQ ID NO: 2166 - DNA, 561 bp, Bovine  MMBT23389
gcgatgtctgggargagctctctctgctgctccaggtggatcagtggaggcatacttcaagcctcagcctaggagtgtcctggcaacaggaagatcaacaggatgcagaggaggacaggaaagctatccaaggactgagkggtgaggacttttttcaggtggggggatgcacatacaggtgtattcgtctcattttggaaaatcaggaaggttgaagtggttttgrcaggtatctgttgacragactcagaattycagacgtctgagtggagaggggtgcccaccatgaggctgcagccrgagtgtggatgtatgataygactacatgggagtgaagacttggggccaataactcagyagagccaggggcaagaggggamgtgtgagtgctgtcaggagaccacgtcagaggctgtgcagacatggcagtggcttgggtccaagtggccggggctggactgagtggagggcagggctccaagggaatgagatacgcgctggactagagaggaaacaagggaaacagatatgactttacacttttgcagatcatggtgatgg

SEQ ID NO: 2167 - DNA, 598 bp, Bovine  MMBT23478
  misc_feature (1)..(212): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcatgcacggcagggatttcggattgttgtgtattactcccttttccattcagagcctcctatcacttgcttctagcaacacagayaggcattaccttctctactgcagggcttgtctattgatgtmagagaaatctaggagttggttttgtcctctgcgtctatactgagccttagtacgctcagctagttttagtaatttctaraacttaacmcacagacccagaattatgaaggcagatgtgatatggcggcagcactggctctgggcactgccacgcactgctgaaagtggastcggagtccatctccactgtttgctcatcgcaagtgctaatctcggagcaggggtcacagtcacggtgccagtaggagccaggcagg

SEQ ID NO: 2168 - DNA, 598 bp, Bovine  MMBT23470
  misc_feature (1)..(60): n is any nucleotide
nnnnnnnnnnnnnnnnnnnnnnnnnnnnnnnnnnnnnnnnnnnnnnnnnnnnnnnnnnnncagtagtcagtttatggatgacatcaaagggcttccttgctttctgacttctggttggttttgttcaatggaagaaaccrgtaagaaactgaacagtgggaagaatatgaaattgggatgtttattccctttctctcctgtcaggtggcatggttcctctcttgcaatgcaatccactgcatgtgtaagtgttacctgacctctttatgtaatcctatgggaatttcaagctcagaaaaytgcacaaatgctgatactttggctactgctattgctgtgagtgacaaactgtcctttgtctctgacccaggagttttgtgtcttctgccaggatccttgaaactagcaggataatttgtcagcttgcaagctgagtaaaaactcggttagatcttcacacaatggagttctccactagctccttttgttatattttgttttgtcttgtttaaacttagtcacatcttaataaggagctcctttaytaaactctcttcaaaytacccagcttgaatgtgccatctgttttctgctttat

SEQ ID NO: 2169 - DNA, 598 bp, Bovine  MMBT23393
  misc_feature (1)..(223): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaatctggacttaacagattccatcagtttcttccaggtatggatcaattgaagcagatcatctccttaggccrgcttatctacaaccagtgtgaggagatgaaatactgccagaaacaatgccgacgtctagggaaccgcgtccagagcctgctgcagcctctgcaaatgctccaggaccaaggagagaggaacctgcccccccagataactgccgcgctgagccgtttccaggatgccctagaggaagctaaggagcggatagacaagttcagcaataagtccaatatccagaagtttctaacagcagggcatgacagcataatctttggtggggtgaaccagaggctgagcgatgtctgggargagctc

SEQ ID NO: 2170 - DNA, 598 bp, Bovine  MMBT23402
  misc_feature (1)..(71): n is any nucleotide
nnnnnnnnnnnnnnnnnnnnnnnnnnnnnnnnnnnnnnnnnnnnnnnnnnnnnnnnnnnnnnnnnnnnnnntttatagcgtatttctcatgtcttattcgtttaataaatattgcttgaaaccttactatttgtaaaaagggatatgaagaattatttagaataaaagaaatctgacacattatatttcatcaaatgacatttgctggctatctctttccctgaaatcctttttttaaratgagaaaagtaaagagaagaasmgtkctccacctaggacatactaggcactgtgaatacygttaacaaactggatttctgttgtaaactgaatgtggtcaataaagagttctctaggggttatgctagagcgttaatgcttatactcaagtagctactgattattccctaaatatagagggtgtgtccctatggcttaattcacacttttgatagaccaatttccaattaaccagggacatttgaattccatttttgtgccttgtagtgctggcagtcttcccagatgggaagagatagtgtactcattaagctgagggtgaggctatcttcccaatcattaataaaatgtacaaaaa

SEQ ID NO: 2171 - DNA, 453 bp, Bovine  MMBT23511
  misc_feature (1)..(71): n is any nucleotide
nnnnnnnnnnnnnnnnnnnnnnnnnnnnnnnnnnnnnnnnnnnnnnnnnnnnnnnnnnnnnnnnnnnnnnntttatagcgtatttctcatgtcttattcgtttaataaatattgcttgaaaccttactatttgtaaaaagggatatgaagaattatttagaataaaagaaatctgacacattatatttcatcaaatgacatttgctggctatctctttccctgaaatcctttttttaaratgagaaaagtaaagagaagaasmgtkctccacctaggacatactaggcactgtgaatacygcatatgtgtacatatattcttttttcagtttcctaaacaaaattttccrattggaaaatactccattctactatcggataaataactgaaatttcctgggaacaacacaaagttaacatcataagtaaatttcccagacttcctatcaaaaa

SEQ ID NO: 2172 - DNA, 598 bp, Bovine  MMBT23464
  misc_feature (1)..(51): n is any nucleotide
nnnnnnnnnnnnnnnnnnnnnnnnnnnnnnnnnnnnnnnnnnnnnnnnnnntttttcccgcagccgtcccggggctcatacgctacgtggccgtgggcagctctggggacgacatggaccggctggcccagcccctcccttcagacggcaagggggcacaggtaggaggaagccgccgggcgagggcaccggagtcccacggagggcctggggacaggataggccccgcgaaggctggggctgccgctgcagtcaacgggctgggaccctgtgactcagagtccactttctttttgaaaygtgttattttaatcagaattatacatacctgtagcctgaagtgtcagagcattctatagtgatggctaacaaaatagaataaaaacaaaatatagccttctggtgggggggcacaccgctgacccttcccaagctgcacttcaggctggttctgattgccaaataacacattaagctgccgccttgttaaaagtgctttctggaatcgacgtttagttgatttacagtgctgtgttagtttcgagtgtccagcgaggcgattcagccatgtatgcrtatgtatgcgttctttctcagg

SEQ ID NO: 2173 - DNA, 598 bp, Bovine  MMBT23576
  misc_feature (1)..(17): n is any nucleotide
nnnnnnnnnnnnnnnnnccgatatgagaacagtgggaagtgttgttgggggtgatgtctggtttgtggagtaaatgggaatcaaggaagtagttayagcttttgaagaasctctctaaagaatttgactctaaaaggaatgggaaaaggaagaaatatttgagaaacttggattgtagaagggttacygggaataaattttttttaataggaagaaaactccttgaattactgctatggttctttgctcaatcagccacccttaaccctacccccttcttcctagaaaataaggccaatytgcaagcagttaaaaacatatgttcattatcaattcargcttcccttttgttatcctgttagtacaatctcctcaacctaggaaataggagtcatttgagttttctttttttcctcccagagttggagaccaaacctacaaccaagaatacgataccaacagaggatttttctaaaaaacatttatcacaggatgccattgtagagaaactcacagagaatggtctatgggaccccataatgggaggattatggaaatggggcgacaggatactgagactgcagtatagtcagcagag

SEQ ID NO: 2174 - DNA, 460 bp, Bovine  MMBT23579
agaggatttttctaaaaaacatttatcacaggatgccattgtagagaaactcacagagaatggtctatgggaccccataatgggaggattatggaaatggggcgacaggatactgagactgcagtatagtcagcagagtcctgtaggccaaaaaacagttaaacmcaagaaaatccccactattcagaaaggctttgagtttggaactgttcttcttccagaaccagaagttatcacagaagagccccatggcaaataccaaacacatgatggaaattttacagagggtttagatttgaycacagatacccatctgaggaaggaaatttgcaaggatacagaaggcagcaaagtcayaagccctgcctcagaactcactttagagaaaaaacccaataagaaagaaaaaccctataaatgtagtacatgtgaaaaggccttccgtacaaggtcattaaaa

SEQ ID NO: 2175 - DNA, 532 bp, Bovine  MMBT23572
cttaaattcaccctttggctaagatatctaaaattgactttgtgtgcaaacacatactcaacaaagaaaggtcaattgtagaaatatatatacacacaactaaaagattaaaaagaagtctgagtaaaattagctgtattctttttttgtcaatgaaactgatacagtagatttattggtagtaaatatttactttctgcttgtttccctctaaacttccacactggtataatacactgataatctgatacttcaccaccataaatatagaatgacccccaaaataaaaaataaataaaycagtgagttataaattaaagttgtcagtaaggtacagcaaggtgaaaaaggatgaaaacttaaattttcaaggccagtgaataacaatactgatgctatattccatgcatcaatcaccattaccacagagctttgatacctacactgccaaatatttcacagacagccttaatggtgatgaatagatgtgccatagcactgaaactgaaaggagactctggtaaacaaaaaa

SEQ ID NO: 2176 - DNA, 403 bp, Bovine  MMBT23581
gaatggtctatgggaccccataatgggaggattatggaaatggggcgacaggatactgagactgcagtatagtcagcagagtcctgtaggccaaaaaacagttaaacmcaagaaaatccccactattcagaaaggctttgagtttggaactgttcttcttccagaaccagaagttatcacagaagagccccatggcaaataccaaacacatgatggaaattttacagagggtttagatttgaycacagatacccatctgaggaaggaaatttgcaaggatacagaaggcagcaaagtcayaagccctgcctcagaactcactttagagaaaaaacccaataagaaagaaaaaccctataaatgtagtacatgtgaaaaggccttccgtacaaggtcattaaaa

SEQ ID NO: 2177 - DNA, 598 bp, Bovine  MMBT23537
  misc_feature (1)..(223): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcggtcgacagcacctgttcacaccaacccccactgggacttcggggccttcaggcagctcgatcgcctggtgygggagacccacctcagcttctccaggtgactgtggtgaggctacctggttcctggaatgagggtcacagcctctccagggtgggcgccaggagggcacgggggagagtgggggcctcagaccgtgtcaggggtgggggtcatgggcggcttccctgggccacgttactctagggggagccccttccacmgctcgtggccctcagactgtccccatattctggcccttcacccccaggtttgctcaccggtttgtagatccgggcacgtacgtgtttcaggacaacgggcagcccgaga

SEQ ID NO: 2178 - DNA, 600 bp, Bovine  MMBT23551
actggtttgagagtttccacattccccactcagacagcagcctagatgctcctgccctccattgactttgccttaggtcacatcttcaggctccatcttgatcttgatcttggtctttgccttctctaaaggctcttcaactcaaatctgactcttatctctcacaatcctcttgtcttgatgtttcaacagtttcctgggtttccagcctgctctctttgagacttggttgtgtgagccttcaactcagtccaagctcgtgcagagatttcctgaggctctgggttttcctggctcacrtttccagagtctccagctggcatgatgcccccaataagccagtgagrmacacacttctttatcggccctctttccttctctcagttcattctccaagaatagtctccgaggtcagccaaattgcctgggcccrctccctatgctgacgatctggcaccctcyggtggtcatggatgactgcgccttggctgtcagcgagtttcagagcgaggtcctacttgagaatccctgggcctgttagggccctccagtgacagttaaaaagagctgcttttagaatctactgtcagatcttggcaa

SEQ ID NO: 2179 - DNA, 423 bp, Bovine  MMBT23506
  misc_feature (1)..(125): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaggcataggatatatatataaatatatatataagcaatcattgaagacaacttgttaaatgaataaaatatgaaatttggatgaaggttttcacatgccctttttattatgaattttcttataatttctaagatttaagatgaccaactacttttctacattcttataaagcrtctcttcagtgtgtattttctggtgattgctcctggatgttttcccacattcataaaatatacagtttataagattcttgttactgtctgaacaatgatttgctgttctctatattaactgaa

SEQ ID NO: 2180 - DNA, 600 bp, Bovine  MMBT23365
tctctataatctatagtttattatgtcacctaccagttacagtgacttctaactccttgtttccaatttttaatactacttcttcttttctgtttttacatcctgagctttgaccaagccttgaacagtatcaacagtaagagtgtaccctttctcttgctctgagtcttatkaaggggaaatctatggtgtcaatcaccctttaggaaaagatgacyatgaaggagtctctctgattcatctcttttgcagtgtctccctcaggtcaaggagcagaggyaccactctggctggagacckgccctcagcccacctcagtcccagcccaatttatcaggcccttccttaggcttctcattattacayactaaaatgtttggttttgtctccacagggcaggccragtcttcacagaaaattgaagacttgatggaaatggtgaagaagttgcagaaaggtcacgtgtctcctctataactgaggctcagcccgaggtttggagtcaggcagaagtggaatcaattctaagccacctgattcaccaccttgggaaattaatatctttccttcccctcttctctgtgtttatttatcgcctta

SEQ ID NO: 2181 - DNA, 598 bp, Bovine  MMBT23362
  misc_feature (1)..(118): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttggaattctctataatctatagtttattatgtcacctaccagttacagtgacttctaactccttgtttccaatttttaatactacttcttcttttctgtttttacatcctgagctttgaccaagccttgaacagtatcaacagtaagagtgtaccctttctcttgctctgagtcttatkaaggggaaatctatggtgtcaatcaccctttaggaaaagatgacyatgaaggagtctctctgattcatctcttttgcagtgtctccctcaggtcaaggagcagaggyaccactctggctggagacckgccctcagcccacctcagtcccagcccaatttatcaggcccttccttaggcttctcattattacayactaaaatgtttggttttgtctccacagggcaggccragtcttcacagaaaattgaagacttgatggaaatggtgaagaagttgcagaaaggtcacgtgtctcct

SEQ ID NO: 2182 - DNA, 600 bp, Bovine  MMBT03603
acgcaagtttagaggggatgattatttcctaattccatagattcctgtagaattttcctcctaaggaactggccgtaccttcgttgtcactcttgagttgggtgtagaatgttcaggattgtggacaagtcagatatttgttgtccccgtacgccacacaagtgaacaaaccacagctaccccacagaagactggtgagtcaggacagataccacaacttcagctttgctgtgctggtgattggggttaggaggtaataagcaaagttatgattcattgcttacaagtgaattgtttctmactaggctgtagttgccttcagtctccattccaggagggctcccgtggctgatggggagagaggaaggaaggataygatgacttgttccctccgtccttgctctgagagcctgggaggcttggtgaagaatgtgaggaagccaagcctccagtgcgtggagatggttgggaatgttatacagaaacctgctgtgtatcgttactactcctttcccttggtctcctctgactccctgggtgaaacaggagagctcagatggcacattttgtaaatataattttcagcagagagtcagacac

SEQ ID NO: 2183 - DNA, 600 bp, Bovine  MMBT01324
attttacaggcaggccaatgtagctcatgcgctggggctccttagccctcaggattttagtatagaatttacagagcaaacatagacagcgagggataaaaccacaccgtgctatgatgggaaaaggacgagttctagtttcaaactgttttcattcccaggatctactaagcataactgctacttacactggtgcatctgtagattgtgtttttgatgacacagacttattttgcctattctttcaaaacttcatactctttgttttcattattctttaaaaaacaaaaaaacatgtgstagaatgtttagagaaggcattcaaaattcaatgcaaaaaaaacaagagcaatataatttatcgtactgttggattcaacaaatttgtttagatgttccaaagcccatggacatgaatcaatactggattaaaagatcagaaatgttagcatatgcatactctactamtttgctagtgtttgaattaaatgagatcggagacaacacattattatagtctctgtgctctgaggttaggattgaagatgcctaatgatgcacttggacattactatgtattatgtgtgtatgtgcttaagt

SEQ ID NO: 2184 - DNA, 600 bp, Bovine  MMBT01910
gaagctgtgatcttgaaaagaagcagaatttacctgggagaagcaggaaggaccttctaagacaaggaccagcacatgcaaaggccctgtggtatgcagggccatggtggaatgaagggtttgttcatgtagctgctggtgccatgtgctaagacaggaaattctgcaggaagagcaggtttagctggatgtggccaggaagttttcatatatgagtttcagaagacgtcatatgatacagaatgttattagcaacccaggaaagaagaaagtcctgacagtatcagacaaataataatracgctaatacttattgaatatttactgtgtgccaggcactgttctaaatattggatctattaactaacttaaacatcacaacaactttatgaggtaggtactatgcttatttccattttatagatgagaacatcgagaaacagatggaaaaacataaaagcacagaagttttggtcatatgatacctgaatatgtaaaggcaaaataacttttaattatttgatgttttcattttctgttacaatagtaataattttacagaaaatttgaggttctccaaactggggactatgtactgaa

SEQ ID NO: 2185 - DNA, 600 bp, Bovine  MMBT01494
cacctagtttcttttttacaattagtagagcatggactagttaattggttaacagttyttcctgctgtgttcattttcatccacacatgcctattttagagaatttctcagggtatttttttatcattgaaatcatataatttctgatayttagaatttaggcagcagcttaatgaatttctgtaagattcatttccaaaacatggaatttgtgaaatgttaaagtatgtctcattcatttcagaaaatgaaccaccctggtgttgaaattgaatagttgtatccaaaatgtcacaaaargggccgttttcctgtaatacatcacttttctgtttagattgaaagtgataaagagggcaaggcaaataatagatgatatgcttcattctgagtgcttttttactcaaaagaaaaaagaaaaactcacagccatctgttatctgtgtgtcagtttgttgcaagtgaatgacatttttcttttttatttgagaagaaatttatggaaaagctgagcaaagttaactttaaaatatatggtaatattaataaagtacctatgtagatattaaagcctcattatgttttgcatatctggacttg

SEQ ID NO: 2186 - DNA, 600 bp, Bovine  MMBT02399
ccaaaagcagcagccgggagcgcaccaggatgtcatggcctccccggaacacgcctgcaagggaagagagaaggcaggcgygtaagaccgaagggggctgcagggctgggctgagggcagcgtgccacagctggcagaggcggctctggggtgagacgggagctctcacacccagtgtgaggcgctgggcacgtcactgcacctctctgagctgcagcrtcatcagtgacctcgcagagatcagtctgcccgtcacgctgctgccaagcccaaaacgactggacgtgtgtggttctgtgygacatcaccgaggctctcacacatgccgacctcatcgaagctcacagaccgagggacagccccaccgtggcaaaatcgcggtgcaggtgtctgcaaaacccaggggacagggctgcctcactgcgggcttgggggcagccagctgtgagcagggcactggagcagagccacctcctaaccctgtttataaacactcagaaaaaagcacttcccttcgttcactgtttcaggcgcagtaagcacattggctcattagcttttggagaaacagcgatcagaaacatttacatatgaaatgcc

SEQ ID NO: 2187 - DNA, 600 bp, Bovine  MMBT00758
attgttagcccctactatttgcctggaataagaggggttgaaaaatacaccgtgtgaattctgtcctcttggaggtaatatttttatttggatgataagccttatttgacgaagctaaacaaaattataagacagtagaagggtgacttagagcctttgcatttgcaaatcttccacaagtattgtgcacccaggttgcctcacatctggtttgccaaattgctaaataattaatatacaaagtctagaaacttccctatattttccaaaatgaagcagtaacatgaaggtattcacttytactcatactctaaaaatatattygttccaaaggaattaccaacaacatcttctacagttctttaatatagaacacataattcaaargaacaatgcctgacatccatgtttctggtcttcactagatacgtatctttcaccagatttgtcttatatccatttactctccaagaatctttcacttgagtcataccaaattccttgttgttttcccaatactgtatgcagtgttatacctccatgtctttgcctttaatgttcgctctaccctcaatgtccttctacccttcttgtatgttc

SEQ ID NO: 2188 - DNA, 600 bp, Bovine  MMBT01752
aatggcaatgattatcttagccaagtttgagtggcctaagggcaggggtcttattttattcatttgagtattcccagctcccagcacatgttgaatctcaagcacagttgaactgaacacatcactaagctttctcacttgcttaaaagagagaatgtgatcacagccctaatgttagcacctactattaaacatgatgtttagatttctcatttatggcagaacagattgtcaagacatctaagtgagcaggtactgacttagcgatttgccattttatttagagttaaagcaaataargttttttgaccctcttaaatggcatgatattttttaatatatataatgacaaagtttaataggttgtgttttggaaaaatgactgtctggaatcgttttcttgatcacaaaattgaatgttcaagaggtagagtttggkcccacttactccaaatctgctgtggaagtcaaatgcagaagagccattggtcttctgtgaatactagagaacttgcatattttttgaccaaaaaaaaaagaaatttcagaatttatttttatgagtgatctgaaatcactattctgttaacgtaatttctg

SEQ ID NO: 2189 - DNA, 600 bp, Bovine  MMBT03249
catgtgcatgtgctttctctctgggcggcagcatggtgggaaagtgacaatgtagactcaggagccagactgcctgggtgcatttcacatgtacagagtgatgatgatactaactactgcacagatttttgagattcagtaagaaaatgtttatgtaatattaatacagcatctttcacaagattagagctcaataagtacttttaattcccagctgcttgctgtgaagggttcaggttaccccagccatgcctcatgacaactctgcctccttgctggggatggggtagggtggactcwgtactttggaatggattcttgtattgtttgtccaacccttacgtygacaaagtgcctgtgacttgtctccaactctttactccgcagattatacataggacaactgagagagagggtggaccattcccacttggcacctttccgttgagctcaggtattccttatagactgtgtctgatagccttttaaagaaatgataaggaaatgataaagaataaccttccattaaacatttcaactctagggagccactctgcagagttctcatttgctcattgattctaaaaagtgtggtcagtt

SEQ ID NO: 2190 - DNA, 600 bp, Bovine  MMBT03646
acaccctctccagcatttattgcttgtagacttttggattacagccattctgactggtgtgaaatggtacctcatagtggttttgatttgcatttctctgataatgagtgatgttgagcatcttttcatgtgtttgttagccatctgtatgtcttgaattgaaaaatgaatttagaaagaccacaagagacagaatgacttctggcatgttaataaaagaaaattgatgctttgcattttttctactgtctaaaatgtgtatatccattaggtatttacatctgtagtcttaggcaaaawgatcagttttccatcaatgagaagaaatccgttccccaggtgtatattatatgtgagcrtgcttgtaattttcttgctgacaccacaaattctcaataagcctttgactattgaacttcaagttctaacagttgattgggagagaaggcatttgaataccaattcagatcctctcaactcagtagaaatctgtagtgctagttatttgatgagagttgaacactagcctcttctttggaggatttgcctccatgcggtgaaacacatgaaaatgggaaatgttttgttttagaatgactg

SEQ ID NO: 2191 - DNA, 600 bp, Bovine  MMBT04471
ctgcctggctgccagcaccgggagaccacgtggatgaaggaaggcacttaagaaatatgaagtgctgtacaattttcaggtggtatcattatttgaaaacacgttacccacggttaagggatttggactttggaggcagcagctaccttgttgatcagattttctgaggagagctgcagtcacccccttagggctccaaatgctgtgtcaggtttttcaaagccaattgataacaattaagtagatgccatgttctgcaagctgtcttttgtgggagttgaattctagctttctttcctwgtgagcctctgtacataagacttgctatgggcagtcaccttgttggagcttttgaatgcctctgaaactatactrgggtcaagtcatttgatgtgtgtgggtgttatctgcattgcaagagaatattctagaaaagtgccttttgctcatgtattttaagcattcccctaccaccagaattgatgtgattcaatcctatacacttgagttgtgaaaytggacccaagacagatagraatgacatagtaacagaatgttctttaaagaagagctgattacttcaagcttttggtagtaaag

SEQ ID NO: 2192 - DNA, 600 bp, Bovine  MMBT05152
ccaatttccctagttgtaaaattaggtgaaagggtgaatgatccttagcatccattattcatctgaaattctaagaagcggttgttatatacctttgagaatatgtttatgtattttaaaatttcatctgaaattatagtgtaatcaatgctaaagatcattgataagtgatacctacaggaagcacatgtaacttattttcatttgtccttcatcttctttatgaacaatatattactatgtctttttctagagaataactaatccaggagacttgtgatgacagataaccctgtgatwgtgactattttttttttaattgaagtatagttgatttataatgtgttagtctcacatgtacaaaaatgattcagttattcatagcagtagtattagtcactcaggagactgtagccaccaggctcctctgtccatggaattctccaggcaacaatactggagtgggtggccatttgtgtgtgtgtgtgtatatatacagatttacatrcatgtatatttcttttcagattcatttcccttatagattattacaagaaactgtstatagtaytgtatgctatayagtaggtttttattggt

SEQ ID NO: 2193 - DNA, 600 bp, Bovine  MMBT04062
tttttttctttttaatgtgtatgttcttgaggcaatgactttttaaaatttattttctaacctttcttccaagtctttatcttctcatatcaaagaaaaggaatgagactgtcttcttttttcactgcaggctttttcaagatacccagaaatgaaggattctttaatcgattaatcaggctcaaatacatagtgccaaaagcaaataaaacaatggcacctaaatttatatagtgtttgagaagcatcttcacaaacttcattttatttgatcatcacaaaaaaactttgaggtgggcmggtccgctatgatcaccattttatgagtagagtaaaatcactatgtgagcacagcacattcaacagcagaattgaaactagaagccagttctcaaatccctgtctccagtgctctccttccctaacacacaaacgcctatgatatgtagagaactgtgtaaatatctctcatctcacttttatatgtttatatattctagtaccaagatagaagtcttctcagtrttactcaaataaattggtaaagattttatgtcttctgaagctaagtgatatataaggaatgaaaactaatttatc

SEQ ID NO: 2194 - DNA, 600 bp, Bovine  MMBT05994
tgtttgtatcatacagcttttagaggactgtcctatacttcactacatagtatggcttcgtggaagggaataaaagcacagtggttaaatgtacgaactccagagttaaaaccacttgggtttgtttcctggcttcgctatttatagtgctactgtcacctaggataagttaattcatctctatctcatctgtaaaatggtgataataacaaagtctaacccatacgatgatggttaggaagattaaatgagtttaataaacataaagtatttaaatagtgcctggcatgtgcctggcakgtagtaaattcccagtaaagattagtcgttattatcagattagaactatcactttagggctggagsaatttaatggtaaagtggatattaaataacgtgaaatgcagaaaggtggtagcaaaggccagagaagaaaaagccatcaatttgtccattaagctatttgaataactgcagaaatttctgctgttttacagttgttcagcaccagctaaacaggaggtgatccccaactcacagcaattttcagttaatatgcttagaactgtaaaacaaataacctccaagcaaatcagatag

SEQ ID NO: 2195 - DNA, 600 bp, Bovine  MMBT08697
gattctacttaataccagaaacttaaatacaaatatagtgtattatttttatattgttgtcataacaaattagcacacaattagtggcttgaaacaacatgaatttattatcttatgtgtctgaaagtaagatgctcaaaatgaggtcactgggrtaaaatcaagatattggcaggattgtgtttcttttggaagctctaggggaaaaattgtttacttgccttttccagtatccaaagactgtgyacatttcttggttcatgatcctgmmtcattccaacctctttccattttgacaamtcatttgctgaccgtaaccttcttacttcttcttataarcacaactgtagttatatttaggcctactaggataaccagatttcttaatctcaaaataatgaacttaattgcatcagcaaaaccccatattgcatataaggtaagatattcaaatgttctggaaattaaggtatagacctatttggaacaccactattaggtctattagacagagtgaagtctctgatgtctcgcagtatagaaactactctattttttcagccattgtttatcaaacagaaattttatcycctggttaaa

SEQ ID NO: 2196 - DNA, 600 bp, Bovine  MMBT07905
atgtttatacaaatttaaataagagtaccaagaagaataatagagattcaattatcttttgtaattccaatctttatagaactgtttggcagaacagcatttttaccattaaacaaaattacttttaagaactgtatttaatttgtagttatttgattccatttagactattgatctttgaacaaaatgtctatttgagaattattcctaccttgtgggatcaattgaaagcaaaatgtctgttttgccacctaaaaattttacaaggaagaaaaattctgatataaggacagcaaaatscatgataaattaacttctactcagacatgatgaagaatatgaagagtgtgaaggcaaagagaaaagtaaagaggaatcttgcacttttctaaatgcaaatatcttattcttccactagcctcatttgaaaataagaggatacttagtgtggcaaatatgcagcatataattggaagagctgattatagagaaagtagaattcctgcacataatgttcagggttttttttgttaggcttattcatatatacattatgtacaaaaattttatattttaagtgtacagttcygtgaattttga

SEQ ID NO: 2197 - DNA, 600 bp, Bovine  MMBT06228
agatatcagaaattgagatttaggaggtgaaacaggtatcagaaatgaaaagatctagaatatgagaggttatagctgaaatgaggyggaggatgcytaacaacctggatgcccttaacaaacttcccattgagaataactaaaaacaatgaataaaatatacaattatattttaaaatgcatcaatgacctgctaataatgtaaggccaaaatgaactcaaagtgaggtccyagtgggatgacccaggcactgatactggccttaggactgagggcttttgacaaatcagaggatcttsagttccagtgttcacagcctttagagatatggatgatatttgacaaagcaaaagagggcagtctcaaagacaatcctacataaagctcaaaagggtatactagaaataaaactgttcccaaagcagacaacaaggatatctacttatcttaaaatttggcactggtaaaggggaaaaaaaaatctttcctgaaagtttctaagtacaagstagccctcatgtgtgagttttcttactggactagctctacctcagtagtcttcaaaacttcaagctgagaattcagtttaaaatggtcct

SEQ ID NO: 2198 - DNA, 535 bp, Bovine  MMBT04969
cctatatgcaaatagaagctttgaagcaaatgcctaaaacacttgatagaatgatgtgtgtgagatgcagatttacgttttggattactgactttatggctatgatatatccccccccgccctccccccctgcagaatgttgttctgcccattkatgaacaaatcaaacacatttgtttcttcaatgtgttctaaaaatggcttttaaaatgtgcctttattcacgcagtttacaagaaaataagtaggactgaaaccgatgcaagctggggacattatttctcccaacaggcctgtccygtagggcctgagaccggaagtgcacacayatgggtatgacaaggagtggtgtgcctgtgcgyccaggctcagtgtttctggacccctctggcttctcctggcacctccccctcagagcacttcctaygctccagtcacaaaaacgctggcctttctctccccccctctacttgctgctcttggataacccttctcatcttcaagaccgagtcaggggggccttccccctgctttc

SEQ ID NO: 2199 - DNA, 456 bp, Bovine  MMBT03264
tcaattcaaagagcataaatactaaaacagttacctaagaatatttagagaataagaatgatctacagagaaaaacttactagtcagaccacctatttaatagataatatatttaaaatatttgtttgaagcatggttgagctggcaggaaacttagggaaacaactcataggttgaaatgacaaggatgtttgattccataagagtaggcaaagtcacagtttgttttgagggcatttgctggcacctggcagtgaggtgcttggtttataaaggcggtgtactcagaggattggagayaaagcctagggctcaagcagaatgggaaattggatcagggattcccacatcaatttaggacccttgaagggcagcatcttccttgagagatctaaaaataaggaaggcatgagatgcaggaaggaatggttaaacctgtgggagcctaaacaaaaa

SEQ ID NO: 2200 - DNA, 600 bp, Bovine  MMBT03908
gggaggattgagggcaggaagagaaggggatgaaggaggatgagatggctggatggcatcactgactcgatggacgtgagtctgagtgaactccgggagttggtaatggacagggaggcctggcgtgctgcgattcatggggtcgcaaagagtcggacacgaccgagcaactgaactgaacagaactgaacccttgattaagtaaaaacctgtgtttcacagagtattttatgtttgtttgaaaataatttttaacaagatgcatagccataaaacattcacatttcaggtatacattaytggtttctrgagtgaaattaggatggcagcctttaaaaaaaattcatatcctgattgtagcagagattctttcttttaattaagaagctcaccagacacttgcaaaaaccatcccctaactaggtcccttgtgtctcagaattgcttgtactatgaatgaggggaatcgcttaatacaagcttattagacaaccgagcggcttggaggttccccactagacctttcaataaggcttaatcaaccaagtaagaccctgatgaggctggcaattagacttactgtatttttaaacggagttg

SEQ ID NO: 2201 - DNA, 510 bp, Bovine  MMBT04199
  misc_feature (1)..(1): n is any nucleotide
nttgcgaccctgtggactgtagcccaccgggctcctctatccaagggatttcccaggcaagaatactgaagtgggttgccttttccttctccaggcgatcttcctgacccagggatcaaactcacatctctagcactgcaggtagatctctttactctgagctcctagggaaactttcccaacctgacttagataacatgtttttaacctttattaaacatgccatgaatggtaatcactctcaactagtatgttatttttagtacattcaggtacttctgacctactagttgagttacaygtttaacaattcattcggttgttcctaaacctgtttatatcagtttacttgctgtagtccttacataacttaaacattatgtaagcctatggaacacaaaagcaaagagttatatctatgtaaatgaagttgagtgcaagctgaggagaatgactcaataaaggtgagtcattcttttaaaaggtattaaattagataaaggtagacat

SEQ ID NO: 2202 - DNA, 600 bp, Bovine  MMBT11281
ggtctgggtttatagtctgagtgggaaaggcctagcttcaagctcgggtctggcagattctgaagcctgattcttctagaaaaggctcagggttaaggattataattccaattggagaatgaagaaactgaggcccagaaaggtgacagggctctccctgtgaaggtggctccatccagtttaatgggagagcgctgagacagtacagtgaggggtatggagcaggacaagggaattcaggctgtgtctcctgtttctgtttgggctgagtctctaggaatcctttactgagcccttggytaattccttgcatgggtcctgggctggtctgcagtttccatggagactgcctccatccatccctgaaatctcattgtgaccagtattaagagattaactctgctcagcagccctcacagggtcttgggtgccagagtggctgtgggagctcccttaaggatgaagaggttgcctgctgtgtgcgaccccataacaccaggaggaggatgtcagactggggccagggcttcccccgggacccctcaggtatgatcctgacttcacatctacctggagaggaggctgagatggtgggagaga

SEQ ID NO: 2203 - DNA, 600 bp, Bovine  MMBT07815
tgtttcagaggccagcctgagtgaatgccagagaccagttaaaagactgcctcaggaatctaggcaagagatgctgccctggaccaagatgtaggtggcagagagaggggaaaagtggagagactccagagacatttaaagggccttgaagatagcatttgtctctctgcaggagagccaggcccctgggggttgggattctcagagatcgtgccacctggagtgaggaaagagtaaaacagttgccagttgagagcagaagatgtcagaatcaaaaggggcatccttaccccaacctcygtgcccgtcactgtttcaaggttgcagttgggcctggagtcggcttcaggaccagtccaagagtcaggattgcagggctagtgggtggagaggcagctgacctcttgaacttcttggaagtgctatgatagcaagggyagattaaagtttcttctggctgccagtttcagaaatcaaatcccaccatcttaagctaaaatattggaatttattggaaggatcaaaatcaccatagacagtaactgcagccatgaaattaaaagacgctccttggaagaatagctatgacaaacctaaaca

SEQ ID NO: 2204 - DNA, 600 bp, Bovine  MMBT06233
aggaaatgcaataatcatatccaaatttggaagtactgatagttcagttatccaacctagaccacaaagttaaacagccaaatggaaactggcctatgtaggactttgaactgggccttaaggagaatacatcaacaagctgtgcagagaaaatctcagtttcttcaagttttataatttaagatactataaaactttatatttgaaaataaagatgtgtgcttcactttttaaatcttgtaattcataattaattactaacaatcaaggaaaacacagcctgtaatgtttaaatttcaygcctataaattttattccctgaatttagtaaacagaaagacattctaaaactattaaatattgcttattggttaccctccccatcactccccatgaatcaatgactattaagaaagtaggttaggctaggagcaatgctgaacataatggatactggaaataataatgttaagaagcaagatgtggagcaaatcaataaatcaggaagggaatcacctacccttaactgataacaaagacaaggtcaataataacatctcacctctaataagttttaggcattgtgataaattctttata

SEQ ID NO: 2205 - DNA, 600 bp, Bovine  MMBT05668
tgactctttgtgacccccatggactgtagcccaccaggctcctctacccatgtaattttccaggcaagaatactggagtaggttgccacttcctcctccaggggatcgtcccaacccggygatcaaatccatgtctcccgtgtctcctgcattggcaggcagattccttaccactagcgccacctgggaagactatatatgtatatataaatatacatgtacattgtgaacatcgtttttcttcaacaaatatctcaagaacacgcataacttcagatgaagaaccttcaagctctttcyaggacagatatgtaggtcttgatacaattagttcaaaaatatactcagggcctccatgtgctcccaacaagaaggaaaaaccaacagagcttaygttaagtgtatccctggcttcacgtgggatcttccaaagggtctctcataacctatggacccttaagcaggaagggcccttagagatccttttgygtaatgtcttcatttcacagataggaacaaggatctagggacattagcagcagagctataaccagagtacagctgtctaactcgggtgttgttgattctctgaatggcata

SEQ ID NO: 2206 - DNA, 600 bp, Bovine  MMBT05992
tgaaaatgaaagtacatataaatagagcacagttgaaaatagaggaggtgagctaattatattagaagaaaaaataatttctaaatatatgggtaagagtgtgtaggcagagatacctagagaggacctggggctagacctattgtgtgaccagcaatgtaaatttatttaaggagcaaatgagaggtgtgcaaaagcaagagcaaaccatggctgaacagaaatcctcctatcctaatcagctctggtagaagtcagggtgggtttaagtgctgaaaattttatgttaaggaaactggyggaggatatttaatagcaagtcaaaaatataaatgggatgaaaaacccgcatgagggaaggataaagaaataatgatgccatggatagcagaaggaaaggctgcaatgagatttayttacccccmaaaaatattgttaaaaaaaaatggagatgatacccaaatagctttacttttttactgtaaaatctcaggggaaagctctcttatacctgwcactggggccattttcyatcagctttgtagggacaaaggaactgaatttggcatccttgatggtctatacttcgtaaataattca

SEQ ID NO: 2207 - DNA, 598 bp, Bovine  MMBT03359
  misc_feature (1)..(12): n is any nucleotide
nnnnnnnnnnnnaacggtttagaatattctttaaagaattcttcaagtgcataccaatcaacacatatctttttgttcattttgactgctaaataaaaattttcttgcctctttcttatttgcaagctgctcgggcctaagaccatgtcatacttagtattttttgccaatatatactcatatatcttactcattcaagatgcttggataaacactgaataacttgaatttacctaattcaaaggtatttaagtaaaatttataatttgcaagaaaaacttaccttaattctttcatttrttattgttcctaaagaaacaaacagtcaaaactttaaagcatacaattaccaccttgtttaatcttatctgacagcttagtaacttgacagaacactaaaaagaagaggtggtttaggaacatgcaggcaacaatttaaggaaaacacctgaggcaacaaaagattttgcagtttaaaatttgaaaggctttgaaaatttttatttccaaggcacagtggcagctgtgtgtttattatcttttaattttgttttgccagaggacaacagggctagttccagaaaaacaaatccactcc

SEQ ID NO: 2208 - DNA, 600 bp, Bovine  MMBT04891
agtgtttagaagcgaagatttgatgccaagtctgatacacaatcctcaaccaagagaggaatttcaacactgacaagctattttcatgctgtgattaaagtcctcatttaattatataatttgtctaataagacaatacttctaaagaaaatacaaattgatgagcatatctataatgattaagcatgtaaaatataaacaataatctataaagcatatatttctctcaatatttccatcttttctccctcagctccatgattttttctctatactttcccaaaacagtataaatacatrtgtgtatatataatattttcaattgaatatattcttaaaaagctgtgtaaataaatgtgcattctgaaatgtgcaatatactgtaagacctttcttttcatgactgcatattgtctcaagcatttttaatttgttgcatggcagatttctggaatcaaatagcagctgtttggggaaagtattaaacacattctctccaggcccactggctgttgttttgctttcatatcttctcaccataaactatatggcagctagagcagaggagttgttaacaaaatgtattttcattgctagcta

SEQ ID NO: 2209 - DNA, 600 bp, Bovine  MMBT07828
ctgaactgaactgaagtcataatcctcatctgattcaaacaactgggtttttgtttttgttttttgtttttctatcaactggtgatcctagactgcacgagctctcgtgattgaattgtcaaatagaaaaaatgagactctattttaaccacagtccctgggctctccatgctggtaataaatattgtggtgcactctagtggtagaatgagatagactagatctagaagtgcgctaggattagcagaagtcattgttattttgaaaaatttaccatccattgtggatttcaaaacatgrctaggggaatgtttcatgtacaaggtggaattcatgtaagaactttgcccctctctacccagaaaatacctggagaaaaataactgcatttytttaatagtaaagcatctcaatttaaatagaaatattatgtgtatttcagaaggcttgtgatcattttatttttaacagaagtggagtttattgttatcttctcatagtgcagtaagaagtatttttttttaaggatttttcaataaaaactgtcagggttgagagtaggtgcatgtgaataaaacaaaaatggacataaatataaag

SEQ ID NO: 2210 - DNA, 598 bp, Bovine  MMBT09537
  misc_feature (1)..(119): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttctgttaaagatactcaaggtaagaacctttaaaaaaaaaaaatctcatagttgggagatgtcctatggtgagagaaccatctcatgtataaatttgattgcatccaaaaaattcagtagtatctctggtttccagaatctctctggtacagttatcacgaagctaacagacrtgttaagtataaacctcttcctaatcaggcataaatattggatgatcattgtcagtagacttgatgcctgcatcgatattaattgcacaaatttcaggcaggattaggcagaatacaaggaaaaaaaatcagacagaccagaagggaaaggtttcttaagctattttagaagcttagaagtaaatcataaaatgtcaagctacagaaattggctctgataaatgtgattttttcctgaattagttcactaagcttttatcctttttgarcactttcagtcaatcctaaatactttaaa

SEQ ID NO: 2211 - DNA, 600 bp, Bovine  MMBT10149
attatctgctaattattagaaattgcatgttgttgttaattgcataaataaattgttttatctgaaagccattaaaaaaaggtttggtgtttgaagcatatatggttttgatgttcctgtataaaaacgttaaactgtttaactctaaaataatgacatgctgcttttaagacaatttcttagactaatggattatggggagggtgggggtagggatccctaaacatgtattttactttatttctgtgagatacttcacctgattataaatctgcatgggaagcaagattgcaaatattyaccaaatgtattagaacaacatccatatgatgctatagttttcttttttaaawccttagaaagaagttaatataaacattccctttttttccccaaaatagtcttatttttttaatgttccttttttaaaaaatatatttcattcatgattggctataagaagactatatttgtatgaacagttccctttgattttctatgaaataattcagaagagtgtaatggatactctcacagaatttgagggcaggacgcctctggaatgagtgggtgcctcaggggtccactccccgggaggca

SEQ ID NO: 2212 - DNA, 600 bp, Bovine  MMBT04835
attcttggtttcagtgaccataagtcatagatggccagtagtacactgtttcttttcctgttctttgtcactgcttctgtccccatggcaggcacccaaatgcccactgtctcatggggcacacttgttgagcttcagagggcactcagtgacctctccctgccaagtgccccccccagagaagaaatctgctgaggctctgaggccctgtctcttgctccctgccctcatccaccaaattgggtgacctagtccatatccttttgtggcctaaataccctcagccaaaaagactcatakaggctcctaccaagatgatgcctacttcagcccaggctccacctgaggtctccatttgaccccagggaactgccatatctccttgtcaagttcaaccatgagacggcacactgaccccaccccaacctagcgctcgtccacacttctgccatctctcccctgctccatttcctcacaagcaatgtcacacattctgagggtttggggtttaggagcccaccaacgttcagagaacagactatcacccatttctcagtgtggagagaagaacagtctgagcacctcagtctcacaggcagt

SEQ ID NO: 2213 - DNA, 600 bp, Bovine  MMBT07105
cagtttccgaggcaactacttatcaccatgggtgtagggtgaaagtagccttagttaccatgcaaacagtgggtgtggcgatgttccacaaagctttctttacaaaaccaggggacgggctggatttggccccccagccatagttcacctatccttgatctgcaccatcaaagcattaaaaaggcttcatgtcaaattattaaataattttaggcctaaacacagtaaatataaccactataaagttgttaaggcagtatttctaaaactatatttagagagctctgaagtagtaatttktattagtttatagactatagcagctaataaacacttcatttatttaagtcttgaagactataatgacacagtttcttcacagtattacaataaatgttttcaataactaaaaagacataaaagtatttaaatattattatgtagtatatattaaatgtcttatttctaagattaagtggactatctttactaaatggaagaatctcaaactgaaaactggtcatattctttcaacaaaactaaagctgcactcacacatatcaaaagacaaaaatcactgccatttgtatcaaaaaatta

SEQ ID NO: 2214 - DNA, 600 bp, Bovine  MMBT07597
ttgaaaataataacgtacttcagctctaacggctagcaatgcatcagatctctatctcagatctatgaaatttcaaaataacttattcctctttgcctgttgggcaaattgttaaccctacatctgcattccttgtaattttatttgcactgtcctttgagaaggacacccagttctttcaaaggtgggcattaggatactgaatttttttctttctggaagaaatatataattcttagatattctgagttctgaaccaaagatatttccatatttctaagaagttgaaaagaatggtgktgtttcagacttgcaaygtaaacattgactcagtccatcttcatagagaataaacaggtgaatgaaagcacccaaaggaattgtgagaccaataatatgcactccatcctgaaatgtgactgcattataaaatgcaaagtgggccataaacaaaatgagaatctggtcatcctaccccctttccacctggattcacaactcacttctctgatcacattggcatgcgaaatttttgtctccattaagatgagccagccatgttgggaatgttttttgagcagaagcaaaaataaaatgcta

SEQ ID NO: 2215 - DNA, 600 bp, Bovine  MMBT08698
atttttcatgttaaactgaagtggtgaaattatctgaactatggcaatacttaataccttacaaatcacagatctttatctctagccctttcagtgtcatttcctttatgccttagtcacatattaataaaccgtacgatgtatttgcacctttataagtaacagacgatgttcaataattgctgatattttggcttgtcatataatcactaaatatattaattttaatgattgtaattccaagtcacttatttcattacattattttttacaaagtatttctcagttctgttcctcttkgagtcctagtgagcaaatgtccaaatgtgaatgttgcttataaccctattcttgcatatacttatattaccaccaaaaatacattaaacagttttatctgaagacattttctattacataagaaatgtggatgttttctctgtttaactagcactttttaaacttgtgtaatttcatatttggctatagttccatttttttcccctaagcagcagagaagatatcatttactgtttctcagttttctgtaacacacatcaagaactcacatacttagtttccaagatattttacattgtg

SEQ ID NO: 2216 - DNA, 600 bp, Bovine  MMBT01383
atctgagacaggacatcccttggctcttatccaccattttattgtattacaagtagtgtgatttattgtgacaacaaaaaaaatacaaccacctccccaaaagtcccaaatgctcctggggtagtactgtgcccttcactcaatagcaagtcattctattagcaattacaattagcytctactaacagactygagagacaatatttttctctcaggtaaaacaaatctggaagcagcagtcttgggctgattttttccaagtctcctatcttttcttttccaacattcctagtactgatwtccatccttaagttcatggtcacagaatggctgctggaaccccagctactgtatctatgatttagttaagataaagaaagaaggggaaaagtcaggaagagcaaaaccatgtagtaaatgaataagtctcctttagaaatrtttctagaagtctctcccaacaactacctttatatctcattagctacccctgtcctcaaagaggcctacaaatgtaattaggcactttgctgtctctaataataatcagttccatagtgaagaagccggagtgaatggacattgggtaggcagccagtc

SEQ ID NO: 2217 - DNA, 600 bp, Bovine  MMBT00513
aggtaggagctcagagaagtgaactgacttgctcaaggtcacacagcttgggcaggacacccagaagagagctcttctcaccacactgcctctctggttatgcagtaatttggaagattactaaattgatgactccaattccagtttaagtaatattcaaatacccaacagagacttgcagctaaggctgaaagagcatgttgtgatggaagaggtctgacgtgggaagcatctaaaatctggaaattcgagaccttccacgagggaaaaacaaggagctgggatgttttagagcgtgawaaatggctttgtgctcaaggagggaaaacccaaaagggaatctggatcactgactgttcccgtaacaggagaaaaggacaataaacacatcagacactggattttacacacagagtcatggggggaatgctgaggatccaagctgctgagggtagggggccccagatttctaactacccccaaatctcaggttgtctgagatcccacccagcagggcactgaccgggaggggcagagccactgtctgccaggatcttaccgattacactcgtgtcagctgtcagccgtaaacaaatgact

SEQ ID NO: 2218 - DNA, 600 bp, Bovine  MMBT11530
tgtgaaattatttgttctagttctgtgaaaaataccactggtagcttgatagggattgcaaaacctcagtcattcttaacttgcttctcagaagatccttgtatgtaatcagcagaatagtacaagggcacacaggagaagaaaaacaagccacacacaaacagaatgtggtaaagttgggcataagttacagggctttaaacctattttataattaaaaacttggtcaaacatttgttaagatataaaatataattatgaaaaggtgaaatatcagaaaagaattcactgaaaataccmaaatcagacttgttgaattatttatttccagactttgcttatcctgcatacgaaaaaaaaaaaaaaaaaaagctgagtgggaaaaaaagcagattagtagattctaatagcttaccaagcaagctttgtcaattagtttgcaactgctgataaaagcacaaaaatgtgtactagagctgtgagatagtccatgaaactgttaaagtgtcttttcctggtattaattgcaaatgcaaaaattgacattcagtaagatttactagtaatttctttccaaataaatccctcataatctttctt

SEQ ID NO: 2219 - DNA, 600 bp, Bovine  MMBT12079
cccagaacacaggtggaacagcccaggatccaagctacaacctacagcagagccatcacaggagcccaaccccaatcagccaaaaataagagtcaacagacagactcatgagggtgagaataaatacctgttgctgtaagtccaggagttttgttacacagcaaaaggtgattaatttttcttttaccatttgatataatttcacgtttcttacataatcattcattttgctcctttttttctcataaaaaagcagtgattgaagcatctctgtctttggtacacctaatgatttttatytttggatcaactattttaaatttatragacctacattatcattaatagcaatgcttctgttttccttttgttctactatctttctaaaacaaggaaaatcacaataaagtatcaaggaataatataaacattgctaaaactcaactgttggctggcagatagatctcccatatgacagccaacgtgttaagctattagctgataaaaaggggttattaaaggaagtcctgctgctgctgctgctaagtcacttcagtcgtgtccaactctgtgcaaccccatagacggtagcccaccagg

SEQ ID NO: 2220 - DNA, 598 bp, Bovine  MMBT11932
  misc_feature (1)..(88): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatgaatgaggtggcattttaaagaatggttgaagtctagaaatcagaaaaggtaaaataaaacagagtaaggacagtttaaaaagtagaaccattcgtggtgtgttaaggaaacatccaggtgtccagactgactgtagcacagcatcggtgaagaataatgagagatgaatctggaaaaacaggtggaagccagatcactgagtgcyttaaaatgcagcctaacaagtttaaactgtaggcagtggaaggtactggcagtttccgttttgtttgtttttagcagatggctgaagttattagagttctacttaagacagaataaccttatattcctgtgcagggtgaaatagacaggaatggaggcaaaacaggtcattattctgtgcagaaacaagccctgaatctaaatgatgatagtgaaaacagaaaggggggaactaatgggagtgaaattatcgcccttttcgatatcttgaaataaaatctttccacatttacatgtgc

SEQ ID NO: 2221 - DNA, 598 bp, Bovine  MMBT13148
  misc_feature (1)..(53): n is any nucleotide
nnnnnnnnnnnnnnnnnnnnnnnnnnnnnnnnnnnnnnnnnnnnnnnnnnnnncagaaagccccaatttatactcaaatggttggaaacacatccattactcattttcttcctttttggaaaaaaactaactatgttgaattgcactgcatcctttaagttattcttagaagaccagtgttcacggagatggttaacctctgctattcacatggccactgtgagttctacatgctttagtgataatactgttctcaccatcagatttatttgctaacagaggctcttctcaatgacacaygctcagggaatatttgtgacggtgactctgatgaagaacagttggctcagatgacattataatcaaatatcttcaccaacwcactttgagaaaaatcagtcgaatttcaataggcacatttcaacaaraaaatacttttgcattaccaggctttcttgcttrggctaagaggaaacacttttatagtgcacatactattatgcccacttttataatgggtcattatttaataaaaataatttcaacatatatcataaattgagtttttcttgggcctaatactgcactggaatacctt

SEQ ID NO: 2222 - DNA, 600 bp, Bovine  MMBT11545
ggaataagaggggttgaaaaatacaccgtgtgaattctgtcctcttggaggtaatatttttatttggatgataagccttatttgacgaagctaaacaaaattataagacagtagaagggtgacttagagcctttgcatttgcaaatcttccacaagtattgtgcacccaggttgcctcacatctggtttgccaaattgctaaataattaatatacaaagtctagaaacttccctatattttccaaaatgaagcagtaacatgaaggtattcacttytactcatactctaaaaatatattygttccaaaggaattaccaacaacatcttctacagttctttaatatagaacacataattcaaargaacaatgcctgacatccatgtttctggtcttcactagatacgtatctttcaccagatttgtcttatatccatttactctccaagaatctttcacttgagtcataccaaattccttgttgttttcccaatactgtatgcagtgttatacctccatgtctttgcctttaatgttcgctctaccctcaatgtccttctacccttcttgtatgttcagagaactactcaagacgcaactc

SEQ ID NO: 2223 - DNA, 600 bp, Bovine  MMBT11736
atgagagagaggctctttttttgtacttgcccagatctttcttatatccccctgccctaggaaaagaagcccaggaggctggagctggcaggtgcgccagggcctgaaacgacctcatgagcatatccctgagaaaacacaggattctggtccctgaacacatcactggagccacgccaaggacatctcttgatttgttaggaaatctagagaagtggagttgggcagaaaggacctggatgccagggacctattttgggcaccgaggaaattggtctccaggagaaatttagagcaccracaaagtcatcatcacaaggctctgggaagcctctgccccagctccacacatgtcctgatctctggctccctgaggcaggctagtctcagatatgcccacctgtcctctacctttttctccttcttcttctctgtcccaggcatgatttgtcttttgggagcccaacatatgcactgggtttggattttaaaaagctcttttattgactgatattccttagcccttctcccagtcaggagagagaagtttgaggagttcctaggttctgaccctgcgaagatggggaatggtgtgatgag

SEQ ID NO: 2224 - DNA, 600 bp, Bovine  MMBT12280
gcagatgagaaktttgtattcttgaatacattaaatcaagccaaaggcctgatatgataagcattcagaatttcttttctgagatggatccccccccccctttttttttttttcagaaaactagtgaaaatttgtctcagatttaacagctgaaaccagatgcatttatgaaagagctggcaatctatatgcaatttgagtgctctgtcccaaaacaaagaggagtagaaactgtaagtggccaataaatatttgtcaagtatgccttgtgaagatctatcccttgtttcattttgattragcaacactttctgtatatttgttgtaatgtgattctttccctctgagttaaagcatgttcccatatcagaaatgggtctcccttcaaagagtttttagtctcagtgggacaaagacaaaactttatcatttttataatatgcaaaaactgtagaaggcttatgtaattgaataacaaaatgaacactagaggaaaagatgaagaggtacaggaaacagaggtatcaaagagatttgtgtagtcaaaagacagaagtatgatcacaaaaaccatgatagtacgatcaactcaagtcacag

SEQ ID NO: 2225 - DNA, 600 bp, Bovine  MMBT16287
tatttctcttttcataatatattcagatcattctccagtaatcagggatgctcaacactgccttaagacacagtaaaatcgccatcactggaggtcaggtgtaaagtgtgcatgatccttaaaaagacagtatttcttgaatgtcttaggaggtagacttaatggtcttgaagacctgctctagtcataacatcctgattctatgggttttttggtaagaacttttaatggcttatacaaatagagttacagatgrtggaatctcaggatggcagggaatatatcttggagcatgaatgsctccaaccaactrcatctttttaarttttacttggawaaactatcaaaatatgacacctgcagccccagagatatgtttattttacagttaacaaaagagaaggcaactgtttctgaaagtgactgttttgcttcaagaatctcaatctaaatgtatgtgtctcatgggaaatggagaaagaatatatgctatggacatctgttttatttttattgcatttttgccttttttcaaaataaaacacatcattggaggagtttaccattcccatttccatgtagcttctgataggctgtatt

SEQ ID NO: 2226 - DNA, 600 bp, Bovine  MMBT15584
gcactgcaggcagattctttaccatctgagccaccagggaagcctatgcttcatcttagctacttttccccacctggcccctttccaccaggctcctgctcatgaaactgccaccatgcagtcatgtcccacagggaactctgtcctctttgtcactgccgacgcaacaacagtggatgtcactgcagctttctgggtcacacacctcatttgtgccattcgcactttcagtcccttttatcatttacaattctccrgtgactctcctcactgccatatcttaattttaatactagacaytacattcattccttggcatcatcagagaaaacaaagcacaatgccattaatcatttccactgggcagaaaaggagcctcaaaacacagtgtggtggaagacagggttcaaacttcctacctcttcctcctaccggctgtgacagcggaccaggtgctcaatcttctggagctttgctttcctctggttactgacataagaaaaggttgccatgaggattaaactggacggcatgtcaactgtgcctgcaaatacacaagagacgccaactgcaatcctcctgctgggtccccgctcacgc

SEQ ID NO: 2227 - DNA, 598 bp, Bovine  MMBT17706
  misc_feature (1)..(161): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtactccaccgtggcaggaaggaaagatgggacctttgctgagggctcaggagtgtggtctcagaaccagggggcctgcctttccatctaagcgctgaccctctccagccatgtgaccttggacaagacacatamtctgtctgggcctcagtttcctcatttatatattttgggaacaaaaatagttcttatttcataggattcgttaaaggtttaagaattagtrcatacaaaacgcttagaactgtactcagaacctagaaagcatcatccatgtagtcagataacagagaggaaagccctggtgttggcatcaagccaccagggtctgtaccctggtgctgctgcttatgactgtgaccttcagctagaaacccaaacctctccgtctcagtttgctcctttgtaaaagcagaatgtgtgctaagtcgct

SEQ ID NO: 2228 - DNA, 600 bp, Bovine  MMBT19779
ttctcataattaataacaatgaatttagtcctgtccttgctacagatattttatargcaatgcttaaaagacatcatttaacactgtattttctattgataggcccaatgctgaaaatttcttggaaactaaaacaatctgcccatttgtttaaaaagcttcagtctttgagggtggatttgatttttgcaaatagccaaatgccactgagagttaaataccatgaacaagacaggtgactacatggggtgaaacagcttttttgcaaagccaaagtgtacctgaagagttatcatctascgtaaactggtcacaaaaagagtcctcaaaatrgccttgggagcaagagcatcactggtatcacgtgacctcctatggcgactgcttaaaaggaaacactcattttcatgcataagatctgatgacggcttaaaaatctggtttcatttctagagcatggctgtaaattaagtccttggaaatgtgtgtcttattttaaaaatagtatgttaaacaaaatatggagtgttygragcatagcagttaccaatccctctttaagcaaagcrctactcattaccttatctgttttgtaattga

SEQ ID NO: 2229 - DNA, 600 bp, Bovine  MMBT22154
gcgcatccctcagggcccacgtggagctcgggtctgcagcaggaaccccctgggataactccgtctgtcctgaggcccctccccagggctgcagcagagtacctgacttacggaaaagggcgttcttaactctatgcagtgagtctggcacccctgggctgcccagtctcccgctccctgtgtcctgggctgcgggcagaggcttggtggggttgatcgccagaygggtcctatgggtgaagagtctgcaggcctccatctgactgtgctctcaccccttctctgctgtctctctgcagrtgtccctctgaagagtccctgagcctgcttgcaccccctagaggtaagcagtggacgtctggggtggtgggtgaggagaagaccggagggtgaaatgtgtgaggggcaggttccaggggcctcgtctccctctgcttggccctctctgccatcttttctttctttctttctcctcttctgtctcccagagcccctgccctcctccagccatgaccctgggggtacttctgagttgcagaaagcagaaggggtttgggatcagctttcagggaagaaaagaggagagtggttcctaggtcg

SEQ ID NO: 2230 - DNA, 600 bp, Bovine  MMBT21843
gtattatttttatattgttgtcataacaaattagcacacaattagtggcttgaaacaacatgaatttattatcttatgtgtctgaaagtaagatgctcaaaatgaggtcactgggrtaaaatcaagatattggcaggattgtgtttcttttggaagctctaggggaaaaattgtttacttgccttttccagtatccaaagactgtgyacatttcttggttcatgatcctgmmtcattccaacctctttccattttgacaamtcatttgctgaccgtaaccttcttacttcttcttataarcacaactgtagttatatttaggcctactaggataaccagatttcttaatctcaaaataatgaacttaattgcatcagcaaaaccccatattgcatataaggtaagatattcaaatgttctggaaattaaggtatagacctatttggaacaccactattaggtctattagacagagtgaagtctctgatgtctcgcagtatagaaactactctattttttcagccattgtttatcaaacagaaattttatcycctggttaaaattatgttttcaaagaaattgttttctggaatgttttgg

SEQ ID NO: 2231 - DNA, 600 bp, Bovine  MMBT20471
agagacatagactttaacttattaagtcattgtatctgggagtgctttgttacaccacttagcctaataagcctaaatgaacacagaatcgaatcatctcattgtgtggaagaggcaaagagactgtgagagttcaagtgctgacacacagccatcacagtccctgtggggctggtgctttgtggggaagtaagagtgagtggcrtggggagatgggataagtaaattgtttctgagtgtgacagccaaattttgtgcaaaacatctaacatatgctaagatttcaagtcaagagacttrgagaaccagaactctggattttcaagtacttgcaagttgagctccttgattttgctctctgactctttgtcccaatacacacacacacaccccacattccacaaacacataccacacacacatcacatcacacacgcacactatctctgtcatatctaattcatctgtagatccatgagaatatgattattgtgtgaagtccatgagttttggagctgtttgtgatgcagcatttttggggcaatagacaactttgacaattgcataaataatgaaagagttctaattgtgattctagtc

SEQ ID NO: 2232 - DNA, 600 bp, Bovine  MMBT21029
agaatcaaacagcctccacacagttcttagttcctgtacatttcttagttattgctttttacactttggtaaattatttctgttccctttgattaagttccctcatcaatataaaagataggatcatgatagcacatacctcataaggtgytctggacattaaattagtatacctaaaactctgtcatttcatwttataagttgtggctaatattaatttgttcaaaagttaagcaaaaacataattttgtcattctgtgagcttcaataattcattaatttgaattcaatttattcttygtaagttgaatatagggcyttggatatcatctgaagtkyaggttacaattaaattgctgattacagaggatcactaaagatatttgtgctatgtaaagaagtctattatctgttctattctagtttttcaatgtcagctgcaatctctctaaaaaagttgaagtcagcctttattttaaaagcactttaaacacttccgtgaaataatttgatgtattggtattaatgtaattctcatggtacagaagaataaatgggctgttaagaatattgaaaaaattagggaacactgaatttaaa

SEQ ID NO: 2233 - DNA, 600 bp, Bovine  MMBT18663
gtgtgtggtatgtgcatgcctgtacgctgtcaaaattcagacccagtcacacagctggtagtagcccgtttctcacaaaagggaycatattgcttataatcctactgccaaacaatgagtattttttaaggccacttgcctcattctttcgggtccaaatgaaatctccaagcaacacaaatgaaccacagtgtccaggaaaatagagataartccrttaatagaaacaaacattaggtttgtttgagtaaaaagaaatcaaagatacatgttagctatttcctgatgaaytaatgacaygatttaggagaggaaggtggcttcagagatgcttgggaacctgggagaactgagtggatggctgatattgggaggaactgatacttagacacacttatgtggtgatgcctccagtcccagggcatgggcttttggatttgttttgtcttccctgcagaggtcaaaaattgaactgggccagctacactatcttttcctgttctcttcatgtccaaggacacccatctaagagaatattggccccgattcaaggtcatgggcagaatgaaactcatgggccccaaagtggtcaacttatga

SEQ ID NO: 2234 - DNA, 600 bp, Bovine  MMBT21851
attggaaggcttgcacatgatggtgacatgcatctgcacagacacagagtaaagcagagaatgagaatgaaggttttttaaatgtatttgtttgtaattggaggataattgcctcacaatattgtgttgcttcagccatacattaacatgaaccatccataggcatatgtatgtcccctycctcctgaatctccttcccaatcctaccccatccaaccctctagattgtcacagagcaccaggttaaagaaaaaagaaaatggaaaatgaaaatctggttctttttggaattttatctcytcttcttaactgagggctttycaggtgactcaatggtaaagaatccacctgtcaatgcaggagacatcggtttgatccctgggtcgggaagatcccctggagaaggaaatggcagaccattccattcttcttgcctggaaaagcccatggacagaggagcctggccaggtacaatccatggagtcacaaaaagggtcagacacgactgagygattgatcatgcacatgctcttcttaactgaatactagtccccaagttcagtgttcttgtattgatggtaagctccttgaggacaagag

SEQ ID NO: 2235 - DNA, 600 bp, Bovine  MMBT20009
agcataagcatggaatgatttaaattttttaaataatggctactagtttcaccctgttaaaatcccctttctgctgagtagccaccttccttaacaagatgtcagtttcgattccattattttaccctcatgtttggcaattaaaaccatctcatgtcctgtgtgaaactttctgttttctccagttcttgttgcttgggttgaggaggtgagaagtggtttgctcacccacttttttctcccccctccctttttcctccgttttcacccctctggcctgtgctcactacaaaagctggrggatttgggtgcgactttacattcttggtttcagtgaccataagtcatagatggccagtagtacactgtttcttttcctgttctttgtcactgcttctgtccccatggcaggcacccaaatgcccactgtctcatggggcacacttgttgagcttcagagggcactcagtgacctctccctgccaagtgccccccccagagaagaaatctgctgaggctctgaggccctgtctcttgctccctgccctcatccaccaaattgggtgacctagtccatatccttttgtggcctaaataccc

SEQ ID NO: 2236 - DNA, 600 bp, Bovine  MMBT18468
gaaggaaaaacaagccagcgcttccctggatgagaagttagaaaatgacagtagtttaaaattcatggggactttcctggtggcccagtggttgagactccaccttgcatcccaggggatgtgggtttgattcgcgggggcagggaactaagatcccacatgacttggggggcagctaagcccaaacgctccaataagagaagtccttgtcctgcaacaaagacccagggcagccaaaaaaaaaaaaaaaagcaagcaacaaaataaagcagcagtgactgctcccagatcccaggcacrgtctagagtggatccatcagagttctgacaaaggagatacrgatgaagatttatgtcaaggagtgggctcatgtgctcacaggggctgttaggccaggctgaagtctgcagggcagcctagcaagctggaractcctgggccagagcagacactgccatccaaccacagaatttcttcctcttgggtcccagctggactcttaaggccttcaactgactagatgaggcccaccaactctcctggatgatcttcactcagagtcaactgatggtggatgacgacccacctgcaaaacgtca

SEQ ID NO: 2237 - DNA, 600 bp, Bovine  MMBT21852
tggtttccctctcygccagctctayaaggtggacagaggggagctatcatcatcacctctggaagcttgccactaactccaaagatgtctcacatactaaaaacaaaatgaccagaaggaacctttgatccctataagagaaagacaatcccttttactgaacctattaatggactcagctgaactcacagagctgctgtttccaagcaggatttgacgctataagcttccagaargtagaattctcctggtttctgcttgtaaagtacgcatcagtgtctcttccacagtatgtcttgrtacttctgatggtaatgatcactctgagtgatttggttaagctagatactaattctccaaggaagcattactcgtgtctggagagaccgtactgatcaaaagattctaaaagtaggaatctggttcagcaggtgagcctggcaaatactgcaagtccgggaaggcatggttcaaaatattcaaccagttaacatatgaggaagaagatagatccacacaagacaccagagatgagtcctgtgaaaataaagggaggcaatgatctgggctgacaggctcaagcagggattttcagctaaa

SEQ ID NO: 2238 - DNA, 600 bp, Bovine  MMBT22105
agtcatggcatgtgggatccctgatcctggggaatgcaggatcttcagctgtagcatatgaaatctagttcactgaacagggcgagaacctgggccccctgcattgggagtgcagagtcttwgccactggaccacccaggaagtccctgctctttttgcttaatgttctctgatcaaggaaatagtttccatgcaattcagctttctgttttcttccaatagttkgcttagtttacatgttttcatacaaytggcttggagggagtattttgacacagacattttctcatttatcagaargctctgractaggcagattycaggctctgtggggagtgagttataagaatgtaagagaagaggatttgcctttatttgtggttatggaaatatttctgcaagactttcacaatgaactttgtcctacaccaactcttctctctcgactgatgcttatagaaactttttgagcatggcaaaaaagaaagtcacaggtattccaactcctccattcccacaactctcagacactatcacatacactcccaatccctgcaatataccccaccactgggatataatcttaatttgtaaagttgt

SEQ ID NO: 2239 - DNA, 600 bp, Bovine  MMBT21505
cttatttttaaaatgtgttggttcgtttgggaaaagaggttaggaggggttaggmggccaactgaaggtgagtcaagattctcttccatctcagagaaaggaaataaaaccacagatggaaagtcaaggtagagaaagtgctgactgacttccaaatcatttactcacagttctttttttttwmatttttttattttgggataattttaaacttatcaaaatattgcaaagacaatagagttcctgtacatctttcagccagtttcccctcaagttagcatcttatttaatcaagctacrcrtgtcagaagtgagacagtgacacaggggccacactgttacctaagctcggtgtcagcagttcccccattcctgccctgttgctgtttccggagccaatctaggaccccgtgttacttttaatcatcatagctccttaagcatcctttggtctgggtcaatttcccaggcttctcttgtttcttatggggcttcccagatcrtaaaaaattcgcttgcaatgcaggcgacctgggttcgatccctagattgggaagatcccctgaagaaggaaatggcaactccagtattcttccctgg

SEQ ID NO: 2240 - DNA, 600 bp, Bovine  MMBT19150
ctcctccgtccatgagatttgccaggcaagagtactggagtgagttagattatagtaactggtgaaagagaccttgaaatatgctaaagaaaataaaaggaacttctttacagagcgaagatcatgttctcagagtacagacttttgaatgaattttatagtactacaggtaagcaagccaaccttccacaactgtaacacagaaatcttcacaaacaggctgctgctgcaaagtgtatcacaaatacatgtgacaatattgtcaaggcaggttattttctatttctactgtacctctcrctacctcggtcaggaagtaggggaagctgagaagagtgaaaatgaataggagacatccatgctcctgctgctactggctgctgctaagttgcttcagtcgtgtccaactttgtgcgaccccatagatggcagcccatcaggctcccycgtccctgggattctccaagcmagaacactggcgtgggttgccatttccttttccaatgcatgaaagtgaaaagtgaaagtgaagttgcccagtagtgcccgactcttcacgaccccatggactgcagcccaccaggcccctccatccatggg

SEQ ID NO: 2241 - DNA, 600 bp, Bovine  MMBT22096
acagaactataaagtaaagtatatggatgtaaagccattatcctccagttaaaaataaatctagaaaaaaaagaaacagcaaaaagtaaagtatatggaagttctaccaagtcctaagtgttcctatgttgaaaattttgatgcttctaacatcattacatacaaaattatttatagaaattaatcttttagcagccctgctttgctggggcyctcagcatgaacttggtttccttggcaggtagtcaagccctgtttccatgttacattgacaccccaagccagttgtttctgggaccrgggtctgaagggttgtttatgcatcagagtaggggaaattgctctccrtgggtgggggtggagcagggagagcctgcagaagacaggagctcagctgggataatgagccagtctagagagagggaagaaatgaagtgggaagtggagaaaagagaagaggtgggagagaggaaagagaaaaagcaagaaagatgaagggagggtgacctttaccaggtgacagctgacttccaagggagagtggtggttgaggactagagctgtgggttctaggaagtggctctctagctgtgtgagttt

SEQ ID NO: 2242 - DNA, 590 bp, Bovine  MMBT22091
ctaatctgtgctcctctccagctgtttcactgaggaaactgtcccagccaggccttatgcttctgttaatactattctagaaccctggaaagacttttctacaacattgacatacttgaattttatctgctgtcagagacattgctcaaattttatttctaccatcaagtctttcctgattttatataattggagtggatcttcctttttctctctattctcactatrccttatgtatatcactctatttttgcaaataattttactttgtaaactgcttattgtgtctctycaataytrtattgtaagctccyagaaggcaggaccatgcattttcatttttgagcttctttcagtatctagtatgatagcagatgctcagtaggtaagtgagtgataaaaagtctaaataattgtaccttacttttggttctttacttttccttgacatgcgttgttgccttaatttctaacatgagtgaaagtaggcttacaacttcagcattataatttcaaatttttaataagtctatttaacccctctatatttctcttcattttcatcacattatatattagatagaagagca

SEQ ID NO: 2243 - DNA, 600 bp, Bovine  MMBT20883
cacaccaggcctccctgtccatcaccaactcccagagtttacccaaacccatgttggtgattgagtcagtgatgccatccaacgatctcatcctctgtcgtccccttctcctcctgccctyagtctttcccagcatcagggtcttttcaaatgaggagaatggatacacatatatggagagctgagtcccttcactgttcrccagaaattaccacaacattgttaatcagctataccccaatacaaagtaaaagtttaaaaacaaaagaaagaatcctctttccaatgaaggggatgcgrcttagatccctggtcagggaactaagatcccacatgctgtggggtatagccaaaaaaaaaaaaaaaagkaaagaaaatctaatagtacttgagtgtaacatgtgttttaaaaccttaattttttatgatgggaaatttaaacatgcatgaaatgcaaattgactatgatctcccaggcgttcatcatccagtttcaacagttacaacattttaccattcttatcatatctccttacctctccttttccttttttggcaggggaagacactttaaagtaaagcccagacatcatatcatta

SEQ ID NO: 2244 - DNA, 600 bp, Bovine  MMBT20145
tgggcttccctggtggttcagcattaaagaatccrcctggccatgcaggagacagttcagtgcctaggttgggaagatcccctggaggagggcatggcaacccactctagtattcttgcctggagaatcccatggamagaagagctatgggattcagtccatggggttgcaaaagagtcggacacaacttagtgactaagcaayaataattccatttctgcacagcctcygatgcccttctctgttcgcatctacttaggtcacttaataaagaggccttcggcagagatggagaagccygagccagaaaagaaggatgatcctgccccgttaaggactcgtggagaagagaaaagagtagtgaccatttccaggctgagagaaaccttttcccttcgtcactcgactgagaacaagtccccggggtccgaaggccactgatccgaggcggggtttctccgaagcagaaaagcagtgcccagtttcctagagctttggggccccccctgctcccagaagcacatttctgaacctggggaggaagggaggacttctgctcaggggccccacgacttgatgagcagagtggagatggaggag

SEQ ID NO: 2245 - DNA, 600 bp, Bovine  MMBT01820
acaggggtaagagatatagagagccagtcataactggtttgttcaaactgagcccagagccaggagacttgtgacaggaggggcagaaaggccagatcaacttggcagcaagagtctcaggctgttcagaccagttgaacatgctcgtgggagcaggttgcatcctggggggaaccaggcccaaaaataacggccttacccagcacgagggtgtcatgactttggttttctgaggctgactcatttcgacacagctttgcaaagatggcaaatatatactgtacaagtttgtctgcaaaytagaaatcaagaacatggatttttatgtcaggtggcagactgtaagcttaaaaattagttctaatgatggaacattctacttattatggtatagagcaccatccaattctttcatggatgtctgaaatgatgagaatatagtaaaagagagaataatatttctcaggaatctgtggacacctagaggtctaaagacattattttcaggtccttgtattttgtggttgctgctactgctgctaagtcggttcagtcgtgtccgactctgtgcgacctcagagacagcagcccaccaggctc

SEQ ID NO: 2246 - DNA, 598 bp, Bovine  MMBT10352
  misc_feature (1)..(45): n is any nucleotide
nnnnnnnnnnnnnnnnnnnnnnnnnnnnnnnnnnnnnnnnnnnnncagaatcgtaaacaaatctccaatgccaagatgaaggggctttcctctgattcatgctcaggaagcagatggtcactactctcatgggataacagcaatattcctggtctttccagacccaggaggtcagtgatgattccactgattctcatstcttcaaaaagacttttttttcttgaccacatttatcagctataaatgggctctaggactcaataataccaaytcaagtcatgaaacagaattcttctattytgcttcatatggtttgttgctggagagacaaagatgccaccccacctggaatggcttcctcttggtaaaggagggttctctttgttgcaagccaaataaagtaagatgtayrctctgaaagacaagccacattctctggaatttcccaagagaamcttgctgtgcatttctgcctgtatatacatctgctgtgactcttaacatctccttaaataattctcacaagccagttcatgatacgtttttatgtatgcccaagtgagatctttctatatacaaaatccaatttgaacttggg

SEQ ID NO: 2247 - DNA, 598 bp, Bovine  MMBT23441
  misc_feature (1)..(176): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcattactatataacattatagaatccttgcccagaagaatattagtctctatttctgcaaaaacatgtggtttattwwtttttttccagccccagatttagataagggaggaatgttttmagttgttactcaaagaaaagatatttaacttttctaaatcctggtgtgagtttatgtatgtatttccttcgaagttttatgatgctatagcttcttttaaatgtttgcacctctaaccttttcataaactctgtctatgattcatttaaacaacgtaatcaaaattgccattcttatgaggttcctgagagtggatagaatttgtaatattaatcagacaatttggggcccttatatacataaattgcactcatagaattgatataagcgaagaattagaatgggtggccacaaggaa

SEQ ID NO: 2248 - DNA, 598 bp, Bovine  MMBT23373
  misc_feature (1)..(211): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtagagcatcactacagagaaggggatcagcagcatcatgacacagcaaatatacatcaccatttcataggcagctttgtcaccayaggccagcctcagcatggtgggtgcctcacagaagaagtggttgatcttgtgtgaagcacagaatggtagagtcattgttataggggtgaggaggaagctatccaaagcaccaccaaaccaagagctggccaagatcatccaacagacscgatggctcatgaggacaggatagcggagagggttgcagatggccacgtagcggtcatatgccatgagtcccaggaggaaaaattcggcccctacaaagcccatatagagaaagtattgggctgtacaggcaataaaggatatggttct

SEQ ID NO: 2249 - DNA, 600 bp, Bovine  MMBT06433
aaataatattttacatgcttcctggatcaaagaaattcattttcacctagtgggtgtagccaataattttggcaacaaagtggaagaatcataaaaacaaaaaggaaaactaaaccccraagaaattttggatatatcgcagataagaaaaaaattgtagaacatgaggacataatgtaccaaagaagtcagcaatagtacaatttttttttgtacatagttttgtgttttctcagtcacacaaagttcagaaattttggaagtggacttcactttttaagacttctggagttaacattycagcatttacttaccaaattccatctcgagacaattttcttctgtggttaagctgtgactttgaaaaatatgctgttacacaagtaaatttgaacaaataagaaaatatgttaatttgaaatgcctgaaaatgtggcttaagccataagaaattgccatttcttattggtatatgtatgataataacatcatgcatgactatgaactagctctgaaagtcaatttgaaaaaacaaacatgtttaagaagtaaaagcagcagtgattttaaaaactcctttcaaagtttattttaacttta

SEQ ID NO: 2250 - DNA, 600 bp, Bovine  MMBT02231
ggttgtcttcattgggtacacaatttttagagttgcatttatttttaacttaacacaaaacccttgcctgcaaaccactcaaataattgcagtgaaaagaatatcatattcaccagtataagatctgctcttttgttttcctcaaagacaggatttctttcaggaaaatcatgcattgatgctttcctaaagctgggaatgttaacataaggcactcctcatttctgagtgtcctgcccattcccacctccagaacctgacaaatctacttaccagcatgtcaagtcacttctcttgaaraataaacaccagaaagtaggaggctcaagagtgacagaaatttagaccgaaattcagaaacggacatctaaagttaattacagccctgtcattcacagttatcacttcagctttcattttttctatcaaaactaacatatgtctcctacttttttctctgcgagattaatgtcctcttattcttagttttaaatttctctgagtatcagtccatggtcactttttggaaaataatcttaaacatgaaatcttgaaatgcatttttgtttggcaaattttataatgaaaaagtctgggcaa

SEQ ID NO: 2251 - DNA, 600 bp, Bovine  MMBT08423
aagagaatgaaaattcctcaaaaaactaaaaatagaattacccgatgatcaagcagttccactcttgggtatatatctgaagaaagcaaaagcactaattcraaaagatacatgcttatcaatgttcacagcagcattaatttttcatcagtagaaggcattcatttttttcaagtaaaatttatcaagatcagaaccagcttcatgggaatgtgacctgtgcaatcagtcacacaggctctgctcttaaaaaggctgycacttagttggatcctgtactcgtttaatgctctgctgtcmctatcttgaatgcttagcaattttttttaacaaggggccttgcrttttcattttgtactacttctccccccttgatttattacattctaaacaaattaactgacattctaacataatccaggctaaaacacagtacatctacctggaataagccagaagttaagaaactaggcaaaaggcaaattcagatctcctgagaatagtcaggttatatgaaataagatcaagcaacaattcatactccttactatgagccctaagactctaggtaatctagaccgtgcctacttctctaacttc

SEQ ID NO: 2252 - DNA, 600 bp, Bovine  MMBT08023
tatcagggactaatcatatgttcatcaaacattaatcaagctgttgctctgtgctaggttctgacctaaaggttggggtatgaagataagtaagttgctgttatcttcatcctagaggtgtctaatccagcgggaagactcacaatatttcctcagcctcccctgaaaaataagagcagtattttcacagccattgatcaagagaaagagaagggaggtggctggcatgcactttgttagctctccagggctccctcctcctgagacctgagtcgcacaaggaagcagattgcaagaaayccagcttattggtacctcccgacactgagagggtttagctacagcactttttggagctcttcaaggtagtgataatgcttgacaacttctgtggttctctgggttcactttataaagaggaaggggaaggggctcactctgatatagtgaccctttatttggccccttagagccacagagatctcttctggatcacatgccttacaggcactgtttgggtcatttcacctaggtgaggctaatccatcatagcaagaggaaatctactgtttacctgtttttccattattatagtgtagc

SEQ ID NO: 2253 - DNA, 600 bp, Bovine  MMBT05397
gttacagtgattatgttaaatttttaagaccttggtaaaaaaaaaaaaaaaaaaggagaatccacctcacttctactattctgaagcaaatagcagatctaattaaaaatttacccaggagaatgtcagtcagacaaaaacttatgaagaaaaactacaacataaaaagtgaaagcaagcataacaagcaaagtaagatgtaaaggtatgcctttgaagctacattacaggaagcaaaagaaagcttttaagcatatatataatggataagcaaaaagatcctactgcatagcacagggyactatattcaataccctaaaataaactataatggaaaagaatatgaaaaagtatctatatgtataactgagtcagttttctctataactgagtcactttagtgtatagcaaaaactaatacaacattgtaaaccaactatacttcaataacataaaattaaaaaaaagaaaactaagtaaaaactgctttgctctcccaagaaaattaaatagactcaatgagagataaactcacataaaatggaatatgacaggggttaagtcaaaaaaagaatatgagagttaagccaaaaaaaayct

SEQ ID NO: 2254 - DNA, 525 bp, Bovine  MMBT18597
gttattcagcctaacataccccttgtctgaaaatttgctaaaactgaaatctatttactactatctctaaacagaccatcaaaggatggagattccaaagacctacttttgttatgactagcaactataaacctaggtttctaaagaagtttattttcaaaaagagctgtttgggggaacwtctgagaacatacttcctgtttttagactaatagatatagtcttcaaaaatcctgaggttcagatttgaattaaattttatcatgttcgttttgtgtgttgttgaatttctaagttatygtgtgcttctgcgttcttttgaattaatttatttttggtggccctaggtctccattgctgcgagccagctttctctggttgcagtgagtgaggactactctctagtttcagcgcttctcatggctgtggcttctcttgtttgggagcacaggctccagggtgcacaggcttcagaagttgcgtgcttggcttcagcagttgtggtgcacaggcttagttgccaca

SEQ ID NO: 2255 - DNA, 600 bp, Bovine  MMBT17546
ttattgctaatattattagtcttcaaacttcactagttctcatcctttctagtttctgagccttcctcaaacagattactatggtgaattctcattcacctcaaatatttccttctgctgattaaaggaatcatgctttctctatttcagcctgctgtactcattctcaaatatcaatatatgtatccaggtcagaacaatatacattatttggccaaagtcacatttatcccatttttcacagcttatttttttcataaaaagttgttttgtaaaggttgtcatttaatgagggcttayttggtgattgatatataaaaagaatttaataaatgcatgaccagaaatagttttaggtaatcatcattatccacattttgtattcagatcaccagagacttgaattaagcattatgcaggagttttaataaaggtaggatgggatcagaacatagaagtaagttacatgtccttggtcacatagtgaggaaaaattgcattagtcaatcccagaactgtctgattctcccaccttcatagtaatcttcctaactaattccaagactctcaaaatcagcaacagctgaaagatctttcttc

SEQ ID NO: 2256 - DNA, 600 bp, Bovine  MMBT13708
agactaaggaatgtagaggggaaaaaaaaaaaaaaagatgtttatcctttcctcctcctttagaattccagactcctgtcttctcttcgagagccccagaactctctttcctcctcagggaccccagacttcttatcaatctacctagaaattgactgtctcagtcccaagatttaatttttaaaagctgttttaggttcacagcaaatactgagcagaaggtgcagatatatcctatatacttccttttcccagatatccacagcctcctctgccatcaacatctcccacyagatggtmcatttgttacaacggatgaacctacatagacacatcatgaccatcctaaattcacagctcacctgagggttcactmggtgctktactcctgtaggttctgacaaatgtatgtgagctaaatgcacctgcgctgaactgaaagcaggagtcggagggagagagataggaagctgttgacttggaagatggaggagggggccattcgccaggaatgtcagtggcttctagaagctggaaaaggcaaggaagcctagaatctccaaaagaaagacaaccctgccgacacctttgattttagcc

SEQ ID NO: 2257 - DNA, 600 bp, Bovine  MMBT17853
actcagtcactttgattgtgtccgactctttgccaccttatggactgtagcctgccaggctgctctgtccatgagattctcctgacaagaacactggagtgggttgccatcttccagaactcagacctacgtcttttatgtctcctgcattgacagatgggttctttaccactagcaccacctgggaagccrcttcccatggttatatagtatgtggtaagtctaggaataagcaggtgtctgctattaggctgttattgcctgttgctgttctcatctcttatttcagttgtcttgtcrttagtatttatttagttaaaaatgatttaattcccattttaacatgaaaacttgaagtttcaatgttgcctgtcttcaaagtcttagccagtgttgatcactttataatgatctccttataatagaaataattgaattactgtgtagtgtattagaaaataatgcagtattgtaggtcaattatacttcagaaacaaactcagaaaacaagatcaaatttgtggctgccagaggcagggcatggtggggtgaattggatgaaagtggttaaaaattatgaacttccatttttaaggtaat

SEQ ID NO: 2258 - DNA, 600 bp, Bovine  MMBT19737
tgtttgggaagaattcattacagtccattactgaagttacagtataggtatgagtgctcttgaatcagacaagaaagtcaattaatttgctgccatgtttcctatgtgggaagtttctaaatagaagttatatttctggggagcatgtttagatatgatacatttaaatgctccctcctgatgttttgtttgtttgtttctttgtatgttagtatgcctgtgtgaaccttattttacagaatgcattctgcttatattacccaaatagaggatggtggctttgagaactgaaaaagcaartaggtatgttttctttgaattgaatggaagtttctgttcagctctgtcgaaaaatgcacattacatactgcatggcatttatgttgaaatcaggtatgagtaatgtgagaatggaggttgagttttgacagaagattttgcatttattacctctttcaaaagaaaggtaatgaagcaagaaatagtcacaaataataagaagcagttgaatacacaacaatctccactctcctttaaattttcaacctctgtggagaaatatgcagttctttcaatcttatgttaatatatggaaagcag

SEQ ID NO: 2259 - DNA, 600 bp, Bovine  MMBT04037
tttatcattaataacgtgtatacagtcctggagaatactacaatatttactttagttgcttactatgctgtctcttattagtgtaaatactgccaagcatgacttacacagcaatggatatcttagtgcacttgagtgtctgagacctgttttcaaattttaaacatatccaaatttcatgcagatttttctagccaagattgtgtttagttttgttttccttaatttatttttaatctgcaaaacgtaagcactgttgtgagtgggtggggtgaaattggagactggattctattttcrgaagcttgaatgctgacccttacaagccattttgtatgtgagactgaatgtgaactagaacttagaattcattgacattgtatgtttcaatctctactgaagattaagatagttatcagactgagtcttttaaatacggagttttgcatccaatgaaatcgtttatctatctctcaaaattaaatactctgttcaatagataaacttccaaaagatgtctctaataacagcaaagtaaaagctgatggtgtgtattcacgttttcatgtaaaatttggtcttaccaaggcacttgatttc

SEQ ID NO: 2260 - DNA, 600 bp, Bovine  MMBT09141
tgtatttgggtgtagccagttaacaatgtggtgggagtttcaggtgaatagcaaatagcatatatctgttctccccccagatcttacgtactttaaaattttgagtgtttggatcctaactttaggatactctttggtaaattatttagaatgttacagacagaatacaataagcagaatgactagaaatttatacaggcaggtactattacttattactcactataakataaaaagtgcttcttttagttcagtgtttattcataacctttttcttgattaaaaaacaatttccgtttkgagtgaaaaacaaatgcactatgtttaagagtcttagggtagattgttttaaggtaataatcgtcaatttatattattcttttcttcttcttgaattggtttaaattacttggtttgactttaaagtggttttggtagttacattaatatatgttaatattaaatgatgctaatgtttacgtattctgttgtttagggaacagactttggaaattagaatgtagataccatttgatgtatttaatctctattccatttcagaatctcaaaactttacaataattacaaattgtacttctg

SEQ ID NO: 2261 - DNA, 600 bp, Bovine  MMBT04021
aagtggacagttcttgattatttgctaaaatttccatttgaaaaagttatatttcattttgacatgatggtgataaatcactgtagacagtggaaaatatcacatgctcaaaaaataaaagtacaatgggtggagtactgatgccatgtcttgtgaatacatattaaaatgtgtctaaaacaatcttttaggtagagtgtttattaaataatcagtgattcatacaaattaagtgcttggtaattatttgaactttaagtttgtataatttattcataactcttacttttttttcttatrtgctaagtgggaaagataagccagagaaagaattgtgtctaatccaagatctaacactgtgtaacaacttttattccttctgtgtatccttcactgagcctttagacttttgatagagaaaaacatttgtctctgatgtccttattgtattaactaccatcttaaattcttggtattgggctcaagcaaactgttaactcaaactatttgacgtcaccttctgctggttatgtatcagataccaactaaagcagaaagcacacacatccctgatctaattctgtattggtaattaaaatt

SEQ ID NO: 2262 - DNA, 600 bp, Bovine  MMBT17907
ttgccaaaaatatactttcagaggaaaaaaagcaaaaaacaaaaaaacatactcttggtattgatcctgagagaagccatgtttcctggatgacttgaggcttcaccttggccttgggaaactaaaacattatagctctcttgatttttaatagctaaagtaaacactgtgggagattttggtcatcaaatgacatcaatactaccagcatcatcactatctattcaggtctccaaattgaaagtcagcttcaagaaaagccatcgtgaagaaatatcctcttctccgagatcagaagarcctgagtggactgagaaaggccaagctggaagcagctagaggcaggagttggctctttactgaaacaaatattccttattgaaccctgarggagtgatgggttctaggaaaaccagtaatagccatctccaagttgaagggaaatgatagcagagaggataccctgaaataaacactttgtgtctcccagaataggtggaaatcaatttatctgaggaacaaatgggactgattaacaaacagaatgactggactcctaaggggttttagagttaattgggaggaggttaaggagttcta

SEQ ID NO: 2263 - DNA, 600 bp, Bovine  MMBT18627
ttctgtagtatgttacacattgtactaacactgggcaatcctttggccattcatgtaagttaaacaccaacttttctagggatagacatgttaatatttgtatcaataaagccaaaccttatctgcccttccttttttatcctgagttctatttgataatcaaacaatagcaacaggccccttgagggctaaaaaggaataatcttttgtctgagtctcaaatccattcactttggcttaaggaggaagctgctctcctggctacctggcttaccagcttagtgccctcctttttcttcyaccatctttctccaatctttactctttggctattgcctcagcccctcaatcaactatggtgatttttctatgttttgaagccagaatttcatgaaaatgtcctctcatataattttactatcaccctcagtccaggaattcacaataaccatgttaaggaaatcttatattctgacctgatttttaatctattgagtccaagaagctcagccaaccagaagccagaggtaggaatgcagatggagagtcaaaatcattcttggcatttcaaagacaacacagactaaagaaatgctattg

SEQ ID NO: 2264 - DNA, 600 bp, Bovine  MMBT19466
tttcattttaagataattaagaagggtgatatattttccccagaagtttacaaagcaacattaaaaagttatgtatattttaatatggagaaaaaattattaatattmaactagattctatgagattgaaatttcattttagttatagttttggtactctggaaggtacattaattccttaagacaatgttatgtattcttcaactgtttcagactgaagcatatttatataactattacttatktccaatataatcatttttttctcctctgaaaagttgctgatttctcctcactctkatggcaaacatgtagtaattattgataagacattcaactaragaaaaacattgctaaaaatattatcatgattcataattaaaaatctctttctgggtatcctagtcaataattcaaattccctgcagcattygtttctgccattgctatttttaagacttacagaagcctgctgatcaagacatagatttacatattttgcttttaatgtattattgcttcatttctcttatattctatacctttgtgtacaaccatccatgttgagaaaactctccttatgcagtgtagaagttggaa

SEQ ID NO: 2265 - DNA, 600 bp, Bovine  MMBT08021
gtccactggcccacttagcatgggggacaaaaaacccaggctccaagataatatactgtggacaaatttgactaagatttgaagcttatgagggggaaaagtttttttttttttttttttcccctgggtctttcttctaaatactgaattaactttctggggattactttagaaaaacctcatagtaatagcattaataatattttattgatcctaatagaaaaactcaaaaaccctaaagcactcaaattttgtgcasacacaaaagaacatgctagaaagtgaaatgttacagtgtgyttaatgttgttaacacagtaagtgtttctggatcctcaaggaaartattagaggctcagcccaatgtatagtgtgggaattgtgacccagctttccttgggaaagttagagagctccctttcaaaagttttcatctcatgaggtctgaaggtattgcatgggccctgcttggggaaagaggaaagtctgagtgacttcaggttgagggggtgaagtagtgacagaggctrtaagccacagctaagctcactccacttttgggtggcaccccacataataatttggtcagcagttttctca

SEQ ID NO: 2266 - DNA, 600 bp, Bovine  MMBT13384
aaaaaggaaagaaaatcaaacattctggtacatgtgaggaagacaggctgactctgagtgtccctctcggagccagccccagagccctccagccccagggttttaggaggctctgtaaggagagctgcaggaggctgaggggagcccgggttggtggtgaaggagtaccaagggggaggcagtgactgtgaggatcaaatggagataagtccgggaggggccaaaggacacctgcatgattgggggaggcggcatggagaggggccagaagccagtgaagggagaggccggagcttggcygaagtcaccctcagaagcggaaagctgctgcagtgactatgtttccccaggagagggctccaccttgggaaaatggctgcatctccatggttccgaggatctctgaggttccctagagaagccgttcaagggtggggcatgggggtcccttgcctcagttggaggaatgggagccagggacggtggttgggggctggctggctggtgatggttgagcctaacctaaccatgttagaagcaaggaagggaccaggaagagcacagagccacagtggccaggattcatgagtggggacagaa

SEQ ID NO: 2267 - DNA, 600 bp, Bovine  MMBT14493
gtcgatgtagggagactaggaattaatctgtattttgagacaaagaaagggggtctaaattaaggcagttttgagacctttcagtgggccataaatagagcatggtgatctctttgcaccaagagatgaggggcagcaagaagttcaggtgccaaagggcaacagcttaagagagtgatgaataatgatactaacactaataacaaagcaagtsggggagaaaatgtttctttgggacatagtatcagtaatgcttagaacatcatgtggaaatgtccgggaagcaactagagatcttgrtctatagctcagaaatggtggatgaagcagaatcgctccaaagcatgctcctttagcctttagtttgaagagactaaaaatggtcctttagcctagaatcaatggtttccctaacatgataacacctactttctttctcattcccttttaaaaattgryatgatgttaaatattttctttgcatgtgtcaactaatactaaggtgacaataaaacttactgtataaataaagttagggagggtattaatatggcagggaaattggtatagactgagactgtccttggcacactgaaacat

SEQ ID NO: 2268 - DNA, 600 bp, Bovine  MMBT16570
gcccaagtaactatatatgtaagagtacatatacatataagccatgcttctgcagttaaactagaaatttccatgtgttccttcatagatattgttttatactcaatgaaatgcagtgtcactatattagagcctgatttctgtttgctttctgtagagcactctttttttaaatcccaaataaaggtacaatttcattttaagataattaagaagggtgatatattttccccagaagtttacaaagcaacattaaaaagttatgtatattttaatatggagaaaaaattattaatattmaactagattctatgagattgaaatttcattttagttatagttttggtactctggaaggtacattaattccttaagacaatgttatgtattcttcaactgtttcagactgaagcatatttatataactattacttatktccaatataatcatttttttctcctctgaaaagttgctgatttctcctcactctkatggcaaacatgtagtaattattgataagacattcaactaragaaaaacattgctaaaaatattatcatgattcataattaaaaatctctttctgggtatcctagtca

SEQ ID NO: 2269 - DNA, 600 bp, Bovine  MMBT04043
aagtctcctaagggtggctaacaggcttcaaacttccttatgtctgcctttggtgtctgactactgctattttcttcctattttaatatgaatgttactgtttcttgaagtatctggactgtatgaaatttactatatatatctctttctacctactcaaataaagaggtatatatctccaaattttatagacatatgtataaagatccatgatgcccaaatcattaaaaaattaattttaaaagtcaacattgtgcattgtagtttttacaaagttttaaaaagctaatttaatagacygctctatccttccatgtttatattctcttatacaaaataatttccaaatataatcactatttcttcttaaatactgtcctttatcatttaaaatttgtaacaaagtactagtaaactagaagtcaaccaaatcttgagtataggagatatataacttagactgatttatatttaatatttatgacaaataatttggataatatagtagtatacttcacaaaaggcatttgtgtgcacttagtaaaaagtattgtgtacttcatttgggtacgcttagtgttcaattttatttttgtttat

SEQ ID NO: 2270 - DNA, 600 bp, Bovine  MMBT07388
gagcaaaaaattcagctctagagtaagtaccatatcaagattaatttatgtcggttatggttatgtagcacaggtgatattcagccaccaggacaatgaatgtgtcaaaatattttgaatgacttcaccttaaaargagacaaagacaagcatctattaacacacagttcgcagtagaatattatctctttaaaagcaccacaatggaacgctttccagagcacaatctttgaataatgttttaaaatattattttaaacacactgaagaatatttcggattaagttggtgagcattttyactaaaatacagagcaaatcttccattaccgtttctgcccctcccccaacatctgcctaaactgccactaggggtcagtatgaagacacagttctccaccgtcggaggaaaatgggctgcggaaaacctttccccgtgaaaagccctaacaaagaccataactgcacagctttagcattaccaagtccagcccgtacatcaggtctggaacatgagtttgcattttttcctgagactgcattttaatgttgtaaatcacagtggattatttctatggtcaatatttctttgattaaaaaa

SEQ ID NO: 2271 - DNA, 598 bp, Bovine  MMBT09330
  misc_feature (1)..(11): n is any nucleotide
nnnnnnnnnnngatcttgttctcctaattgctctagtggcccctgggagtgaacaggagcctggggtggaggatgttcttaggttcatgtttggaacacagtgtataatgatgctcacattccatttataggaatggcaaggaatttactctgtcaggaagaaaaatggagataacgtacaacaaaatgtgaagataatacctgtcattggacagggagggtaagtagaaaaaacaagtacttcagtcagtataccatgtttggcttattgcagcatatgctttaaatacttaagtaagytaagaactgcacatggaaacttctaagaaggactggtaaccaggtcagttaccaccaaagtgtgaccttccagggtggcttccccatggtcacagcccgaccctcctgctggcagcccagagccaccagactccaacagtcctgcttaagctgtgtgagcacatacataaaagatgaaagcatttaaatcygatgccacctcactgagttttgtgccaagaacactcactgggactctatatttaaaagttttctgtctggcttagcaggtaaagaatctgcctgcagtgtaggaggc

SEQ ID NO: 2272 - DNA, 598 bp, Bovine  MMBT12480
  misc_feature (1)..(52): n is any nucleotide
nnnnnnnnnnnnnnnnnnnnnnnnnnnnnnnnnnnnnnnnnnnnnnnnnnnnctttggtaaagaaccccctgccatgcaggagatgggctcaacctctagtggggaagagcccctggagaaggaaatggcaccccactccagcattcttgcatgggacatcccatggacagaggagcctggcaggctaccattcatggggttgcaaaagggtcagccacgatttattgactaaataacaatactatattcctatatwattataaactataataaatatgacatagccttgtagcagaatytttactcatatattcaattgtttgttattgctagatccctagaaatagatttactaagtcaaagaaaatgtgatatgtaaatatagttccccaagttgcctattgtccattttattttgatgttattttgcttggtatttccctcctcttttcccccgatgcttattcattctttatctctcaagttgaaagctgctttagctaaaagaccttccctgaacatttgatgaagaatatagaagagtatattgagtttgttatgtttattatagcaaactttttttttcacaatactcct

SEQ ID NO: 2273 - DNA, 600 bp, Bovine  MMBT16692
cctagcaagctttatataaattagcttttatttaattaacctttattcagtaagaattttcattaaaacttcttgtttttatatgttatgcattctcttcataaaaaatgaaaaagctttctagaaggtttttttttggtattattttattttattttttaactttacaatattgtattggttttgctctgtggcagattcatgaagtttttcttttattattaatatagaaagctgaattttagcctatgtagaagttaaaactttggatgatgtcatttatagtcaaggtcacaccaraagtatattataatgtagaagctaggcctctctggtgagaaccactcaagtttgatatagaaaagaaggacataagaacggctcttctctgggaccgtcaccaattgaaaacaacatgttcctgtccacagataagcccacacagactatgcaaatgtagacggtggcgggggtgggggggccccataatcagatgcagtaggtggaaacaaatatgcttgaaaagtgtgaatttatttaaaacgacagacagctcaagaagctatactttttagaaaagtgcatatttaaaaaaaataa

SEQ ID NO: 2274 - DNA, 600 bp, Bovine  MMBT17737
cttttcaggtcctatagtccattatcgtaggagatacatttgaaccagagggtgggagatgggggctttataaccctcacgttatacctgtaaactgctgtctgatgatgcaactgtaagtctcaactcatttatagtttgacaaggtgatttttgtgtaccttgttcagatgatcatcacaaccttatgaggtaggtagtgggtttcattagaccattttacagggagattaagtagttcagaactttgatgtcatgaagctggacctaggacttgattctgactcaagacggagggcycccccacattccatacaccatctggtgggatggactctgcaaaaaatataacaccccacctagggtgaccaagtcatcactattggcccaggacttttccagtttaaaaactgctgctgctgytgctaagtcrcttcagttgtgtccgactctgtgcgaccyagtagatggtcgcccaccaggctcccccatccctgagattctccaggcaagaacactggagtggcttgccatttccttctccaatgcatgaaagtgaaaagtgaaagtggagtcgttcagtcrtgtccgactcttagc

SEQ ID NO: 2275 - DNA, 598 bp, Bovine  MMBT18891
  misc_feature (1)..(29): n is any nucleotide
nnnnnnnnnnnnnnnnnnnnnnnnnnnnnttttgaccctagttgatctttaccttcccctggtcttaatctgacttttacaccctgcccactgctccacccccatttaagagcatggagaccatgttatctccttagacctcaaaccacctgtggggtcaacatcactattctctatttttcagatgaggaaacagaactaaagcttaggtaaacttgccagtgcagctagaaagtactggaactagacttttatctcagttctctttgattttaagagagttaagggctatagaagatyagaacactattcagtccaggagacagatgctgagaaggcacataatcaaactcaatcagactctgcaagtcatgtggctgtgaggaaggggaatacttagtttcttaggcagttaggaaactagatgactttctagtaatcagaaaggggcacttttacgagaagcaagaggaagtatttctttatctgggggaggagtgggggacggtacatgtgaaacttattattcccatgagggagcagtgactgcaaaacatagatgaaaaagagatttctgtccacagatgatggttaattg

SEQ ID NO: 2276 - DNA, 598 bp, Bovine  MMBT19683
  misc_feature (1)..(128): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagccgtctttagagttggcatacatactgtcctctacccgtcctttaccttaaagatgttttaatagaagccttgactcagtcacccactgtaacaacacctgtcctcgccaaggttacaaggctctgagacagatcctggagggcaagcacagccctgcctggtgctgrctgcaggcaggcaggaacaccacgcttctgcccaggggcgggcagcccagtggatggagaggcgatgtgaggatctggycgcattgcattccatggggccattagacagagccgtatgagcgattttacaaggcaattcccaagtccaaatcsgagtattaaatgcagggggtggaaagcaaatattacaaaattaatctacttaaaacaggaccatgaatcttattacatttccagccactatacgttcatgcttaagcaacagatgttaatctttggcaatgaaattgcttccacc

SEQ ID NO: 2277 - DNA, 600 bp, Bovine  MMBT22181
ccagcctgtatgagaatgccagtttattgcatcctcgccagccttaggtataagwtcttgtttggttttggtgttattagctatgggagttgaattttattaagtggttttakagtatttcttgaaawwtttttttcctggtgttttcattattctgcygtcttcctcaatattttaaaagatatttatttctttatttcactgcaccaggtcttagctgtggcatttaggttctagttccctaaccagtgattgagcccaagtctcttatgttgggagctcagagtcttagccactggrcccccagggaaatcccttcctcagtattttgccatattattatgggagcagagtaaaggaggrttatcaatagacatatcaccaagtttacaaaagaaaagagctagactcgatgcttcatagtttcttctgtgtctttaatctgtgttcatcctgatggacattttcacatggattatctgctgtcaccagaaattcagtgtatctgaagctgaatacccttatttgtcctctaaaccacctctccattttcccagtcatttgttgccagaaaatatttttaaaaagaaagcaaatgga

SEQ ID NO: 2278 - DNA, 600 bp, Bovine  MMBT08637
cctggagaatcccatggtcagaggtgcttggcaggctacagcccatggggtcacaaagagtctgacacgactaaagcgactgagcatgtacacacagctaacttaatacctatcgcaaactgatttttcttataactgatttttgttagcagttaaacctgtcttttctactgtcacctaatctacatctttttaaactttttctccaaatagggcaccgtaaaacaagcttatacaaatgctccagtggtagacaatgaactgttacgactgagtcttcgattatttaagcgaaagackatgtgccaagccccaggacctgaaaagactgaagatgataaactttcacagtccggtatccaacaggaactctgtgtrtcttaagactgaagtccaggtacatttgtggtactattttccttcagcagtgtgtattctttttcaaagttctttggtttgacaagcattattagtgacaaagacagaaaagacttaccagccatgctaaaatagtgatgaacttttttaataaagtttaaagacactagtttggcgagcttaagattttacataaatttttacactgtccaaaataatgtg

SEQ ID NO: 2279 - DNA, 600 bp, Bovine  MMBT19733
gctcatgaatatatatatactatgtgatatcaagttaggttccagttttgatcatcagaggtaagaaaagtaaatgattcagttttccttttatgaaaaatggatttttttttacttatttacttttaacaggaaggaaaaatgtttaaatatacagagacttgcagatatacagagatatacagatacatagagacttgcagatatacagagatctcagtttccctttggaaacatactttactgaataataaatgttaaaatagtaacattaaaattctgcaawgccygccttttttyatttagcaagaaaaaataattcctgtaccctcaccaaggtctaaaatgtraacatattaaatggtgtttcgaagttaggtttggacagcgcccttttcagatccttttatatgtgtaccaatttttttcataaaatattgctrcttgttattaaaacaatattaatattagtgactcaaatactttggccatctgatgcgaaaaactgactcgtttgaaaagaaactgatgctgggaaagattgaaggtgggtggagaaggggacgacagaggatgagatggttggatagcatcaccgac

SEQ ID NO: 2280 - DNA, 600 bp, Bovine  MMBT21403
atagcccttcactttcccagtgttgacaactgaagagacatgaaacaacacttctggcacaaaacatgaaacttaccactctcgtcatcaatattgaaccttccaagaccactgccatccctgatggagtactggatctccccatccctccccgagtcctcatcgtgggcagtcacctgcagcacactggttccaatccgtgagttttcttttacagagccaacaacagcaaagtccgggaaatagggagtatggaggttttcattgacatccaccacttccacctccacaaaggacacrgatgacagagagacaggccgccctttgtccttggcccgaactgtgaggttatagaactgctgcttttcatagtcaagctccctgctcaggcggatggcgccacttgctttatctatttcaaatctcccgttgtaatcattgaccaaagaatagcgcacttgaccccccagtcccagatctgggtcatgggtctccagccaagcaatgacggtgccaacggggaggtcttcaaggactttcacactgtagctactgggaatgaaagctggggagcagtcattgacatcatccaagaaaacc

SEQ ID NO: 2281 - DNA, 598 bp, Bovine  MMBT01061
  misc_feature (1)..(100): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctgtggccaagttcagcagctcaggccacatctgtgatcatccccaggatacatttctgcgtctggggccattcccacggccgtgtgccagggctctgccctcataccacgactagaaatcacaattttccaggagatagtaaccttgatagtagccgatgttaactgacttaattgcgtctcttcgattctcacgragcccttggtttttgctgtgttccggctaaccgtatgccttcacgaacgtcttgttcgagcttttggccgctgcttccagggggtgttgctcttgatccatgtggtagagccccctgggcctcaccgggtggcgagtgtgcttgcagtatactggtggcctgaacctgggcaagcgctttcctgtcccccagggacyttaattctgcgcgctccaacctctcagcgtcttccttcaggatccctgccttcggtgcaatgctataaaggcttttcccacaacagagttgcgggagcatc

SEQ ID NO: 2282 - DNA, 600 bp, Bovine  MMBT21493
gaaagaccccgagagtttaaagtatggtcttgccctatagaaagctcttcctctcccagcaaggccttgaatggccatcgggtcaccaggaacactgccaagagaaataccctctggcagccactgacccctcccaagaaacagtygggccttctgttctctcccgcatgccagtgcccatctctgtcagccacctgcacctgtcacgggggtcgcagctccggcacagtgtgacaggccacctgtcacctttggcgatgctgggagctatggcagcttcagagtgacatggggccgggmtggctcatcatgcaggcgtgcaggggacaggaacttgagttgtstcctgggggcccgtcccagtgctgcacagggagcgaccgycttccttccctgccccactgtcctggtcacagaaggagaacaactgccagttaacctccccgtggctttgttctccacatccgagggcccgcacttttctgtgcctcgcttaaggatgctggagtctaccccacgatcacaggaagtgccatttctttggggagctggactctgaagcctttgtcttgcataagacactgggtccgtgtgtctggt

SEQ ID NO: 2283 - DNA, 600 bp, Bovine  MMBT03201
acggtcacagctttggggtcacgagagaactcatactggagagaaactttacaaatgtgatgagtgtggaaaagcccttacaagacattcatatcttacgcaacataaaaccatccacactggagaaaaaccttacaaatgtartgagtgtggcaaagcttatacccagtttgcaagcctcacgaggcatctgaaaatacacactgaaaacaaacatatgcctcacacatatggaaacgcttttattcaaagctcaaagttaaaacaattcagacaaaatttctgcatgtattccagccytactcagctaatgggactctatcagggtggaaaaacacatacagatgcccagcagacacatgaaaagatgctcagcatcattaatcatcagggaaatgcaaaacacaaagtcaatgagatcccacactatagttagaaagacaataaataacaagcattagcagtgctgtagagaaaagggtactcttgggccttggtgctggtattgtaaattggtrcatcatttatgcaaaacagtatgaaagaktctcagaaattaaaaaacaaaaaacctattatgtgagccaggtttcgcacttc

SEQ ID NO: 2284 - DNA, 600 bp, Bovine  MMBT19740
ttgttctttactattggattttagaagacccaaatgttttgttgaaatgattcaacctacattttgcagtgaaaaccttgcaatgtgtactagaacatgaaccaccttactacagatttggagaaaatcttgaagaagcaaaagtaatctcttctttggctgagtckagattaaacttttaaattcatttatattattccacaaatatttgccaagcaattgctctgtgccagagattttgcatgcaggaatgctggtgagaaagaacagcgtgagcctttgtttgtaatgtgacaagtrctatgaatctgtgatgctcatttgttctctcaaggatttctcatctttatttaggcacaggttttaaagatgactgtgtgatgccacagccctttgcatctgtgagtgtttagcaacagtgtggcttttctactgtgttatctctgtgggttcttcagaatattcctgggttgtgctgtaatggtgctgagcatcagaggaggtggcacttgagtctgtttttttgaaatatttgctttctgttcaaagtccaaattagaagtgatcacccagagtgaataaatagcaatatcatgacac

SEQ ID NO: 2285 - DNA, 600 bp, Bovine  MMBT00870
cacacaattaagtccaaatgactatagaaaatcatggctccagctctgcttcgacaccctgctaaattatgatttggtgacacagatttctgccaggtacgctgacttacctataaacacacaacttgctttacactgtgtatcagatcttagtgtgtttccaaggttcgtatttctgatatgggcatgagaagtcacagcaacacaggagctgagattcaatcagtacttggaaaaggaggaacaattaattttaagaaaacctccaggaagaaactcaataatgctgtagaggtgaayaggtgtaggaatcacttttgtcctcacttttaaggacttgtttaaaaaaaaaaaaagtcatctagagttaaagtcaggactgttccacctccagaacagtgactcttaacattagaactaggacatcttagacctgggagaatatgaggaaagctatcacttgttcttggttggcggggcggggggcagggggtggggagcagtgggaaggtgcgggagtacataatgccatgaaaatgttcatatatttttaaatctctgaacttgccatagattcaaagttagaatctattttagact

SEQ ID NO: 2286 - DNA, 600 bp, Bovine  MMBT01469
caggatgacagcagaggggaacaagatgctaaggaatggagtgataaaccgcagcagcagaaaaacaagcttcagaaaaagaaacggtataaaagcctggagaaatgccataaaaacacaggtgatcttaaaaaaaataagattctttctgctcatcaagctgggaggcccaatcagattaaaattgagcagtttaagtttgataaatacattctgagaaaacatccaggttttcattatataaataacacttcttcagattctagacactcagaggatagtgagctgctcacagatacraccaccaacatcctttctaccaccacttctcctgtggaatcagatatattgacccaaacagataaggaaatgactttgcatgagaggagcagctcaatttccaccattgacactgcccgattgatccatgcttttggccatgaaagagtttgtttgtcacccaggcgaattaaattatacagcagtatcaccgaccaccagaggagataccttgagaagcggagcaagaaaaacaagaaagctttgaatacaggttatccccaaattacttcagagcacaccagaaggaaacacatccag

SEQ ID NO: 2287 - DNA, 600 bp, Bovine  MMBT04063
cttaaaaatatttccagtgtggacatattttaaaggtcttccaggggagaaagcaactacttatttacaacrttctgctgggcacttattcccctatagtcactggatggctcctattatctcattactctttaatggataataaggcatatttagaacagaagagaccacataggagggaattctgcatgagattgtcacagggcgacctaggtggaaaataacagactattagtgaaatgccaaactggaaaataagtacctgaacacaacatctgcaaggtaacaaagatagagaaygacactgaactgtttaagctctaatcaatctaaaaagaatgccaaaaatagctaaaacaaggctggggacctgttacagtttaaaaagtgtttgcttgcagttagttggagtattttccattcagccttaaattcttttttttttttttcacattctcactctaaggctgtttgtacaataaccactaattattcttttcttatataaatttcaggtgtcacttagtctcttagttgtgtccaactctttgcaaccccaaggactgtagcccaccaggctcctctatccatggggattct

SEQ ID NO: 2288 - DNA, 600 bp, Bovine  MMBT04311
gccaccctccatcagtctgtccttagtgggagttggagcctgagtgactatggtcaggcatgggggctttccatgcctacrttaccaaccccagcagcagccctggacaccaagactgaggtaagcatcccaggttggcaatgcttggtacatagagatccacatcattgctgggagggctaagcattgtctgtagactccgactgagggagggtattggaagcttatatctgcactatactctttcctgattttaatgtttatctgttcatcataataaacaataaccataagtgaaasagcttttctaagtcccragtccttttagtgaagaatcatagggtggtcttggggagctcgaggacaaggatgagcatatccatgaagttgatcaaactctgtcatcygatytcattgcacagaggaggaacatgaagcttgaagaggtggaagtgacttgctcaagatcacacagctggaaaataacagagccaggtatccaaatccaggactcagttctgttcagttcagttgctcagtcatgtccgactctgggaccccatggacagcagcacgtgaggcctccctgtccatcaccaa

SEQ ID NO: 2289 - DNA, 598 bp, Bovine  MMBT08638
  misc_feature (1)..(60): n is any nucleotide
nnnnnnnnnnnnnnnnnnnnnnnnnnnnnnnnnnnnnnnnnnnnnnnnnnnnnnnnnnnntggatatgttaacgtcttgagtgtgacactggtggtttgagtgatttttggtgccaacggtttttaatgggtgtgcttagtagccacattgaactagaggctgtctcttctccatttattctctaaaaataaaagcaatttgtgttgcttaattgtactgctttgtagaattgtctgaactacttgatgtcctcataaccatacaaatgaccgttaagttatggaggaagggcttctgtytgcaatagaaattcttataaagttgctatgggatatttattccagaaactttgttgaaactcagtccttgaaacttgtaacatcagccttgattaattgtcattattcaacgatattaagaaccgttgacaaatgataaacataaaagccattcagattgcaaatggattcatttatcagcatacttatcaaaacctaatttttcttaattaagtatgtgctaagttgcttcagtcaactctttgcgactccgtggactgtagcccaccaggctcctctgtccacaggattctccagg

SEQ ID NO: 2290 - DNA, 600 bp, Bovine  MMBT16698
gaatccactgtaatcaggagatcacctgtaatgcaggagatccaggttagatccccatgttcgatccctgtgtcggaaagattgcctggagaaggaaatggcagcccactccagtattcttgcctgggaaatcccgtggacagagaagactgccgggctacagtctatgggcttgcaagagtcagacacgaactgagtgactaaaccaaccaaccaacccgcctaatacaacatgccaagctcaggtggagggagtccccagtgtagcaacttacactgtttaaagctcgggatgcattytcccatagaaatgtgtacacatatgtggggagaaccctcattcccaaccccaaagcagtctgtactggagggagcacagtcctgtcctcacagaaccaaccgtcacaggtcagggagctgctctggacacttgagatgtcccctggggatctcagtcacccctatgtagagaccagcatggcagttcccagcttctcttctccttctcccacccttgggtggcttttttgggtgactttgggtgactttcccagtgcaacagccacttttctttccccacactatctcaaactttctcag

SEQ ID NO: 2291 - DNA, 600 bp, Bovine  MMBT17572
gcaaggagagagaattccctaaaatggggccagggctggtctcctgggaagaaatgtaaggaccttggagacaatccaaaacatggtaaggtctcactgctcccaattcaggatttgactcaggtctgttttcctttcctcagacttttatctaacagggagacagtatataaagtattccatctgcttcctgaactgactctaatcaaacaagacatcacagcaggttggaaataggcatcagtggtagatctatcctcagttatctgttggagagaggagagagtcgaggatgaagtrtaggtggtcagtgggcacctccagatgacatcagccaaagttttatttccttctctagggcatctgtccccaaaagtcatggatggatttgaaggtcactgttttatctcatgcatgcatgtgctaattgcttcagttgtgttggactctctgcaaccctatgaaccacagcccgccaggctcctcagtccatgggatactccaggcaagaatattggagtgggttgccatgcccttatccaggggattttcctggcccagggatcgaactggtatctcttatgtctcctacactggcag

SEQ ID NO: 2292 - DNA, 600 bp, Bovine  MMBT13695
cagtaktcttgcctggagaatcccagaggagcctggygggctgcagtccgaagggctgcacagagttggacrcgactgaagagacttagcactcacactcacacaaccaattaacaaacaatgttggcacagtttcaggtgaacagggaagggactcggccatacatatacatgtatccattctcccccaaatcccctcccagccaggcttccacattaatactgagcagagttccatatgctatacagtagcagaagtattacttaacaaaacaaagcaaatatggtggatacaaataytgtttttctttaatttagaaacatgtggatagataagtcctcacaaaaacctttagaaaattttaccaaaacagaacactggcgtttaagtaggaatattcccttttattaaagttgcttaccattttttaaagctgctaacaaagcaaaggtacaagcatccaaaatgtttccatcatggttgaggcaaatgagatcacagtacaaaacccaagcaagctaaaacggagttgacaaagaaattaaagctttctgataggtataatgtggtatttgtttctactcacaaaccacatcctt

SEQ ID NO: 2293 - DNA, 501 bp, Bovine  MMBT18631
agagaaaatatttgcctgtgagaccctgcctgtctctttggacttctttgtaatggttaagacaacccaacagggctggagtcgttagtgattcagaatcggattagccaggactggtggagttactttctcagcaaagggtttcatattttaacatttgtttcccatgacagtttgcttattcttaagttttggcagccatgagcaaatggttgtcaggttttttgttttgttttgttttaagacaaaactccaaattttattttgccaatttaataaactgtattctacctaccactycttctgctccctctgtaattattgatcaaactttgtttttcagttgtggaagtactatgaaaagttttcttttgtaccctgagatatttataattttgtgtaagcacactgtttacagaaaatctaagtggtgcatatgttaactcaaatacccttaaaacacttaaaatattttccaataactaattctccccccaaggg

SEQ ID NO: 2294 - DNA, 600 bp, Bovine  MMBT10382
tttactcggtggtttgttcattgtcctcatcttcttgaagattgagtctaggagactggggactttgtccaccttgtcctagatagtacccttgatttctggaacagtgcccatcaccggaggatctcattaaacttttgatgatcttttgataagtgatgaatgaatgagggaatgagggaatgacttcattcacaaaaattctagagtaattggcccaaacaccatgaagtacaagggtatctcaatctacagaggtcataaccctgctagctgctcctggaggcaagctgatgatamtgcagtggtaagcatggcagctctccagtctgaatctctaattataggccaggttctgagtaacagaaacagaacatattcacatgcctaatacagacaattataactcaacatccaaaagctaactgaatgtatcccctcatccccaacttttcattccttttctcagctcatgatattggcaaaatcaaacaatggggtaccatcctagattttttttttttattctccacactgccaccctcagagatatcattctaaaattccatgtcctcagtggaaaaaaaaaaatttctagta

SEQ ID NO: 2295 - DNA, 414 bp, Bovine  MMBT18814
ggctatttctaaattttgttttctttttctgagtcaaaaactaataagaaacagagtaaagaatcttttactgattccactgttgacttccctgccagtagcttctattattcccttggctgatttgctatagcttattagaactcctcttagatcttgataatcaagaccctctgcctctgaatttttggttgacacctctccgcccctcctaggaatgtttgctttctgctgcagccaggtgtctaaggaccaaccctagtgtccattgtccttatctgtgctctcatattttgtccrttgctctccttcctttcttcccactctgcattctcatctctagctcctttctgacttcttgctctaaaaattctcctagacttaatgggatctccatccctccccctaactccc

SEQ ID NO: 2296 - DNA, 600 bp, Bovine  MMBT00764
aaagtttggggagcatgtgtatacctgaaatttaaaaatgttaaaaattattaaaaaaaaaaaaaaaagaaatgaaaaaaaaaaaagaaataaagttaagtaagtaaacaatatttcctcaaagccaaatcctaaaacaaggatttttgtagagcttgtgagtgaaggatagttattacattttcatatgtttaaaaaatcaaaagaataatatttcaagacacagaaattatatgaaattatagtttccatatctataaacaaagctcattcatttgtatattgtctgtgactgttttktgctaaatggtagagttcagtagttgtagcagaggctcaaaggcacatattgcttcccacctctgactgttgtgctgaaaattcctgtgaygcaattataaatggacaaatgcttcaagcagaacatatattgacttgctgtgagattttattatcactgcatatccattgtatcaaaacaaaaaaagaagaaaaaagtcgactttgaatgttgtatttttaaggtacagtggaatgtggattattttgtggtcaagctagatgtcaaagttttgtgtttattatgtgatgacacgacag

SEQ ID NO: 2297 - DNA, 600 bp, Bovine  MMBT03659
cagggggtgcgcatgcacgtgcatgagagagctcaagatggagagagaggagaatgattgattggagagaagggatgcaatctgctattaacagcccattaggttccaagcacgtgactcgaaccacagggagcgaactcctgcactttcggatctcaggggccagcagcctcttactgtggctgcccctgagaagccctgctctagagaaatggccgcagtggtgcagggcsggggtttgaggggtgggcgagggccatcacccccacacttccctaactgactctgcctgtttttcartgactcaaaaggccagtgaggtgagcgtctcatagtccaaggctaataatgataataaacctgcaagaatgaaattgactctatagaataaaattttaaaagtaaaacagttctctacagttctctgtcatttctgtctcagattgtgttggagaaggttgaacacaattttattgagaaattgattgtaattggcactctgcatgctctctggcagaggaccctgaaaacaggctctcctgacatgccgatgtcacttctgccaccaacaccctcgccaataagcccaaattaggggcc

SEQ ID NO: 2298 - DNA, 600 bp, Bovine  MMBT09474
caattaacagcaacaaacagagatttgctcagttgtgtctgactctttgtgaccccatagactgaggaccccaacaggctcctctgttcatgggattctccagccaagaatcctggagtgggttgccattctcttctccaggggatcttccccgacccatggatcaaacctgggtctcccgcactgcaggcatattctttactgtctgagccaccggggaagcccctgacacggtgaagtaatgcttaaaacacrtttaaaatcagtgcatatttcacaccacacagcactatgttctastgttttatggggatactccaaaagagtaagagaaaagagagaccaaagtcaacaaagcacagatgtcaaaattgtaaaaaatattcagtatcactgcagcaagccgttcaatcaatgctggctgactcaaaattactagtaagaacagcaaaacaaatgacttggtttcatcgtgtttgtttttatacaaaatctaatcaattgatgtttgcagaaaatatcttgtaaggttcaaagtataaaattccttaaccaagtttcaatctgttttgaacattccatttgaaacgggaagtcagc

SEQ ID NO: 2299 - DNA, 600 bp, Bovine  MMBT11575
tccatccatccgatggatctgcgccctcctcgggaagaagcacagtgctggccactggagtctttgtgtgcttgggtttctctgcgcctggaggaggcccaggatgggggtagctgggctgctagctgaggccaagctgctctgagcaatgtggttgtgtttactgggagggtgggagggccgggcctgcttttttcctgccttccaggaagataaggcagaaagcggggatgaaggatagaatgggtaatactctgaaaccacaagaaagggtcctggctttcgtctctgccctacagytcagacatgctcctggggcatctgggagcagggaatggccccacccccactactctggggtccctgctcagggaagctcagaaccctcagtgggctccccagacttccatctcccctccagtgtcagttcacccacaagctgtttcagctctctcactccccttcggasccctagttttcccttccaggtgagcccagcaaccctagagccaggcttttccccttgctttcctgtaccagctaaagccacagggaccctgggcaggtgacatgacatgcatgggccttgagggctggctg

SEQ ID NO: 2300 - DNA, 600 bp, Bovine  MMBT11807
ccacaggactgccagggaaattccaagtcctttcctttttatgcaaactgttctgggattcctttcactggtctcacctaacgtaatctcytctgggaaaccatccctgaccaactgaaatgaatctccctatattccctataacatagtcccctatatataagccccataatacaggctcccgtaatccttcacagtgcttactgaactttgtagttttatcttttttgcggttaaatatttagtatccattccctggtggctcagatggtaaacaatctgcctgcaacacagaagaamtggattccatctctgggttgtgaagataccctggagaagggaatggaacccactctagtagacttgcctggagaattccgaatccctggtggctcatgtggtaaagaatccgcctgcaatacaggagacccaggttcaattccttggtcaggaagatcccctggagaaggaaatggcaactcactccagtattcttgcctaagaaatcccatggacagaggaagctggcgggctacagtccatggggtcgcaaagagttggacacgactcagcgattcacacacagacatacacacatcc

SEQ ID NO: 2301 - DNA, 600 bp, Bovine  MMBT11882
agaaggattttactatcattgtatccaaaggtacgtatcgcttggccactctgaaaatgaggaccagtggactagmcaaagattcagtttattcctagaatagaaagaattgagaatgaagatgttcttgtatgtgctttgggtgaaggtcagagagttagatcacagaaccaaagaatattcaggtaaaaagaggtttaaaagtaaaatggagaatcattttatcagtgagaaatccaaggctcagggaagtaactatgaggttgtctagctgtttatcctacattccttgtgtctaaycactttataagcaaaggggatattttttaaggataattaaaaatagagtttattaatgtatggcrtaattaagaagtcaccttcagaaatataagggaaaacatgtagcttaaatgggatgtttgcacgatgagaaacgcaaacctagatgcttaaaaattctaagtaaatcaccctgctgggaacagctgaacaacaccttttctccacaagtaggagctagtttcattctcgaataaccagccactttgggcagtatgcccattgtgtcactgatatagcccggtgataaattggtaa

SEQ ID NO: 2302 - DNA, 600 bp, Bovine  MMBT12345
aggcactactggtaagaagatatcttatatcatttgtagaagaaaatgagctacagatcagatatcttttttaacttaaaaytgctaatttttcattcaaaggattctttggtagtactcagaacaaaggttttggatttgggactggttttggcacgacaactggaactagtactggcttaggtactggtctggggaccggacttggatttggaggatttaatacgcagcagcagcaacagcagcaacagactagtaagtacaagaggttttcattttcagatatgaaaccataacaaygtagataatattatttagtcactgttcaaaacatttgagtagataccttttttgggggaggagttataaatatcatattccataggattccaaaagctacttctcatgttcaaatataatgatagcaactggggaaaagacagattggcatgattataagacctctgtgtttagtgtcattctattaaagtttttgttkttcgtaaacatgacacaggtatgtaaagctgtacagaaatacagcttcacggattgtttataagatgaatgccctttgtaaccactgcccatgtcaggagg

SEQ ID NO: 2303 - DNA, 564 bp, Bovine  MMBT13862
aggcactactggtaagaagatatcttatatcatttgtagaagaaaatgagctacagatcagatatcttttttaacttaaaaytgctaatttttcattcaaaggattctttggtagtactcagaacaaaggttttggatttgggactggttttggcacgacaactggaactagtactggcttaggtactggtctggggaccggacttggatttggaggatttaatacgcagcagcagcaacagcagcaacagactagtaagtacaagaggttttcattttcagatatgaaaccataacaayacctggttggcagggctcgggcctaccacggcctcgtagggtggtgggagctcagcagggtacagcaggccggggctgttgatggcgacgccgtacaaagtgccaaacggggaggaagcgaagtccaagtggaggcccctgagcagcagaaggaggaaggtcaccctctggggaaggagccggctgttcccattgccctcagagcaatcggaacaattccccacacagaattcttgggtgtgtaaaaaaaagcctcattcacta

SEQ ID NO: 2304 - DNA, 600 bp, Bovine  MMBT15628
ggttggatggcatcactgactcaatgaacgtgagtttgagtaaactccagcagttcatgatggacagggaggcctggtgtgctgcatccatggggttgcgaagagtcaaacaggactgagtgactgaactgaactgaatatagggaatgactgaatatagtgaaagaccttaagatttcttctgattttcaattcagaaatggaaatagcagtattagtaagattgattctgattctcataacattgtatatttacctggcaatatgttcttgcattttaatcctgcagcataactaacmtttgactgaggataggaaactgaagatagtagacatgatccttgagtgcactttgtggatcaattttttatataaattttagttttgtttttcctttctgaaatttttagataactatcaatcaaaatgcatggactttgtgaaatatttaatttgtaacactgttgaggaaattgagtttgagctttgataagtattagataatatattgtgaggatttatgaccaacatattcaaatgtatttttgtcaataattcttgaaggcccttttttgctaatgtattagtgaaagaagcctc

SEQ ID NO: 2305 - DNA, 598 bp, Bovine  MMBT16889
  misc_feature (1)..(97): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcagaactgagaaacgtatttatttatctaatttttcttttgttgtatctgactgtgtcactccagttaaaataaaaccaccttggtgaaaataaaggcgatttctttgcatttactggattatatgtcacagcacctgaaaaggtttgccatccatgtggagaccatgtaagcagttatgaccgctgtctcgtctgcaragattacctcttccacgarraggaggaccgtcctccctggcatgcagatggcactgacctacgcagccaagccggaattgttccccttacacaccaggagcacgggactcgaggctgtgagcrgctttaaagaaacccagatacacattacatgttgattgatttaaccaaatgagtggggctaagattttaaaatgctgagagtccaactgagggcagaaaagcttcaccagtgaggtgaggcatcacacctatcagggctcackcccygtgacttgagagaagggagttccataaa

SEQ ID NO: 2306 - DNA, 600 bp, Bovine  MMBT18710
ctaagggacccaggactccacccaatcctctctgctggccacaaatgggtgtgccaaaggctttggaaagcgattgcagccctggagggtcacctgctgggaggctgggggaggggtaagtgtgcccagagaggcaacttattcagtgatccagaaaatagaggagattcttgtttttttctccctctcstctctcctgtgcccactctcctcatcaccatcaccagggctccactgttcctctctcccttcgagatttcccattcttctctgccttcaattggaagttcccttagagascctctggccaactccttcttacccagcctcagaatatggaagggacttgttcccacatcatgcctggttgatgtcagggccagccttggagccctgtgccttggtgctggatccatggctacagtcaactaggtcctccccttcaaaagcatcttccccctgatttcacagtattcaaatcaacaatgcacataaatcggagtgctctccactccatggaggaagaaagwcacaactgggccccccaccccaagggcagcctgggcccccagttctctcccacctgcacagttcagtctt

SEQ ID NO: 2307 - DNA, 600 bp, Bovine  MMBT18809
cccttgtggctcagctggtaaagaatttgcctgcaaaggagacctaggttcaatccctgggttgggaagataccctggagaagggaaaggctacccactctagtatcctggcctggagaattcccatggactgtatgtatagtctctggggtcatatgaagtccaaagaggcaactgtgttgaaaattagcaattttaatcaatggtgaaagcacctcttttttttgttgttttaacaaagagggttactgcagaatgaatcttcacaaacagtgctttatttggtcacaggatccatgrtccactatgaggatgggagaactttattggatgctaatctaacatctaaaattatatttgtctgctcttctttcttgccatttatggtgaaaaatctgaagccagagcaccgtaaatgttttgcttctcatttctagtcccatcccaatttcatttycttgcaatgagaggaagggttggaagataattagcaatgtycttctcccacatttaacatctctacttactgtgctstatgttaccrcttactctgaaaaattcagtatgtagcttgaatgttgttttaggcttttctaagtt

SEQ ID NO: 2308 - DNA, 600 bp, Bovine  MMBT19755
atacagagcctattttaactctattttatctgatcattcacagataacacctcttacaatctcttatttccttacaagtgaaataagaaaagcaaacttgatggtcataagtctagtttccaacctagtaaagaaatgacatcaaaccctacagcaacttcagccttctcctgctactgcctttatgttttatggaaccacctatattcactgtggaattgtaataactaggcaaagacgaacaactttggatgagaaatgttgaaataaacaatgctacacttctgagtttatatccartagtgtatcaggccaggaactggagggggaaaagtggagtcctcagattatgtctagagaaatgttaatattcccagactatcagccttctgcatctggcctgagtactgttcctcccctggcagtccaccgtacattgctagctagggaggttattagaatgaatttattatcctttggtagtcattaacactgactgcagtggacagtaaatattttacactctttgtgaatgggtctggaaaacagtttcagaatttttcaaagtgacttttgggggcaatattctatatcggggac

SEQ ID NO: 2309 - DNA, 601 bp, Bovine  MMBT20811
  misc_feature (1)..(1): n is any nucleotide
naaacctctcaaaaacgcaaactaatccatagtgacagtaagcagatcagtggttgcttgggaataggggcctcaggagaggaaagagggatggattacaaagtggcacaaagaaaatttgaagggtgatggatatgtttgctattttgattgtggttatgggttcatgctatattcttatatcaagacttatcaagtacacttgaaatatgtgcagtatattgtacgttaattatacttcaatgaaactgtyaaaaaaaaaaacaaacctraggaaaagcagttaatcaactggcaagcytacagaaatgcagatttatacccttcatctactgagatttccatacagtctgtctgactggaccactcagttggttagtaccccaggtgttttgatayggactgcagagctaattaaaactctaacctgactcaccacacgggtgaactataggtacaatccctgtagcttctcccaggtggaggttttattggatgttctgaatgagatcacctgcttctaaatacctgttacagtcatgsgggatcatgggcaaggccatactgcctcatgcttgaaaatgttataaattggggaaaa

SEQ ID NO: 2310 - DNA, 600 bp, Bovine  MMBT12329
tcattttagttatagttttggtactctggaaggtacattaattccttaagacaatgttatgtattcttcaactgtttcagactgaagcatatttatataactattacttatktccaatataatcatttttttctcctctgaaaagttgctgatttctcctcactctkatggcaaacatgtagtaattattgataagacattcaactaragaaaaacattgctaaaaatattatcatgattcataattaaaaatctctttctgggtatcctagtcaataattcaaattccctgcagcattygtttctgccattgctatttttaagacttacagaagcctgctgatcaagacatagatttacatattttgcttttaatgtattattgcttcatttctcttatattctatacctttgtgtacaaccatccatgttgagaaaactctccttatgcagtgtagaagttggaaacaattcttttaattatcttttgtgctgaatatttgtagctgaatatcattttgtgtgaatatccacaagccatttgcatcagactagaaactcttcagttaagtgactctccagagaatatatgctattttg

SEQ ID NO: 2311 - DNA, 600 bp, Bovine  MMBT00767
tatcttttgtttattagcatactgaggataccctaatttggaaccaacagcttctttaaaaatgttgaggtgaactcttaatgcatctagctgcatacagaaccaaagaagcagaaaaatatttaatgccattatatgcttggtgtctgattttcctgagtgccacagaatgggatatcatagtcattgtactcaagtaggattttccatacccctactcccacacaacttcatctgagcaaacatttcctacagtgggtggagagaaaataaaaagtcctgtttaaattcccctagcgytgtgattacagatcctttgatttaaaaatgaagctgtctcctcttttctgcacactattttctatgtccatttttatcctaatctctcccaggcctagttgacctaagatcacctgtaataatgctctgattatatttgtaggcaattagaaacgctsrcttccaaatagatggatctgaaatagtgctgctgactgatggggaggatagcactgcaaagtcttgtattgagaaagtgaaacaaagtggagccatcattcattttattgctcttggaccagatgctgctcaagcagtcaa

SEQ ID NO: 2312 - DNA, 598 bp, Bovine  MMBT01347
  misc_feature (1)..(3): n is any nucleotide
nnnagagctgcttaaccttcccctgacatattcttatctatgagttcagctcctgaatttttctgaaatttgtagcttatacatcccttaacctttcaaactcttaaatataaaatgtataaaggagaaggatgctgactgaaatcttggtggtttaaagtttcaaatagcactttacactcactcataagaagacaaaagtatcccacaatacactagcctgggcaaaaagccacaggagtgtccattgatctaataagaccatcccagctggaagatcttttggaaaataactgaatygcattttaactccaaygcttctccatttgaaaaatgggaactctgaggcccagagggattcaggaccagccccaggtcactaaatcagcaaaaggcacagtagtcagaagaccgaggatccagtgycctattttctccactacagagttgtttgttggaaaaagtatatttctgttttggcattcttgagtctacagattcctagcataagttttggcataatraagtatggtgttgtaatcttcttcctaactgtaacccttcttcagtcctaaaawccatataaggaatttgatct

SEQ ID NO: 2313 - DNA, 600 bp, Bovine  MMBT01605
aaagaattgtgaactgtagcgaatagacctggagggatattcactcacacacagactcactgactcacatattttttcttcttccagccacaaatattcactgtggcctcctccctcctagaggccagctgagcaagaaagaaagaaaatcaaatcctttctgttgtagaatgtattggttatttcttatggccgttaaaggctctcactgaggaaggccatctgtttatacagtgaggtccatgcagagctgcctaagcagaaatcatgggtacagtaaagtcacttcatagtgttgaragacttggctgaataaaggggaaagtttaaataaattaatgcctgtctatggaatgaagcagtttgaatcctctaaaatgttatttatgcagaatcttaatgatgatattaaaaaaacagaatatagaattatatacactgtatgaaatgtatttttcaaatgtgaaaaccagtggaagtgttagttgctcagttgtatctgactctttgcaaccccatagactgttgctcaccaggctcctctgtccatggaattctctrtactggagtggrtagccattcccttctccagggcatctt

SEQ ID NO: 2314 - DNA, 600 bp, Bovine  MMBT02278
tagggcggtttttaatatcaacaaattgaaatcctatcatctaatatatttgtttctcaaaaaacagcatagatgactgaggttttgaatctctggatgtaaaactctgaaagaggagagagatgccttagtgaatctaaatttacaatcttatggagctaagctattggcctctgcccatccatgagaatttcattttcagaactgagatgagcttagtgaaagctactactgacagagggaaagatggcatcaactaatgacatgaaggaagtagttgtcactctaagtgagtgtttyagtctactttgctattcaatagtttcaaagaatctttttttttctatttaaacaaccagggaattaatttagctaggagaaatgcatctatgaattgtggttatgcttctacaaactaaattttgccagtagagtgtaactctcccacagagttttatagaatgagaaactgggtcagtgttttatatgactggcttctcctaacaaagtaacatgatactcccattttgctgaaactgaagaccaagaagttataattttgtagtaaagtttataattttctttcccaggcattttgct

SEQ ID NO: 2315 - DNA, 600 bp, Bovine  MMBT02734
accctaccccactcttttcttttccaacccaaaaactcaatttgaaaagaaaagggaagatattcagaggtaagagacaataaaacaaaaacaagtaagtagtaccatagaccgatgtgttaatttattaaaacatgtattcattaggcaactattatgtgactaaggttgtgttatacattgcagataaaatgatgcaatccccatttgtgattccagccattttaggttttgtaaattggagattctcgatagtgattagttcaataaaatatgagcaatagtttcttggagatctakaatttaatagggatgaggaaagaaatatagaataaaataaatattttgaaaacaaaattgataagactcagtaacagaacaaatkagtattaaaggaatatagcagtaaagaaaaattccaaattatatttttctttggggagttcatagatttcaagaactctggcagttttgttttgttgggatattgtttgactccaggatatatcaatcatgttttaattttagtaatattaacaacattaaatttgaagcccacttcaattttgaaagcatgaggagggaaatattaaataaaaa

SEQ ID NO: 2316 - DNA, 600 bp, Bovine  MMBT03085
attaataaaaaagagttcacactctcatgtagaagacagacaagtggataagtggggaaatcaatgattaagtaaaagggcatactgggacctcagaatccaggtcaggttgaagggagtaatgttggtgtcagataaagctttcaaaggaggtggtttgaattgattcattatcctgctctttatttccttcattccccaaacatgttttaaggaactattgtgtttcaggctttaggcttagccctgggattaaacacaggcaagtctccatccagtatatgtccctaagaaacttayagtctagcccagagggatagacagcaaataactcaacattaaaattgtgttggggcgcacaaggcattgttgatgctatatgccaagggttgtttcagaggtctagtttcttaaatgttttttttcttctttttcctattcaccccagtcttttggcactttaagcacctttcaggatattccacagaccatgccagataaaaatggccatctcaaactgcatttatattttatgatattctccagaggaagaggctatcattcaaaccacaatatgtcaagatggggcaatgtctccac

SEQ ID NO: 2317 - DNA, 598 bp, Bovine  MMBT04789
  misc_feature (1)..(56): n is any nucleotide
nnnnnnnnnnnnnnnnnnnnnnnnnnnnnnnnnnnnnnnnnnnnnnnnnnnnnnnntctaccatgaatgagacgctttgcaaacagcatctcactcaacagcctcatatcctctttactatcactcagaccctgcctccattatctcacttaaattgttccagctgaccttatggtggcttccagtgatgttcctatgacctcttttactttcttttatgtacacttaactcttgccgtactggcctccttaaaattcttcacatgtgccaagaatgctcctatctttggacacctgctstgcatgtastgtttcccccagatgtccacttgcaaactccctcagctcattccatttatcactgaaacatcacttcttgatgaggattccccaaccgttcaaatttaaatcacattgtacccttcctacagagccttcccattctttacactttgctttatattttccttttcatttgatttttaacatactatatgatttccttattatgttyaattcctattgtgtatctgtgacatcaggcaagaatctttgtcttattcatggacacgtcctaactgcccagaaaaagtactgg

SEQ ID NO: 2318 - DNA, 600 bp, Bovine  MMBT05648
aaacacacttaaacatgtatataaacacccacgtgtgtacacatacttacaaatacgtatccatacctcctccccgcataacacatacaaccacatccacacaggcacatacatacttgcaaacacacatagctttccaaggctatctcttgtctttagatgctctgagttgatacctttgggaatttctctgacttcttatcaaagcaagtctctttggggtccaaaatgtccctaaacttttagagacatcctttcctgagtctacctgagtgatggtggttgaccctaggagagacygggaggcaggtacagcccacaccaagggctccctcagctctgcccggggctctggctatctggggagatagagcctcctgtgccccactgagggyaggttgacagccatggcaggccaggcagcactagtagctggagtgtgtcatcagctgctgtcggactgtggggacaggggtaagggctgtgtgctgagctccaacagcacggggtggcagggagtgacatctggctaccaaatggcctataggtgtcaagaagccatggggtgagggtgacccatgccggggcccccaggcgggt

SEQ ID NO: 2319 - DNA, 600 bp, Bovine  MMBT05934
aatagaaatcaaccmatccttttttgtaaaatgattaaataactaagcacagaaggaatcataaaaacattcacatgctttgacccttattttctctcctagaaacctaccaaggaaacaatttgaaagactgaaaaaatgatatataaaaatgtatttaatagcataaaaataataaatgcccccaaaggtaaaaataagtctatgcttaaggaaattagaggatattagacagccatgacccactccagtgttcttgcctggagaatcccagggatgggggagcctggtgggctgccrtctatggggtcgcacagagttggacacgactgaagcgacttagcagcagtagcaacagcagcagacagccatgaaaaacaatagtgaagatttcataatgtagaaatggtgagcacaggctgttaagtaaaagataaagttagcaaaatattgagtattataactaaaatgtatttggtgtggacaaaagttagaagataatgtggaaaaataaaaacagatatgatcgaatggtaaaggttccagttgacttgaaaaaatgtaatgactggaagaaaaattaggaaaaggataaaagtc

SEQ ID NO: 2320 - DNA, 598 bp, Bovine  MMBT07143
  misc_feature (1)..(179): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcagcagcatagtcctttagaaaatgaagcattgcccgtatccgttttgaaacagcagtgcatactgctcaagtccgtcaaagctcctgtaaccgtccaagtccaagccgcctggcctygcctttcccctcctttctgccgggagtacaggctgctgagtcacgcctgcccggccagtctgtccttcccggccgcgcggccaaggtcccgcctccggccttcctgggcgagcagccgctccccacacttgtagagtcctgggctggggccagccttcccttgtcgccgccgggcccctcctcgggagggaaccgcacctcctcgccgctctccacgcgcccccgcctgccagtctccacgccgcactccggcgccctccgagggcgcatccacagagccagccccgcgctaggcgcc

SEQ ID NO: 2321 - DNA, 598 bp, Bovine  MMBT07183
  misc_feature (1)..(23): n is any nucleotide
nnnnnnnnnnnnnnnnnnnnnnnacaccaaatcttgagtaaatgagttccctgtatatgatttgaagttgtcttcccactaagggattttgttcacacacttaaagcctacggagttcccatgattttactattccagaattcctctccatgatttcaaaggtttttaaaaatcatacatcatccttcatggtcaatagacctgaatttaaatcattataggtattaatttgaacaagatttaacttctctgaacatccttttccttggatgtaaatgaggttcacagtagctcgcttaygagatttctagtttgttaggtgggatattaatacagaggaagaaataggcaacattttgcctgagagttgcaaaagcatcgaatatcagttacccctgtggagctcatacctccccctaatcctgactggatgtttgactctctcgtgctcaatccctttatttctttggaggtcaaaataatgaaactgccttcagaaataaagacacagcagagatgaggagtgaatgattagagtatttgcactttcatctatgcagagaaacacagtgayagtttgtctcttgtgttctgtttt

SEQ ID NO: 2322 - DNA, 527 bp, Bovine  MMBT09349
aatttggtggacatttttgaaagagttgaagaagaaatagcccctttccagtcctggttacccttctgttcccatgcggcctccctcccagcacagacacccttcccaccgccctcatttcactctgctccccgctttatgtggctagtgcgggagggaatttgaacagttcagctgttggaaccagtggtgagttcttggccttggactctcacttcagctccttatgaggcatctatacagctttccttccaggtccttctgaagtcctgcctcctctgtgaagccttccccacctcytcccatccataattttctgtgttctttaattgtttcgtgctgcttttattgtctgtttggtatttggttatttccgatgtgacttccccagcacagcactgtaaagcagttatcccccaattgaaaaaaaaaaaaattcttccccacaaaaaagtgtgggcttctcaggacacagaacacataatcctcctctcgcccacctccgtatcacctcacagggctaggcc

SEQ ID NO: 2323 - DNA, 600 bp, Bovine  MMBT10383
gagcagctgaataccctgggttgtttcagatcacacagtgacaactgcatcattttcctcatgctctttcctcagcctttagctgacaaactctcagtcttcctgatcaaatgcagtctgttctgagaagcctaatgatttagtttccgtcgagttagtctctgtaatgacatagatcgtgttcattcatttattcatttaacacatgctcgttgagcaccttcttggtaccaggccattgtcctagtcacagaagatcaagtttcacccaaatccagaacaaatgaatgaaataaggtyagtattctcctgaggagcttccactcgatgggaggagacaagtgaataaatrtgtaggcagacaaatgtggtataatttcagataataataaagcgaataactatgttagaactggaactatacagaagagcaggagctgggtcttcttgacattcaggtttcttggggctctttggactcatttgcaggatatgagaagggaaatttctgaggaagagtgtcagatttcactttaaccagagtgggaaaggaaatatagaagctctcacccctgctttctcctctgggccagcatcgtg

SEQ ID NO: 2324 - DNA, 566 bp, Bovine  MMBT10647
cccagacacttgatgcagcattcaaagcagcctggacccaggggggagaaaacatggctggtaagggtaaaacgcctacgacttcatgaagaccgcgcattaacagagaaggtcgactcttccctctgccccgcgtgctctttgggtaacagctcagcatcgcagaggctaagaggagctgccctcatctgcttctgtgggtgaggacctgggggcttcaatgggaaatgaagcttaatttgctcggggtgtgtggcagagcagctaagtgacaaatggttatggagtaaggcacaactstaccgcttcctgattgacccagggtttgaggttaggggacccctgctcaagtgacaatgagaaagcagtcaccccactaacaatgtcagaagaactgcagtgaggcttgccgttctatgaagacaagtgaccatcaagttccccccagcctcacccttatggggtttcaggtagctatttctctattttcgcagcagccaatggctttccccagcctctgacctcctgggcaaccagaagagtcaaatacagtaattacactattg

SEQ ID NO: 2325 - DNA, 598 bp, Bovine  MMBT10651
  misc_feature (1)..(172): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccacctacacacaagctgtgttctcatcaacctctacatacctctataccctccttccacgccccccctctattttcctgtaactgaagtttccttgtctccttacaaccacctctgcacatccamattctaccattctgtaagactcgtttcaaatgcttcctcttccataaaattttccctaggcccacaagtaattccttctctgtgaatagctagtggacctgaactatgcctttcttaaggcacttagtccatttccccttgacagagttactggcatttatgccatatcttcctgtacagagatcttaacagcacagtctatacatcctaagaagcccccagagcggattacagcagagccaatgaaaagacttktagraaatatttgtggactgaatcttttccttccttattttta

SEQ ID NO: 2326 - DNA, 600 bp, Bovine  MMBT11548
aaagttaagtaagtaaacaatatttcctcaaagccaaatcctaaaacaaggatttttgtagagcttgtgagtgaaggatagttattacattttcatatgtttaaaaaatcaaaagaataatatttcaagacacagaaattatatgaaattatagtttccatatctataaacaaagctcattcatttgtatattgtctgtgactgttttktgctaaatggtagagttcagtagttgtagcagaggctcaaaggcacatattgcttcccacctctgactgttgtgctgaaaattcctgtgaygcaattataaatggacaaatgcttcaagcagaacatatattgacttgctgtgagattttattatcactgcatatccattgtatcaaaacaaaaaaagaagaaaaaagtcgactttgaatgttgtatttttaaggtacagtggaatgtggattattttgtggtcaagctagatgtcaaagttttgtgtttattatgtgatgacacgacagctgtgcttaaaaaaatactatatacatcaacactattataccaagcacttgacacaatattcccacttcacagaaatgtaacagaaaaatg

SEQ ID NO: 2327 - DNA, 600 bp, Bovine  MMBT11879
cacatgagattaagtgatagtgtcaagaagtacattatctgaattgatattattattttgaaacatgaacctgtttataggttcaaggttaaagtacctgaaaataatgtcataatggtgtactgccacataacatggtagcatgtgatttatgatgacaaagcttctatgttgtaaataaaaatgctgattaagcttgcaaggtacagtatttaagaaattataataaaaatgtttaacacagagatgagaaagcataatttgtggatttcacttctcttttccacatggaactctcascagtgaaatgtctaaagtcagctcaattcttagtggaaactattgtactctgaaagtaacatgcataattatagactaattgaatgttttttcccctttctctgtgtcagcagaagtaaagaagtaaactactaagctcaatcagtatgaaaacttacaaagttaccatataccaaattacttttggtagcaaccaaaaaaaaaacactttcattgtgataagaataactattcctatccaaaaaaaataacttttaatttatgttttcattcttaatgatttagcagtgtttactattt

SEQ ID NO: 2328 - DNA, 600 bp, Bovine  MMBT12327
ggtccatgaagggaagagggatggcactgtgagaacatatgacaaaggcatcccatcttgtctcaggtcatctggaggctgcataacggtaactaagccaagaggggaagcaggagggcaatgacacaaaacyggtaacaacagaagggcatgaaccatctggatgtacttcaytggtggtggtgggaagcaatcttggacggcatcatggagaaraaagactggaaaaatccacgtagtaggaagagaacagaggaaaagggaacatcatgaattcagaatgaacctaatgaattttgsgaacagggaracaatgatgttttagaattgtttcagtcatgagcagcagtcactcaatttgaacgaccaaagaaaacaaggacattaccaacttgagttgctgaaaaggccttggcagcaggacaaaagatgttgttttacatttctcagctttatttttcttcactcaagcagtggaaagacagaagctctagatattatcgtaccagctcagcaaactaaagaaggggagcacttctttccccaaagacccagggccaactctaattggctcagcgtatatcacatcctcctagctga

SEQ ID NO: 2329 - DNA, 600 bp, Bovine  MMBT12468
ttatactcttatgattctcatgttttgtattaggtttgttgaatacttattttaataaacactaactgaagaactaaaacaaaaataagaattttctcctttatcaaagagtttaattttatatatttcaaatggaagaatataagtaatgaatgcacgtgagctgaggttrcctattatacatatttttcatctacatttctgacaaagattccattttcttatttcacagcttcacatagaaaagcaatcacttataaattttcaagtggaccaaatttgcttattctaccaacaatrttaaatgcagaaatgaaaatcaaagtccatgttgaatgtgttatttcacctcttaaaatatatcttgtggtcttgccagataagccatgttgtaacatctttaaaaataacatgacatgtattctgaaatggaggcatttattctaaacagctcagatctatctttgatgtagttataagctaaagggcatgtgaagaagaaaaaaagttgtaacttaccctataccttagaggcggggagattcaaatgataaattatttacaggaattaaagaagacactgcaggctcttgacgctta

SEQ ID NO: 2330 - DNA, 496 bp, Bovine  MMBT14327
tggcgtttacaacccgaagtgaacatttgttaacagtgacccatctttccactggtgaaagcgggaattctggttaaattcccttagctaaataccccagctatttctttcactgggttacttctgtgttttttcttttgccttcaaactgtgcccccacccccaagtttagatggtcattctccttttttaccaaatttgaaataataccgaccttcttccaaatgcgtccgtcaaaagattgcaacagaagcatcttggtccctagtcttttgttctctgcacaaacttgaagtaaaygttcaagtaggtttctgcaattggattttaagtgctaataaagcattctgtgtacaaacctctttctagagtgacaaccattacatctcttattggttcagcactactttgctctctgaactagagagatttttcagcagcggagcatatagcaatagagaaactgcagaggaattgtcctgtttgctttaatgga

SEQ ID NO: 2331 - DNA, 600 bp, Bovine  MMBT17858
ggtgcactggtgtgccaggcacccagctgagcacttgatgaataactaccccagggaacggcgcttctcagtcacctaggaaacgtcagtccagtcttgattgcttctctcatggtcacagaactgactctcagtggatcctatgttgtaatatttgaactgtcgctagagatctctaaactcagaagctgctgagaaatacctacaaaggtgccggatagaaggcacgctccactgtggttcttagctctctagctggaaaagaatggcttttccacagctgttctcragtaaatgtckacctcgtactgagaaatgtgctcatctgcgagcctgttgtcttaagtgctttcctcttcttgcagggtaacgccgtcctctgaaaaccccagtggtgctacttctagtgtcagccaaggaaagccttctttaagacgaattaaagggagactgcacaggagcaagagcctcgatagcatcgatttctgtgaactcactgtgagtggatggtttaagacttttattccttttcaaagcatatgaaaaaattgaattttaaaaaatttcaytaaaaggcaacaggcttattttgtgttaagc

SEQ ID NO: 2332 - DNA, 600 bp, Bovine  MMBT18619
cggtccgacccgaaatgaaaagcttccctcctgcgaagtccttcctcggggcgctgtgcagcgaggccccttgggcggtggcaacgccgtggccccggaggttccgagcggtcctgtggggcccggcgctcagaagtgatgaattgatcagatagacgaggccgggcttgtcccgcgccattgattatcgaggcgattctgatctgagccyggcccagggcacggccgcccgtggcrttggggataacgtgtcaacagtcgacagcyggctggggtctttggcgggcgtcgaactagccrtcgccccgcccgcaggcgccgaagctgaaaggggacagagaccttgttctctgctgcagttttacttttctaggcgcctccttttttttttttttttctttcggtccgctttgtcattatgactcgcgtgtgataccaacactggtgccctaggtctaaagacactatacagcgcctgccggtgaaggcatgtaggtgtatacgcacgtctgaagtgaactgaagccgctcagtcgtgtctgactctttgctatcccatggactgtattctaccagtttctctgttcatgggattttcca

SEQ ID NO: 2333 - DNA, 600 bp, Bovine  MMBT20801
catgggatcacaaagacacaactgagcaactgaactgaacctctggktgaatcagattgagttttttgaaagaacctgtttatcatcttcrggaaagttctagttgaaactggaaaatttttaattttattctagctcattacgtattatagggacttcaatattgttcattcaaaaattcagtacattttagaaactagctattagttgaccttagctttgtacatgtttgttactttgcaagagtactcttaaggctcaaatcaagttaaaattagggtagatggtgtgtacctatamagtcagactaaagctgtatttttttcctgtcgacacttgaatagaaaaaagtaacctaagaatcatgctacagtgtacagtcttattcaaaaccacatatactatagtatttttaaaacctggaaccaaaatgtagaatcattgtgtttaatagcagttaaactacatctgatattacttgtatgactctgctgctctgtttcagcttttggattacattagtggtatgagaatgatttttatatttaagtaagatacactgcttcactgcacagatggtatcagttttgaattacagta

SEQ ID NO: 2334 - DNA, 600 bp, Bovine  MMBT20808
gaggatgagacggttggatggcatcaacaactcgatggatatgaamttgagtaaactccaggagttggtgatggacagggaggcctggtgtgctgcagtccttggggttgygaagagttggacacgrctgagcaactgaactgaactgaactgagggtccttttatttcctttgttctgccatcctattccaagaccactgtccttgaggtactttatggtctaagatgactggacctctagtagagggcaagagaaagggggaaagggctaaagctccttacctactgtctatctttcragaagcctttctgaaagtcccatgcaacagcttccacttttctctcactggctacaactttgtaacatggccaccccctaatagcaagggagtctggaaaatgtggtcttttttattgggcacattgccatgctgaaagtgaaagtgatagtcactcagtcatgtyggactctttgtgaccccagggactgtagcctgccaggttcctctgtccatgaaattctccaggaaagaatactggagtgggttgccatataagtattaataaaagcagtgttctcatactaataaggaaagagg

SEQ ID NO: 2335 - DNA, 601 bp, Bovine  MMBT20810
  misc_feature (1)..(1): n is any nucleotide
naaagtggcacaaagaaaatttgaagggtgatggatatgtttgctattttgattgtggttatgggttcatgctatattcttatatcaagacttatcaagtacacttgaaatatgtgcagtatattgtacgttaattatacttcaatgaaactgtyaaaaaaaaaaacaaacctraggaaaagcagttaatcaactggcaagcytacagaaatgcagatttatacccttcatctactgagatttccatacagtctgtctgactggaccactcagttggttagtaccccaggtgttttgatayggactgcagagctaattaaaactctaacctgactcaccacacgggtgaactataggtacaatccctgtagcttctcccaggtggaggttttattggatgttctgaatgagatcacctgcttctaaatacctgttacagtcatgsgggatcatgggcaaggccatactgcctcatgcttgaaaatgttataaattggggaaaatttaattttgaccttataaagtcacactatgttgttatatttggtgcttcctctgcctcctttgcccattcctcctcccagagaagggcttttactag

SEQ ID NO: 2336 - DNA, 600 bp, Bovine  MMBT21024
agtcagagggctgtcttcctaaatagtttggtttttattaacaggtaagaaccaaacaagcccttttccccctcctccaattcattttcccacaagcactaacatgctgctagaaatattaaggttattaaatctggatcaatattttgaacagatcttttggttctttagcaaagagcaagacctaaaggggagggacacggggaagataaattttgataasgactctaaaggagagatagaaaaagggattagaagcagcaaagagtcttgagccagggatagaggtgggattgggtygggagttcagggcagagataagggaacacagagaaaaatgtagaccagaaataaagatgaagttactaaaaacaatttttcctatctgtcagaagaggtttacctggtccttctaaagttcagtaataagcaaatgactcagtaattagttattctctgtgaacaacccccaatatcacacttcgagtaatgtctgttgaacagcaggaaatcctaaagatgttgggtttcagtgataaagcgaaatgtatcaacactttcaagttgcttgtcttaattttgcctttctttgctccagca

SEQ ID NO: 2337 - DNA, 509 bp, Bovine  MMBT22069
aacaattttttaaagctgggtaagtggagatacttcctcagaattgcatattaaattcactttcaattaatgtggttcagcgttttcttcttatgatttgtatgcttggtaatacttttaaaattaactgtgcctctgacagacacacyacatacttctaagccgccgtaatttttctaacactgtatctttataacagtaattgccttctttctgaaagaatatgcgtctgaatgtagtgacacttcatttattacttttcttatattacagctacctcagcatattagatttctttcycccttaacgacttttttctattaggagaccatgaagacccccagggcagagtaagtccattaacgaggaggcacttcagaggcagcaggaatttctaacatggacatcagacagttcttgtcaagaagacatctcgtcaagatcaggatatcttccatttcctgtgaactacagacgcttttttaaaaataatttttaaaatttattta

SEQ ID NO: 2338 - DNA, 600 bp, Bovine  MMBT22071
ttccttttcaaagcatatgaaaaaattgaattttaaaaaatttcaytaaaaggcaacaggcttattttgtgttaagcatttttcagtaaaaactggtttacccaacagattaccaagcggtgtaactttcttaaccagtacccatagttacgtttatgataagtggttcataatgatgattctggttcacagaccaagataaagatatgtttcctgaactctacaataaaaactgagttaaggtcagtggatgaagtaaatttcttggaaaatcacaaatccacatgttaatgtaggtayagacctaagtatttgatgaaccccaaacacccaacttcctggtagttctggaaaatagaggtgcactsctattattatattaggacagatcctggttcagttaacggtgggtgttttcttttcgttcttggtggttaacattagtggtcttttttcactaggcaaggtaacaggttttcacaaggcatatggtaaatttgtgatgtctttagagaacaccgccacgttcaggccccattgtcctttcctgttaattgtgttgtcctggtctagaagagctacttaatgccataaaggaaa

SEQ ID NO: 2339 - DNA, 600 bp, Bovine  MMBT22890
attctactgacatccaggcttcctgtgggctcccaggggctttggccttgaattctttgttggagtttcatcttcccacttcacagctgagctctgggcctctatctcattccccacctctgcaacagggaatgttgcttgagtatgtgtttcaagataattgcaaaatttaggaaaaaacaaaacaaaacaaaaaaaaaaacacgatttggtgtgaacatgcatgagcagtggagctcggtggggggttggagatctctgctccattcttgggggggtagcaggacgtgatgggtgtgytgctaacacgcacagcctggttctggattcctgctgcagattttatcaggaatttatcagattttccagtgatgcagagtgtaagttaagatgttatctgcagagtgtctgccactatccctggctcagaggtgactttgctgtaatgctcatgaaacttaagctcccagaaacttcatatgcagcaacctgttccaaggccctgaaacggaccttagcaagtttcattaacatttatttatcctctttcttagagggcttcaaaaacatacttaacctccagttctacagaacatggat

SEQ ID NO: 2340 - DNA, 600 bp, Bovine  MMBT01003
ctctttttgtcatagtacatatccatctccaaaatatgggatgactcccttaccttttcccctcttctatcactcaaaatatgggatgactcccttaccttttcccctcttctatcactcaaaatatgggatgactcccttaccttttccccgcttctatcactagaatataagcacaaaggaattttggtcttttttttttttttttatcactgttgcatcaagaattgtgcccagcatcttgtgggtatttaataaatacttgttaaataaatctttgtttcatatttaagaaagaarcaatgaaagttgcatctgcctacataggtcttgtcaataggcagacttcactttagactgagtgtatgggcagctgtccaccaggagagccagccattgcactggaactctcagggaatagattggagaggaatttgtactggggtgtaaacacccgagttctttccagagacttaattctgaaaagtaattgtgatacaaaattttatttggagtattaaacagatatctttaataaggatggaggctgcagagagagaaagagaatagaaatcagaagtaattccacttaatagatgg

SEQ ID NO: 2341 - DNA, 600 bp, Bovine  MMBT07555
tcaaggaaaagagaacttggtaatagcttgttgcagctttcattttgcttctccctggactgggaaaggacagtgttctctctggtggcccgtttctctctcccatgggccctgagtaggttgcccgctgagcttgtgaacacagtgggcagagcagagttcccacggcacacaaacacacctrtgtcaatatgacaatgaacttgagagggcttaattgrtctatggaaacaggaagcttacattttaaaaattattggcagttgcatcttacttagcatcactctggtaaatgtactrgatgggagaattgcttaggagatgtcttaggtgagagcttgctgcttctctgactttgtcaaggatgacagtgatgactggggagttgggcagctccagtaaaatcgtgggctctgttcttcccaccaggcagagaggtggccactgggtgcactggcagatctttgaggatgaacataccaccacatcratgcctrtttactaacrgckgggcagaactgggcctattagcttgcttcccagttgggagaatgggcagtgtaatgaaaagaaccaaggcttcgtggtcagaccatcctg

SEQ ID NO: 2342 - DNA, 598 bp, Bovine  MMBT09152
  misc_feature (1)..(48): n is any nucleotide
nnnnnnnnnnnnnnnnnnnnnnnnnnnnnnnnnnnnnnnnnnnnnnnnttatgatcccccttcacagatgaggaaaccgagctcacacatcctgagtgtgtgccttctgggctcaggcctctctctggctggagccaccaggcttccrgcaggagcaggggttcaaaccagctgtcacgtgtctggctgaccatgacagtggcctgtagctgaaacaggccagagccccctgcatactcaggctccctgcccctgcctcctgctcagacagggctgagacatcagtgcccacaggtttgytgaatggctgggagagattccaaagaaggcagaaaggccgggaacagggaactggcctgttggagggcctgggactyacctggttggcagggctcgggcctaccacggcctcgtagggtggtgggagctcagcagggtacagcaggccggggctgttgatggcgacgccgtacaaagtgccaaacggggaggaagcgaagtccaagtggaggcccctgagcagcagaaggaggaaggtcaccctctggggaaggagccggctgttcccattgccctcagagcaatcggaacaattccc

SEQ ID NO: 2343 - DNA, 600 bp, Bovine  MMBT01643
caaccagagctggaaaagcgccacctagtgctccaatgtcaacattacatgtcaacagaggactgagcaaagcactgtggtctctggcaacgagcgcatttctcaagtgaaaagataaagacagaaacctattttaaaattaagtctcagaggctctcaagtgagacycaagttttgaaaagtaattgcacccccaaagctcaggatttccaagaaatatttattttatttttcatgccaataggaaagcgggacaccccagagttatgcacaaaggcattttcttctaccagcacaagrgatatacggccaaggtgaaaagtatagatctgccttaatttcttggaaagcccttgaaacgtaggttcagattcyagagacttcacatgagtctgccttccccaccctcaaggatccgagttgcacttgctccttcttggtcttactcygtgccctcttgcagagttcatatacagagcctataattaggcgttcaccacgcttgaaagcatatgttttccacaaccataccactaacctcagaaaacatactctacataaatagacaaaaggccacgaagaaagayttgtttttaagtt

SEQ ID NO: 2344 - DNA, 600 bp, Bovine  MMBT01646
tccatgggatttttcaggcaagaatactggagtgggtcgccattccctcctccagggtatctttccaacacagtgaccgaaacctgcatctcctatgtctcctgcattgcaggcagattcttgacccactgagccatcgggactatagcctccaatagcacaaatccactctagtcttttgaaaccagagtttaaaagttttggtgttgatgggaatatgagtmcctgattagaaactttctgtccaaataaatcaaagcctaaggtggggaacaatatggaaatacacttctcctttgrtggkaacaaagatactaatgttacttcagctccctttggagaaaataggccttgaattattctccaaaactcactgaaataatcagccttgttggaacaataagggaaaggaagaaagaactagtcttccagggaaaatagtggctccttcgtgccccatgtgagctgaagtagcttggctcwtcttagctctggggtgatttgtgagagcttttggcttaacacattatctctgaaatatcaccaagagtcagagaatccctgaacagtgggcaataatctgcttggagttttgaaaat

SEQ ID NO: 2345 - DNA, 600 bp, Bovine  MMBT05607
atcaatggtgaaagcacctcttttttttgttgttttaacaaagagggttactgcagaatgaatcttcacaaacagtgctttatttggtcacaggatccatgrtccactatgaggatgggagaactttattggatgctaatctaacatctaaaattatatttgtctgctcttctttcttgccatttatggtgaaaaatctgaagccagagcaccgtaaatgttttgcttctcatttctagtcccatcccaatttcatttycttgcaatgagaggaagggttggaagataattagcaatgtycttctcccacatttaacatctctacttactgtgctstatgttaccrcttactctgaaaaattcagtatgtagcttgaatgttgttttaggcttttctaagttttgtgtgtttctggggcattactaatggtttaccttaaaatgcagaaaaactattatgaaggagactttaggataaaagcataatcccctctaggaaacaaaccacttcactaaaatgccgttgttaagggatggggtggaakaagcagaaggaaggttagacagtgacttagaaataaatatcaacatttgatgtca

SEQ ID NO: 2346 - DNA, 600 bp, Bovine  MMBT08461
tttggccagaaacaataatacttggagctggaatagatggcacggagagagggtgagacttttctcagaaacttgaaacacaaaggatggcrgggatgagcggagagcggggcagggcctcaaagtagagtttgcccggtggctgagcagcaggcaggcccttcctgccgaaactgactgtgtgtgtatgttagacaaaagctctacaactttactactcactcttcatagctaatcgcagtctcttagttttgaagrttccaccagcagggrggccacacgatgtctgtggggcgctcrggcaaccctaagacttaggcaagaaaagaaaagagcagaaaaagagggatggagatgatagagggaaaggaacaaatacagagcggttgatgcaccctggcagaaaatctgatttaatcagtttcaccctcttgtcagtactggaaaagacctttattcccatttaatagattaggcaaccgaggccagagtggtcaagcaaggacttattactgcagagcacatggctaatgactgtgaaattaggatggcaagatttggaaaacaaaactacaggacacccagttgaatttgaattcc

SEQ ID NO: 2347 - DNA, 600 bp, Bovine  MMBT13231
aatgaggttcacagtagctcgcttaygagatttctagtttgttaggtgggatattaatacagaggaagaaataggcaacattttgcctgagagttgcaaaagcatcgaatatcagttacccctgtggagctcatacctccccctaatcctgactggatgtttgactctctcgtgctcaatccctttatttctttggaggtcaaaataatgaaactgccttcagaaataaagacacagcagagatgaggagtgaatgattagagtatttgcactttcatctatgcagagaaacacagtgayagtttgtctcttgtgttctgttttgcagataatgtcaaataggacagaataaaagaaaagatgcaagatccttcagactcccctgtctgtctagaatctgcttctctggccctgtttttgccccagcctctgggtctcacctttgtgtctcccctttctttctgcttctgattctgctcttactcacattagacaacctgaccccccatcttcacctgtattcctagctttcatgtgacaaccagagtctggttccttctcattcttgattcatctgtttaaaacattatagaagatttc

SEQ ID NO: 2348 - DNA, 600 bp, Bovine  MMBT14495
gttacaatagttccagtctgtctggagacttgcagtgagcctctgtagtgacttagctacaaaatgttaagaaaagctattcttcagcagcagagacactgggaaaattactgtcaaaaagggtgagccccttttaaaagcacgatgccaaagcattttgatgatggaatactttattttgtaagacatcagaatgctcatttcataatgttaatgcaaggagctacttcttttaatccccttttgtagatatgcatcaagcaacaaaggtttactgtttagcatagggaactatagtcratatcttataataacctatgatggaaaataatttaaaaataaatgtgtatttgtgtaactgaatcatcttgctgtgcaccygaaacattgtaagtcaactatatttcagtaaaaaaaatatatattaaaaaaattcccttttggagtcagtaagagtaaagataatagtgggggttctgcatgaataaaaagattgataaacattatatattttgaaaatattccacatgctctaactttcaaaagaaccttcamttgttctatggccamaagacaaaggataaactggggaaaatgttc

SEQ ID NO: 2349 - DNA, 598 bp, Bovine  MMBT14966
  misc_feature (1)..(141): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcgctggcctctggagcaactgaaggcgtttcatagcaacctaaatcttaacggctgaaataggaaacagagcaaagaacgtggaaactaggtcaaggaggaaactctggtaaacctcctgaaatggctgacgtttcaaacgttacaattcctcktatcagtcattttcaaaaggaaagtatgtattcccaaakggtatcctttccagaccaaaacaagacatgtaagcagacaggtatggagaaatagagaaacaaaacccaagtcagccacgcacgcctcacctctgtactgcccagccttctrtgtctgtctctcctgagctgcactgcctcctggacatgtggtgtcaggaaagtgggatccacttgacctgagatgagaagtatcagtaaggaaacaaattcattcacagcttgaggtcattatctttaatccattttagatggattg

SEQ ID NO: 2350 - DNA, 600 bp, Bovine  MMBT16227
ctttcaggcaaactaagatctcatatgctatgtggcatgtccaaaaaataataataatttttaaaatagaaatacagagatgagcagagtatcattctctcttcccgggcccatagatgggaggatgatacataaaagcttcacttagaaactctgttgacatataaagagtttcattttcaccatggatcactccaaggaaccagaccttcacagcagctttcatcagaatgctgctaactcacacatggttggttgaaaccattctaagagtgatgaggacaactgagcatctgtaayaggaaagaatatttctatgcactgaatccacccaaatgatctcattgtttttattttcatgaatcaaaagtgctttcatccagaagaaataatgacttggtaatgtagaaaaggggaaacatgacatttggtttgctttattaaggacttggcacataaattataaatgagcctttgtacatggtcactaagagaaaagtaaactgtgacttttatattcaagagagcataaaagcatcaaatgactgctggtcctctgagatggaagtcttaaaatctgtagtctgcctgagccctctt

SEQ ID NO: 2351 - DNA, 600 bp, Bovine  MMBT17139
aacacgactgaagcgacttagcagcagcagcagcagctcgctccctgcgtctagttaacggcaactgaatggtcagctgctgattcactggatgctgtttagtttgttctgtcagctgtttattcatctgtaacttcctgttaagatgcagggtgtgctttttaaagaagccttgcacagcataagttttattttgggactggatgtgctaatatataaagaggatctccgggagttatttagccccatgagctattttctctgagcaaaattttgtggacactccctgggtgccaggcrtgcttcaggacaccgtggtgcagcagtgaatgagactgtctcagcctcagaagcttgccgtccactcctgcaagacgagcacaagcgtgagtgcagtgaagtgtggtacacgtgcaaggggtgcggggtgcagagcagggctggaaactcccaggaagcaaactgagggagtccccgyggcagaggctctgggagggaatttagcaacatttcagctgtgggtgatagtggtttgtgtagkcgcttagtcatttccaactctcgtgaccccatggactgtagcccaccaggctcctctgt

SEQ ID NO: 2352 - DNA, 600 bp, Bovine  MMBT18807
aacaaagagggttactgcagaatgaatcttcacaaacagtgctttatttggtcacaggatccatgrtccactatgaggatgggagaactttattggatgctaatctaacatctaaaattatatttgtctgctcttctttcttgccatttatggtgaaaaatctgaagccagagcaccgtaaatgttttgcttctcatttctagtcccatcccaatttcatttycttgcaatgagaggaagggttggaagataattagcaatgtycttctcccacatttaacatctctacttactgtgctstatgttaccrcttactctgaaaaattcagtatgtagcttgaatgttgttttaggcttttctaagttttgtgtgtttctggggcattactaatggtttaccttaaaatgcagaaaaactattatgaaggagactttaggataaaagcataatcccctctaggaaacaaaccacttcactaaaatgccgttgttaagggatggggtggaakaagcagaaggaaggttagacagtgacttagaaataaatatcaacatttgatgtcaaggcattaatccctttatacctggtgatctgtaggg

SEQ ID NO: 2353 - DNA, 600 bp, Bovine  MMBT19044
ggcctaaatacttagcacttacctagcctagtctagaacttgaaaaaaggggcgatcatattcccttgtggaaggaccccagtgtactacccaaaatggatactgttgatctttgtttcagtcttattcagtaggacctgtggctttttatcagagtaactatcctatttggaaaaggaaataatcagaatactcctggactactagactattgcaattcaggagacccaaaatgccactgtggcccttcrgtcagaaaagaaccttaaggagattaggtaatcaatggagttttagctsagatttgcctcacagtgggtccagtggggtccccaagcctgtcttgtggttatgtccccaatttcagagtacataattgcaatggttatactcagcaagtggcagaatctccaaaactttctgttgaacactcattatttattgactttcagccggtggttccacagtttcttctacctggaaggcccttgtagatgtccataaacatccaggtccacattttaaggtcagtcttgtcttgcccattatatgcagttacgttgggattatcagacagagtatctgggtatgcaaaagcag

SEQ ID NO: 2354 - DNA, 598 bp, Bovine  MMBT00867
  misc_feature (1)..(20): n is any nucleotide
nnnnnnnnnnnnnnnnnnnnatatacatgtatccattttcccccaagctcccctaaaaggctattttctatgtcatgggattgtctgaagattacatgagctaaggaatatgaaagtgtcctggcaaatgtaaaatgatacacgaatcatgaatattgttttatcatgcactttttgaattctacagatttacctattaaacaataattatttatacataaagtgccccaatatgatacaatcgtggtcctagaactccaaagacttcataattaaaatttgtttcactttaaagaaacmtttgtattagcaaaaatatttttatcaaattaaaaatctttgtctgaatccctaattttttatcagtttgttttttttaaacttcaagtttataccatttatgtgttgttaaatcaatcagtcaaaatatggctgttttgatgactttaaatctgaagttacaaataacagttgaatctcatgttagtcaattgatctctgtttttttgttttgaagatataatattgagaaatcctaattacccagaatagaaatcaaaaaacttattttttwaaaaaaatcttgctttaaatctaa

SEQ ID NO: 2355 - DNA, 600 bp, Bovine  MMBT01680
tcatcacctgttgctcctttgtcatatataggtcctcccgggagggggtaacacattgtgccctgcagacatttactctaaacagtttgaaggagtttatttgatattttaaatttagttcttgcaagtaaagtttagaaacaaagcaggaaaaggaacattgaacaagagggataataaacagaaaccaaggtattctttatgtcattcagttctactaagatcaattgaagaactattatatgaaatacataatattatgtacctagttttaggagtttaagttataatctctctctrcagtgattcaggctgtttgttgactttgaatgctaattaatctagagacttagagtcccagataaggtaggcatatatgctggatagggatgcaagggagaattaattaactctcaggctaccttactcttatttgaatgcactatttacaaaccattaaattactaacttaagagatggtgaggttgcagaatgtggctttgagtagtttgcaaagaatactgtgtactgtaaggtctgcctcattagacaaaatatttgtatcattggaatgtctccttgaaaaaccatttgataaag

SEQ ID NO: 2356 - DNA, 600 bp, Bovine  MMBT02712
gatccactggaggagggcatgactacccattccagtattctttcctggagaatctcatggacagtggagcctggagggtcatagttcacagggttgcaaagagctggacacgactgaagcacttagcatgcatgcatacaatctgattcagttcttacatattaaacagctgcttctctgtttcccccccactgtttcatcgaattctcatgatgactctgcaatgcaactactatcatccacagataaaagataaaattacaaaatcagctcaaatttacctgctcatatgagaaagaytcaaggcttgggtccagacatctccaaacagtgataattgtcaaaatactgtttcaaagagggacctgagctgaagctgtggctttgcctcatacaatctccatgacctcctggccatwgcttagtcctctgaagcctcagtttctttatctctaaagtggtgatgatgaccagctctgctcatctcatgggtgtgaggagagaagcaggtgaaatratataatagtgaaaacttgtttcttaccagtgtccttggcagtgagtaagagaatctgtttgagtcattctgctctttaattt

SEQ ID NO: 2357 - DNA, 600 bp, Bovine  MMBT02740
tccattgattattcatcttttgtttttgttttgtggtttaaataaattttgtatctagttgaatttatcagtcttttattatggcttttggcttatgagtcacaatagaaaggtctttctcatttcaaggttttaaaagaattctcccatgttttcttgcagaacttatagttgatccatttggaatttatcctgatatgagatataaatccaacttttctagatgaaattccagatgtcccaacacctagactatttgttgaatagtccctctcttcattggtgtgagatgcgcctttygttgtctaataaatttccatatagacttggatatatttctggattttctattctgtttcagtcattgctgtgactgyttatgtgccagaacttgatttttgtgtataggtgtgtatattttatcattccattttcccctctattagtttggaattctgtttttagtgttcactttgtatgttayaagacagtttttatttacttttttatggctgtgcagggtcttggtggcttcccgggctttttcctagttgtgccgagctggaacgactctttagttgtggagtgtgctttctgggg

SEQ ID NO: 2358 - DNA, 598 bp, Bovine  MMBT04108
  misc_feature (1)..(146): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctcagcagtgttctgcaatttggggaggagtgagtatctttttataaaatcacttagtgagtccctttggtaagcctgtacactctattacgctgaggtttagtgtataagaaaaacgtggtgtgttggagtttgcctgcttgtgttactytttctcctttacatgctgtggtagcttactcagccatagaaaataaattcaaagctgtttaataataaggctaytgttgtgtagtagaaactaggcattatggcagtaagtaaataccttatacatcaagaatatttcaagtttctggtgaaatccaaagtatcacaagggcttcattatgcccttgctttcagcccacaasccctctgatcttaatgactcccaaacagagtcatccaagattttgtcccatgtagggtcactgastaagtttgtgatgggtctctgtgtgttctct

SEQ ID NO: 2359 - DNA, 600 bp, Bovine  MMBT09308
cttatagactgttttgttttatcatccttattaagagacttctactgcgtcatgttcctttattcagaaaattacatgctatcatgggtgtctgattgtcagtgtatttgacctaagcaataactggaatacctgttgtatttgcttttgcttgtaactttagaaattgaagttccgatcttaaattgagcccttgtcctcaagtaaacaaatgattggaaacaagatttttctttttcagtgctactttgttgaaaagtcgaattggtttcacctaccaaataaagcctgatggtgctraccatcttcattgttggactgcacagtttaaatgtgtattgggggctataaaaatatacatgcataggctaggcttgatcttcttgagctgaaaatttcacaagaataataaatgtgaatgtaaaaatcgtttacataggatatataaacccaaaactagaaacgttttgtttcatttctacatggttaataacgtaagagttgctccctcttcaaagaattattttgacaccagagataaagttttggtaaaggtagaacttgtggtaccactgcctgatcagctttttgatgcctgag

SEQ ID NO: 2360 - DNA, 600 bp, Bovine  MMBT10577
aaaccaaaaataattaaaaatatgtttttaaaaaaggaaaccagattatccaagaggggtcgaacctagaaactcagaatgtaggtgtatgtgcggtttggatggtcatggggttcacagagccccgtgtctggagtcccttgtcccagagtcagtgccccctgcttggtctgtggtgggggaggggctttcctgtcacttcagaagattgtgggtcacaaggcccgaatttggtgagtcttgaaatcagccggcccaggycctctggtgacccgggtctctcttatcatatctagagasatgactccaatatcaacgatttaggctttccttatgggttagcctgggaaccacaccacattgtttggttaaacctcgagtacggacggacttaataatgaactgttgggccagtgctacttgcttgacctccagggctgtctttkgctgccgctccctctcccccagagcagtgtcctctcgggaaatgcagctgaccaggctgcatccgtgggaaggcctggccctgctgaggctgcaggaaatgaccctcttagcagccacgagctgtgatccagaggacaatgacagggggacgga

SEQ ID NO: 2361 - DNA, 600 bp, Bovine  MMBT11754
tctttgctcatatctgtgcttttggctctaaaaatcttaaggatggttttaaaaattagatgtgattaaaaggtaaaaatatacagaaataaatgttttactgttattgtcatcaacaaatgggcttcctccagtgtgcagcaatgcatttttttctgagtccttgaaacagaaaagctgcggcttcttgcattagacgaagcttgcacgtggatggcaaactacagcaatgtctaccgatgccgggtgtggarcattcgtgcttcaaaagttcatttgtggttgtttagaatggaggcytcattttcacaaacgagtaatgttataaatggtggctagattcttgagttatctcacaaggctgtttaattaacaatgtcttagagtacatttctagtttatcaggtggctgaagtaatgcatatattatgccagccactgcaacataatcatcaakttcttgatcaattaaggagtgtttactttgagccctgagaactgtctcctgacagcagtactgaatctgtcactataggttctagagtatgtaggagttgttggaaaatttcccatattttaatagctgagaaagctggtttg

SEQ ID NO: 2362 - DNA, 598 bp, Bovine  MMBT12503
  misc_feature (1)..(65): n is any nucleotide
nnnnnnnnnnnnnnnnnnnnnnnnnnnnnnnnnnnnnnnnnnnnnnnnnnnnnnnnnnnnnnnnntaaaatagggagggagacatagagtttgagcttttaaggttgactttttgactctgaaaagaatttttaatggcaacataagtaaggctgaagcttagaatctgcctctttcaaggtctccaaatagtcacagaaagaaaattttcagctctaaatgtggcccttattataaaatgcatcatttatactacaaaaatcattttacatacatacaaaaaagattaactagttaaartggagacaaaatattggctaaggttttaaaatttcttataaaaataatttattaaaattggactacagaagacagaaaacatttcacaacttcrtattgctcattgttgccctgaagacatcatgaaacatacgcaggtccacagcatgggcttgggcacaatataragaaagctaaagaaacacaaccctttccaaccaaagactagagttgtaactagtggacttgtgaagctctatcacccagtgtccccaggagtcttccttttttagtggaacctgtaactaactttaaaact

SEQ ID NO: 2363 - DNA, 600 bp, Bovine  MMBT14803
gactgaaattaagctgtcctgaaactgactctcccatttctcaagattttcccatacatcttgattttctgtgtttaactcagcctatcactgagagtcttcctctttcagtgaacttctttcaatttgggggaaatgaaaagatgataatttcccatatggtcaatgaccagaaagcactatctgtgtgtttaaagcctatttgaacaggacaaaaagaaaaataatttttaaaaaacggaggggatggagactttttttaaagtgctatagctgctccttaagatcactaatttcttsggttgtagaggaaattttgagagactacgaaacttaattgattgttatcaaaagattatacagataactttgaaactgttaggtaacattcacacccaccaattctcctaaaccaatatcctggaaagagctgaaatttacctttaagttatgaagtaaaggtcacagaattcttgagaagcattctgaaaacaattaattcactattttattttcaggtgccaagaaaatgtgaaacyatgagaagcatttttaacatgtcttttaaatacattatcaatgcattattacaaagaaatg

SEQ ID NO: 2364 - DNA, 600 bp, Bovine  MMBT15899
gcgtacgcattatttcagtcgctcctttcaccgttctgctgatgcttgtggcgttacgccacgcacagatgaagagactgagacgaggtttccatgaatgacttgcagccaagagccacgtcacagcgtgagcccggggtttctgactcttagatctggagccgtttgtaagttagaacatgagtgagcagttctcagaaccctggagggtctgggagcacagggttggtttgtatctcttatcaccaaaggaatgaatttcttaaaattactgggttctggggcaggggagtgtcttcrttttgtattttggttcaatggcagctctttccgttgtttgagggactcatccattttttctaaaaaaaactgtatgaacgttactattatctcaaacactgatgtgacagatgtcatgtgtatgactttcattttcataaaaacctgttggctgattttttttccaagtgatattttaaattgtcatttggaatgtatttgctaaagtttattctggtagcatgacttcattgacgtgagtatcaagagttcaagtaaacatcagccttgctcattcaggacctaatacgtctgactgtc

SEQ ID NO: 2365 - DNA, 600 bp, Bovine  MMBT17408
atcaacacgtttggtttcaaaaacattaaaagaagaataaagaaagaacgctacctgtgtgtggctgcttctcaaatacccagatattaactctgaatgtctgtaaactctaacacttttctcattgacattcttctagtcaatgaagtagatagtacaactaagacagtacatttttcccgtgggactcaataaagctatttttattttgaatggaaaataaatacagcccataaattttgtttatttttttctgagtaatcctttccatttctcaaattctgtgattctgtattttgytatgtctttccccacccagaacaaaatactctaaaatgagctattctacaaatatcatatttgtagaaaataataaaattgaaattgcctaaaaatactctaaatgcttttgaatatggttacattctgacatcataggaaccctgtgaaatagttattataatcctgctttacggtgagagaccagtaagagctggaactcagtgcggtctaattagaaataccaagcttttcccaccatacctcttggcctcctcaaagtgtttccygaactatggacagttacatgattttagggtg

SEQ ID NO: 2366 - DNA, 600 bp, Bovine  MMBT18603
ttagtttttaatccttagaattttagcaatattttggatagattagtggttctcaagattagttgcacattagaatcactttggaaagtttttagaaaaaagtaccagttcctgggcttcacttgtgaagattttggtttaattgattttgagggtgtgtttggcagggctgggtgttggtgtttctggattttgtttctaattcttkaaatcagtcatttttggcaccagggactsattttgtggaagacartttttccacagactgagatggggtttagggatggtgtggatggtttykagatgattcaagtgcatacatttattttactaccactgatgtgacaggargcggagctcaggtggtaatgtgagcaataggcagtggctgtaaatacagatgaaacacctcctgctgtgcagcccagttcctaagaagccacggacttgtaccaatctgtgaccyggaagttgtgaacccttgcttccgatgattaaaatctctggctagtcattaaaatctaaccactggaatagatgccccttggaatcctgtataacttgaactacttagatatagtccttatgtttttaggtatc

SEQ ID NO: 2367 - DNA, 600 bp, Bovine  MMBT18758
gggagaagaagatgagagagaaaataagccagaactaacagcctccccatataaggagtttttaaaaatcatgaaactcaagacatgatgagatagttcttcacacccatcaatatgaccattttcaaatatgcaaccaaccaagcaacaacaacaacaacaacaaaaaaaaacattatggagaaactggaaccctcatgtcttgytggtaggcctataaattggtgcagccactgtggacagtggtatgacagtttstctaaaatttaaacatagaattccctatgatccatcaattcrcttctgggtatttacccaaaagaattgaaagtagagatgcaaacagatgcttgcacacccatgttcatagcagcatcattcacaatagattaaagtggaagcagcccaagcgtccactgacagatgaccagataggcaaaatccggactcatgtgtgaacctagaaggacaaatactgtgagtccacctgtgtgaggtcccgagaggagcgaatacacagagacagaaagcaggctggtggttaccaagggcttggggaaggggaatgaggagttagtgtttaacgggtgcaaagggtca

SEQ ID NO: 2368 - DNA, 600 bp, Bovine  MMBT18808
gttactgcagaatgaatcttcacaaacagtgctttatttggtcacaggatccatgrtccactatgaggatgggagaactttattggatgctaatctaacatctaaaattatatttgtctgctcttctttcttgccatttatggtgaaaaatctgaagccagagcaccgtaaatgttttgcttctcatttctagtcccatcccaatttcatttycttgcaatgagaggaagggttggaagataattagcaatgtycttctcccacatttaacatctctacttactgtgctstatgttaccrcttactctgaaaaattcagtatgtagcttgaatgttgttttaggcttttctaagttttgtgtgtttctggggcattactaatggtttaccttaaaatgcagaaaaactattatgaaggagactttaggataaaagcataatcccctctaggaaacaaaccacttcactaaaatgccgttgttaagggatggggtggaakaagcagaaggaaggttagacagtgacttagaaataaatatcaacatttgatgtcaaggcattaatccctttatacctggtgatctgtagggtgaatggaac

SEQ ID NO: 2369 - DNA, 600 bp, Bovine  MMBT18825
agttcctgacagagctggaggcatcaaacgtccgttagtatattttgactgaaagtttggggctgaacctgatcatatccagtctacacttaccccatcaagtgttcatgctacactgtttctgtgagataggcaagcatttggataccctctcccgccttaatttatccgtatttcctttcggaccatgaatatcttcactgctgtggcataccgctacagagccacacaaagcaaggccgatytggaaatacagagtggaaagactgcctcttgttttattttctataaggccctcckgaaagcacatgaaatctggggattgtgaactctccttccacgsaaaggacaaaataaaacgtgattcaactgcttgaatttggcctgaaagggagagcgctgagcactgggaaagaagggagtgggaagtaggtggtccagctgggaacagaagcagcagagacagagctgataattaacaaaccactgcacactgaaccatgccttcatgctcacaggagtggaaagacagcaccaaaggcccatattttggagtgactttaaaattcatgagtttaatcagggttcagcaatataaat

SEQ ID NO: 2370 - DNA, 600 bp, Bovine  MMBT19478
agctatggaacatcttatccatgttttacaaacagatcggtatgtctctaatgatttttctccctaatttttcttaaaattttaattaatttgttttagagtcactgttccagaaatgattaaggctactaagtttttactttcagttgtcattttaataaacagttattgggcactagatccaaaccattgtgctaagcatttaggacagacataatctaaaccttcagggattgagagcttaccattatataaaaatggaatgaagtaacttgtccaataaaggtttaaaatttggartttgaacaaattaatgtattggttttcacttaggtatactatagcatactattctataatatacatattatatgttatatcagttatctagactttgtctttctgaggggagagaagtaaactcatactaatagagggaagtcttaagagaagagtcactcagcctagtttttgcttttttagtttctctttaagagagcatctgcatctttgtttttaattaacaactgtacaggaataactttagatcttatctctagttaaatatatctttcaatctttagctgctcagtttacatt

SEQ ID NO: 2371 - DNA, 600 bp, Bovine  MMBT19754
cttactgatgttgtgaccttggagagctaaatagcttctctgaatctcatattctttgcaaaaatgaagcaataagacctcatatcttctagggtggtgtatgagttaagtgagataaaatatgtgaagccctggaatatgacctgacaatgttaagtgtttagaggacttcaaattgctccctccctttcctgtgagcatcaccacaagtgaaaatgcaattatgggagaagaaaggcaattaaggaacactcaattttcctagcttttataaatcaagaacatatttatgagctataytatagtgcgtggaaaaaaygaaaagaacaaaagacaaaaaccaggcacaagatctcggggttctcttgtattatcataactgtaaaaggcatttttcattggccatttaaaacctggtgttcctgaggcctgtgaggaagtgcacagatcactcactctgcttcaggtattgacattcctgtgaagaagagatatttcctataggattattactcatcatgactgaagttcaatagataaattaaaaacccagccactcctcagctctggaagtgactcactgctcaaggaatgctctct

SEQ ID NO: 2372 - DNA, 600 bp, Bovine  MMBT22067
cagggtaaaatataggtgttctaatattaccatcacttactgtaaccacataaaattattcaggtatcagagataaagtccatgagtaatattcctcattaaaagagactggacatttgaaagaaaatctgataactaatagcctatgcgtaacaattttttaaagctgggtaagtggagatacttcctcagaattgcatattaaattcactttcaattaatgtggttcagcgttttcttcttatgatttgtatgcttggtaatacttttaaaattaactgtgcctctgacagacacacyacatacttctaagccgccgtaatttttctaacactgtatctttataacagtaattgccttctttctgaaagaatatgcgtctgaatgtagtgacacttcatttattacttttcttatattacagctacctcagcatattagatttctttcycccttaacgacttttttctattaggagaccatgaagacccccagggcagagtaagtccattaacgaggaggcacttcagaggcagcaggaatttctaacatggacatcagacagttcttgtcaagaagacatctcgtcaagatcaggat

SEQ ID NO: 2373 - DNA, 600 bp, Bovine  MMBT22744
cgtggccctgcccctggccgggggcccagtgggccagagagcacagtggtgcctgaccttcrggactggaatgcagcttgggtgtccccaggctcttactcccgagctttgggggcatgscygggacccagggagagctggctggcccagctgggctgatcaatatttgtgggttcagtttagatgagggggaagttcccaggaacacctgggctgggctggtgaggacaggctgcccctcatggaagcagagatgggatggaggccgagacagtttycacgctccactacccggggaayrcccagaaagggtctgaaggggtgcaggctcacatggctccagatactcctgctggggttcccagatgtggctggggacgggtgggcccagcacggacccyggacggggacagactgtgcctcagctctgagctcggtgccctacagacttcctaattctccaaatccccagaccagtcttcctgtgagtctgaaggcctcagggctgcctcccttccagcgctgagatgagctgtgttcctgtgatcgtgattttggggtgggggcacaggataggaaaaggcctgcagctgggttcag

SEQ ID NO: 2374 - DNA, 598 bp, Bovine  MMBT22766
  misc_feature (1)..(170): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttctctggtttccttctattctcctgtcggtgactctggcatcttcgtcagtgttcagtcctcctaggtggtctcttctgcctcaccctcacctgtccttacttactctcttctccatccttctcccrctctctccttaggttcccagaaaactcaaacctctgtactcttctgtartttttggtctttttcttctgtttctactataatgatgtttctctctgagtaaaaatagtagagggccttttacatttcttttagattgggaggagcaatcagaaaccaaagatctaactccagagcaaagcctgcctgtagaaaaatcatcttcrggggcaggaatagaggatttggaggcaggtgattcctggtatacccacacaggagagtcttctgatgatcccctggagtcgcaacaggtcaagc

SEQ ID NO: 2375 - DNA, 600 bp, Bovine  MMBT23279
agcaattaattaatctgctttaggaacctaagtaagtactagctgaaatttaagatgtaaaattggaagtcatgagtmcaatgaaggttagaggaaaaaagaaatgggatatgaaggagagtcataatkctgctcagaaggtcaggccaaatagtgcaatagaccttttgtgcttgaattcatgggagttttcttcctcagattaaagttatraaaaggagtttttttctctccttgatggctatatttaacaggagaatagttgctcaaatttattatttggcccagtwgaaaaaagtrcaatgtaactcaaagtctaaatcaatgtaatttaaaatataattatgcatgtatgggagtgtccatggcaagttagatgaatgtgttctaaagaaagaataagaatccagggattgagagattcttgttaaataggaaagaatcaataaggagacaagtttcctcattaagagatgatcgccacatttctgaaaaaaatgataaagtgactgaaaaaaaagatgacattccttatggagattcataatgtcttaaaaaaataataatgttttttgcttcgctgggtctttgtgtctgtgc

SEQ ID NO: 2376 - DNA, 600 bp, Bovine  MMBT00751
atatttgaatgttttcatacatttaaaaagtgtggatcagtggctcattagtccacataataaaaaaatttccaatcaaaatagagaccactttactgacacagttggttaacttagcagggggctagcaaactagtgactttttcatgagatactgcagttttatttctagtgtcacctattaggtcaggattcatatctgctgttaagagaatttcattttttggcacatgaggccagggggtgttacttttgaagcagttccctcctacaggtaaaaagaacctgggaggaacccayactgctagctgcgagagcacacacagttactgcgcaccgcactgttaacaacattgttcaggcgtcacgtggttttgtcttagaaaaagttttatgtgacrtgatagacctgttttgccagccagcagataatgctctatgaacacctatagagaaaacctatcaaagttaggtatgagagcacaggaaagaagatataaaattaaccttttagccattgagtttctttgggtcccttatgtgattgttacctttttagatcttacagaaatgagcactttttgtgtcagctcctgaatc

SEQ ID NO: 2377 - DNA, 598 bp, Bovine  MMBT00768
  misc_feature (1)..(37): n is any nucleotide
nnnnnnnnnnnnnnnnnnnnnnnnnnnnnnnnnnnnnatagctccttactgccctcttctggctgtggcttttgtttgtcattgagcgtgttttagtttttaatccttagaattttagcaatattttggatagattagtggttctcaagattagttgcacattagaatcactttggaaagtttttagaaaaaagtaccagttcctgggcttcacttgtgaagattttggtttaattgattttgagggtgtgtttggcagggctgggtgttggtgtttctggattttgtttctaattcttkaaatcagtcatttttggcaccagggactsattttgtggaagacartttttccacagactgagatggggtttagggatggtgtggatggtttykagatgattcaagtgcatacatttattttactaccactgatgtgacaggargcggagctcaggtggtaatgtgagcaataggcagtggctgtaaatacagatgaaacacctcctgctgtgcagcccagttcctaagaagccacggacttgtaccaatctgtgaccyggaagttgtgaacccttgcttccgatgattaaaatctctg

SEQ ID NO: 2378 - DNA, 600 bp, Bovine  MMBT01352
ctggagaatcccagggacgggggagcctcgtaggctgccatctatggggtcgcacagagtcagacatgactgaagcgacttagcagcagcagcatagctgctaatctcaaaaaacatgcctgtttctagttttaaatttagactttttagatttcaagctgtttatttttttaataactaaatggaaaaggaaactaaatgtataggtttcccaccaaagatcatcactattcccaaaatcagtgttagaaccttttgtttttctttcccaagactcctcctaagagagttttttccctkccttggggagatttatgaattgcagcaattactataccctcaattattatatcattatttaaaagaattatcccaaactactttcttaccctcatttgttagataatatttataagtgctgggaaagacactgtgaagaaaccccacccatgcccaaagcaaaatactgctctaaagcaataaaaagagtacacaggtacatgcatacaaaatttttttaaatcaatggaaaaatgcagaattataatgcttttgttttaccttgttttcgtaaaccttttatctcacttgataaaacag

SEQ ID NO: 2379 - DNA, 600 bp, Bovine  MMBT01364
gtggctggaatgtggttcccacagctccattcacagcaccaggtttgccattgctggtggatatttggttgggatttggtttgctgctttcaatgaaatataaagtgaagtgataaaaatgacttgtgtaacaaggtagaaggctctacatttcattactgatttatcttaaccacacataaacatgtgaatgtttgatgaagaagaaatttaaatgaacccaaaccatttatctttacaaaccgaggctatgtaaaaaccaatctcataagcatgacactcacaaaataagtagtcatrtmtcttcctcatccagacataayttccttaggatactgtttgamattttggaaaatgcaagttattaaatattacttatcatgacmaaataatttctggattaaataaattaggcagtgtgcagtgtttagggaaaaccactgcccattcctgccactagagtgacagctgctgaccctacgcattggctctcgagggaactgcacaaaagctgcatgtcaacagtgacactgtggataccagctgggcttactgggagaggtaaacgcatttcaggagactgtgaccactcatcatttc

SEQ ID NO: 2380 - DNA, 600 bp, Bovine  MMBT03789
cttcagtactcataggaaaaaaaaaaaggcaatgttgcttctggtgtcagttggatgccaaatgtaaataactacgattaccctagcaagcccatgtggttgagccagaaaagggcactgtgccagcttccactcggtttgcatgtttattaattaagctcctggaagtttcaaaataagagttttaactcaccaagaaccctggaaaaagagggaaaggraagaatttgacaaagaaaaaacatactgaccggcaggtggacagacagacaaaagcagtgcttacattaaaggcacaayggtctttgaccaggaggttttaccaagagtctccactacctggtacatgaaggataagctaaaggctaactttgcactatgcttccccccagtggtcaagttttggaaatgcatttttctagtcaggaaagaaaagctggggaccatctgggcracatacacaaagaataccattagcttcttaatgtatggaacccgatgctcacttttaagcggaataataaaaagggaggtttgcatttaaattgttgccaatttgcaaatataaaatgtatatatttgaaacacattctaaagaaa

SEQ ID NO: 2381 - DNA, 598 bp, Bovine  MMBT07576
  misc_feature (1)..(89): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgatgaaatgatgcagaacagaaattaaaattcatgtattaattttttatcttcataactatttctacctagtatgctacagagactttaatatgaataatttaaaatatttttctctctttaatggctctttgtaaggctggcaagataacactgaaagtcaaatgtttatcataggttatcttattctatacagctattagtgtcrctttcggtcttcatggtaaattcaatgcaattcccttccttgacccctcagragaagtcaggatttagataaaggcctgagaaaaacactgagactattaaacaagaaagagttaaaaaaagaaaataaaataagaaagagttaatctggtaggggaagaaaagaaagaaggaaaagaatttttctcagggccattctttggaggccttcctttggattttggcrtctagggataccttccttgtgttctttactttcctgcagctgttgctataagaggagacagcaccaccaccac

SEQ ID NO: 2382 - DNA, 598 bp, Bovine  MMBT09303
  misc_feature (1)..(11): n is any nucleotide
nnnnnnnnnnntgtgcctagtgtttaatgctgccttcagtgctgtgtgacttctacgcccgtctatattttactattgtgcaaactccttggacctatctctacgctccctgctaatccagggtctggcttgtgtcggttttagttgagccaaactgaatttgttattaaggatgtcactataccagggccatgctgtgtggccttgggcatgctccttccctctctgggttgcagtctcagcatctctataatgaggaagctgccaggatctctgggctgttctgagtttctggaactycccaggtctgcctgcctacactaggggtgaacaaaaatttggggggtgggttggttcttagtgcctcacagaccayctgcctctcctgttagcaacttkgtccccttggaaccaggtgactggtattactaggaaacaaaaggactttcgcagaagttaatatttctttcttttccccaaagaaatggataaacctcattaagccaagacaagggaactaggtcatgcccygatgatgtcaagcagaggcttgtgagtgaagcaggctattaaatttcagatataaaaaataatctgc

SEQ ID NO: 2383 - DNA, 600 bp, Bovine  MMBT09324
ctctgtcggctgaggggccgcctgatggagaagcctgaggttatgaggcatccaactgcatcacagacaccaaacatggcccaggctgcgagagtcggaaggggctggctatccacttggcccatgacccagcatcttccttactctcgcccgcctttttggccactgctgttcattagcatctctcccaagagaagagagacaaggggaaaagagccaactttttgcttgtccgtttggctccttgtcaacagctctagtaagtgtgtaatctgatggaaccatggtccaagatgagawtttggactctttccctctctctgccccttgccaggcatgtgaactcctgttacggcttcaagtcccagcctttttccctaaggccccaggggcaaagtcagaagttagtcattccctccctggctcatggagcccctctccaggaccagagaacactcctcacattgtgcagtgataatcagagcccaggtctgtctgacaccagccrgggagctactctgagggtggggtgtgctctttcatcggcttaagtcccacgggttccggaccaggacttggcacaggactggggtgtaagaa

SEQ ID NO: 2384 - DNA, 600 bp, Bovine  MMBT09343
gggttctgtgggcccttctggatcgtcaccattcccactggctttgtctctgtgcggtgggctcttccctctacatgtgcttctaaacccacctgtacccctgctccccagatcaagatgaatgccatgatggagacctccgagctcccggccgtatttgacggggtgaagctggccgcggtggctgccgtgctgtacgtgatcgtccggtgtttgaacctgaagagccccacagctccgcccgacctctacttccaggactcggggctctcacgcttcctactcaagtcttgtcctctyctgaccaaagagtgagtagacgtcaaacccacctgtacacctgattgctgatctgtctgtcattacactgttcaaagaagaaccttttcaccatgggtcctcaaggcatctatgtaaaatagtgtcactgatgttaaaatagccaccatctctgtaggagtctggcacttgaatcctggcgggtaggggacggactcagatctttgttgcccaaagtcatcccttcttccacagtgtggtgtcatcaaccatgtcaaggactttgcagaaaactgttgttgtttttaggtagatgcagaa

SEQ ID NO: 2385 - DNA, 600 bp, Bovine  MMBT10243
gcatttcccgtcgaggaggaagtagccgtggaggcagctctcacacttatccccrtagctgttattctggcagttcacacacacagcctcatcttcgctgggaccctctgtcgcccagtgttcaatctggccaagggccgacaggacgatcacaaaccaacacggaccagacccctcctccttcagacccaggagctcaggaccccagcctctttcacctcatctggatccagcgagtacttctccggctccctcctggctatctcaagctccttcctggagacgcagacgtggctgttkccgcgacaaaaggcgtggcagggccggcaggtccctccccctacggctgagcccacgaacagygggaggcactgctcacagtggctgccctggaaaccagggacagagtggtcagagggagttaagggtcctggtggktgtgagagtcgggggaggttctgagagcacccagcttccctgtggctcagagagtaaagaacctgcctgcaatgcaggagactcgggtttaattcctggcctggagwagaaagtggctacccactccagtattccatggacagaggagcctggcaggcaaca

SEQ ID NO: 2386 - DNA, 600 bp, Bovine  MMBT14773
tttaattaatcacgtaacattttagaaacctattttgttataaggactcatataaatttttttgatctctgttaatggtctatgataggtaagtgtaaagatttatgccttaccaagaaaagtccaattgagcatattttgtttaaattaataaagaaccgtggagagaattggaggttgaaggcttaggtaatgaataagagaaacagatgcggatgaaatatgacttccttcgtgtgctgtatttcagggaatctttaattcacctgaatatggccgtgagttatgcttagagtattstattagaattcctagtagaaagggatttagatatacacgtaaagttaaatatggttagacagtaaaatattgattgcttaccacaaacaatgcagcagggtatctaacacttgttttccttgtgggacataataaggtaattaatttatctctagctgagttttatttgtggaaaaatttttttttggtggaatagatttaaatgtgctttgtgtgtgtctccggcagctctctatttgtgctgtaataaccacgtgcagcttggagcagccctttaataatcatcaccttggaaatggg

SEQ ID NO: 2387 - DNA, 600 bp, Bovine  MMBT16141
ttccttctccaggggatctttccaacccaggaatcgaacccaagtctcccacattgcaggcagacgctttaacctctgagccaccagggaagccctgcataggctttgaaaggggtgctaaagctctagagttcctgctgcagggagttaatcttccagaaaaggccagcaaaggctctgagaagcttcactcagcccagctttcctcagatctccctcaggcagctgtgactccttagttacctcttggcttctccccagtccagattagccctggttgcgttgtcatttcactgtcaktctgagcacatctatggggcagagtcacctctggaggctcaggagtctggggccccagcccrttgatagctgagttttagaaataccttgagatttggagggcaccagggaacagggtcaagggtrctaaggagctgctggwgtaaggagctgtgttcaggggcaaagctgattcacagggaaagctaatccttcagtctacagtgtttactgatcctactattgtttggtctttgagggcaggcatgctaggcctgagagaggcactgatagtaataacaacagctactttttatccag

SEQ ID NO: 2388 - DNA, 600 bp, Bovine  MMBT16443
ttaaatttttctccaccagctaaatttctgtacttttactatgagaatgtcattcaaatttctaaaataacccctgactttaaacatctctaatatatgtacttctttttaaagcaatactgtcataagatgcatttgtaaaattacttagatttagacaaaagtaactgaaaaacttaaaggggaagccttgaacactattaattttttccccacatgaaaagtacagatagcagcagaatacccactaagtgacaatattaactggtttcgaaggcacattgttagttacaacatctsaagtgggatttatttgacgaattctgtgaaattttcagaatatttgctgcaactcaagtagaaaagaggcaagtgttcacatactatgttagcttgtagtcaagaaagacatttcaactaaaatttgtcaaccccccaacatgaaatcacttagacattgctgatgtagtatttggatgaatttctgtatagaagattttttcagactgacagtgtactcagtgcttcaagggctaggtaaaattagttctcttttggtcaacagtgcctaacttccactagatgaatcttggtctccaa

SEQ ID NO: 2389 - DNA, 600 bp, Bovine  MMBT18605
ctcaagattagttgcacattagaatcactttggaaagtttttagaaaaaagtaccagttcctgggcttcacttgtgaagattttggtttaattgattttgagggtgtgtttggcagggctgggtgttggtgtttctggattttgtttctaattcttkaaatcagtcatttttggcaccagggactsattttgtggaagacartttttccacagactgagatggggtttagggatggtgtggatggtttykagatgattcaagtgcatacatttattttactaccactgatgtgacaggargcggagctcaggtggtaatgtgagcaataggcagtggctgtaaatacagatgaaacacctcctgctgtgcagcccagttcctaagaagccacggacttgtaccaatctgtgaccyggaagttgtgaacccttgcttccgatgattaaaatctctggctagtcattaaaatctaaccactggaatagatgccccttggaatcctgtataacttgaactacttagatatagtccttatgtttttaggtatcatagtggtttaaagaatttaaattgaggaatgtaggacttcagaagaggca

SEQ ID NO: 2390 - DNA, 598 bp, Bovine  MMBT18713
  misc_feature (1)..(54): n is any nucleotide
nnnnnnnnnnnnnnnnnnnnnnnnnnnnnnnnnnnnnnnnnnnnnnnnnnnnnncacccagacctcagataccaaaagacctgactaagcatttggcccagttttgttaacagtcactcatgaagtataggaatgccagaaaagctaaaaccgctactttgggaaatccttctgagttaggtctcaggagcaccctgaaaagaamatgagaccatgacacacaaaaaagaaccaacaaagcagcatgggccatgacaaaggagtcaggattaaagcatgactctgacattcttcaagcasctcttctccagtcttaaaaaggcaaggggatacaaataggaactggagactaaagagcagtattgggatgaatttatcaaataggaaggaatgatggcagacttttccaagaaggcctctcagaagaagagaggccaacttcgctcaatgatttcaggtaggctgctgctaatgagccccatcggggtaggtacctttgggcttcagaattgacgtactctaygccacctggaaagggttcgaggatgccccagttcctgcaccctaccaagctctaagacccacctttgaactccat

SEQ ID NO: 2391 - DNA, 600 bp, Bovine  MMBT19760
tgcctctttcaaggtctccaaatagtcacagaaagaaaattttcagctctaaatgtggcccttattataaaatgcatcatttatactacaaaaatcattttacatacatacaaaaaagattaactagttaaartggagacaaaatattggctaaggttttaaaatttcttataaaaataatttattaaaattggactacagaagacagaaaacatttcacaacttcrtattgctcattgttgccctgaagacatcatgaaacatacgcaggtccacagcatgggcttgggcacaatataragaaagctaaagaaacacaaccctttccaaccaaagactagagttgtaactagtggacttgtgaagctctatcacccagtgtccccaggagtcttccttttttagtggaacctgtaactaactttaaaacttgtcaaaatggaaagagtggccagcaagacgytgcttcaggtagtgtaacttcttcacattggtatttcattttattgactggttcattactggttcattgactggttcattaccggtgatttcagagagatcacttcttttaggttatggccagtaaataagtcttaa

SEQ ID NO: 2392 - DNA, 600 bp, Bovine  MMBT20592
ggattgttcataggcattacattcagaaagaaagtaatttcttataaastcatttattgcagatcytcattttcttcttgggtgtcagctaatgattagtaccaatttgatgtatgcaattatagtgaaaacaagagtataatcaaaaacttcatgagactgcgagtaaaaagcagatgaaagcaggtgatgaaaacttttcaatgaccaaattaaggtataaatactagatgaattctcttacaactgctggctatttctcttctggaacattgraaaaccctcattccattgctccasaccttttctaaagacagttgatctgaaagatggtttggaaattctgatttactttaggatactagtgtcaaaacagttggtaagtttagtagcataactagaagtaaagttggacaatataatcagtacaaacaaacattttatttgaactaacttctgttaagtatggcagcttgacacaattttaaaaactattccacaaaaacactaagtacaattatttgtcttctctgaaagctactttgagctgggtacttaagatgtgattcagtgagaaagggaaaaaaagttgttacaggg

SEQ ID NO: 2393 - DNA, 600 bp, Bovine  MMBT21050
catgctgctgggaactgtcccccggagggcaaccctgaaccccagcggggctgctccctcgttctcttctcggccctatgtgaaccggcaaggcggaaaatcaaactttatccctttctgtgacttcctgcttgtgggcatggggcacagcacccttgcgatggatgctgcattgcttcaggaggcaagctccatcctctcaggtccttaaaggtcctcggtggcycttttggagggctggtttataagcttgtgcttgcctgaagaaggaagggtgggcagcaggcagaggggaagcgmatatgacaagttgttcccagcggcagggttttggtggttgtattaacccgttattgctggctttcattggctggcaacgcacaggagtttctatttgaacagctttggggtgtgtgtatatttctttttaagttgcaagagatcaagttgacttggaattcttsatytaacaagtcagcaggttatctttctttggactttctagatccatatttttgatctgatctggccaactccaaaagaaagagtgtaggttttatttcctagggcagagttgtatagtgtggtaatgagaaatca

SEQ ID NO: 2394 - DNA, 600 bp, Bovine  MMBT21070
cggggtgataggactagtctcttcaactttacagagggatcttgggtatcccttggccagggtcaaggggtaagggtcctggtgtgaagaccagagccccagtctcctcacagtcagcaccttgttttgtccaatgctcagacccacccttccctctccagcaccaccctagtcctcagagtgagcgctgtagggacccgtgtccctctaagggtcaacttcaccctgacatgttcataaataactkgccttgattctgtgctcaggaccccataccctaaagcctgyagtggagctttrgcagtaagggggcaaaagaggcctcatgtatgttggctgcattctttatgactgcatacrgccattgtctcattgtaatgcacacagcagtcttatgattatttccgtccaacagccgaggctgaacaagcagttcaagatcgggtaagtagtaagtgcttggtataaaaacttggaattcgtgtgaccagttctttccaaagtgcagttctctgagcagcctgtgaagatggtcagaacttgtgctgggctgcactgtctgttatcaccatgactgtccttctggagcccgttcccgga

SEQ ID NO: 2395 - DNA, 600 bp, Bovine  MMBT21796
atccttcaagtaaaagaaaaaaaaattactgtgactttaacgtgagctccatgattttgttttcccagtttctgaattcctcttgggcattctcatcagtgtgcacagcttgtcctcatcactcatacctggcatttggtcttccaaggaccctttgctaccctccccagcccctaaactctcttgccttcagttctctgccaggcttgccctcccacccaagtggcctctgagtgtgcctgtgygtgaccagaggctgacactggactttcccagctgccggaactctgtgttcaaccraagggcctagattgtgtttgatgaccaatcacactaggaaaygggcccccgtcaccagcgtcccccagcttctggggagagtggaagtgctcccgagaggccagttgggattcacatggccatcatgtggcagagtggccctgttcctctacctgttcatgctgtgagtttgccagtttgattctttatgagttgctaagtgtcttcaatcttttctcaaattatccaaagactaatagctaccagcaagactgcataaatgcatttctttaaaatggcataaaatgagttatcctacag

SEQ ID NO: 2396 - DNA, 600 bp, Bovine  MMBT22169
aaacatacctggatctgatttgagcaaaccaacagctaaaaaggaaaaccagggagatttgagtatttactggctagctgatactaagaagtttagaggttttgtttatttgtatcaaggtagtatttttaagtccatatcttttagagaaacaaactgaaacatgtccagttaaaatgtgatatcttgataaaaaagtggtttttttaaatgttttacagttaaataatgtgattattttccatctgaaataaaaactaacactcttgcagccttacccctcgtgaattcaactcttayggagcccgaagaggtaacgatgctgtaatgacaagaggcacttttgcaaatatcaagctttttaataagtttattggaaaaccagctcccaaaacaattcattttccatcaggacagacggtaaggatayatacagagtgtttaagcagttgctaactagattaaaatttgtattaaaatttttatgtttgttttaatctacagctggatgtatttgaggctgcagagctgtaccagaaggaaggtatcccactgattattttagcagggaagaaatatggttcaggaaattcaagagat

SEQ ID NO: 2397 - DNA, 600 bp, Bovine  MMBT22174
gatcacgataaccagagccatttgggaaggtgaggtctggaccatctccctaagaccacactggagtctctcagcttgaattctgcaagccagggcagcatttcagaatctcatttttaagtgcaygttagtgtctgctgtaatgaaacacatgccgtagactgatgaaatttaatgttcaagctaaataataaaatcttttatttatgggcaagttttacrtctccctgaggggagataagctagtgtacaagtctttcccactttccctgggtctgatgtgaagccagcttgttcccycttgacatcacaggggaaatatgagtcggagggaggtggaaggtcgggggagaggaggctctatatttacaagcctgtggtatgatgcagccagatgcagattctactgggtttgtgggtgtgaggacattgagggaagtagttaaataggacttacctttctgacctcagccaagtctccagaaggactcatggggagggtcgcactggagaaattttaactctaaagagaccacagatgatcagacaatgctagaaagggctcccagccctcacagaccccatccttcactgataagc

SEQ ID NO: 2398 - DNA, 600 bp, Bovine  MMBT23027
caccaccaacacacacacatcaccctgctgctgaaattactcatgtccttaggatcaagttcaagtgtcttgtcaggtcctccagggtcctgtgtggcctgaccctacctctcctccattgtgattcctggtcagccaatgtcacctcctcagggaagcctgccgtaaccactgccacgaacccattaggctagttctcaggactatcttgcctttttaaaaaaaaaaaaaaactctttatttttatttatggaggtaggtacgcccatttcactgctgaagacactgagggccaamtgrcactgagctaggttagcctcacggggctacttggaaagtaagcggtgtttgcagactccttattatcatcattgttattgttattattattggctgttacatgcagcatgtgggatcttagttcctccaccaaggatcgaaccyatgccccctgtactgaaagtagagtcttaacccactggaccaccagggacgtccccttactttttttgaaaaatttacttttcaaactgagatacgattgacatacaaaaaaacctgtacatttttaatcgtacatcctgataagtttgaagcata

SEQ ID NO: 2399 - DNA, 600 bp, Bovine  MMBT01592
tacttctttaataattgcagcactcaaatggcaacaggatggattaaggtgacctagctcagaaacaactttcatctgggtcatagtaaaaagttgtaaaattcccttaacagaaaattagaagtatatctttatagattgtttgtggaaaaaaattcctaacttgattttctaattcaatagaatttagtaagagttgaccacttagtacacattttaatttcccagtatctctgtatagggattacttctgtttcatctctggatatactaattacctttytccatcctgttttgtgyccagaggcatgtrtggttagtaggaggaggcttcattgctccctagtgtctagctggtttgggtcaaagggaggcagttggagrgttgagggtatraggaagtgatgtgtgtttattccagttctctacctgccagattattgtagccctctcatgaagactgcagcttctccagttccttctacatgttcctttgccctaaggataattaatgccccctccttgctagtctggggcaaggaaggaattaaggaggtggcttctgatctatttctgtctctcaagattttcctggataaa

SEQ ID NO: 2400 - DNA, 600 bp, Bovine  MMBT01597
caagttctccaggcccggggagacagaggcagcacagaattagaaaagtcagatgaaatgggattggggtcgaaattcaattcagccagagaagtcccagggaacaaggtcgggctaggagcctgagtgaaccaccagagctattggtctactaccacacaggggtgtctgagttcatgggggtaaccaaggccagagaggttcacaggcccacagaccattctattctaggatgaggcaggggtccagggaaaggcttataccaccactttcctgttgagagtctatcctttatcttcyttaacccaagaagtctactatttccttccatagaatatttcagcagtatgacctgaagataagtggatatctagaatttcaaaactgtttgaccttggggaagttcttaacctcttagtgcttctctgcctacatctgggaaaaggagctcataacgggatctagttcatagagttcttccaagaattaatcragttaacacacatttggaataatgcttaccacataataggcatartatatgtgtgctgccattattatatgttgttcctaattctcctttcattcatatggattttt

SEQ ID NO: 2401 - DNA, 600 bp, Bovine  MMBT01616
cccttcaattacaaacgaagacctcagggygtaggagatgacaggcctgcttaggactggtcagttaattaatggactggcccgggtagaaattcaagtttgctcaaccccagatggtgaccactaggtcagaattatgccacctgtgcataagtctggtaaccattagttatatcattctccataggatttgttttaacaaatgatttattttctgctaaaggaagggtatagtttcatttcctggataacagaaaaactttgaaaaatagtgcataattttcataagaatttgcattycttctcatttattcttgccttctttacttctttgacactccaccaaaagaggggaggaaagtccacaaagggagaataagtgaaagaaatgtatctgtttccttattaatatttgtaggaatattcatgggaagcattttttttggaataagtagggatagttttcccctcaatwtacatgcgtgagtaaatattaaaggtcttctttgacattaattaaaaggtaaagacacagaagagaattctgaataaatatgatatttacacagcttctgagaaattatcattgactctttaagc

SEQ ID NO: 2402 - DNA, 601 bp, Bovine  MMBT01649
  misc_feature (1)..(1): n is any nucleotide
nttggcaaacatcctgttcaatagtccttgggggttctgagtacattcacaaaatgaaatcccaattattgctgccaacaaatgagtacrtaagtttttcaaactaggtgggtgaaactgcttgaaaaacacaacttaaaaaaaaaaaatgtactcattaacaataggcaaatcgagttaaatcaaccactaaacaggttttaagtgagatttctcccccaaacttggaaataaaggaaatcagccctcagaatttacttttgcgattaatggatcacagagaacagggtaagtcactttkgagagaccagaattactcctagccacacaaccttccaatgtatcttgcttatttagcaagctaccttatgaaacttcaaccagaacacatactggtaaatgaacagaagaggagtcatagaagcaaaaggtggctgtgcccaaattaacattgcaaaataaaaaatggatgcatagtatcagacctaaaatgcttggaatacagatgtttcagaggcaaacttctcttaccaagacaaacttctgactatttggcttacatttgttggtttacaggaaaaaaaatgtcaggttatcaata

SEQ ID NO: 2403 - DNA, 598 bp, Bovine  MMBT01650
  misc_feature (1)..(49): n is any nucleotide
nnnnnnnnnnnnnnnnnnnnnnnnnnnnnnnnnnnnnnnnnnnnnnnnntcagtgttaccttactgtgaaatgtgtgagaatccacggggcggcgctggtgagtacatggagggcgaccttgaggcgggtagcagtggtgtcttcagataacctgtgtgtttagagacaactgctgtcatcagagatccatgactgggttccaacttcagtgtttaagctggaggaagagcttccacagtgaagactgtgaatttatccccttgtggaatgtgaaaagctcccagttctgtcaagaatayatatcccctggcgtctgtgacatggcattaatttggcacaaatggacatttctgattaatgccagcaggacgtgkattcagtgggcaggaatagaagctctgttgctatggcagcaaatatgccttatagccatagacctgctgttttctttcctctgtagaatatacttgtttttaaagaaattgtagattattttgtttaaatagcagaatgaatccagtgtagcttcttcgcctactgaaatatttattgtgccatgtttctcccatgaaaaatcataaaaattcctctcttgat

SEQ ID NO: 2404 - DNA, 600 bp, Bovine  MMBT01712
aataaggaagaaaaagaatgtaatccaccttaggaaaaaaaaatgatggtgttaagtctggtatttaagagtttattaatgtagtcaacttcctactgaacaattccattcagttgcctgacacatgtctcaacctcaacacatacaaaatagactcagtagctacctcaactcctcctacatctcacctatcaagaaactggatcaaataatgtcctgcaagaaacttgaaacgtgtccttgacatttccatctcctccacccaccagagtctgtcaagcacccaggtctcttaatccygtatctcaaatacctctttatttcacccacttctgtcacatctcactggcactactatgctctaagcaggccttacttcccacacagaactcatgaaaggccaccaccaccacctaccccacctccctgtagagttgtctattccccgatctagtccacacatgaactttccacaacacagagctaatcatgtctgctgtattctaaactcattcagtggcttcccctttttttcaaatccattcaatggttcttattcactcactttagttgtctatattacagacacatcaaacccac

SEQ ID NO: 2405 - DNA, 600 bp, Bovine  MMBT02036
gggcttggggcaagtcagacccagatgaagcggagctcggagggggtcttcacatggacaccaaattaaaaacctcccggtttgcaatcctgattatgctgaggttatccagttgctgcctctttgggtggcacggccaggggaagagatggtctgagattgtctgcaggctcgacctgtgccccgggaggagaaaatattcacagtgtaccagggaatctggaggaaggagggagcagcccctactttagttttttctcactctctctctccctttctttcctcctttccttctgagtkttttgttgaagtataggtgatttacggcattgtgttagtttcacatgtaccgcaaagcgattcagttacacatgtgcacacctgttttcagattcttgtccatgatagtttattacaagatgttgaatctagctccctgtgctgtgcagtaggtccttgtttatttcacaggcagcagccagtgtctgttagtcccagactcctagcttatccctctccctaccccactgctttcccctttggtaaccagaagttcatgttctgcctctgtgagcctgttttccttttgtaaatagtttg

SEQ ID NO: 2406 - DNA, 600 bp, Bovine  MMBT02246
gtgtgtatatggtaaccgtatttataaagatgtctaagacgtaagactaaaaattcctgcagatagtgtggtcagattttaagaatcttgatatcttaagatcaataatgtaaaaaggttaaagtgtgtcctattttcctttccaagtccccctatatcctgttaaggaaaaataaaacattaagttcttaattgacatgttacagagaatttatcacagatctgaaaccatggcatatctcagacataatgtggatttggcaccacagctctgcattcaagtgagtcacatggattttrtgtaatggtttcccactacatataaaggtcagtttatastaggccttaatctattaactgtacaatagcattatgtctaaaaaaataatgtatataccttaatgaaaaagtgctttattrctaaaaaaatgctagccatcatccaagcctttgtcaagtcataatcttgttgcaatagtgacatccaagatcacagattacagagcaccataacaaatatgctaattatgaaaaagwttgcagtattccaaaaattaccaaaatgtgacacagagacatgaagtgagcaagtgctattgg

SEQ ID NO: 2407 - DNA, 600 bp, Bovine  MMBT03241
gtgactgtaacactgttctgttcaagcaaagatttagaaaacaggtttcctggacagaactgggcctgacatctccacgactgagctgacaagccaaaaaataaacctggtgtacgaaggtacccagtggttctgaaaatagctcactgtctttacaaactgctaatgatcaagtcctgggcctagacaagcaccaagcaaggaaaggacaaacatgtgctcagcactaggctaagtgctctgaaggatactagcatacagaagatacaattctaagtctcagagacttaaaatcaagcrtgaaaaacaaggcagaaatcaaaacaaagcatggctgaaggactggcatggtaagagccaatggaatggtataaccttgctctggaggccaaagcagagaggagaccctacaaaaggctactcagggaaggccagcttcacagctggaaggcaagcagcaggtggacccatttggaaatgcagagcaagggcaaaagaggtcctaaactaatctmggtgacacctggccttgcaggacagctaggggttccctttcccaaggcatgaagagcctctagtagaggaagcatgtggaggaga

SEQ ID NO: 2408 - DNA, 600 bp, Bovine  MMBT04106
ttgaacaggatacctaaattctctgagcttaaatttccgtatgtatgaaatcatgaaaattctacctagttagcacaattaaatgtaagaaaatatatgaaacctggcacaatgtctggtactttgtataaacccaaagttcatgtcttctctccttccaattaatcatggcaaagcaatcctttttaaaatcataagtgtttttcacattaaaacttctgtagtttagcagtcaagtcttaattttgacagatgcagttatttgtatgtgtgtgtgtatttctgatttaatggcaaaaygtgttgcacttttctagaggaccagggcaggtaaatgatcaataaaatcatatgaatatgtacatatgatgtacattctgtaaatatgtacattctgtaaataaaggaagagtttgaaaaaggttgacatcactgaatttgtgttgaggtacagactttccttcagtcttcatttcgtcaacaaatactaattgcatacctagtgtgtaataagtcaaagatccaatratgaagaatccaaacatggtccttgtttgaatggaatttattgtactagagaggtgttaagcaaattgtcat

SEQ ID NO: 2409 - DNA, 598 bp, Bovine  MMBT05316
  misc_feature (1)..(157): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacccaatcttgttttaaagtcagtcctggacatactgttcctaagaaggaacatatattcctgaagacattcaaaaggggggactcttcgctctgaaaccctaacaatatcactttaatcatcgcttctgtccctgcacstcacaaggccatacctctaattaattccatacctctaattctgcttctcttccccagggcccagtcatatatgcgcagctagaccactctggcggacaycacagcgacaggattaacaagtcagagtctgtggtgtacgcagacattcggaaaaattgagaagaccgccatcatatcctaagcaataaacaaatccaaactggactcttgtgcagaaaatgtagcccataagtatgtgtggccttggaaaccagaacgtggagaagcacatgtttagtcatagagggagaaaaagatg

SEQ ID NO: 2410 - DNA, 600 bp, Bovine  MMBT05530
tctgcccttcctttgatttgcccttctttgaacaccaagaagccttttcatttcttttctcagaatcttgatattgggctagaattagttcgtaaaggatacgcagttgagcttgcagaagacatggaaaaaaacagagctgtcccagtaatgttggacgacctcgtaagtgagccattatcatcatttggggtgctgctttgggacaaaccttgtgcctcaagacaggagggcttctagtcatgcatgcaatttgtagaacacccttaaggactctgagttgctccactagttgatcartggaagcactgtgtcccttagcagccacaccagactctgtgagcaaaatgatggggtcgcttctcttttcccaccagccaaacacgttcttcctttttctcctgtttattccctcaggccacagaaacagatgtctcactgagcatgctcactgagaccaagaagagccctggagagatagcaaacaccctgtcctgcctcagtttatcaggtacaaacagcatttgctccctcgagcatctctggaagttaccaattcttagtcagcctctccaaactagggaagttgtgtcaagattt

SEQ ID NO: 2411 - DNA, 600 bp, Bovine  MMBT07970
tcttttaaatgtttaccacatctaattaaagtacagagctaacttgtggcataactttttgcaagggatgattctgttcatatacaggggatgtttctgatttagtccaaacttaaaattttaataagcaactactcaccaacccctcaaatatgcatatatcyttccttctttcctataccactcatttccatctgagtctacaaaaaggatggtactagattttaaagaaggtgaaatgaatcagaaagtctttcattttacctaggaagttgagcatatgtttaaaaatccttaagrtttgcttctactcatagtttccctttcaatgggcagaagacagagtcttactactaattctttttattagattcctacctcccaaacattttacaattcagatagttctagtgaaaatattctgttatgatcatttaaaatgacgtgcttcatcactgcttttcaaatttccctatcctatttagaatattttcctgtcctagttagaatatccactatatctgagatctgtcaaggtaaatacgatttacaaaaaatcaagcagatttctcaagaattatttttttctcaagaattttc

SEQ ID NO: 2412 - DNA, 600 bp, Bovine  MMBT09317
tctcatcttttaattagcaagccctttcaagatatttatgaaaaatctggtgatggtggccatctagatttgttcctgattgtcttaatatttttctttatatgaaaaaagcaacatttgtggcttgagatgtatattattttcgattatcccaaaatggcatggccattctccccatcagccaggctgaagccacagtacatcttggacttatctttctttcccacccgcatacagctccagttgctaggtcctatggctcttccttcgtaatgcagtctggtccatctttgcattccygatgccacttcccatagcttgatcccttcagtctatcctgactttatcccatactggcaggatgctctcagattgaccctttaaaaggtcagctcttctcacctcccatctccaatgaaaagtcagtagtgctccctcttcccacctcctaactgccctctgcattaagtgctgctggtgactggcatttaaagccctctgtaatatgtccctggggcttcagtggtggctcagtggtaaagaacctgtctgccaatgtaggagacgagggttccatccctgggttgggaagatcccttg

SEQ ID NO: 2413 - DNA, 604 bp, Bovine  MMBT10931
  misc_feature (1)..(4): n is any nucleotide
nnnntctttagtcttccctaaatattgtggtatttttgtcttgtctctttaactgagttgtaacctgggrctgtattttatccctttggacttacrttacttcacactatgctgcccaactattggttcattcattcacttaacaaatgttttctcagaaacctctatgtgctaggcactgtgtgagagactgcaaaggcaaaactaaatgtttgtcaaaaaatattctccaagtcagttgtaatagattcctgccctgtagcacagccccagctgccgggatgctccagtcacagaaaggtaygaaccaacagcttccttcctggtccctgtgctctagctttggcctgaaaatctgtgtagaattggctttgctgctgctcactagggtaccttcaggcctggaccttgggggtattgtgactcccaaatatggtccctttttactaagctcttatcaaggtttgtatcttcaataggtacctttttaagctctgctgctgctgctaagtcrcttcagtcgtgtccgactctgtgcgaccccatagacagcagctgttaatatacatttttttgacatattgcaatttgcagttttgtagtt

SEQ ID NO: 2414 - DNA, 600 bp, Bovine  MMBT11572
tttagttctccggcacttttccaggactgtatgatttttcttttaagcagtctatgaagggcaccctgcctgaacacastctgcctgtctctatttccaccccttcatccaccttttcttttaactgaaacttctggggaatttgaatagaacytcccttatgccttgcaactacacacacacatacacacacctggagtcagcagcccactcagccttgaccgggatgcttctctcagtcttagagaaatctgtacccccatgacactgggaagtctccacattcctcattctgcttgsagaagaacactcttgggtgggcacagttctcagggccctgtgggcagtaggggcagaaccaatatcaagttcatctgtctctggtaacgggagtctgaagtggggcatcttcttttctcttgtcctgtccattcaggttggagaactgggctctgtggtttccatagcgatcatatacccgagatattcctaataaccacagtctagtttgaccacaacattggctgtctgtctctagtgtgtttgtgagctgtgtgtgttgggaacaatgggaagacaatcaaggtgaatcactctgga

SEQ ID NO: 2415 - DNA, 600 bp, Bovine  MMBT11763
ggctggaatgtggttcccacagctccattcacagcaccaggtttgccattgctggtggatatttggttgggatttggtttgctgctttcaatgaaatataaagtgaagtgataaaaatgacttgtgtaacaaggtagaaggctctacatttcattactgatttatcttaaccacacataaacatgtgaatgtttgatgaagaagaaatttaaatgaacccaaaccatttatctttacaaaccgaggctatgtaaaaaccaatctcataagcatgacactcacaaaataagtagtcatrtmtcttcctcatccagacataayttccttaggatactgtttgamattttggaaaatgcaagttattaaatattacttatcatgacmaaataatttctggattaaataaattaggcagtgtgcagtgtttagggaaaaccactgcccattcctgccactagagtgacagctgctgaccctacgcattggctctcgagggaactgcacaaaagctgcatgtcaacagtgacactgtggataccagctgggcttactgggagaggtaaacgcatttcaggagactgtgaccactcatcatttcta

SEQ ID NO: 2416 - DNA, 502 bp, Bovine  MMBT12026
caagttctttggtcagattatttagataggaattggaaagcagtttatctgaactatgagctaagctgtktaaaaagcatgttaatatgttgtagaatatatttttgcaaatctgcaaccttatgagcttagatagaaattgttgagaagaatatgaattaacccatacaatctagatctttccaaaccagaagtttgaaaacttctgcccagagccaaactctgtgacttaaacgagccacttgagcaatgttgattgttgattgaatgagtcagtcaatcttctttctgtgaatgagyacactgaggcacaaatggttcaaggaatgaattttttaagaaataattattgcacattcattaaaggtcaggcaccggatatgacaagaataattccaacatgaacaaagcattagatgttgggctcgtaagacgctggggagagaccacctttgaacatctataagcgatagatatgctacaaatacagaaacgggtactg

SEQ ID NO: 2417 - DNA, 600 bp, Bovine  MMBT12311
attatggcttttggcttatgagtcacaatagaaaggtctttctcatttcaaggttttaaaagaattctcccatgttttcttgcagaacttatagttgatccatttggaatttatcctgatatgagatataaatccaacttttctagatgaaattccagatgtcccaacacctagactatttgttgaatagtccctctcttcattggtgtgagatgcgcctttygttgtctaataaatttccatatagacttggatatatttctggattttctattctgtttcagtcattgctgtgactgyttatgtgccagaacttgatttttgtgtataggtgtgtatattttatcattccattttcccctctattagtttggaattctgtttttagtgttcactttgtatgttayaagacagtttttatttacttttttatggctgtgcagggtcttggtggcttcccgggctttttcctagttgtgccgagctggaacgactctttagttgtggagtgtgctttctggggcacgtgggctcagtagttgcgagcacaggctcagtagttgtggcgcaggcgcttagttgctctgtggcattgtggga

SEQ ID NO: 2418 - DNA, 598 bp, Bovine  MMBT13350
  misc_feature (1)..(21): n is any nucleotide
nnnnnnnnnnnnnnnnnnnnnctcttaagtttctggtctggtagggaattataaaaaaaaaaaaaaaaaggtgggggtaggtttcccttaaacacccaggaatagactgcttcccggatagaccatttctgaacctgagaatggttctcagagagagctgacaragctgtctctgagagagagacctgagagagctaacaaactctctttgttagcttrtagattaaagaaaataaatacatacgtagagttaatactaagttataggagagtttcttcaaatagctaaaatttaggagsctccaccaaagtaacrgtaaatatgactaaattatatcatgcctaaagcttgatgtgtatgtctgatttgacatatttcagaggtgctatttactctgtaaactgttctacatttcaaaaactaagattcttggggttcataagataaaagttaaaattaatatttcagaaattaattttctgagcatttgggtggrtgctgacaatagttgctaacttcttcatttctgatcactagttctaatcattagttgtttttcttgggtatttagaactgattttttttttttctctacct

SEQ ID NO: 2419 - DNA, 600 bp, Bovine  MMBT14297
attttcaggccatgagccactaagacaatgcccctataagtggctgcttcaccgtgagcctcagatccatgcagatggcgaccrtgtggttatattaaacttcgatctgcctgcatttggcacaggcctggctcagtaggcacttactcattcaacaatcatttcctgggcctttcccgggtgctgggtgctctcccagacactggtgacctaatggggacagcacatatgcagctgcctatcctcatggagttcagaggccagtgggggggactgataacaatcaggttaacagtaaaygaatgaatgaaaaattataggtggtgataacaattgggaagataataaacagactgatacaaaagagaaatggggcaagggttagaatctactaccagttagaggacattaccatccttggggatgacaagggagccaccacggaagatgaggggtgtgaactgggaggagggtgcagcatgtgcaaaggccccggggtgtgaaaggccctggcagctttgaggagcagaatggagagtggagagggtgctgggaggcacaggctcttgcagagcccagggaggagcccaggctgtccgc

SEQ ID NO: 2420 - DNA, 600 bp, Bovine  MMBT14896
taagctcctggaagtttcaaaataagagttttaactcaccaagaaccctggaaaaagagggaaaggraagaatttgacaaagaaaaaacatactgaccggcaggtggacagacagacaaaagcagtgcttacattaaaggcacaayggtctttgaccaggaggttttaccaagagtctccactacctggtacatgaaggataagctaaaggctaactttgcactatgcttccccccagtggtcaagttttggaaatgcatttttctagtcaggaaagaaaagctggggaccatctgggcracatacacaaagaataccattagcttcttaatgtatggaacccgatgctcacttttaagcggaataataaaaagggaggtttgcatttaaattgttgccaatttgcaaatataaaatgtatatatttgaaacacattctaaagaaaacatattaagggttataagagacagatcatatactatctaggaggcacacccctagcattgtgaacagaaaggtaaaaaaacaggggctttctctgccagatttctcaagcttgggaaatgtcctagatcagcagtttaaatataaagcagggc

SEQ ID NO: 2421 - DNA, 600 bp, Bovine  MMBT15868
ggacacaactcagtgactaacactgtctctttcatattattttagcaacaaaatcttatggcagagaggatgttttccaacatccattttcaaaacactctccatggcctgtttcatttacttaatagatactttgttccttatttttaaaatgtcaccttacccttgaagcgagagattatacttattattattcttaacattgtgattagtattattatttaatcatctgataagtgataatataccaacagacattgcagtagcagcaaaactgttcagcaaacttaaaacacttcwctttttagaaaacaaaaataaataaccttaaagttagcagcttttggaagttctttgtgacattttraaaataatttttattgtcactgtctcttataaaggtaaatattcttttgtattctaaagatcttttctcttgcaaaattaagcacatgaggacaaactgkagacatttttgcatatctacagcttcaactatttttttgctatagatgwaatggtctagcctatgaatttcatatccagagctttctttgtaaccttccttggaattaaaaagaaaactaaatccaagtcaac

SEQ ID NO: 2422 - DNA, 600 bp, Bovine  MMBT15901
cctgagctggtggagaccccgcagctgtgctctcagcctctgcacaccatctccgggttctggcactggtgagtcaggaggtgtttcacggagccccgtgtggggtgccttcctttttcagaggcaagaatgagcacccagacagacaagacgacctgtctcccttagtgcatagcaggctcggggcaaaagtgggctgagagcctgggtctccactcctctccgctctgagaaaagctactatacagagctcctcctcctgcctgtggggcaaggagttaggagaatctccatcccagmtgrgcaaactgtacccaacacgacagggaaaaccgcctgtgactggggcaggggggtggagtggcccaagggcagcctggctgtgcgcctgggaagcccaggtgagactgggccaggctggatggaaccgtgctgccaggcaggcgcctgctcctcccagggccctgactggctcctttggagcacagcacacccggcgctgcgggacctctctcctctgctgaaacagcagatggacagaggagagacttctggggtggagggagtcaggaaggccagtccccagattgtgtggtgctg

SEQ ID NO: 2423 - DNA, 514 bp, Bovine  MMBT15938
atgactttgaacgggactattaggacagggtgtacagttacccagcacatgttcctcatcctcctcctattgtctgggctgtagtgccctcaaaatgccagcgtgtatcaggaaacacctcatgaaggggcaaaagtggcttcaattctaagaacagacagcggggagcttcttctaagtctgaaaagttgaaaggagatgaccttcagactattaagaaggaattaaccsagataaaacaaaaagtggattctttactggaaagcctggaaaaaaattgaaaaggaacatagcaaacayggaatagagatgaagaatgataaatcagaagaggagcagagcagaaactcccttaagaaagatgagactaacgtgaagatgtagtctgagggggaggcagaggggtcagattctgctgaggaggggaacctactggatgatgatgataatgaagactggggggatgaccagctggagttgatcaaggacgatgaaaaagaggctgaggaaggag

SEQ ID NO: 2424 - DNA, 600 bp, Bovine  MMBT16303
gccttgagggccagagtgaacagggagatggaccaaagagatacaggccaggcaaccaccttgggaactggagagaaagttgcttagctccacggcagctgcgcagcctgaattcaccaccatgcggcagcttccggggcttctttaccgttttctctctcaactccaccgctttaaaccctttcccctggtttatcactggaagagcctgaggcttgaaagacagagccctggaggcctcatcactctggtggaaagttactgcagttacagccctgctttcagggtcaacaaaacccrcctcagagagtccttccagtcattattgtggaaaattaaaatgaagccagygctttacctggaaatcctgattctccttttgttcctttctgtccttgaagtcctaagatcaaaatacagaaaagggaagaagataataaaacttagatattaaacacttttaatcttagacaacctctaccttctgtctgattaatgcagatggaaaggtacattggttctcctcgattgtttaaagccactttagcagagcataaaagtagacagattgcagataaatgggtatgtgtattggggtga

SEQ ID NO: 2425 - DNA, 600 bp, Bovine  MMBT16353
cagggaaagtcaatccatttgtgtgaagataggaagtatctctgtgccattttatcagggttccagtttcaccagaatgagagtgtggaggagggtatcactatttgctccccccgagaacctagatgctaaaaaaaaaaaaaaaaaaaactggtacgaaacaaaactctgctggctggactaaatggatgttggcatcaccttttcarttggtttactttattgtggtattttgagctgagaaagttgtgttttcagagtttttcccttttacccactgcctatarcagcatttgtttygccctcttccgcccttgccctttggattgattataaagttgggaaagaaatgtaaaaatcagaacccatactctcgcttgaaactcatatttgaaaccatggtgaagcaggtttaattacagagaaagattggctgcttaattgctgttacctgccacgaagctgttgcctttctgtagctgtttccataaatagactttatatacaggaatctaccctggggcaaagagttcccattcggcctctttacttaattcaaattgctaggttgaggtggttatttttgaaactcttctcagg

SEQ ID NO: 2426 - DNA, 600 bp, Bovine  MMBT17288
cacgagctgaaccctagggggcactgacgaggccgccgttaactgggtgttcgtgacagacacgctcaacttctccttctggtcggagagtgacgagtataaatgtcaggtggggttcggggggaagacgtacagtgggtactggtccctgtgcgccgcggtcaacagagctctggacgaaggttggtacctctactcccggtcagacccagtggcgttgagatttcattttactgggagggtcccacagagtgggctgggacatggaataatgtattgataagatgaatttattgccgrtacctctgcttaaaagtacgagaagaagctggcataaaatctttcttcagtgtgaagtgattctgattttaatacttagcactgtcgcagctaagactgaaagtcggttttcttaggaacgccactctgatgatatctgaggagcaaagggacaaatattatcccacactctacacagtcaaaatacatttggtgtaatattacaattgttagaagtgattgaggaagtacagacgagcaaatacagaatgagggatctgttcctgatttttaattattcatctacttttaattcattcc

SEQ ID NO: 2427 - DNA, 600 bp, Bovine  MMBT17421
atactacaaaccaaaagctgagaaagcacctgataaaccccacaccaygcagcaaaattagggagtgtggggaatctgcatctctcagttggatttaatgatctattgttaggccaagaaacctgtttccctgatcagcatgtgaaacaatagaggataaaatggtgtgtaagcagaaagtctccccttgtaagctgcaaattacctaaaggttttatttctaattatggtcatataattgcagacactttaaggagaagagcctgtttgttctccctggtgtgagcaactctgatccargctctcctgaagccagcagccaagtggcagtggcacaggtccaggagtcctggagaaggacagayggacagctatcctaaaaaagagctcctgatgtcacccagcaatgagacgtgagagcctgataacgctcccatcctcactcaggtgttacgtgtataaagtgaaagggctyacaacattaagtagatattttttcactgggtagtggtcagcaccatgcttgatctcccattctctcattttctgaccaggccttcccaaggccttccttcttagcataaattggcttcccctaag

SEQ ID NO: 2428 - DNA, 600 bp, Bovine  MMBT17430
cttaatggacttctgtagttcacctattcaactctgggaagacttgttagctttacagaagaataaacctttcctgagttgtggtttatctgtcattcttaatcacttactttcggctgaccattgcttctggttagaattaagttgtcacttcatcatttgatatttgtattatccatatttttgagtttattttcctggactcaaaattagacacataagaattaaacttctctgcttgaggaaactctgaccttggtataaggaactgttttctttccagcatttggagaccacgcrtttagagccattggtcaggtctttgtcagtgccctttacagatcaaatcaaatgtaattttaaatcamattagataattaattaggcagatgagattgcaatttttccttagtgttctgttgagagcacaygagtggatggctgccaatttgtctcacagcctgtctattaaccgtatattaccccagttttcaaatcaactttcaattcagttattcaattttgggactgataatgattctcaaagatagccagtgcctcattttaggatgaagatgctgagatctgatattactcaaa

SEQ ID NO: 2429 - DNA, 600 bp, Bovine  MMBT18250
tgagacccgcctgctgccagtggctggtgtgtctcaagtctcagtttataactctgcgctgtttattttctggagaactttggttacttgtcctgtagaaactcctacattctgaatttgctgattgcagctccctggagttgtttaacacgtgcctctgtgccccgtattttctgaaaatggtcatttgttttacagacttgattagagtctgtgttttagggcgaggacactttgttattggtgctgtgtgcttcctgttgcatcacatcaggcgactgtcattaagatccatcagtraacctgactgaaggttgtctttccacatctgtacatatagtccttaatttaaaaaaawtttttttttttttaaagaaacacacgtgtcagggtgcttgagttggaatgacaaagaaaggccataatggggccctcacagacaggctccatgctgtgaagaagagagcagacttgtggagaggtggaagccctggaccacggggaagacctggagcagaggccagaacagtgctgtgctgctggcagccagctgctcttctgggacattatgtaaaatgatgtaactgagtgaaaaagtgg

SEQ ID NO: 2430 - DNA, 598 bp, Bovine  MMBT18601
  misc_feature (1)..(8): n is any nucleotide
nnnnnnnnatagctccttactgccctcttctggctgtggcttttgtttgtcattgagcgtgttttagtttttaatccttagaattttagcaatattttggatagattagtggttctcaagattagttgcacattagaatcactttggaaagtttttagaaaaaagtaccagttcctgggcttcacttgtgaagattttggtttaattgattttgagggtgtgtttggcagggctgggtgttggtgtttctggattttgtttctaattcttkaaatcagtcatttttggcaccagggactsattttgtggaagacartttttccacagactgagatggggtttagggatggtgtggatggtttykagatgattcaagtgcatacatttattttactaccactgatgtgacaggargcggagctcaggtggtaatgtgagcaataggcagtggctgtaaatacagatgaaacacctcctgctgtgcagcccagttcctaagaagccacggacttgtaccaatctgtgaccyggaagttgtgaacccttgcttccgatgattaaaatctctggctagtcattaaaatctaaccactggaat

SEQ ID NO: 2431 - DNA, 601 bp, Bovine  MMBT18816
  misc_feature (1)..(1): n is any nucleotide
nagggagtttacagactagtgggaaagatgagacatacatatagctatascatatgatggattgggaaaatgcagtaagaaaagtataaagtacctaaaacttgcagagaaaaaaaaaaatgagttctggtcatggggattaaagaaagtgtcataaagaagataggttatgagcttgactgtgaacagtatgtagatatggcacaaaggggatcagtgaagtggacagtgatcagaggtggacagttgcaatgcatcagaggatttaggggttccaggragtatcattggtagagtagarggtaagcctggataggtggattagagacagataaagggcagtsaatatcttcytgggagtctcatctgatgtggacagaataaggagttactgaaagcctctgagcaggggaataaccagatcacatgttctcagtaagaagatgacaattttgactgcagaggaaagaccagctgcagagtggctaagatgggcacctttaataatccaagtaaaaggcaatgatggcctgaattaggggaagtgactattagaatggaaaggagggcacagacagagcaatatttcaaaggttactgc

SEQ ID NO: 2432 - DNA, 593 bp, Bovine  MMBT18817
  misc_feature (1)..(1): n is any nucleotide
ntgatggattgggaaaatgcagtaagaaaagtataaagtacctaaaacttgcagagaaaaaaaaaaatgagttctggtcatggggattaaagaaagtgtcataaagaagataggttatgagcttgactgtgaacagtatgtagatatggcacaaaggggatcagtgaagtggacagtgatcagaggtggacagttgcaatgcatcagaggatttaggggttccaggragtatcattggtagagtagarggtaagcctggataggtggattagagacagataaagggcagtsaatatcttcytgggagtctcatctgatgtggacagaataaggagttactgaaagcctctgagcaggggaataaccagatcacatgttctcagtaagaagatgacaattttgactgcagaggaaagaccagctgcagagtggctaagatgggcacctttaataatccaagtaaaaggcaatgatggcctgaattaggggaagtgactattagaatggaaaggagggcacagacagagcaatatttcaaaggttactgcatgagctaaatgtatgctttgcccagaaaaaaaaaaaaagagttg

SEQ ID NO: 2433 - DNA, 598 bp, Bovine  MMBT19995
  misc_feature (1)..(47): n is any nucleotide
nnnnnnnnnnnnnnnnnnnnnnnnnnnnnnnnnnnnnnnnnnnnnnntctaccatgaatgagacgctttgcaaacagcatctcactcaacagcctcatatcctctttactatcactcagaccctgcctccattatctcacttaaattgttccagctgaccttatggtggcttccagtgatgttcctatgacctcttttactttcttttatgtacacttaactcttgccgtactggcctccttaaaattcttcacatgtgccaagaatgctcctatctttggacacctgctstgcatgtastgtttcccccagatgtccacttgcaaactccctcagctcattccatttatcactgaaacatcacttcttgatgaggattccccaaccgttcaaatttaaatcacattgtacccttcctacagagccttcccattctttacactttgctttatattttccttttcatttgatttttaacatactatatgatttccttattatgttyaattcctattgtgtatctgtgacatcaggcaagaatctttgtcttattcatggacacgtcctaactgcccagaaaaagtactgggcacaaggt

SEQ ID NO: 2434 - DNA, 600 bp, Bovine  MMBT19996
tttatgtacacttaactcttgccgtactggcctccttaaaattcttcacatgtgccaagaatgctcctatctttggacacctgctstgcatgtastgtttcccccagatgtccacttgcaaactccctcagctcattccatttatcactgaaacatcacttcttgatgaggattccccaaccgttcaaatttaaatcacattgtacccttcctacagagccttcccattctttacactttgctttatattttccttttcatttgatttttaacatactatatgatttccttattatgttyaattcctattgtgtatctgtgacatcaggcaagaatctttgtcttattcatggacacgtcctaactgcccagaaaaagtactgggcacaaggtaagtgtccacatgatgaatggtttatctgactggagcccatggtccttcccttgtataagcggcatctcagcaattgagtatctgttccaagatgtcccttactcagagactccttatgtgaaatgatggtaatgctctcctttctccttttgcttctgcagctgatttgttcctttaagacatattctttctttataatgagagga

SEQ ID NO: 2435 - DNA, 600 bp, Bovine  MMBT20598
accatctgagccaccagggaacccccaaattggctactaacatactcaaagcactgactccccccgattggtcaagaggttggcccactgtgcgtgtrgtrctccrattacgtctgctctttgttcttaayaaactccctactttctgaaatgcttctggaaatccttttccaacctgagtacagaccacagcagaagatagctaatttagtcacaaacaaataaatctggctggtaaggagacttgtcaaggatagyagtgcaatctagaggtagagaggcgggaggcagactagtgaygaagggcctggaatccagaccatggtgttcagtccttattccgaagacaactgaacagccatttgtcatttaactttgttaacagttgamcttgggaaagactggtcatttaggtgtgcagctatggatgatcaagagctgacctttgtaaaccaaatatatacaaggggagggactgacaagatgcaagggcttgctcatmataaacgtgataaatgagagggaaaaatgtattacagaagcttatatgaatcagagctttatgaaagtattcatatacagtttgggaaatgtcagagt

SEQ ID NO: 2436 - DNA, 600 bp, Bovine  MMBT21075
ggtcaaggggtaagggtcctggtgtgaagaccagagccccagtctcctcacagtcagcaccttgttttgtccaatgctcagacccacccttccctctccagcaccaccctagtcctcagagtgagcgctgtagggacccgtgtccctctaagggtcaacttcaccctgacatgttcataaataactkgccttgattctgtgctcaggaccccataccctaaagcctgyagtggagctttrgcagtaagggggcaaaagaggcctcatgtatgttggctgcattctttatgactgcatacrgccattgtctcattgtaatgcacacagcagtcttatgattatttccgtccaacagccgaggctgaacaagcagttcaagatcgggtaagtagtaagtgcttggtataaaaacttggaattcgtgtgaccagttctttccaaagtgcagttctctgagcagcctgtgaagatggtcagaacttgtgctgggctgcactgtctgttatcaccatgactgtccttctggagcccgttcccggagtggcctcttgtgtgggtctgtgtcagcaccgtgagaggtccaggtgtggagccccttag

SEQ ID NO: 2437 - DNA, 600 bp, Bovine  MMBT21079
cttggcactgtgttaggacttgaatacccagaagtgaggatcactgggtcaccataaaggctgcatactacacatgcttagcacttcgcagaatctatttcttttgatcctagtataactccatgagacaggagagcttagtccatttatggatgtggaaactacaacttagaaaggttatgataatgaacacaaagcctctagaaaacatgtgttagaattaagtcgatcaagtctccttgtctgagcacttaactatggactttctgcacttacacatacaaacctagatgggtatgrgtatggtgttgttgatgaaatgctgaagaccgttctttgcagtataattgtgaaatctatgcagaagtgagggttacgtggagtagaaccaaaactcaagtacatgtgagtgctaattccaaagtgctttaaaggaagacaaagtattcccatcagtgcaagagaatctctttacctggaatcctcttcactagactcccaactatactgacttcttccctaagtagagctgcatttcagaaaacaatactcaggataataggcttarttgttctagaatccataaaagagaacccccca

SEQ ID NO: 2438 - DNA, 600 bp, Bovine  MMBT22160
ttyrttctggttacataattgaaacttaaacagaaataaatgtagtagccataakaatttaagaagttaacaccttaattcaagaacggtaaaagaaaacaaagaacaattagctaaatttaaaggtagaattcaagacctaatgggagcaacaaatgtgaacaatgtctcagtatttccttgccataggaacagggcgatgggttttgctttcaagaaggaatcctgattctccacttctggccccaagagtgctgtattcactacactagagtactaagtacactcaaataactgtaytgtgacagaagagagaggataacatttgcaggttaaaaagaaatacttgggagcattactaaaaacaatcgggattagcaaatgagactgctagattggtgctcagaagatactattctattaactttgttccaaagttacattgtattatactgtatacaacacttgtcattctccatccaaaacaaacaaacacaatttcataaaccatgctatttcatttccctacagagatggcttctggcaccacttaaactggtctatgtataaagacctctgagattgtggtaagggaaacca

SEQ ID NO: 2439 - DNA, 600 bp, Bovine  MMBT22168
tttttaattggagtatagttcccttacaatgttgtgttagttcctgctgtacaacaatgtgaatcagctatacttatacatatatcccttccctcttgagcctccttcccatcccacccctccaatttcttcctgaatttctagtagtatctgttgtatacattttcatgccatgtgtttgcattcctggcctcttgccatcttaaagttaaaagaagataacaattcctgggatgttatgcatcatacaaaggaagtcctgtctctcatascaaagggatacaagcagagtcaaggtgyttgctttcccccacccagtcttaccagcattgtgtctggcaacccaagtcattctgggaacaccatacccagaatcacatgctgtgggacccaatcccatgggtcggtgtgtgtrtgtgtgtgtgtgtgtgtgtgttttaatgcaaatctcagcttccaaagcaagatcctcatttggaatttaaaagagttctaggttgtttaacgtttgagtggaattcctgagcctgttaactggtcacagtctactagctctcataattagcaagagacattgtattatgcaaacaccactcagtt

SEQ ID NO: 2440 - DNA, 600 bp, Bovine  MMBT00075
tagagaggtccagcttcagactgttgagggaaacccgccggaagaaagtctcactggtgtgctgaaggcaagcccgcaggggggtgaacagaccttggtctttgtgcatcacaggagtctagccgagggaggtgagtctaacaggagccagacgtctaaggacgagcggagcatgcagggctagcctctgaggcttaccttacaagcctccagggtaaggactgttatcaccgaagaggaaactgaagcacagagaggttacataagttgccctaggctgcacagcgagtgagtggtagrgctgggattcaaacccaaccagaagctgtagagcccgcgttcttaaccaccacactgtgctgcgcacctcccaagctcatttaattgtcaaggcgtattgtcctcactctgcaagaaagttccagaagcacagagaggtcaagtaatgccctatatgggtgcacagcaaaaagtggtgtatctgggatccaaacccargctatttgataataatgaccaaaaaaaaaaaaaaaactgtactaaaacccaaaaggacagagagtattctgtcctggggggctgagcaggaggaggagccct

SEQ ID NO: 2441 - DNA, 600 bp, Bovine  MMBT08714
ataatcagaagtgtcaagacttattgagtattataagtacttccaaaacagtcttgtgtgtccttccaaggcatatttctttctgarcaaagtggcccacccactaaacccagtattgatttagctgagcctgtggttctaccttcccagctgcagggcagggcttcataacgtgcacaggtagtttcagttggcaccagagcagtcttatatgttatgttatctttgatgataggtgtgggatttgttctttcttgccagtgcatcctactttgaaacagtactggaggttccagcctrgaagatggaggctggaccatcagatgcgcctctcaagatttccaagttagcaaacacacactcaactccatggcactgtgtctcttgaggtttcatttttctgttgttagatatgaggactaccacgcaggggaccacactgaggcaacagggtttccaagaggtcaacaaaagaaggactttcttacaggataatagctggataaagaaacgtccctgaagaggaaaggtaagcgggcatggagaggaaggagcgggggagaagaaagagctattctccatttaggaaactaatggccg

SEQ ID NO: 2442 - DNA, 547 bp, Bovine  MMBT10574
ccccagcggccataaggacagtaaggcccagggagcttgcgggagagggccacagacgaggaggagaaggaccgaggcttgagcgtgaactgtgtgggtttcgcgtcaaggctcgttggagaaggtctggacgcgagagagcaagaagagggcttcggcaaactctggcctcctgccccccaggagtggccggaccctaaagactggagcttgcaggacacggacgccttcgtgcttgtctacgatatctgcagcccggacagctttgattatgtgaaggcgctgcggcagcgcatcgcrgagaccaggtaaggtgcgccgcccaggttgcgtgtcagacggcggggagtgtttgtgggtctggctgggccttttttccccagaggtgagtgggtgggytcttccgccgtcctgggccaggtctcaggccttttcgggcctggcctctggccctaagcggtctttgtgggtctggtgtttgctgggggttctctgggtgcaggaaagtatgctccttagtgtgtatataaccactggaaggattctc

SEQ ID NO: 2443 - DNA, 598 bp, Bovine  MMBT11895
  misc_feature (1)..(154): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgggattctccaggcaagaatactggagtgggttgccatgccctcctccaagggatcttaaacccaaggatggaatccacatctaatacactggcaagtggcttctttaccactagcgccacctgggtggacaccagcagatayttgtgacgtccctattggttcaaattgactcattcacaggcccaggtctgataaaatgaacgtgagtaggagaacagactttacaaattcagctcctagactgattgggtcagtattacctaaaacacagacctgtgaatagaagtaggacagtccttcasagtgaaataggggttctagtaccatgaagtggatgggcagcaagaagaatgcttgccagaagcaaaatcatttccctgtaagagctcagttgtgcagggtttgtttgcacatataattatccactagactaaaagtt

SEQ ID NO: 2444 - DNA, 600 bp, Bovine  MMBT21068
ggacgcaggaggcgcaggtgccaacatccttcagacctcccccaaaggagtaactagcccccccaggaacatcttgggtgtggtggaggctgaggacttagagaatttctgctcccagctcagcgcctgcctgatgggtggctgccagctgggcgtggctgggygtgaccaccatgaaggctgcaggaaaggaygctaggtcctggatggactgcctccatctgtgccccagtctccattcctacagaggcaccgagccctgcactgatccccagtagcagatacaatctggagatgagsaaaggtggcccagagagcaagtgactcatccaaggttgcacagctggtaaaaagtagagctggaacttgaactctggctttgaggttatacatttgaagctgtttcctctgacctcaacaagatgtcccttcactaacatcagggtccttcctgttggcctatggaccctcagccctgtctgagtttcagaggaaaggtagtatctggagttttcacatcatatcatccatcagagaggcctgcagtggccatccaacctaaagcagcctcagacactctgcagggaggacccctgtgga

SEQ ID NO: 2445 - DNA, 598 bp, Bovine  MMBT11552
  misc_feature (1)..(69): n is any nucleotide
nnnnnnnnnnnnnnnnnnnnnnnnnnnnnnnnnnnnnnnnnnnnnnnnnnnnnnnnnnnnnnnnnnnnnttctgatagatttttccaaatattaatctaacagcagcatatgttacttctaastctaaattataaagctcctattttattgtttgcatttcaaaacttattttaaatgatgtggcagtgaaagtgtataaaatatacttactaaacattattttccacattcaaattagagcctcttgggctgatttttaagtgccatgtacattttaaaatcaaaatgtattgctgacrttcttttaacactccctccccgttcactcttcccaaatgccacagttccttactgctccgaaagtacttatmtgtgcattcgtctggtctttcacaacagcacactccaactgtttgtacttcagatctctctctcaattaaagtaacaaatgttaaytctttaaggtacttaaccatacggtaaacttgctgcactcttcctttcgttaactttaaatctcattatagcaatttcccctcaacctttcctcccccttctaaattcactacaccarcattgctgcgaagcaacatgca

SEQ ID NO: 2446 - DNA, 600 bp, Bovine  MMBT18822
tagagtacatttctagtttatcaggtggctgaagtaatgcatatattatgccagccactgcaacataatcatcaakttcttgatcaattaaggagtgtttactttgagccctgagaactgtctcctgacagcagtactgaatctgtcactataggttctagagtatgtaggagttgttggaaaatttcccatattttaatagctgagaaagctggtttgtcagatgagaagtgagagggtattctcgtgagaggtcaggtggcttgaaaaamtgtgcagatgtggagtmcaaawagggcrggaaaagagaaatcccaggaacaaaaaatgatgtgagtagagggggtggaagaaatcagttatctgaggatgagaagtaaaatctgacaaggaaatgggaactaatacagggatttagagaatgtggatttagaaggttagggatttataatgtgagaaacagaagatgacttgggcagaagatttcgaatggcttttgatggaaccacttcgattttagagaaatgtaatagagaaaagctatgggcttccctggtggctcagatggtaaagaatccacctgcaatgcaggaggccagg

SEQ ID NO: 2447 - DNA, 598 bp, Bovine  MMBT22740
  misc_feature (1)..(38): n is any nucleotide
nnnnnnnnnnnnnnnnnnnnnnnnnnnnnnnnnnnnnncccacatcatgatccataacctggaggagggcatggcaacccactccagtactcttgcctggagaatctcatggagagaagcctggccagctacagtccatggggttgcagagtcggacacgactgaagcgactgagcacacacgcatgtgatccataataacargtctgttcatatgacagatargggaaactgragactggaagggactcgcttccagtgtgaaggaagccagaacccacatgtacacactcatgtatasggggagacccagcccacctacatgcccatcaacccacaagctctaactggagtcctgctaacaatgggaacgtcactgagtgtacccggaatgttctaagtgctttccaataagtcgttcaatattcagtgagcctataggcagagcctatttttctyccctttttacaaaggaggaaatggaggcacagggcaagacaataactcactcagagtgacagccaggagaaggctgggttggggtttgagtcaagagggtgggctctggacctcacacttccaaggctacacaatgcaat

SEQ ID NO: 2448 - DNA, 600 bp, Bovine  MMBT22774
tgtgtgaacaactatacaccaacaacctgtgcaaccagaaggggtgggagaattctcagaaacatacagtttaccaagattgacccaggaagaaatagacctgtgactaccagacgcagagtgggaaggaggaggaattggaggcagggggtcaaaaggcacggacctccagtcatagctaggtggaagkgacatgattcatcggwcaggaacctgagcaaactccagggtacagaggaacacagaggascctggcgtgctgcagcccagagggtcgcaaagagtcggacacgacttagygcctgaacagcaacagtgtgtggaagggacataatayacaggatgactactggagtgggttgccatgccctcctccagggggtcttcccaacccaggggcagaacccaggtctcccacattgcaggtgcattcttcaccatctgagccaccagggaagcccaagaatactggagtgggcagcctatcccttctccaggggatcttcctgacccaggaaacgaaccggggtctcctgcattgcaggcaaaatttttactggctgaatttttaccggggaatcccatagctgacagtattgc

SEQ ID NO: 2449 - DNA, 598 bp, Bovine  MMBT05663
  misc_feature (1)..(132): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgtcagtaactgcagttcctttcagatgcctgttgcatctctctaaaggagtgtggcagaacaaatttaccatttgttccttcattttgtgtgtcttgcatctgtttcatttgatcttacacatttaaggccagtaatgtcctttgagactttattttctagatragaacaatgagggtctaagatttgggagggaatcagagggaagacaacatcaatctggaaacawagctttgacccgactagagtaaaacagtaactcttggcacccgcatttagagcccttccttgaataagtttttttccagagctatttctcattatcactgtgccttccagctccccagcagccggtttggaatttgcctaaattcaaatttacaacatatggtatttacatcgaatctgtgaggtactcagtaatgtggcatgctgtcagaatcggaaacaattctactttcca

SEQ ID NO: 2450 - DNA, 600 bp, Bovine  MMBT23288
aacccacatctcttatgtttcctgcattggcaagctggttctttaccactaggccacctgggaaatcatgaatcatgaatgtttaacagcaattaattaatctgctttaggaacctaagtaagtactagctgaaatttaagatgtaaaattggaagtcatgagtmcaatgaaggttagaggaaaaaagaaatgggatatgaaggagagtcataatkctgctcagaaggtcaggccaaatagtgcaatagaccttttgtgcttgaattcatgggagttttcttcctcagattaaagttatraaaaggagtttttttctctccttgatggctatatttaacaggagaatagttgctcaaatttattatttggcccagtwgaaaaaagtrcaatgtaactcaaagtctaaatcaatgtaatttaaaatataattatgcatgtatgggagtgtccatggcaagttagatgaatgtgttctaaagaaagaataagaatccagggattgagagattcttgttaaataggaaagaatcaataaggagacaagtttcctcattaagagatgatcgccacatttctgaaaaaaatgataaagtgactga

SEQ ID NO: 2451 - DNA, 600 bp, Bovine  MMBT01681
tgaatgttgttttaaaaaccataataatttgcaatcaatttagcataatctgtgttaaggttggtaatattaaagaaaaaagaaggaaaacagtttaaaagcacaaagcttgtaatttatcctaaataatatacttaaagcttagattaataggtgcaagtaaattttgtaagagtcatgtcctgtggcatagggaacactgttttcttgttgtttttttgttaacaataaatcctactgaacaggagcctacattaatccttcatctctactatttttgcttaagtgtatctcactcamaaactataagactggagttatagttaaagaggaaaagtcctagagttggggtcctagggtatatctgtgttgtgtgtgtgtgtgtgtctgtgtgtgtgtgtgcgcgcacataggctgtatttagttttcagattcccatcagcagagcaaaggtgatggaaaatctttagaggacaatcattttacttagagattttccccttttaacaggtctatttattatgaaaacagtttactgagttctttatatataaacctcacctcttaaaactgagaaatctcatgatgtgaaacacttcc

SEQ ID NO: 2452 - DNA, 600 bp, Bovine  MMBT08006
atgtgtgtgctcagtcgcttcagttgtgactgactctctgcgaccccatggactgtagccgactaggcttctctgcccatgggattctccaggaaagaatactggagtgagttgctatgccctcccttcaggggatcttcccaacccagggactgaacccgagtctcctgtgtctcttgaattgcagggaaattcttcaccactgagtcaccagggaagccctagttcttgtatataatgcattataaactgcaaagtcattttcctatgagaaaaggaataatattaccacactgtgartgaggaaacagaggtggggagaggttcagccaccttcccagggttgtacttgtatctcaaagcaaagccaggacgcgctcacaggccttctgctcccaggtctcatggttcttccrctacaggacttctcatccacgcttagagtctaggaactatgctatgagattctagaggttgggtgtcctttcctgccttctccaactttgccacatttacttcctgagtcagtgcctgctgcctgctcagcaaagatgagccctacccacatcagaggagggtttaacatgaatgcataaagaa

SEQ ID NO: 2453 - DNA, 600 bp, Bovine  MMBT08182
caacttttctaagtaatgcaggctttgtcgtaactgatttctagaggactaacttacttatattagcaataagtgtaggatggcttccttaasaataatccctcttccagttagtcaaaagtcctggggaattctcagcctccatggttccaccaaacttctgaatggcaagagaaaggagatgtcttatgcaccatccaaagggccttggaggtagtgatgtcctggctgatgttggttttttcataaccctcccaactctttgctctatttcttaatttctgtcatggcaccaccatytacctggtcttccagaaagctgatctttattttacatgtattcttccatcccaagccttcctctagctactgtttctcttttttcttatttgtagtcatttttcttgaaataattgcttatgcgttactgcttttactacttcatctcaccagtgagcaccaactcctaatccatggaggattagactgtgggcttagtctcatcgactttctgcaacactgcatcttatctgatagttcttggaaatgtgactaattatcatacttgcccaccgataacctacaagtatgaaaagcttc

SEQ ID NO: 2454 - DNA, 598 bp, Bovine  MMBT10238
  misc_feature (1)..(38): n is any nucleotide
nnnnnnnnnnnnnnnnnnnnnnnnnnnnnnnnnnnnnntgtcaaatactgagttactaacattctgagattctgagggaactgatactgactttgggattttaagatttcacgactctgacaatatatattttacgtgtataacatgccacatttctgagatattaacattccaagggtcaacgtgctaagggtctaatgttttaaaggcttacgattatggaattgtgtgtctgagaagggtctttgctcataaaactttagtattgatgattaaacacttctgagattctaaaacttsatgaatacaaagtccaaaggatcaagaacttaaagttccaaaggtctaaggtcctaagattttatacagttctctggtctttgcttatattgtcctaaaacatcaaagtagtgtgaccaaccattctagttgtcccaagactgagggtttcagtgcaaaaaaacatgaaggtgtggtcattctgctcagcatccacatttctaatctgaaatcctaaagctttaggattataaagtcctaaggacctatgtatattagagtctagatttctgaggctttaagattctaagacccaaca

SEQ ID NO: 2455 - DNA, 600 bp, Bovine  MMBT11584
atttcttaaaaggaccttctggacatgctgctgactgttcagaggagctgactttcctccccatcagaaagacccttccatggtttggattgggataacacattaggattcagttcctgaatccaggataaagctgtttatccctggagttagatgttctgctaacttagtctttggaagaaataatgtaacatgtctcttgtctgctcctgaactacctgtgaaagactttcttctgtcattatttgcaatttaatgacgagttcatgtggtccatgataaaaatacatcctcttagayaaagaggataaatgcatttcaacatatatgtcaactctggtcatttgatggtggcagtgaagatcacaaaattgaggagtataaaacctgattcaagcttagagagatgagtgccagatcaattagtgaagtctgccatcagcatgggaacaggagattagcaggccacaggttattacatattcgctatcatactctttccaaggcctccactgaaatgctgccatgcatgaattacaatgctgttcctcttccctactttaagggaataaaggctattgtgtccttgtgcatattttg

SEQ ID NO: 2456 - DNA, 600 bp, Bovine  MMBT18304
accagacttcttgtccagtggattttccaggcaaggatactggagtgccatgcccttcaggggatctccctgacccacagagtgaacccacatctcttatgtttcctgcattggcaagctggttctttaccactaggccacctgggaaatcatgaatcatgaatgtttaacagcaattaattaatctgctttaggaacctaagtaagtactagctgaaatttaagatgtaaaattggaagtcatgagtmcaatgaaggttagaggaaaaaagaaatgggatatgaaggagagtcataatkctgctcagaaggtcaggccaaatagtgcaatagaccttttgtgcttgaattcatgggagttttcttcctcagattaaagttatraaaaggagtttttttctctccttgatggctatatttaacaggagaatagttgctcaaatttattatttggcccagtwgaaaaaagtrcaatgtaactcaaagtctaaatcaatgtaatttaaaatataattatgcatgtatgggagtgtccatggcaagttagatgaatgtgttctaaagaaagaataagaatccagggattgagagattcttgtt

SEQ ID NO: 2457 - DNA, 600 bp, Bovine  MMBT05956
acacgactgagtgactgaacaacagttacttccgtcttccttaaagataaggaccaggggaccataaaccacagaggtttagtttgatgagtggagttagtttgttgagtggcctttcaacccatttttttccctacgaataagctaagctagctagttatatgcctcgaagaaagccatttggttaaatatttaggattttcaggagagtaggtgtaagaatttcctatcatctatcaaaaaaagttaaaaaattatgattatgaatcaggaacatcactttgaacagcagcctgtacrtgtagtgtattttgaacaaatttcccatttccattttctgaactgcattattaaaactttgaattttggtgttgtttcttaccaaatttttttttttgtctttgttgtaggaattccatacaagcaactaactgttggggtccccaaagagattttccaaaatgagaagcgagtggcattgtctcctgctggcgttcaggccttggtcaagcaggggtttaatgttgttgtggaatctggcgcaggtgaagcttccaagttctcagatgatcactacagagcagcaggtgcccagatcca

SEQ ID NO: 2458 - DNA, 600 bp, Bovine  MMBT11873
tgagaatccacggggcggcgctggtgagtacatggagggcgaccttgaggcgggtagcagtggtgtcttcagataacctgtgtgtttagagacaactgctgtcatcagagatccatgactgggttccaacttcagtgtttaagctggaggaagagcttccacagtgaagactgtgaatttatccccttgtggaatgtgaaaagctcccagttctgtcaagaatayatatcccctggcgtctgtgacatggcattaatttggcacaaatggacatttctgattaatgccagcaggacgtgkattcagtgggcaggaatagaagctctgttgctatggcagcaaatatgccttatagccatagacctgctgttttctttcctctgtagaatatacttgtttttaaagaaattgtagattattttgtttaaatagcagaatgaatccagtgtagcttcttcgcctactgaaatatttattgtgccatgtttctcccatgaaaaatcataaaaattcctctcttgatcttcttttaaaaaccaaatctcacgtctgttttatgagtttattcttttctaaaacatgctatttaaaagaaattat

SEQ ID NO: 2459 - DNA, 598 bp, Bovine  MMBT17716
  misc_feature (1)..(14): n is any nucleotide
nnnnnnnnnnnnnncagattctgtgatgtttgagtaaacatcacatgagggtcatctctggctgcagagaatttgtgatctgagaaaatcaaacacccctgggtgaaataactatacattataaagctatgtattgtgactttcccccaatgccatgaggatattagtattaattattattattactgctactattaatatttaaaattctgatctacttaaacactccctttctttttaggttttgggcatagaaatagacaatttaatgacccttattccatatagttaggttgattkctatagcctgacagagtgaagttaatttaagtgttcctggataaccttggttggcattggactttttatgtaaaggacacttactttgttttttccttctgtgtgtttcctggagatggcagtgaaaggtgaccccatctccatcatgaattcctttcttcatccagatctgggtgtcaggtccaagctacagaattttctcgttcctttattagttaattccaaagagacagagacaaagacagaagagaggactaaagctcggaaagaattattatccccatggacagctttaacc

SEQ ID NO: 2460 - DNA, 598 bp, Bovine  MMBT21078
  misc_feature (1)..(52): n is any nucleotide
nnnnnnnnnnnnnnnnnnnnnnnnnnnnnnnnnnnnnnnnnnnnnnnnnnnntggacacggacaaaggagagttggccccacccttcaccctgggcagttcagagttctataatctaagctttactgtagcccaaggaggccaaaacagtgatcctagagggtgggaggttaggcaggggaagagggagtggggtgaagactggctgctgtgagttcacgggacctctcccacccaggccagggtgctctgccttccttacctcttgagggctgagcttgagaggttgtctcagagaatrttagatgaacaaatgtgacttctcctgactggccactgttaggtcatgcccagacttgctcttcatctcttcttcccaaactcgactctcactagtcragccctcatttcttcatttggttccctcaactcctggttgcttagccccgggtagcagtgggtgggaagaacgtggattgcrgrgaccgctgtctcyaccccyacgttgccttggtgtgggtcctgaacgctgtgctttttgtcctgctgttgggcaagtcacatgacctttctgaactcctgtttccctgttgtgaagt

SEQ ID NO: 2461 - DNA, 604 bp, Bovine  MMBT21160
  misc_feature (1)..(4): n is any nucleotide
nnnntctgcagtcatctcctttcaaccagaagaattctctttagckgatttaccaacagatattcttagtttyttattatctgaaaatgctttgtttcaccttcatccttaaagaaggattttgctgagtatagaatttggggttgacagtttttgccatactctttcaggatttttattgaaccactcctttcgccctccataatttctgatggaaaggcagcaattattttgattgccatttycctatatgtaatgtgtccttttttttttttttttcaggcatcttttaagattgtctcaktattcattactttctagaaatttgaatatcatgtaccctagcgtgactttcttcatttttatcctggttgagrttttctgagcttcttgaatctgtaaattggtttcaccaatttgggaaaaatttagactgttattttcaaatatccttttcctgacttatcttctttctcttattcttctgctgcttcaatgataccttttgatattattccacagattcttgaggttctattcatttattttgtttttcttttttcttctcctgataggataatttatattgatttgttgttaagtt

SEQ ID NO: 2462 - DNA, 600 bp, Bovine  MMBT01645
tgagaagagagagagargtaggatcaatgagagagctgaaaaccaacrggagcaatgctcctaattctacaggtgaatcagcacgcttagagaamtataattttcaccctgatgttggaatctactgtggatactcaataatttaaacaggttctcttcccatctgtcttcatcactgaagcttcagaggtgccctatctctccccaacacacaaattcrtcccaaatgccattttcacaggcctcaccaagccatgtccctctctttcattttgaaatccattcatactatgaaacctyccatcataagcctcttgccttcttattaggtcaacaggcmgcctcctagcagttaaagcatgctataccctgccctaaaccaattgatatttgctttgtttatctcacaaaatgactcttcatagatgctaatgttttatttctccccttacactgaaaattctcaaaggcagaaatgagagatgcattctttctttgtctccgctttctcatttctctgctaccatatgtctaattcatttcacaatactattgaagcattctctcatctctttctctcagtgtgattattttcttacc

SEQ ID NO: 2463 - DNA, 605 bp, Bovine  MMBT01704
  misc_feature (1)..(5): n is any nucleotide
nnnnntagaattcttgatttagaaaagaaatactgttaaacattttagtaatggagaaagactctgggttgatacagcaataataatgcagaaacttctaaaaatgtctgtgctgaaatcatttaaaacccaaaagaaaattttttaattatataaaaaaaaacctatgggtttaatgttgtctcaggttttatgtgcaagtccagaaaatagaggtaagtctagtttaataattggatagattaattgtactaatacactggtgaattayttaggtatgtgtagaaacaaattaagggatggtrcaaccgtaaatcataacaaaaactattaggcagtttgagaacttggagaatagtggagagtctaaactgaaatactaacaagatttgtaggtcatgtagacaggattgatgctttgaagtgtctaaatagcttcaacgtagttggctgggagcatgccagtcctgccagtcctctgcacagtgccgtacatccaaccttcatcaatagcttgaacattgacaatggcatctccatctttgaaggatacctcatctgcatcagcagccatatagtcatacatggcacggaagattttctgt

SEQ ID NO: 2464 - DNA, 600 bp, Bovine  MMBT02775
cttttatgtgtcttgtaaggatcctgacaataaaatgattcatattcttgtagcattattgttttccttgaggtaaaaataaagggaataggttctgctttttattttttaattcattgttattattacttttttggcagagacatttatttycttctctacaaatatctctcttcctttctctccttcctccagtgagggcatctagacgaagtatagtcattttatgctctggcagtcctttctatatactctatgctggcattttagcttccttttataagtaatcatttatatgcsttcctcttytccttaaaactttctctgccttatttatcattgtattctcatacatggatggttaggaaaactagtactcaataaatgcttagtaaatgaggaatttaggtgctgaagaagactcttgagacacgcctgggcaacttgctcaaggaaatcaaatcaatcaatcytaaaggaaatcaaccctgaatattcattggaaagactgatgctgaagctgaagctccaatacttgctcacctaatgcgaagagatgactcattggaaaagtccctgatgctgagaaaagaagtccct

SEQ ID NO: 2465 - DNA, 600 bp, Bovine  MMBT02857
tgcggcttcattattacacctctcatcaagctatgtgactcagaggactcgaggtctccacttctctcactctccccttggaaacgcagtgcagaacttcacggacactgcgggctgactaaagttaatggtcaatgagtgcacactctgggagcacttcatggagaagtgtcagggtttcgggtgatgagatgcgtgcgcagggacagcataattatccatgtttgtatcactggatgagggccccttctgtcacaacagtcctagtatcctcgtggaacgccactgacagcactcctmctttcggcagagtttgaactggagtaacgtacctgtaagactgtttaactcattcctactagctttcacctcacttaataaatggtctctctcttgcttgatgtctttcactgcacggagcctctcggagcctgcgttcaccagcttcaccttttccagttccaggtcactcactctggcttcaagctcccgtatctttgcatctcttttatctttcaaaatctaaatgtagggataaatacaaaggacagagcaagaaataacaaaataaaatataaagcagcaataagaagtgggaaa

SEQ ID NO: 2466 - DNA, 600 bp, Bovine  MMBT03304
tgattccaagggtgacagtgtttcctcttatgatcgaatgaagttaaaattttatttttaaagggattcctgagtttgtttgatcttcgttgagttttatctcaacgtctgtaatcacatggaccatccctttgtaagctaaaatttgaagacaaaataatgtcatgatgatgactctttgtaaaaagtactcacaagtaatgattacaggaacaaggtaagctgggaactatttccatgtcaagtctcagaggaaaagttaaaaacagaawacaaaatattgactggtagtgtgcttcyaagaatgctccaggtctccaatgcaaacaatgatttcaacagatccctgaatcccaaattctctgccagttttcataggaatacatatttctcatagaacattaccatgaagtttatggtgttttgccccaaatgtctagaattttactaycctgatgcatcagactgtaccacacatagactgagtatgctcttctgcttttctacattcaagtctgactgtgtgtgtccatgtggctcggcttccyctgatgtaaactatgtactgatcaaggctctcaggacctcaaaatcctcaaa

SEQ ID NO: 2467 - DNA, 600 bp, Bovine  MMBT03311
cagacatgactgagaaacgttcattttcactttcatggacatattttaagcaaagtgattccatgcatagttttgtatcacagaggaacactctacaaacaaagtgaaaaaggttttaaagaccctttgagagaatctctataacttgtacctggttcaactgtgctgactgcagttgagttgatatttttagagtataaaaatatttatgtatactactttttactggcacagttgctgcataaaatgaggtatatgtgtacactcacaaatatgaaagagttttccaataggtaatayaagcccacaaccatttaaataaaattctgaaatccataaacctcagaagaaaaaaaaattggtaatagaataaactcaccttatttggactcatttgagacaaagttgaatagatatgaaatattattttaaattttcccacttaggtaatctttatatttttgctaatttcctttttaatatagggtgagtatacaataaaatatatatcatatgcatgctgtatatgatatataacatacccacactgcattaccattctaraatgttatatatataatgaattctaaaatgcagtat

SEQ ID NO: 2468 - DNA, 600 bp, Bovine  MMBT04129
caaagacaaatatcatgtgatatcatttgcatatggaatctacaaaatatgatgcaaatgagcttatttaaaaaagagaaacagactcacagacttagagaatgcacttttggttactagggggcaggagaggggaggggagagataggttgggggtttggggattgacatgtaaacactgctattatttaaaatggtaaaccaccaaggacctactgtatagcacagggagttctgctcaatattttgtaatagcctaaagggaaaagaaatgaaaaagaatagatatttgtatatgtrtaactgaatcattttgctgtacacctgaaactaacacaatgttgtcaaccaactattgtccaatataaastaaaaatcaaaaaaagaattatcctgcaatgtagttgtcaattaaaatcaaagctcatattgttttaaaatatttaatcaagaaactctaacttaggtataatttgcagctaaatgtaaaactagaatacaacttaaagacaatgtaggtcagaagtggttcctaaccttgactgtgctttagaattacttgggtagttcttaaaatgtcttaatgccctactgcacaat

SEQ ID NO: 2469 - DNA, 600 bp, Bovine  MMBT07440
agtgaatttttagtctgtaagacctgtacagtttaagttgttttattatttgtccctaagtcagacataaataatggatcacatgttctggtaatgttcagtcatggttttattcttgtagcatttatttgtgattaagaatgtaaatacagaaaatggtccttttcagtgtgattttaaggcttacattggttggtgtctcttttcacatatttaatctattcattatataagcacaaatgtttctggtgaccacttttggaaatgcagttttcacccattgggcatatgactgtgtayatgttattagatattcgataatctcaatttggaatctgtgaggagaaaattcaatccaagttttagatcattcgataacaatttcatgagaatttatagggattttaagatataatcacattgtctttatcatcataaacagctgtagaactttagtctgagaaatattaagctttttcaaagcatagtgtattaatcatatttttaaattttatgtatcttatgatgttttgacatcttacacagcttgctgaccagggagagactttgtctcctagggctagccatttcttagagata

SEQ ID NO: 2470 - DNA, 600 bp, Bovine  MMBT08183
ttaagatgtcagctggagatgtaggctttgttcacatggaaaagctgctgattttcagcaagttttatacacatacacacccaagcatgcacggctgacacttgcctgctcttgacaagacaactgggccatrtggtgacaatattaattagacaattgctgctgaagaaggcatctgtacagctctccacctgcttccccaccatactcagttcatctacaacaaacagccaaccggggctgacagccccaaacggtacagctgtagttttctccagggtagtagctccagaagaaacrcaagatgcaggagacctgacagagtcttgggatggaatttgccctctagaccttctttgcaaggctgccagatcattgtccagaggttgaacaccaaacccttagctcaacrctgagggctctctggcagttttattagggaagtcaatcagcaacatggccttaggctcagcaaccatgtagagctgggttcaaattccaggcatgccttgtgctagctgtgcratcttcaactatttaatttactatttgaacttcttccyttacttcgagaacattatcaccttcccagtagactgt

SEQ ID NO: 2471 - DNA, 600 bp, Bovine  MMBT08648
acagtattataaagtaattagcctccaattaaataaatttgraaaaaaaaatttggaatagaaatagaatactattgaacatggctgtcatttaaaaatagttatctctcctactggttcatagttttaaatttcagttaagtaagacttatctaaaatttcctgaatattacttcattaagactttagaataactgcattgttccctcatgtttctgtatatatcatgtattgtctttctctcccagctgttcccatggtgtcctctgggaccttatctttatgctgaaagacctcacrtacctttccaggacagaagtaatgtagcataatgatgaagacaatggattaggggctcggatccctgcttacccatttattagctctgtgaccatggttgagatattttatctctatccacagtttcttcatctggaaaatgagaataatcatagctactttgtaaaagctgggaaaattaaagaaggtgatttaggaccagacacatggtaactgttaggtattattattatcgtcgtacatacagtcagcattaccactaccaccccccacacctccatcatttcattaccaacatca

SEQ ID NO: 2472 - DNA, 600 bp, Bovine  MMBT09063
gttgcaaatagctggacatggctaagtgactaacactttcacttcaattttcatactccagtaagttttttttttttctttaatcaaatttagaggaaaaaaaataaaggaagagactttgcaatatcttctttgttccccagttatatgatttctgttaaaatatcggcaatagatgaaatgcctgtgtcccccaaatccctatgttgaagccctaatgaccaaggtgatgacttttagaagtggggcctctgagaggtaactaggtcctggggcagcgtccccttgaatggaattatygaacttataggaaaagagaaagagcatgtctctcctgcaggtgagactacagcagcaaagcagccaacttgcaagctagggggagagctctcaccacacattcaatctgttagagtcttcctcttagactttccagcctccagcattgagagaaataaatgtktgttgcctcagtcaccgaacctgtggcattctgctatagtgacccaaaytaagacaatttccctttgaattttatatactctcactgcctaaactaaggagtacagtcaccactaaatgataatctatgcaaacaga

SEQ ID NO: 2473 - DNA, 600 bp, Bovine  MMBT09316
tgggtgaccacacacacacaggcttcccgtctctgctgagaaaggtctgccatgtggccagtttctggtcagcaaaagaattactgtttaaaaggcttcaagtaagaggacagagggtttgtaattaacatggaacactgacagattcacctttatcataaaatcactttcagtggaaacctgcaggtgtgactttttcccactgaaatgtggaggcatctctggctggaccgtggcaccgcacccttggcctgacctgcagccttctgtgttgtttcccttaaacaaaaggataccacrttctcatcagacaaacttaagactctcaaatgsattgaatcaggctcttatagacaccacatccgtaactgtaaaattaaaaacaggccacaggagcaccactcagtgctccgacatctgcatacacagtcaggacgccaggacacgtgaatcccaaatctctgcagaagacacagaacagaaaatcatgcagcttgaaaatcccgagtaatcacttgaaatttattggatttaaacccctctcatcagttaggagcactcttgatatcagtcagattttgtgtggtctgtgaatccagg

SEQ ID NO: 2474 - DNA, 600 bp, Bovine  MMBT11621
cttcgagaattctctttgtcctgcttagtgtcggaggcgtggaggggaggcaggaggcgggagtgggatacgcgcaagtgggagatgaggacccacgtgcacactctcgccctggtggagggggcagaaatgtgctcagagccctgtggtttggggcagagcccagcgccaagcaccctggggaccttccggcccaccaccgcctcttcctctccctgtgctttycttggactcccagatctcagactgcagtgccctgaaacctgactctggtcactggaagtattggaagacgtgggyatctgggctctgaggtgtcctgctaatttcagagtggatgaagcgagcatctttataacagaaggtgctggccacctctttatctaagagcccctcaggctaggacaggggctcagggaggttggtgcaggttcctacctggcctgtgcccagggtcttgggcctctctcccacccttcccctattccccatctaccccttccagcagagatgggtgaagcccacaaagagaaccttgggggaggaaagctcaggaaaggggcaggacccccaagattagctgatgtggcttcagacgag

SEQ ID NO: 2475 - DNA, 600 bp, Bovine  MMBT11850
acaaaataatgtcatgatgatgactctttgtaaaaagtactcacaagtaatgattacaggaacaaggtaagctgggaactatttccatgtcaagtctcagaggaaaagttaaaaacagaawacaaaatattgactggtagtgtgcttcyaagaatgctccaggtctccaatgcaaacaatgatttcaacagatccctgaatcccaaattctctgccagttttcataggaatacatatttctcatagaacattaccatgaagtttatggtgttttgccccaaatgtctagaattttactaycctgatgcatcagactgtaccacacatagactgagtatgctcttctgcttttctacattcaagtctgactgtgtgtgtccatgtggctcggcttccyctgatgtaaactatgtactgatcaaggctctcaggacctcaaaatcctcaaagctaaaggggaaatgtataaaaagtcaaggtgtttgccaataactctgatccatttataccctcacactaaaaagggaatctcttaacaccgtggcacaggtgtctgctagaagtaccatttaatggctccaacaaagatgcacactcaca

SEQ ID NO: 2476 - DNA, 530 bp, Bovine  MMBT11886
ctttctccagacccctcagcattgtctattccatgcaaaccatactgaccaacagcacctgcctcagtgggaggactgagcgggtcagctcatgcttagggaagtactaggatgttgcagtgctgtttattagccaataaatcagagccattattcctgttatttagtttaagtatcttgtatcacatatactaattaaactcttattcccacagctaggttacaagcaaattgagggccaacatcttacgtgtggatttttaaattttcctccagagtacttaccattagtttttaatrattattgtcaagtgatggaaacaaaggatttccatgtttaaagtttcatttgaaaccctttagaacctctatttagacagtgattcaatcctttaacctcttccaggactgaccttgtgtgtaaatatggcaaatccctgaaaatggcatctatcatgggaactttgctagagtagagccaaaatactctctacaagatcaaacaaatattgactcaaaagaattttccc

SEQ ID NO: 2477 - DNA, 600 bp, Bovine  MMBT12517
ttaaagagctataacttaaacggtgatacagggcaggcacacagtagatgataaatggctttgtgtaagaggtttcaaatttgtcaaatctgcattaaataactatatttgaaatcggttagaaggttgggtgaattctccaggtgaaaatgacatttgttttatggatccctccaaaacaattcccccagagttttcacttgaataaatcacatttcgagttcagtgctccagaaacagcttgcattgtaaagttgcattagctgcttctctgtttcctctttgtaggaaaaagcgctygatttcttcatttgtaaaggaagtgagactagataacctggagtgagaatctttatatcctctcattcattcattccatgggcttccctggtggtgccagtggtaaagagcctgcctgccaacgtgggtttgatccctgggttggaagattcccctggaggagggcatggcaagccactcaggtattcttgctggagaatctcatggatagaggaacctggtgggctatggtccacggggtcgcagagtcagacacgactcaagtgactgagcacacacgcaaagaaacaacaacataca

SEQ ID NO: 2478 - DNA, 600 bp, Bovine  MMBT15649
ttagacgagagccctcctcggggctatggaaggcaacaacttgcaacagytcggcaggcgtgagccccagctgcagaccgagctccacgtcctgcaaatggagacaggagccccgaggacaccgcccagacctctgggttcagccccgcctgaagcaagttccagctggttatccttcacttacagcacggggtgtcgcaggaccctggtgagagtggcctttactgtgatgtacagtgaggagttgcagaaggttttctgagcaagtaagttccactataaaggcagacatggcaaccyactccagtatctttgcctgggaaatcccatggacagaggagcytggcgggctacagtacacggggtcacaaagagtcagatacgacttagcaactgaataacaaggcaggatgagccaaattctggaaaccctggcccttgacctcctaaaaaaaaaaaaaacaggccagaggttgggaagtgatgcctattaatgattatcaaaaactttatcgagtttcaggcaaaaaatgacttccctcttgtttagctcctggcttacttgtgttacttctcaaatgtgcatggtgagggatgatc

SEQ ID NO: 2479 - DNA, 518 bp, Bovine  MMBT16255
ctcagactttgaggaggcacagtaagtaggagaaagagaagaagtaagatgatagagattctctgcaccaatgtctgcccttagaaactgtacagtctagtttccaagatcactcaggataagaagtgttatcttcctcttttacaagctctctgatagttcctctgaacttgaatgcagatagtttttctttaagacggcttcattaagccagagggactattactttgtacatggttatgtccctagcctggatggaccatgattgatgccctctattacatttcattagtattcccygtggtactggtgtggccattaagagtgaaagcctggaaaaaaagattcgagaatcttatgcacttgaatacattagaaatagctaaccccttttcccttccctattgttgttcagagttggctcagaatttttattttgaagctatttcaagaggggtaaataaaatgtaacacatacacacaagagtaaaattcacataaaaaatagattcacagca

SEQ ID NO: 2480 - DNA, 601 bp, Bovine  MMBT18813
  misc_feature (1)..(1): n is any nucleotide
nttatatcatttttcctccttcagggagtttacagactagtgggaaagatgagacatacatatagctatascatatgatggattgggaaaatgcagtaagaaaagtataaagtacctaaaacttgcagagaaaaaaaaaaatgagttctggtcatggggattaaagaaagtgtcataaagaagataggttatgagcttgactgtgaacagtatgtagatatggcacaaaggggatcagtgaagtggacagtgatcagaggtggacagttgcaatgcatcagaggatttaggggttccaggragtatcattggtagagtagarggtaagcctggataggtggattagagacagataaagggcagtsaatatcttcytgggagtctcatctgatgtggacagaataaggagttactgaaagcctctgagcaggggaataaccagatcacatgttctcagtaagaagatgacaattttgactgcagaggaaagaccagctgcagagtggctaagatgggcacctttaataatccaagtaaaaggcaatgatggcctgaattaggggaagtgactattagaatggaaaggagggcacagacagag

SEQ ID NO: 2481 - DNA, 600 bp, Bovine  MMBT21062
ttctgacaatatgtcttctattaatcatttaagcagtagtaggaaacttaaaggagtgtattcagaagcaagaatccatggttcatttagtgctgtctaaaaaaatttcttattgattggcatcctctgtggttatgtgatgtaatatttataatatgtcacccagccatacatcaaaacaagtatgtctcttgtttcatttccatgagagatgttgatttcagagaggtcagcccagttttaggtcaccttgtggccaaccactgggccagaaatgggaagtgaccagatttatrgagmtattggaaatgaccccagagcygctttaggttctgtggatgctttcctcccctccccccacagcaccccttttccttcctcacgtaccccctgtatgcccagttggattttcttggcacacgtccacacagtaaaacagcctcattaaatctgtatgtgagcatgagcacactaccaggctgtttagcggtgccctggtcctgctgggaccggagcaaagccgagcctggggtttctctacgccattcatcatagctcgtggctgaaatgtgtccattgccatgctattataggcgctga

SEQ ID NO: 2482 - DNA, 600 bp, Bovine  MMBT22078
tcggagtgataaacatgttctaaagttagataatggtgatggttgtacaactttgtgaatatgcaaaaagtcactgaattgcacactatagaagggtgaattttgtgatatgaaatatatgtatttcatgtgaattcatcttgccagttgaggttttgccagttatcctgactttcaagagtatagccgctgctataaatcaagggattctcttaatcttattagctaatatttattgatctttcattgtgcaaaatactgtgtataaatgaaccctcatataacattatatagagttcrcaaagagttagacatgacttagtgactgtacaacaacaagtttatgagatagatayttttccatttttaaggagattgaagattgtgtgttaaatcacttcagtcgtatctgactctttgcaaccctatggactgtagcccaccaggctcctctgtccatgggattctccaggcatgaatactggaggtgattgccattccatcctccaggrgatcttcccgactcagggattgaacccacgtcttttacatctcctgcattggcaggagtgttctttaccactagtgccaactgacatt

SEQ ID NO: 2483 - DNA, 601 bp, Bovine  MMBT22164
  misc_feature (1)..(1): n is any nucleotide
ntttatcagtctctgttaggcactttacatattttatcttttttgagacacagttkacatttaacattgtgtaaatttaaggtatgcagtgtgttgatttgatacatttatatattacaatatgattaccaccatagcataccatagaattagctcaccccactatcacatcatataattatcattttttgtgtgtgtggtagaacatttaagacctagtctcttagcaacttttaagtatgtaatacagtattgttgtctataatcagtatgctctgaattagacccccaaaacttactyatcttctaagtatgactacatctcccaattctcctatccttcagtccctgataaccaccatttgggtttcccagctagctcagtggtttaaaaaaaaaaaaaaaaatccacctgccactcaggagatgcaggtttgatccctgggtcaggaagatcccctggagaaggaaatggcaacccactgcagtattctcacctgggaaatcctatggacagaagagcctggcgagttatagtccatgggtcacaaaagagtcagacacgacttagtgactaaacagcagcagcaaccaccatttt

SEQ ID NO: 2484 - DNA, 600 bp, Bovine  MMBT22201
ctgtagttatagacttcaaaggcatttattaagtgtttactctgtgccagaagctattggacctgggacagtgatgaaccagtcaaagttcctgctctcatggagaaattttaatgagaaaagaaaagaaatgacaagaaaagtattagagtggaaagggctatgcatacgtttcaagtggatgatgtgacagtgacagcatggctacgttaggttgaggggtcagggaaacctctgagaatgtgctgtgttacctgaagcctgaaggataaaagccataatatgtagctcaaggaaaaraacattctcagtggaagagttagtccaaaggcaggacacagcacggtatggctggaaaagagtttttgaagcaaatatttgtagaatgcttgccgtgtgccaagtactgttttttagcactttaaacttcacagcaactccattttgtctctcttttatacatggagaaaccaaggcacagagaaattaagggatttcctggggttttatagccataaattggtggagctgtgatttgaatgcaagcaatttgtctgcagcatttgtgcttttaatcctatctcaatctactaacctgga

SEQ ID NO: 2485 - DNA, 401 bp, Bovine  MMBT03652
ctgtagttatagacttcaaaggcatttattaagtgtttactctgtgccagaagctattggacctgggacagtgatgaaccagtcaaagttcctgctctcatggagaaattttaatgagaaaagaaaagaaatgacaagaaaagtattagagtggaaagggctatgcatacgtttcaagtggatgatgtgacagtgacagcatggctacgttaggttgaggggtcagggaaacctctgagaatgtgctgtgttacctgaagcctgaaggataaaagccataatatgtagctcaaggaaaaygcgaggtggggagagcgatgtgcatgtctgtgcgaggaagggtccatcacatgacagtaaaagaggacccgagtcatcggggcgtccgtgaggagaagggg

SEQ ID NO: 2486 - DNA, 600 bp, Bovine  MMBT04450
aggaagattcccttccctttgagggttatgactcctttctggcaggaaaacagcaatcagccrgggagccactatgtacctgctcctttttgtgaatgaagagaggctgcaaagccaggaaccagagcagagagayggctagttgctttcttcttccttcctgttatctagaagcctcttccttgtagtatcagggcaagaagatggacaggcaggtggtaggccagaaaggctgtggctggcatgagatacccacagagcagcagttccctgccagtacttggggaaacctgagagttracgtcaaacttcctgcaatcctaggaagggtctgattccaagaaaacaggctgtgatgagtaagaaaccagtgttctgatcaaatatgcctgcagattaaatagtgaattgtgccaagatttgtgagaaaggtgacaacttgtgagcaggtgtttgtttcgccctagttgtttagtggtgaggtgaaactaggtttgcctacaatattcacgtcttttctaatcttcagtagctactaacagtgttttgcttaacagttttcttcctcccttcaaggaccgatacttctgaagagaagaa

SEQ ID NO: 2487 - DNA, 600 bp, Bovine  MMBT01257
tgaactttctctgtatcaaaagttactgaagtaaagctttgaaagatacaaggaagcaaaatacttaatagtggtgtgtttcagagaaacacacacttgctaagtttaagcctgaatgttgtcttttttttttttttaaagaccctaaacggcccagtctatcactggtgaccctatttaaatgttacttatgtaaacagaatgtgtgtgctggctgttggtctgttcccttctcctctgggcgaattaggaaactaggaggttgacaaagccagcaagtcacattagatcaagtctcgmaagttctcccatgcatgggtttggatttatggcaggctcgtccccctgggcctctcatagtgtcccatgccagagtaaatccggcccgaaccattgcctggcctctggcagtaggctgcaggcactgaagtgggttgcacagtggaaaagatgccctccctatcagattaaatagattaaaataattattttaaggtaactcattgacctatgtcacgtttcatgaacgccaaggacagtggctctgatggttaaatgagctttrtttttgtttattcataaatcattgtttgctaattt

SEQ ID NO: 2488 - DNA, 600 bp, Bovine  MMBT01617
aattctttacatacagagcaagcgtttaactctcttattttggttctcattctatctgattggtattattattgtgatgatcactattattaatagtagtccttacagatgctataaaatattccatcggttaccacggagatcaccactaagaagaaaaagcaaacagaagaaaagtgaaaaaagagacagaaacacgtgataactctgattaataaaacctcattctacacacatayctgactctgcagagcaaggaaaaaactgtaaattttctctcataatgcttggaaggaagaragaagtctacagattgtcaatacccagcttaattgaacttaaatcactgtggggagctgcttacagtcctttgaaaaatgtgccaattcacttatactcctgttgcaataaaacaagtctatattaaggtcaccagggtcacttctggtacagttatctaagttgacaaagtgaattttctatgccaagggtaaagatagcttaaataattctcaaagcactgtctttaccattcatttaccatctatgccatttcttgtcattttgcactgacagttatttaatttttcatatgtttgt

SEQ ID NO: 2489 - DNA, 600 bp, Bovine  MMBT02307
ctgaagaaagtgttttgtctatattataattgtctatagataattgtatcaattcttgrctttatttcatctactgaaaaaaaaattctttgwatgtaatctaatgaacatataggaagaaaacaaaaatccaaacctttctgagagacaatggaaatgcaactactctatttattctaaaacaattstaacattttactcaacatgaaaatggtctgcaaagtacttaagattatacagtggaagacactaagcaaatttggggaactcaggattcctgacaasaataaatgagctgtyttacttgtttttcatttgtgcatttgtttctcccatatcactagtattcattatggtcacacagccaggctcacaatgaaactgagtttatgctctgggaaatgctggaaagcaccatcttcattatgtcaacaatgaaaattacgtttgtccrygttctytggagctggyggctgaaatgtctgaaaacaacatscaggcattttccctctcactctgggggaaaaatatacctactgacattattattattattatttttactaataatctgtttcccctttgccctttaagactgag

SEQ ID NO: 2490 - DNA, 600 bp, Bovine  MMBT02327
ggagatatttttaactgacaccgtttgggggttattactggtatgagatgtgcagaggtcagggatggtactaaacattctgttgtgtgtggagcagtgcctaacagcagcaacttacctgacctaaagtattaataatgctatgattaagaaagcctgatatatataacttcattttaggggaataaagtatcacctataaagtcagcatccatatttatattgccgtgataccatttagccattgactcattatgaaagagatttgaggtggcttgacatgatgtggagttttgtttstcaaaggttatkcaattatagtaagttaycagtttaatctttgtaccttgtaagttacataaatggctttatttcttgtgattgagttcatgtaattctttgtgtttttttaagcgcttaaatataaatccaattatacgaaggagaaagccatttttctattagttgctggactactgctcactgtccttgtcattgttggagcctttcttttcatcccaggtaagatatacagttattatgagggaaaggaggattgataaggttgaggacatttctggagaggtgcatgttagtttc

SEQ ID NO: 2491 - DNA, 598 bp, Bovine  MMBT02700
  misc_feature (1)..(71): n is any nucleotide
nnnnnnnnnnnnnnnnnnnnnnnnnnnnnnnnnnnnnnnnnnnnnnnnnnnnnnnnnnnnnnnnnnnnnnncattcacaaaactttattacctaatagttcagtgatgtatactacaagctcaaggaacctgaagccttcctggtttgattttggaggctcacttttgtttctaaaagtttccaattaaccctacaattaaaacctctatccctaatttcaagaatcaatcatgaaatcttctagttgactgatggttattctatgtggcaagaaacactgcaaaagttaagtgcaggtrtaattgaaaaagaaaaaccccagtaaataaataaagcttcctggagtcttcaatttttatcaaccaacaagaaaattatctaagactggtgtcattatgtagtttgtaagaaagaaaatctgaaaatatggaggtgcaggatggggctggcattggagatattacataaagttgacagataaagggttacatgaccgtatcagtatttgtgttgtgcatatttagaatctttcaaggcagcaaatacttttcttttttttttaatgtgccacctctttactatgtaaaatagtctttt

SEQ ID NO: 2492 - DNA, 600 bp, Bovine  MMBT02747
ctccttaccctacctagttcctccatcacttcagccccgtgtcccatttcaacaagaataacaaactgtacatttgacctccttccaaatgtgcccatttgagatcacaggcttgtaaaaatgaaagcttgagggagtcttgcctctgtgacttccttctccctttctaacccagcagagcattcctgttcagtgactccccaatagctctgggcttataatgtcccagtttgctgtgttttctctttcttctttttgccccaatctttctttgtgttgtctggccctctctgagcctcmccactgtctcttttgtcagtgggaggttcatcccagctcctggtgcttggtaggcacacaatcaccataaattcccagactcttcaccccagcattctttttcttctgccatcctaacccttctctcccacactctctgcatctctttttactcttaaaatatatctatgaaaaacctagagaaagaaaataaaagcaaagactaaagagtacttaataattttattttctaaacaataaagaatacataatgtgtgtttttttgtaaatggttttacagatgacagtgataatctaata

SEQ ID NO: 2493 - DNA, 600 bp, Bovine  MMBT02750
catatgcacaaatacatataagcacacaaagtttaggaaaagtgtgggaagaagccttagtcaaggaatctaacytgggttaggtgctcagttttttctcaggatttattttagtctatgtccatttgcatatccattttacacaatatataacaacttcatgtattgcttttttcccctttaacattatattttgagccttttccatgacaatccataatgtccataatgatttttttaaatggctgcaaattattccaattaattatgccagttaaccatttctctctattgcttaayatttctggaactttccatttttgttaaagtcaccctccttgcagtttccaagttccaagtctgtggtgccaaccataagctttatataattgtaacaagtgacctgatttcgattttctttgcctctcaatttcttaattttcttctgacacaaagtaaagatctataggaccaagctgttaagagacagcaggaggctgtttctccatcacaaaccaggcaatgctgcatccataaggcatcaccgctcttcagagctttatccaggtgaaagcaaagggaacctgcctagccatcacc

SEQ ID NO: 2494 - DNA, 600 bp, Bovine  MMBT02766
tattatttctccatcctctctctgaaatgcctgttgaatataggctaaagcttcatgcctttcaaaagctttttcatttttttggaaaatctttttactttcctatgcacgttcagaatgaatttcaatttactaattttctacttgactatagccattcaatatactatattcttattttaatgaccacactttcatttctaggcattctcattggctcgtccagatctacttcttatgcttttatttctgtcagtttgtatttcaaaatatgagtacttcatttattcttttgaggayattaaacttatttgaagcaatttgtgctgttattttaaaattatctggagttaattcatatttgattgttgattttgttggctttcttgtgttagaattctttgtgcattttttaccgagatatattgacataaagttaaggtgtatataatacattgatttcattaacttatatattacaatatgacccttcctgtacttctaaattttggaatttgcagtcttattctgaataggatatattgtttcactctcctcttcatgatctattgtccaaaactcaatccgacccttctgtcc

SEQ ID NO: 2495 - DNA, 600 bp, Bovine  MMBT03140
gccccctgggagcttcccatccaggtggagatctggggacacagtaaatccatttcataccacgttataatggctacaatggtgttttgttgtatggatttaaactcttattttgctgctttctaagtatatgactttaggcaagtaatctaaccttcttagttgtgaaatgaaggtaaaacatctaggatttgggtgccaattccccatgatatatataaaaagtatattaacaaaaacagtaattacaacttcaacttaataatagcttatgatgtagcagatatcatgctaaacatwttttgtactttgtctcattaatccttataatactcaatgaaaggggttttattatcctattaaagatgaagaaattggggtgcaaagcacataagtatcttactctagatcattctgctaaataaatgacagattgggatttgagcccatattgctatctccaaaactcaggttcttaaacactgtatcatattgcctctgggtctggcatgatgtcagaactggtaaatgcttgataatcaggggctacactaattattatgtataatgtgcagtggtgtttaaaagagaaagtaacaa

SEQ ID NO: 2496 - DNA, 600 bp, Bovine  MMBT03392
aagtgacttgcctcagtcaccgagaggacagtttccaagcccaggcgctgttgactatatcaggtgacttgccatattggccggtgacattttaggagattcacgtttttacttaagtaaaaacattctaaaaaaatgtaatgcttacctcttttatggtaactcacaattcatgaatgccagcatatgtttatacagcactttataattttcagtgccatttagctcatgttattataattaccattttgtgagtcaggcaagggatttttcattggtggtgattttattctggttttkcttttaaatccccattttatagaagaaaaaaagaggtgtccagagaggttaagtgagttgttcatagatgcagagctacagccaacaaatggcagctcaggaccagacctggatatcctgmttcccagtttgccctctctcagaaaagtgtctttcttgtttgtcatgcacaccctgtattttaggcatcctcgtgcttacagggctgtagttggggttgtatgaaacagttaaactggcactgcccttgccttctggcagcacataatcaaagtaaagtaaaaagtttttggagtttat

SEQ ID NO: 2497 - DNA, 600 bp, Bovine  MMBT04121
ccatttttaagagacaagagaaggttagtagcaatcaagcctttctgggctcttcaccctggccctttgctatgccttcttataaggtcaagacacatcgatgggaagctcagttatcgtacactggtgtgaaggtgctgtctgctgccccatttaggctgcatgactgagtgactgggtgttgttaagggacatccacagccaatacacaaggtattttctctttgctggctgagcagcactcgagggattctgacagcctgagctgacatgctaacaatctgattgcagatggcaatrgtaggaggctttgagtgagagagaagagtcccctgaccctcctgtcatctactctctcaatctccatcctaggatcggagcgctgcacaactatcacagggagaggtgacatagtgaaaataacttatccacaaatgtgctgaaatgtcatctctaatgttatagttcctttaagacgaactataatttctaatataacttttcagttttgaaaggaaagggcaccaaggctgagttgacagaaataaattatccagataattaaggctaactactccactttctcctactccctggccc

SEQ ID NO: 2498 - DNA, 600 bp, Bovine  MMBT04816
ggttgcactatccctttatgacaaaagaatatgtttgccaaagtagatctttgcattgaatatctgctgatttatttaattttggagtcagtttacattcaactcaagagcctacttctgcctcgtctttggattatttacccttgggtagatatcaccagtgcaagcacattggctaccttggtatagcctcatggttaaggcggggcttggtccaaatcctagtctgccattggtgagggatgtggcattgggcaaggagtctcagcctcttcatttgtaaaaatgggactggagtgktaccttctgtataggattgctgtgagcatcaaagatttcttcaatgaagtattccatatagagtgccaggtacacagaaagtattcaatgcctgttgtctattattttcattgtatcatcatcgtggagataggagagcagcagtagtaataacagcagtaataaaaacatgaaaaattataaccctgaatcgtacaagatctttaatcataaaaatattgtgttcagtacataatacttctaaaccaagggtacacgctggtataatttttagagagcttttagtaaatttaagttcag

SEQ ID NO: 2499 - DNA, 600 bp, Bovine  MMBT05534
gygttctagatgaaggagaaacacaaaggccctctaagtaatcagggactggctcygttttcctaaattcttygacactggggtactgatgctgcccactgagacctgcttcacctaaacgaggaaggagccaaactaacagcacccagccaccatccaacctgtggttcccagggcagctgccaagatgacggagctgctgttggcatcttctacctctgctttacgccttgccttctctctcttacctttgcaccccaccttccttcaaactctcctgcctctttgatcctagaaaayattatcaccctcctgagggcacttataatttaattagtgtatgcacgattcaaggtagaatatcagtcaatgtcacaagcattaagagggaatttgggttcaggtagacaggagaccctgattagtagccctcaaatyaaagaggaggataaaaggcttaggaatggaggtggcaggacttccctggtggtccagtggttaagaatccaccttccagtgccggggacttgagtttgatccctgattggggaagtaagatcccacatgacmcgtggcaactaagccagggcaccacagctc

SEQ ID NO: 2500 - DNA, 600 bp, Bovine  MMBT05767
agtgagcagtccttaaaattgcccttgagaccatttcaggggctccacaaagtcaaaactacggtcataatcacaccaattccttattttcaattctcttacaaatgtgttgtggagccttccagaaattacctgatgtataatgttactatcagtctgatgacccaatgaaatgtatgtttgtaggtttttgtttttaaaatgtattggttttaatatcaaatatggtaaatatcaacagacataatttgctatataagaaagctctttggggtcctcaatgatgtttttacatgtgtwaaggggccctgagacctttaaatgtttggagctactgctttaagttacaagatctgatctggcaactgagatgccagaatatagcaaaatcagaagcaggatattaagtcctaccaaattcaaagctgtgtgagctaattcatttgaaaaggttagtatctaaaagtaaaatcaaaacagcatatataaggaagtgctccaaaactgaccgggtcatatcaccaacatgaaggagctctcactggtcagaaaaggacatctgacttgtgatgttgtgagaaatcagaaatgtcaacagca

SEQ ID NO: 2501 - DNA, 600 bp, Bovine  MMBT07129
aagaaacacacactgtgagttattctgcatattctagtagctgcagttgcctttcatacaagacttctctgatttttaatttctagttttgtaagagccgagaaaagttcacacacagacatagtggctctataatccaccctctgaaaaaattagagttatatatgtaattactttctattactatataaaataataaaataattaactttacaaatcattaattattaaataaataatgctaaagtatcctgatatttcctaaatcaggtcaccacacactaagagggctagttcaayttcacaatctatttagtctttactttctgagattagtaagaattaggctatttagagataagacctcaatattatggccccttgctatgtttttaaacatggttcctctggtgccaagaagaagccatactgtgggtgaaatgtctcaaataagacaatgaaaatcgttgatatggaaagtgcaaaaatctgaaacacttttataatttctttttcattattacaggtctctaaagaaagattttgaaaaattctccagaatatgtgaagataacatgccaaaactgaagcacccaagcc

SEQ ID NO: 2502 - DNA, 600 bp, Bovine  MMBT07167
cacaggactcatgcacatgactctccaaagctttagaaataagataacttgagtggctagcagagtcaaaatctttcttaactatgagaacaaaattcaactgatacttgaacaacactttctacgccatttgcagactaaatttttacaatttaaaaaattatgtaatagctgaaagtagattcaatttcaaaacaagtaagtaggttgtaagtaggtttggaaaagatgactagcctatgctttcacttttgctaccttgtcccaaaggatgcaaataataaagttaagcattaagtraggagaaaactttkggccctgtgtttaatatcattttactgttttgcttaagtctatttttaacagagtactcataaggttggggttttcctaattccaaactctttaacagaaaacagaaaccagttaagaatagaaggctctatttgtcctgcttaaggggaaaaaaaaatacttttgaggaaacagatggtatgtagctaaccctaaccacgaaagagaagtgttgccgaacctcagccttggttcatcaaagttgaatagaaactcggagacagagttttgggtgaagtagaaaag

SEQ ID NO: 2503 - DNA, 600 bp, Bovine  MMBT07533
ttctatgggtaattttgtttccttctttacacctgtttttttttttttttttgacaaacagcaattaagtttaactttaaaaagtatatgctacaggagtcccaagacaattcaatggggaaagaatattcttttcaacaaacggtagtagaacaactcaatctcaccatacaaaacaaagaaactggatccctacctcacatcacacacaaacattaattcaaaatgtagcaaagacctaaatgtaagagctacagttatgaaattcttagaagaaaacacaggtgtaaatcttcattrtcttggatgggaaactgtttctcaaatgacaccaaaagcatgagaagtgaaattttaaaaaaagataaattggacatyatcaaacaaaaaactagtgcttcaagataccatcaagaaagtgaaaagacaactccagaaaatgtctgcaaaatattactgataaaggacttgtatctagactacataaagaactcttacaactcaatgatcaaaagacagacaacccaaktaaaaatggtcaaatgatatgaacagactcttccccagagaygatatacaaacagcaataagcacatgaaa

SEQ ID NO: 2504 - DNA, 600 bp, Bovine  MMBT07813
ggccatttagcatgaatatacaagagtccaaatttatcccaaggagtctgggtccaaaatctgacttttttctccacacctcatagaatctactgctaccctcactgatcctcaatgacccacccactgttatctggaatcctgaacattccacttatctatagtcttgaaaggtcacagattttctagctgccaaacccagtaacctccttcttcattttccttcttgagccccagcaggggccaaccctgcatattgtcccttccttcctgagtctcacttcctagactctggacacygcttcatccacctcccttcccagtcctctggtactctccatcttggctcatttccttctatactcctttgctcatgtatctcatttactctctccaggctgctatggcttttttatacaccaccagtaatccctacttctcgttcctggtcagagctttctccatatataacattctcaccctaaccacctctcaaggattagcagcagctttactcccctttgaaatcctccgcgacagttctcagccatcgctcacaactcttacttttgattgctgttaaacattttctagaaataa

SEQ ID NO: 2505 - DNA, 600 bp, Bovine  MMBT07937
tataatcattggtcttcttttctatttgtggggagagatgaccaaaagctttgcggttacctactctgaagtgaaatattgtgtcccttcccagattatacccaggaatatcacttgggggctatgggcatgtattctgtctgtgttaatggcctagctgtgttgctgcatgtgggtcaacagcatgctgagactctattgggcaggactcttgtctgggcccaccagaaggccaatatggtagaaggccaatgctccttcaaggaataggagcataccacacccactgatggaaggtastgaagagtttaagtaaccttgtggagggacattaaagatctaccactcaccaggtggtgctagtggtaaaaaataaaaacaaaacctctctgccaatgcaggaaacttaagagatgtgggtttgatccctgggtcgggaagatccgctggaggaggaaatggcaacccactccagaattcttgcctggagaatcccatgaacagaggagcctggtgagctacagtccatgggatcgaaaagagtcagacatgactgaagtatgactgaagtgatggcacacacgtacacatgcgactcat

SEQ ID NO: 2506 - DNA, 600 bp, Bovine  MMBT07990
cggggaagcctagggagggagggctgaagcagatgcttgtcctcctggctggccaaccttggttgtgcagacctaggtaccagaccgaaattgtgcttagtaagtgtcccacaatgtgctaaagacattctgttcatcgtctccctcaatttgctgggtttgagccaacataccagttacacaccaagctttggagaaaggaaagatctggtgttaagttccaactctgtcattgctagttgtgaattttaggtctgtggcttaacctcttagatgacactcttaaccagagacgaccaytctctcattgatcaaatgcagataacgatggcacgaactcacaagaccgttatggagatactgctatggcatggtgcctgtaaagttcccaagacctgcacagaatgaatccccttcgttattatttctgttaacaatcctgccatgtcagcgttttggatctcataaaagaaatgagagtcaaagagccgaaatgaaaaaaagctagtaagtggcagaatcaggatttaaacaagacagatgtgtctgaatcaaaagcctgtgctctgactgcagaattcagcttggagctcctgatca

SEQ ID NO: 2507 - DNA, 600 bp, Bovine  MMBT07996
tataagtacctactgtgtaccagacatcatgctagcatgtagccacttggaaaaatttttwaatgttttagaatgttaatgcttataaaacatggaaatgttcatttatcttttcatacggttgtcagaatataacaagaagtaattgaagataaattcagagtccctcttcccatgcaatgcaaggaaattctagtttgtatattacaagttgacagtatcatttttcatatggtttgcagatgactggctcataagattaaaaataagtctagtcccttctgatcttaaaacaaatcrtgttccccattattaatagaagatttacccacaagcagaaacaattgtattagcaattgtttctgagaaccaataatttatagatgaactagttacagcaagatgatttcatgtcttcagttaataagcatcttgattgaggtccagctaagctgcttcttcaaattctccttaatagacaaatattgtgatgagattctgttgttgttattctactaacaggaaaaaacaactaacttgtcaaattgtggatgtcatctatttaaaaagacgttgttaggatggtgcagcagacactca

SEQ ID NO: 2508 - DNA, 600 bp, Bovine  MMBT07998
tttgtcaaaaatttcaagatctatgttagaaatayccagtattatctcamaccaaatctggctatttcaaatgtattrgaacttggckctgggattttaaaatgtcctgggtccctcctcccttctttccttgcctccttctttcctccctctcttccttccatttattcttcctttttccatttttatagccttatggtgctccttacttatatctagggcaacatttcagcagaagaaagtactttaggaagcaaagtgctaccatgtcacgtggcckcattgagataaagagatgtrtttgccagtcwtgatgctgtaagtcatttggactcatacagcctccatcaagatgtttgtgcctcagctgttgatgcagatataaagattatccctttaatttttaacatagtcaaagttaatatgtactgtttccttttcaatgctgttaatgttaatacaaaccttttaatttttaacattttaagagttaatataaactccattaatgcttcttagctgatcacaggaaggatcatcaagcactagttgtatcgataatttttttctgtagttaattttttggtgatgatattgtca

SEQ ID NO: 2509 - DNA, 600 bp, Bovine  MMBT08132
cctgtgctcacagtcagggtcacgttgcactgggcgctgcccacctcattgtgggccctgcagatatacactccagacatggaagtggacaggtttttgaggcttaaagacccgtggatggcatctgtggacacaatttggccatcagtccaaggatcgatcccctttcccataaaaaatcaccctgcccttcctctggaatgtctattttgactctctgagagccttagctatctgaatccctgatgaaaggtgaaggtgtgacgatcagttgccaaactgctagctcactaccctttyccatttccactgctcagtgttcccaagtgatatctgaaagaaggctaaagaggaagtgatgcccagaaaaaccaaaacctgattttcacttttatttctgagtagtgagagagaaaaaacactgagcaaggaattagaaaacgtggcatccagaacaggccatgggactttaagaaagctatttactatctctgggtcccaatttattcatctataaaatggggtgatatgacctaattgatggtgttgaaaggaatgtatgaaataatctaatgattttaacagttaaagtttgttggc

SEQ ID NO: 2510 - DNA, 600 bp, Bovine  MMBT08169
tatgggtgttacacagacgggcagaagtggtggtgggatgactaaagccccagcactgtacggaaggttgacgccgcgttcctcttacaggtgaacaatgactttattctggcactggagagagatgcgtttgtggagcaagtgcgggagatcattgagaaagctgacgagatgctcagtgaggatgtcagcgtggagccagagggtgaccagagcttggagagtctccatggcaaggatgactatggcttctcaggcacccaggtaggttcatcattcccatggtgaagctctgtttayggtaaaagtatgctgaatttgccttgcggagtctgagccgtctagtctgacactttgcgagcgtccagtgataccacatcacacctgtaactgcgacgatcagcatttatattctctttgcatgtggccatttgctttgcttgatcattaagattgagttagagaacacatttaatcccttttgtttgttgtagaaattggaaggagagttcaaacaaccaattcctgcatcttccttgccacaacagataggtgaatttcttttctttttattgtttattctaaccttttacctaagaa

SEQ ID NO: 2511 - DNA, 600 bp, Bovine  MMBT08618
tacagatacgtgaaatcacttctttttctttctattaattatcagcacaattccgtatttcaacattcccttttatgctgggtrtccagaaatggcaccgcaccaggacttgcrttaaaggataacatttaatattttgatgcatcaaaatggtctggtcaaagatcatttctttttatacgtgagtaatgtgtatcccactcctccccttctggaactttctctatcccttggagtggtgactagggtctgaattttaaggatgaggtataggatggtggagattttggaaggggtgasattatctgcttcttcattctttaaaaaaagaactaatagctgacttttttttttaacatgacaaaatagtctctcatcagaataattgtatcaaaatggcaatgtcaaatatcatgccctctactttgctgattgtaggttcttgatctctacttgttattatggctgttaatttaacctgaaactgaaatttagtaaggcttccagagagaaggtaaccaaatggcagatatttctggcactatggaaatgcatgctgctgctgctgctaagtcacttcagtcgtgtccaactctgtgt

SEQ ID NO: 2512 - DNA, 600 bp, Bovine  MMBT08620
ggtgtacagcaaactcagtcagttatacaaataaatacagccactctttttcagattttatccccatataggtcattattgggggaatcttaagttaaattccaagtgacacattctactttgttcaatgtcatagatatacaaattactttaattcaaataaccttccaaagtcactataacctctgaacttcctttattaactgctgaccatcttttccaatcctcttgtataaattaataatttaatacccagaaggcactaactcaggttcctgagattatacgtagaacaaaatmcatggaataagcaacacacagaaaaccctccaattttaagcacatgctgctataaagttcagttagtgtttgtcagaccatgctaaatattcggctttctctccccaactatcacttcataggcttcaaggagaaaaagcacaaactttgcgtaaacacaggcagctttctactataaaataactatgtaagacatggcttagcatctttaagaactacaaattaccaaattgagattgccacagataagctaccacttaaaggtattataatgggtcttcctttttttgatggtgggtc

SEQ ID NO: 2513 - DNA, 536 bp, Bovine  MMBT09042
accaggctcctctgtccttgggatttcccaggcaggaatactggaataggttgccatttccttctccaggggatctgtctgacccagggatcaaacccttgtcttctgaattgacaagcagattctttacctctgagtcaccggggaagcccatttatattattaaatataaataaatgaagagcgcagagttttacagtaaaatttacaaatcttatccacacgggggaaaaaagagtctggaaagaaatatgtcatattgtcatggctttaggtgatttccttctctctctctttacrtggattataatattaaattatggtataacatagcttgtatcttgaggttcagttttattttcagtacatttaagtgaatcctgagccttacatattgcaatgatttgaactgaaatgcccgtgctctctttttttaggatgacagaaactttgctgaaagctcccatgcttatgggttagatcagtcatcttgttggcaggatcacagtcgcttcctgtctagtccacgattttcc

SEQ ID NO: 2514 - DNA, 415 bp, Bovine  MMBT09096
acatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctgcagctggtctcagattcaaatttaagttcacgatgtagcagtgtagatagccttggggagatcgtgttgcatataaagtgacaagcctaatwctgttccttttgccagctttcccagggtagtaaggcaggtcctgtttgtacttcatgcgtaaacctactctccaaataaactcgaattttagctgtaatgttgctaaaatccagt

SEQ ID NO: 2515 - DNA, 600 bp, Bovine  MMBT09106
aatttgccttgattcatggacctgacattccaggttcctatgcaatattgctctttacagcatcagaccttgcttctatcaccagtcacatccacagctgggtattgtttttgctttggctccatcccttcattctttctggagttatttctccactgatctccagtagcatattgggcacctactgacctggggagtttctctttcagtatcctatcattttgccttttcatactgtgctgcaagtaagctataaacaggcgttatttttctatatccttttcaccctgtagcacagtyctgcaaagaaagagagggaccatctaatattacagcagagaaccccaaggcctggggaggccagaaagtgcggtgacgagcttgggtttctgtagccaggctacttaggctggatctcagctctccggtttatgaggggtgaggcaaccagggatgctctgtggcctctctgagctcagctgcctcgactgtgaaataaatggcgatcacaacagcacccacttacctagaagactggggcttccctggtggctcagtgggtaaagaacccgcctgccaatgcaggagatataggttcaa

SEQ ID NO: 2516 - DNA, 600 bp, Bovine  MMBT09193
atcaagagtttacattcttctccaaatgatatctgaagaccacttccctgtttgaacgaaggcattagaagaggagttaaaaataagtactatacacatcaagttttaccacattttaattagtaaaacaaaataaaatgaaaataggcttagccatgtctcaacagaactaaataattttatatgaaaaaatgccatccaccataacatatttccaataattctgacaaatatctgtcacaacattttgcaaaattctaaggaaaattacaaattggagatttactctaaacatgcagmgctatctgactayaatttgtgcgcaaaacaccctgaagactttacttgaccaagatgttgatgttggacgtcagagttcttccctccacacctctaagatgccagcatagcacctccactgcggcttactgccaacacagaccacactacagagaaaccaggcacaaagagaatyaaaagaagatgtttgtggtaacatcaatryartttcttatttatgtgcacaaagcatcaaagtctatcagtgttaaaaagcaagaaaacagaatttggaattagtccaacccaaatgaggcatct

SEQ ID NO: 2517 - DNA, 600 bp, Bovine  MMBT09470
caatgcaatttactggcaatgtaccaggtaaactacaactgcaaatctagcaaaagaaatttgatttcccagtgtcaatgaaagtcatcctgggaaactgttggaatgtgggagggttagaccagctgatgattgccacttctgaagaaaatgatctaactgataaaggactcaaacattttttttttcaccctgagaccttacctgactccctatttgtcaggcaacgtgccaggtactatggttacaaccaagaataagaaaaactaactgcctgcctcaatcttatcctctttagartatgattgacaataaacatgtacaactcagtaatttcatatattaataagcattatgagaaaaaaataagctagataaagacaatgataaatgagattctaaagttggctacagaataatagtaattttctgacaagggtactctgtaaactccatgttaagagagtatgcccaggggcagaacggctgtcttgattactagagtgggtctcctgcagccatgactgcattacatgagtctgtcccactggccacagctgactggaccagaggtagacagctgacccaagctaggccaat

SEQ ID NO: 2518 - DNA, 600 bp, Bovine  MMBT10547
atctgcttcaaaatatctgacatttgagaaatgtttacaagtagtttggtgtttccctttgaattcaaaggcatctttaattagttctaagttaggacatccccagctaccacactgatttcattagtataagtctctctagttcaaagacaagaaggacttgacacaggattttcatacccctgtttacataactgtcacagaggaatcagagaacacccagcagtgttacacaaagattcagacaccgcttggaagagtttgctttggagagtgacaggagaacatccctgagataascggtaggtgtctatgattttatgaatacctatcttacctttcttctcctaaataagaatatatcatcaattaaggaggagaaacctgagcccagcctacaactgacgctccatctcatcacggagggcccctgcggttacctctctgccaggacttccaaggggcttgtccccagagaccagctacgcaccatccaggctgagtccatagcagccagaaagccccgggctattcctgttcccattggccaaaaaggctagaaggagatagaaaacagagaattaattaccttttaataga

SEQ ID NO: 2519 - DNA, 600 bp, Bovine  MMBT11204
gaagaaaaatatgattctacatgtcttcaaatgctctaaattcaatctcaaagcaagattttccctttactacagaggctttctcaaatgatacttttattgctttagctatttctattccaatgtgaaaattcacaaatttatgaaatactgtaaattctggaggtgtgactctccttctagttttctacttgaaagagactatgaatatcactctaaaaatatcttgtacccaatgcctactgaagttttgctgattttagggggtacactaactgtctagattaaacattattgaamgagacttcctaattattcggaagcttctctctctgtacaatattgactcattttgttatgtacctaaaaataatataatgctataggtcaatcgcacgtgtgctgtgctgtgcttaatcacttagtcatgtccaactttttgcaacactatgaactgcagtccgccaggttcctctgcccatggggattgtccggcaagaatacttggagtgggtagcctttccctcctccaggggatctgcccaacccagggatcaaacacaggtctctcacattgcaggcagattttttaccaactga

SEQ ID NO: 2520 - DNA, 600 bp, Bovine  MMBT11383
aggatggtgctgctgctgctgctaagttgcttcagtcatgtccaactctgtgcgaccccatagacggcagcccacgaggctcccccgtccctgggattctccaggcaagaacactgaagtgrgttgccatttccttctccaatgtggctatcctaaactcccaggkgttatataaaatactgagtgggatccttaggggaggaaartaggtcctctctgggatctttctatagcagccccacactaggtaacctgagttactttagttcttagtacactacccatgggtctcacttctgraaatgctaaaagcccatctacatatgtgtttgcatcctgctgcccctcagcacgtggggctggtgatgcctccaagactgcagcagtgactgcctcccttcacgggcagcrgcctcccacccccttctgctgcctggtccttcacttggactggagcagacctgctccttctctttcttctgaattaacttccttacctgaaaaatcttctggatccccttccatccccacaccagatggggtctctagtctcctcccgcttagctcttccatgtcactgtcctgctggctttcctcccc

SEQ ID NO: 2521 - DNA, 600 bp, Bovine  MMBT11891
atttttctatctttgatgaatactgcagtgataaaagaggtaagataattttgtttttaaaaatcttggtcttagaaaacctaaattttgaatgattcaagactctgaagtagaaatttaccaaacagtccctagtagttaacactcgaccagaaatgaatacttattggccaaccgcaacatgatgcttttgacataagcattaatcctatataacctgatgctccccaagtacttttcatctttttttaagcctccagaagatgtgcaatcaggccacttactgagacctcagtctaycctggacaatcaacaagttagctccatttaaagggtttaaacctgctgccagtcagtgtaacttatagaattggacatggaaatttaaagacaggcatcttcaagagcagtgattctcagtgtgggctgcccattagaacctgggaagttttcaaaatcctctacaggtcccaaggctgcctggacaaataaactagcacaacctgggcatcagtagtcttagagctcatagaatcttagggaaattcgatgtgcagccagttaaaatacttctgtttcaggttacagaacactctgatc

SEQ ID NO: 2522 - DNA, 600 bp, Bovine  MMBT12140
tcaaatcatgtcattaatataaaagaaaaacatccatatttgctctttggaaagacaaatgcagaggttaataacacccgggttgcctgctcctgagagcatctgcatcactaggacagtttgataatgagattttgtataaaagaaatggacattttttgagagaagtcatgatgtaaagtgtattcttagtaagacatataagagaagctgaaataaaatccttgtaaatttcagtggtgagactatttccagaattagagctctctaattaatgattttttggaacttgttttaatygaagtcctcatatgtcaactcataattttactgggacytataatttgcaaagtgcttttaaaatttacyckcctccccccaaatcctatataataaacaactaatttcttctgagataatttattcttagctcaggctaagaatgctgcttaaagttttatgaaacatctacaaacataacagatcatgcycattttcttagcttttattcttactttgttcccttggcctcaaatccataatttcctgagggcatttcagtgcactttaccttagagaaaaactagttaactacgtcct

SEQ ID NO: 2523 - DNA, 600 bp, Bovine  MMBT12312
ggcctatcacaaagcagtcatccttgaacaatccagagttctgaatctgatgacctacactttcttggtttactcttttattttgctggagtgcatcccccagtagcatctggagcaacggtaaaaagaagataaacattttgatactatgcatgcctaaatatatctaagttaaaaatttgttttctaattctgaattttgacaacaattatccattgtcttctagcatccattgttgctgagaaatttaatactgtttaatttccaattttttgtatgtgatcttcctttgaaagctyctagaatcatatctcrttgcattctgaaatttcaagttcatatgtacttgagttgctattttaaaaatttattataatgggcactcaatgtggtcttttttttttcttaaaaaatgagatataattgacamataacattatattagttatattaagtatacaacataaggattccatatctgtataktcaatatactcttaaactggagacttgggctttatttctggtaaatgttcttgtgctgttttcttgataattttgttccatttaactcttggttaaatgttgaacttcctggc

SEQ ID NO: 2524 - DNA, 600 bp, Bovine  MMBT13345
ctcagttcagcttacaactattttatctccgaatttaaatctgttaagtggctacagatacttctgaaagaagcagaaaagataccatgcaccgttctctacctgaatgaaaatgatacaagcttattataggaaaaaaggaaacaagatcatctgtagccctccatcaatacatagccactgctgatgtttctgtacatgttctttcagtcacgtttttgtataagtattttatgtgctgatgatcattttacatatatgattttgtagaatataaatattacatgaataaagtaaatstaatgttaataaaatcactgactataaagtcatgccaaatgtaaagtgggcatccattagataaagatgccccaaattctgcataaacaccagataggaatctgggaaccaagcagacataggctgagtaaggcacaaagcactgaggagaacaaggcagaagaaaatgttccatcaacggccccaaatggggagaatacacaaaatatcagttcagatcaaagtgatcacaaatagtcactctactatctttgcaactcttgacaaatttaaaatgacttaaaattacaaataatttcc

SEQ ID NO: 2525 - DNA, 600 bp, Bovine  MMBT13387
tgtttttggctgtgtcacatgtcttgcggaggtctcagttccctgaccagagatcgaacccgggccatggaagtgaaagcccagagtcctaatcactaggccaccagggaactccctacgcttcttttacttgcctctggtgggactctggacccagcctaatgccattgcttctctcaagattcaagttctgaggaagaaaagaaacctccagctaaggcagtcatcgccaaggcagctactaaagcagctccagcaaagaaggcagcagagagctcttcagacagctcgggtaaggayggtgtagcgtaggaggccctcagggcgatggtagctccaagggccccctttagcctgattcggggacctattcactctaacctccctgtctagactccgacagttctgaggatgaagctcctgccaagccagctggtaccaccaagaatccctcaagtaaaccagcmgccactcccaagcagcctgcagctaagttagcygccactcccaagcaggctgcgggcagtgtccagaagcctctaaccagaaaggctgacagcagctccagtgaggaggagagcagttctagtgacgaggagg

SEQ ID NO: 2526 - DNA, 600 bp, Bovine  MMBT13697
ttaaaaataaatttacttaaaaccatttcggagagctttgtgttaacaggggttgaaaaytatatatttaaatattttaaacaaaacaccttaatactttgtaatcaggaagccataaccaaggaaagtgttttttaattcatttgatgtaacatataaacaacagccaaataagaaagtttcagcagagtgtttcaggtcattactttcataggttttaagacaagtacctaaagtgatagttagcattcctagcttatttgtttatgcaatgagagccattaatcattccatttgcgyccaagtattygcaattgaatctagaactagagtgctcatagagtatatacttgaagactgaccctgtggaatttcttttcttactttaacaaacaattcagttcagttcaaacatttagtgaatactcattagttactaggaatacaaattctttaggaataagctttggttatttgcctattgaactygaatataaaatgaatgtcaagattcaaatacttacacgactgagaaatgttacaaaattagaaagtcaccattattcatattctgaaagtagttttcttccactgacactc

SEQ ID NO: 2527 - DNA, 600 bp, Bovine  MMBT13736
aaaatatctcataggatccagtaacttaattttctaaacttgtaaatttttatcataatgtagggaacgatgattatggggaaagaaacttatgaagaatgtgagattctcatgtgaaacatttatagccacaatattatgtatacgatctacagcaagcaattgtttcccagggcctctgttgacttatttttataatatctgattgccctttgtggtagccaatctcctcgatgacacccaagtgatcttcatctatttgtatttgtactcatatgtagtcccctcttacattatacytgggcaggtctgtgaatagcagcatacagtagaattaatggtgtatcatgtctgaggttaggttataaaaaatactgtggtttctgggcttctgttttgaatgacttcttatccttcttcckctttctcttctttttcatctctccctctctcttatcctctttctttctcctggaataagccagttgccatgaactctgattctgcctrtagagagactcacatggcaagagactgaagtctctggccaacagtcagaagtgaagcctgccaataaccatgtgattgaacttcaaatta

SEQ ID NO: 2528 - DNA, 600 bp, Bovine  MMBT14387
gtcaaaaaatattctccaagtcagttgtaatagattcctgccctgtagcacagccccagctgccgggatgctccagtcacagaaaggtaygaaccaacagcttccttcctggtccctgtgctctagctttggcctgaaaatctgtgtagaattggctttgctgctgctcactagggtaccttcaggcctggaccttgggggtattgtgactcccaaatatggtccctttttactaagctcttatcaaggtttgtatcttcaataggtacctttttaagctctgctgctgctgctaagtcrcttcagtcgtgtccgactctgtgcgaccccatagacagcagctgttaatatacatttttttgacatattgcaatttgcagttttgtagtttgtagttacaatatttaattctaataataaatgtgcatgtgagatgagtacctgagataactttttccatattcattttaaagaagtttttcactaattaatttgcttttctggatggataatatacattcacgtggtttataattcaaaaagtgccaaagagtatatacaagaataagtttctttatatccttgtagaaataaaaaatc

SEQ ID NO: 2529 - DNA, 598 bp, Bovine  MMBT14598
  misc_feature (1)..(65): n is any nucleotide
nnnnnnnnnnnnnnnnnnnnnnnnnnnnnnnnnnnnnnnnnnnnnnnnnnnnnnnnnnnnnnnnnaagttctgaaatgatgccttatattctctgaataaaagataactgccttcagggtaaataatatgcctgcacttgcagctctcttcctaccttaaaccatcactataatggcccaaggctctgcttctcatcactacacaggaagagagaacaaggtgtggcttacaaagctggtagccctaggyacatgtcactttacttttttgccttctcttttttcttccatttagagtcwtctgtgccaactctcagattggtaaacagagggtggggctaaaggtcgaaaggtgacagatctcaatctgaactcactagcttaatcagctgcatttcttcattttaatcaggaaatcctggagtgaccsagtcagcaagagcacttgtggggcgacaaagaagggagggaggggaaggagaagagggaggagtcctgtatcgaggaagggaggggcgcctctctcttttctgggctcaaaatggatcttcctttctttagaccacatgttcaatctctgacaaatttttttcctttg

SEQ ID NO: 2530 - DNA, 600 bp, Bovine  MMBT16469
gcctttttcctgatacaggtgtaaattcctggtactgatcttgcacttcagtcatgactaggattattttttggctcaaaatggaacaaagcagggaggagaaggtagaagggagggagaaggagatcttttcctaaggtagtttggagagaattggaaataaagaaaagagacaggcctaggatgttctgtgaaaatacagtttatagtggaaagtgattcctctkaggaatataggagaacagcatctctttggtgggaaagaaagaaaggaggcagtagaaaagggtgaaaccaagycaggtgggagagtgagtgccctcgtgttttagaaacagggtacagagaccttgtgcagatcaagaatgagaatcytgttaccaatctcagtttgaatgtttccacattgactgttctgagcccagaatgcctttatagtgactgtatccttctgccataggaaatatcaatctgatgaaaattatatataatataaaattatcctaaggaaattaagcccagatgtggatattggaagatattaattggtcagaaatcgaaaccataggctggcacattttgggggctagagagaggact

SEQ ID NO: 2531 - DNA, 601 bp, Bovine  MMBT16524
  misc_feature (1)..(1): n is any nucleotide
nggttggttatttagagcatgcgtgaatgttcaattgtatctgactttgcaacccccaccaggctcctccgtccatggaatttcccaggtaagagtgctggagtgggtggccatttccttcttgagggaatcttcccaacccaggcatcaaacctgtgtctcctgcattggcaagcgaattctttaccaactgtgccacctgggaagcccctggatatttagttcagagggagaaaaatgtctgtgcaaatgagcagtaaatccacaagcctctctggcataagaatttgagagtaggaayttcacatctccttcctgaggggygacactgaccttctaaatattaccaatgaaatgccagcctctttgatgttttcctgcttataccaacagtacaggttttcagaacaaaagctgtttgcggcttctcagtggaaggatttcaaagttgggcttccccagtggttggggaagcctatacagggctgtgacataataatgaaactttgtttctgtaggttcatgtgatgtctgagggagctcagacctagactgctcacttgttagaacttcgcttctaggtggaataggacacatcatt

SEQ ID NO: 2532 - DNA, 600 bp, Bovine  MMBT17401
ccaccataagagccactgaatactgaatcccagaggtgactcctacaggactggtaaccagggtttcccgctacctagaggagtgacaaggcatctttctgtactctgtacttaagtctgaaaataagtactatgttacttggcccataattactcttttattaacaatctggacttgttatcaatagtaaaatcaagagactgatgactgatcaactatacttcaataatatatatttttagtttggagtctaaatgtaaaaaaaaaaaatcaaatttctacctttctgtttgaacaaygggaagatctggccacacctggcttgcatttccagaggacaacctcatgccaccgagcagagctgtcccctgcaggccaggcactgcctctctggtttgccttatccccccatcactccctgattaatatcccaacccatttcacttattacgtatagctctacagtcttccaccctattacttctgaaacctgaaaacaacaaacgtggagacacagcaacaatatccataagctaatacaaataatattattattgtttcatgacccagaagtatccctgatccatgtaatcagaggc

SEQ ID NO: 2533 - DNA, 539 bp, Bovine  MMBT17579
agggttttctctctttcccagggctcccagtgagctgctgtagcttgcagagtcagagggaagaatcaggctgcatgtaaatacttaaccccatcagagaggtgtcactgagccgtaaatagtgctgcaggcaacggccatgcatcactgattcacacttgtcacacccctcattttctgaaatctagttccctgcccatctctctctctcggtacaggagatccattgccatgagctattttggagtctacttaaatactgtgatttctacactaatattcttttgaggctttaaaatrcacattgtaattttaaataaagatattttactttgactatttttgtaatttgcagaagttttaaaatgattatctaaatgtaactgttctgggacttccctggcagtccagtggttaagaatccgcctgccagtgyggggacacagatttgatccctagtccagaaactaggatcccacatgccacacagcaagtaagcccattcgccataactactgagcccaagctctagagcctga

SEQ ID NO: 2534 - DNA, 598 bp, Bovine  MMBT18409
  misc_feature (1)..(47): n is any nucleotide
nnnnnnnnnnnnnnnnnnnnnnnnnnnnnnnnnnnnnnnnnnnnnnnctttaaaaaataaaattaaaaaaaattaatacagttttacattaattttgaatagttcttaaaatgtattaaattttaaaattttacaaatagtgcttttgaatattacatatttaatctgatgagctctacattgaagctaaaacaatgacattatgtatgatcttatataaataaaaaactgaggaaagaaatttaaataattgtactaataggtggatatcccatgtctcaagccagcttatatggtaayggtctattccaaagctttataaacttcagtgacacactcagcagtttttaatgattctcactaaaatattattttcaagataaatcttcatattaaacacaatattctgtcctctgtttccctgtcctcttttcaggtttagattaattttgagatagagtctgagggtggattagatagtaatctagtataagctatttagaatggcacaggctttgattattataaatattcttttaaaaaactatattattgttagcaacaaaatcacaatgctgcttctatatttagaaaccag

SEQ ID NO: 2535 - DNA, 600 bp, Bovine  MMBT18647
gggcaccctctgactcttagattgtgcccctagaatgacgtgggtggcgaaaagttgctgcagaagaagtggaccaccttcctaaaggcccagctgctttgcacccagccggaacaacttcccttcaacgttatccgtcacgctgtcctgctggcagacaattcctccaccgatccccaggtctacgcagtctttacctctcagtggtgagcaactaggcgagagcgtgggggttggaagtgggatttggggtcagctccctggccsgccagggagggtaggaactgatgtgagcgaagyacaaactccacacttcacatatgaagacatttgatcatcaccatctcccaggartttgactcacgcccttaatgtagggctcaatgtagatagggaaaataaagctcagaaaggttcttattagtttatgtcctgcctggttccaaaaaggataggaggcagcttacaaaaggcaaacgttaaaataaaataaacctatgaggaaatggaaataaaaggagaatgagagaacccagggatggagtcygcacattacagatgattatcacttatacagttggggatgctgggacacctgta

SEQ ID NO: 2536 - DNA, 589 bp, Bovine  MMBT18778
trtctgagacttgtcaaatgcttcaagaacctgattcacagtcatttccaaaaacctaagggagaatgtgtttttatgtatatgtttatagcytgtttcccagagatatggaagcagcagacacctgtcaagaatttccagtgaagcatttttgttaccagcgacttgagaatagcagccttaaccccatctaatccattgggcccacagcgagtgacttgcccagagtttacagagcaacttagtggtaaaattaggatgagagcttctagttgcatatcccaagcctcatactctgcytccttctgataacattcagatgagctctctgaaatcaaagcattttaactgaatctatcataaattaagcatctgtagttgaatctttgtctctctcaaagtccttactcatatcatgatttattccagaacccaggataactgtaaggcagaacaaaagggtatatgtcttaagagtttggtagggggtgggggtgggggtgggggaatatgctaatttcatttgttttaaaatatgaatgaaatgcaaatacaagtcagcaactaagcaactaaggtcacaagatca

SEQ ID NO: 2537 - DNA, 600 bp, Bovine  MMBT18983
taccagcacaagrgatatacggccaaggtgaaaagtatagatctgccttaatttcttggaaagcccttgaaacgtaggttcagattcyagagacttcacatgagtctgccttccccaccctcaaggatccgagttgcacttgctccttcttggtcttactcygtgccctcttgcagagttcatatacagagcctataattaggcgttcaccacgcttgaaagcatatgttttccacaaccataccactaacctcagaaaacatactctacataaatagacaaaaggccacgaagaaagayttgtttttaagttttagataatttctatcacagtcaaggaatactgttagcagagactttttttggtaagaaatttaattactgcatttaaaattcacataaagcactgtactaaagagtaaagatctgcatagaaaaacatgttgaattaaaaaaggactgtacccacatgtattagagttatagcatcttaaatcagaaagagattgctctatggaaaagaaaagtacaaatacaatacttcaagctgcagtgtcatatttatttttgtaaaaggaagtacaacatttacttattcct

SEQ ID NO: 2538 - DNA, 511 bp, Bovine  MMBT18991
tttgcttttctcttttcagtagctgttgccaatgcagttcctctgtttactgagttgtagctttatagacaagaatgcaggaagtctctatagtattctgatgataggttagtcrtcaggcttattatagtccctaaatccagcaaggagagcagagagaagcctggatgatgaagtcactaggggaagaaaatggtatggaagaaatgataagatattcagaaggctgctcaaatgctgcctcctaataaattgtcaattcctcccaaagagagtgmtgtctttttatgctgatgtgcmttatgtgcagagcttatattccttactcccgtgtgcacgtttgtcttcataggtcataagaaaggaaaattgtctcacgtttgacatctccattcgattttactactttagcatcttgatggcttttaaataaaaatggggaaaggattatagttggcagcaaagtgaatttcagggacagctagaaaataggagggaagacagcctctta

SEQ ID NO: 2539 - DNA, 600 bp, Bovine  MMBT19028
attcctgacggctcagtccatggggtcccaaagagtcgacacgactgagcaactaacacttatcagacatatatccccaccctcttgagcctacccgccaccacccctccatcccaccctcaaggttatcacagagcaaaaagctgagctgcctgtgttatatagaaggttcccactagctagctattttacatatggttgtgtatatatgttaatcccactctcccaatttgttccactcctcccttccccacaccgtgtcaacaaaaccattctctatgtctaygtttytattcctgmcctgcargaagatgtggtacaaatayacgatagaatattactcagccataaaaagaaacaaaattggatcatttacagagatgtggatggatatagagtctgtcatacaaagtgaagtaaatcagaargagtaaaatgagtgttgtgtattaatgcatatgyggaatctagaaaaatagtacagatgaacatatttgaattccatatctaactggtagttttgacatcttccctgcaccaaactatttctccttgtccactgtctctgtatctaaaaatacacaattttctcttcctctt

SEQ ID NO: 2540 - DNA, 600 bp, Bovine  MMBT19759
gcttttaaggttgactttttgactctgaaaagaatttttaatggcaacataagtaaggctgaagcttagaatctgcctctttcaaggtctccaaatagtcacagaaagaaaattttcagctctaaatgtggcccttattataaaatgcatcatttatactacaaaaatcattttacatacatacaaaaaagattaactagttaaartggagacaaaatattggctaaggttttaaaatttcttataaaaataatttattaaaattggactacagaagacagaaaacatttcacaacttcrtattgctcattgttgccctgaagacatcatgaaacatacgcaggtccacagcatgggcttgggcacaatataragaaagctaaagaaacacaaccctttccaaccaaagactagagttgtaactagtggacttgtgaagctctatcacccagtgtccccaggagtcttccttttttagtggaacctgtaactaactttaaaacttgtcaaaatggaaagagtggccagcaagacgytgcttcaggtagtgtaacttcttcacattggtatttcattttattgactggttcattactggtt

SEQ ID NO: 2541 - DNA, 600 bp, Bovine  MMBT20815
ggcccttctcattagaaaagcctagggtttcaacatcagtgagcttctggagatttttttttgtatgttattgtcatgttgctagcttttctaactgtggaatatatatctctgatttacaatccttgtggaaggagggtaactaaggaaatgtcttttctctgtcattctgctcctggctttctaatccaggggatatctctctattttgctgctctgcctccatcttttggaaggcagctgccttgctttatataaaggcctgcaaagtcccagggggatttctctcagccaagtccrtgctctgactctgatgtattgtccctgagcacattgtcaagtcctatagaaagggttggcagttggagcgagacttactctgtcgctggagtttctcagaattctaatctatcaagccagcccatgcacatacattaaaagtacattaaattttctgtggatttctctatttttcccctatgggttttttttgttgttgttgctttgccrtgactgaaagtcattgtgtaggagtraaaatatcttctaagaggagcttgtcacttgctagagtttaattcatttagattctttgcattc

SEQ ID NO: 2542 - DNA, 600 bp, Bovine  MMBT21044
caaacagctgtgctttatctccctggccagctcagtgctaatggccttgatggccacgtccctcccwatgtcctcctggcctcctgttggctgtggccaatttgctcgtgatttaccactcyggggcgctgacccgtgagggagacacacgggacagaaggaggcagagcggacgtcatgcctgatgcgtgtgcacrcgtgcrtgtccgggcgcaagggtggggaggcgtctctccaggaaygcgctacccagccaggctctctaggactgggagcagggtctggcacccccaccctttmgctatcccatgctgattatggcactaggcactgtgctagagagaggaaggccaagggagaccttgagggctgccaggagccacaggctggaagtcaggcccaggagcagccctctcacaatggtctggagccttctgggtcctctgagaatccaggcatgcgcacaggacacacctcccagccgtgaacacatccacggccctgcccctgaccacagtcaacagaggcagcacaagcgtggtggggccctggaggtgcacccgctgggttcacatcccagctcagcaactgacaaccttt

SEQ ID NO: 2543 - DNA, 600 bp, Bovine  MMBT21379
aaccattcctttagtagaatggctttactgtatagatacttaaaagtttgtataaattgtatgtatcacacttaaccgtcacattgagaacaaaaaaaaaactagattaaacaaatctatttgaaggtgctgaagaattattaagatagatagggttcaaatggataagctgttgtagcctgaaattctttctttccacttcgaggcattagttgcattttgagtagtgctaactgagagtacaacagacttagcagaaagaggctaagaagctgagcacagcctctcackgggctgggraggcaaaatttggccagctaaggagagatggtctcagaaaacactctagatggatagttttcaaagtatgggccccaggccggcagtatcagcaatgcctgaggatttgttagaaatgcatattttggggccaggttggatacatgctaaaatatgcaaactactacctaggttttcagttggagcccatgaaagaccacagcctagaaatatgggcaaagaaaaatgagatcagaccacgtgaaagcttctcgtcagttcgttaccaggctagattgaggcagtgtgtcctttctctgt

SEQ ID NO: 2544 - DNA, 600 bp, Bovine  MMBT21394
agtagatatgcctgttaccagctggtgaaattgaggctccttagttgtgagttgtccaaagttccataaatgataagtggaagaacgggaatttaaagggctaagtccttttactaaagagcatttttttctcataggcagtgcattacataaaggaaggattcaaatgtttgtgaatgtaatcaggaaaacagtggaataaaaggtgtaagtgattttctcacgcttagtgtcaaaaagcagttgagaatgagatccaggataaataacttaagttctaaaatatcccaaccttttctktttcaattggttaatattgctaggtaattggatggaattgaagagttgataaaatgaatagcaaactgaagaagggcggctttcagaatggcaactcaacgataattttgaagaagcaaatgaatagttactgaatgctagtagttttctaaacttaagtgctaggatttgtaatttcttcacattttgtgtgattatctatttgttgcaatagaaattggcatcaatgaatagaaacttaaattatctcatttgtgcaagtcagtattcagagactgtttatataaataaatgaaaatg

SEQ ID NO: 2545 - DNA, 600 bp, Bovine  MMBT21498
agacttttgccgttatcccctggcttgagtgacaccaggcgctggttcctgcctttcacaccccagcaagyggctatttcccagaggtcttagaagtgattccatcctctttgtggctgtttcgtatttcagttatcttcaggaaggagcatatgtctgggatctttgcctggctgtgaaatttcatttccatttctttacacctgcagttgcagcgtgagtggaagacagagccctgctgatgtcccagacccaggttatcaagatgctttagctgttgtttcccagaaggggctgggkccctagagcagatttcatcagctagggctttgtgggggccatctttttttttttttytctctctctctcttttatgtgtgtgtatggtaaatcgctcagtcatgtccatctctttgcaatcctgtgaattgtagcccracaggcacctctatccaagggattttccaggcaagaatactggagtgggttgccatgccctcttccaggggatcttcctgacccaaggattgaaccagagtctctttacgtctcctgcattggccagcagattctttaccactagcaccacctgggaagccc

SEQ ID NO: 2546 - DNA, 600 bp, Bovine  MMBT21519
tttcctgttcaattccattttgcaaggaggcccgccttttgggatctgttgcacagtctcgggcttaatacccctgggacttaacacaagcaccttttctactgaagaacccaagccttgattggctttcttgggtacctctggctgtgagatgagggacctgaagtcacaggtcaccatggcttctgtggtcctgtagcctccttggtggatagtctggacagaggagcgtggaaaagtttctcgaagctgcatgtttatattctgtgttccccacctcccccagagtaggatcagggraactttattgggagccatcacaggtcttttcaaccagtcttgcagaaaccatcattccctctaacctacagaagagcactgatttcatcatttggggacttgaaaatctggggaagagactatsggacccaggttcacccagagatcatcctttgcaaccaagggaattcaggagatcaaaagtgctaaacaatactttttttttttttttttttgaatttatgttttccaagtctaactgcagatacttgcctgcttcgttccgtggaaaaagtaacactggtccagggacatgttcgt

SEQ ID NO: 2547 - DNA, 600 bp, Bovine  MMBT23299
gagtaacggtacccatcaataaaaagcagatgtgggatttgaaccctggtcttatctaattccgagtcttgtgcttcttccccatgcatcaagatattgtcttctccagaaacccctttgtctctgcctatctatatgtcatcttcccttcacaccagcctacagggctatttcccacctctgatttcctatagctcaggctcactaggcactgasgccttgcttttaggcctctctttagtcttccctaaatattgtggtatttttgtcttgtctctttaactgagttgtaacctgggrctgtattttatccctttggacttacrttacttcacactatgctgcccaactattggttcattcattcacttaacaaatgttttctcagaaacctctatgtgctaggcactgtgtgagagactgcaaaggcaaaactaaatgtttgtcaaaaaatattctccaagtcagttgtaatagattcctgccctgtagcacagccccagctgccgggatgctccagtcacagaaaggtaygaaccaacagcttccttcctggtccctgtgctctagctttggcctgaaaatctgtgtagaattggc

SEQ ID NO: 2548 - DNA, 600 bp, Bovine  MMBT07978
aggtaaaatmatttagaagccctgaacatcagcttctttataaatgaatgcaatattaactacctctcaakaatttctgttaactttaagggaaatacaggagccttgtctttcctataacacacagtaacacacattatgtgatcaaaatgtataactgggcaacttttttacttcattaatgttttccattgattacctaaaaaggaagccttcaatatacctttaaatatattaaacagtggtaactacaatctattaggaaagtttcactgaagaggatcatagtgggcttagtgsaggagacggcatgtttagctggactttaaaaattaacaatttsattaagtggaaaaactacagatgtgcagttgaagtaccattcaggagagtgtctaggctgatatkctcaaagtcagttccctccatgtgattcttctagtagcaaagagagtcacatactttagacaaatcattggttgctaatttgggcttttatcaatttcagtataaaagtaattttgagattactatctatagtaagaatcttaaaagtagatttctatactgtgggaaaaaaagggtggaattttatacttt

SEQ ID NO: 2549 - DNA, 600 bp, Bovine  MMBT18760
gggtgttgatcaaagttgaatgggaggacccaggagacctaagggagaagaagatgagagagaaaataagccagaactaacagcctccccatataaggagtttttaaaaatcatgaaactcaagacatgatgagatagttcttcacacccatcaatatgaccattttcaaatatgcaaccaaccaagcaacaacaacaacaacaacaaaaaaaaacattatggagaaactggaaccctcatgtcttgytggtaggcctataaattggtgcagccactgtggacagtggtatgacagtttstctaaaatttaaacatagaattccctatgatccatcaattcrcttctgggtatttacccaaaagaattgaaagtagagatgcaaacagatgcttgcacacccatgttcatagcagcatcattcacaatagattaaagtggaagcagcccaagcgtccactgacagatgaccagataggcaaaatccggactcatgtgtgaacctagaaggacaaatactgtgagtccacctgtgtgaggtcccgagaggagcgaatacacagagacagaaagcaggctggtggttaccaagggcttgggg

SEQ ID NO: 2550 - DNA, 600 bp, Bovine  MMBT21793
ccctatggagaagcccatgtggtgaggttttataattgttaactgaagcaaaaatgcaatccaacatcgtaagaggaaactggaataaatgtacatcttccttagatactttgtaaattgtgtcaacataaaaactgtatttgaaaattaaaatgatccagtgctatcagaagttttgaaaatgaagctagtatacaaaataagtattgcaggcatactgcttactgtctgagccaccagggaagccccaaataaaacataacagatataattatgcactacataaacaaatttcctgayatcactaaaattttctttcttaggttctcaaggagtaataaaacttttctttttaatagtgaaaacactttacagtggcttctatcatttatttggaataatgtgtttaaacaaacaatggtaggaaaattcaaatgttgaatttgtcaactagtaagcatcctgttacctttttgggaaaacccctgtacgaaaatgaaggctggcttatattaaattgtatattagctaattcaaggccctgtctgccaagcaatagcaatgtgtatcactgaccaagtcaaagatggactatatcct

SEQ ID NO: 2551 - DNA, 600 bp, Bovine  MMBT07861
tagactttttcttttagaaactgataaaactgattctaaaagttatatggaaatgcaaaggactcaaaatagtcaaaacaattttggaaaagaacaacaaaattgaaggaattatactaccacattttaagactttttataatgctacattaataaagaaaatgttaaattgtctatccacaaatgtatatgctgaaattgaagattcatgtccaagaaatgattcttaatcctatgtcatattgtataaaaaattaatttaaaatgtactacagactatatgcatacactcatttttaraagttgagaaagtgaaaatataaaccatggagaaaataatcagcaatggtcctaatttcttttaagaggttataccccacatacttgaattttacctcaaacttcttgtcttcctcaaactttttctgatcacataattcatcataatcttcttgtaacttagtatgagtttctttaagtgatgataactcacttttaatctcattaatttctccattaagttcttcaacctaatatataacatttaaccaaaatgaacatgtatgtaaattagttgtatataaaaatacttcattaaca

SEQ ID NO: 2552 - DNA, 602 bp, Bovine  MMBT11207
  misc_feature (1)..(2): n is any nucleotide
nntctacctagtataaggaactgtgcactctgggaaataaattggaaaacaaaagtttctgattttcaaggaagagactatcgtatggctcaaggttatatgacagtgtcttttgcttctaaaagctcactgatttctcattaagaaattataaaaatgaaytgaaatgtgttagagaaattatragtaataacaaatayaagagaataattactcataattctttcactttaatgcatyactttaatacttcttagagctttctattttcctcacattttgatacagatgtactctctacrtggtactttgcattttgctcttttctacttcacattagagtttaacctagtcttttgttagtatatgtcattattctaatgactggctgctgctgctaagtcgcttcagttgtgtctgactctgtgcaaccccatagacagcagcccaccaggctctgctgtccctgggattctccaggcaagaacacctggagtgggttgccatttccttctccaatgcatcaaagggaaaagtgaaagggaagtcgctcactcgtgtctgactcttagcgatcccatggactgcagcctaccaggctc

SEQ ID NO: 2553 - DNA, 598 bp, Bovine  MMBT14885
  misc_feature (1)..(151): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttacttttatattaacttagttcttagctctcatcttcggtctatttatctctcttctatctatgctaatttcttttaagacggatttgccaaatcatatccctattgtctggccttccctggtagtgcagtcagtaaaaaatctrcctgcagtgcaggagacccaggtttgatccctgggttgggaagatatggtggaaaaggaaatggcaactcactccagtattcctgcctggaaaatcctatgaacagaggagcctggcagactacactctgtggggtcgcaagagtcagacacaagttagcgactaaaccattaccaccatccctaatattttgtgttaaatattgtgctgtactgtgttaaataggtaattactattcattgctagtacattgaattcattgtataaaatgcagcattgttcattttagagraaaaaa

SEQ ID NO: 2554 - DNA, 600 bp, Bovine  MMBT21071
cctagagggccccggggtgataggactagtctcttcaactttacagagggatcttgggtatcccttggccagggtcaaggggtaagggtcctggtgtgaagaccagagccccagtctcctcacagtcagcaccttgttttgtccaatgctcagacccacccttccctctccagcaccaccctagtcctcagagtgagcgctgtagggacccgtgtccctctaagggtcaacttcaccctgacatgttcataaataactkgccttgattctgtgctcaggaccccataccctaaagcctgyagtggagctttrgcagtaagggggcaaaagaggcctcatgtatgttggctgcattctttatgactgcatacrgccattgtctcattgtaatgcacacagcagtcttatgattatttccgtccaacagccgaggctgaacaagcagttcaagatcgggtaagtagtaagtgcttggtataaaaacttggaattcgtgtgaccagttctttccaaagtgcagttctctgagcagcctgtgaagatggtcagaacttgtgctgggctgcactgtctgttatcaccatgactgtccttctggag

SEQ ID NO: 2555 - DNA, 600 bp, Bovine  MMBT08148
gagacgtgggttcaatccctgagtcagggaagatcccctcgagtagaaaatgcaatccactccagtattcttgcctggaaaatcccatggagtggaggagcctggtgggctacagtccatggggttgcaaagagtcagacacaattgagcgactaacactttcacttcatatagctgtttgctggcagaaatagggcaggaggaggtataggagagagtgatacatgcagggagatcacttgcacgaacaaagacttatgaaagaggatggggtgactggaaaacacagtccacggattrcttgtaggtcyttaaatacatttcctttctttcaaagatgcagtaaagggaaaacgaccaacttacttggagaaaatacatctcactgtgttttgtgctgctgttgtcttgaaagcactgaatgcctgtgtgcatggggaaggcaactcccataaggggatgaaagttgtctatacctacaagagtagagaggacatctctatgcacacacacaccaatgtctatgcacagagacaattgtcctttgtggctggtttggaaatcgttgtgttcctggtcttgcaaagttcagacttgtat

SEQ ID NO: 2556 - DNA, 600 bp, Bovine  MMBT11713
cctgcagcgtttagacccttggtatgcrgacacgcccagaraagcccattctttatggcaatttgggccttctgcctggcttctcacatgtgcaagagattttggcaaaacactgcttttttttttgtttctctcattgtcatataatacaaagctttgcttctttcctctaacgggctttcctattttgtttctcaaatccagacaaacacacatttcaatgtccattcacattattaaccaaaaagacctccataatcaakcatttggggtttgattcacaaagataccatgtatggrgywctggagcttttscactcttttgggggaaggttgaaagggccttgtctgtggcaggtcgggtgcaagagggttgcaaagctttctcaggttcgtgactgacttgccccacggatgagaaaatcagagctcggggacctgactccagtgctgggatgtctgagacagctggcttcaacttccccctctccaccggcccccgccctcactcacgctgcctaagaggcacctgctctgggggcctgttcaagctgtcccatcatcccatcattctgagctgttgtttccagggttctaagg

SEQ ID NO: 2557 - DNA, 600 bp, Bovine  MMBT17431
agccagagcacaggtgagatatggacttggagttctgagctagactaaactcagtttgagcttagctccactgagaatcaacctgatatacaggatcaagttgtttaaacctcgcaggtcttgttgctgtaagtgaggtttatggacagcagcatcagttcacctgggaatttgttagaaatgcagaacttcagatctcatcctgacctagtgaatcagaaactgcattttatcaaaatccatctttgatttgcatgcagattacattgtgagggagaagtactgttctcaggaaccttycatttccttatccacaaaattcacataacagtagctaacttccaggggggcctaggaggatcaagtatatgtaaaatgctcacctcagtagctggcatgtttcaggattaatgaatagtgagtttattttttcttattgatattactgacaatattgtatatcattagatagttttatcacttaaattttctaagatgcatctctaaaactgggataattatatatgttttctataacttcctttactgtggattaaatcatttaatatctgtaaactatcaatataatgtgcaatgttc

SEQ ID NO: 2558 - DNA, 600 bp, Bovine  MMBT21385
tacctatgcaccggcagcacagtatggtgagagggaatccatttcactcagtctttaggttagaggttcagcatttgggcttcttcctgccacttgcttcaactaaatcatctaatcagtaactattgctagcttcctagaatgggttaaaatatggcaggatggccaagaagattgcttaccatagtgcatataaatgttaatgtctcgttagcattaggtctagcgttakagcattaagtcactaatgaattaggatcactagcaaatcggagttaatgataatgtcaactatcatcractgatagctactggtttccagggactatgcttaatgttttatgtaattatcccaatgaaaacactattttgcaggaaagaaaagtgagttagatagacattacacttttgcctacagccatacagatggcgattagaagacccaggataggaaccaggaagttgggctgtagagttggaactcctgactgttggactaagtagctgttcctcctcacaaaacatttactatgtgtaaggaactatgccaagcacattattgtattctrtccctatatttattatcatttccattttcca

SEQ ID NO: 2559 - DNA, 600 bp, Bovine  MMBT21806
agaaagaaatatgtgacaccagatrscaggtcacagagctggctcataaggaacaggagtttggggacactttcacagtgccaagttaagaagatacaagagaagaaaaaaaggaatttgctcttttctttttatttctaagctcgtttacagtttaaacctgcatgaaatctctacttagatcttcagaggaaagataataagtagctcagttaatagtttgggatgtgtcatgtaagatgctaccccaaattgtgctggccttgatgacaaacttccatgaagaaactttgcaataaycacaacaacttaaagcaaaggtggttattactgtctcagacattatctccagaatgtttaatttctgtgttttgacttataatttatatggtcatgctttatagaaacactagagaaaattattgttgattgtagtgtccttctagacaaaggataaactaaagaaaacaaatcccaaattttcaccaaaatagaaggtcttaacctgttggggaggggataacctgtaaggaaatatagtctaccactgttgctatctgtacagatgtagaattaattcagattgtatgtctaagctgt

SEQ ID NO: 2560 - DNA, 600 bp, Bovine  MMBT03111
aggatggaagcattgctggggtgagtcttccttgtatcggagttcccaaaacagagcaagcacacaatacarcaaatggttgagaaagaaagagaggtggggcgagcttgcatacatgggtgcatgtatgcatgtgtgtgtgtgtgtacatgtggctgggacagggaaggagtagggtaaaggagtggctgagggaagcaggaccccttcttccttccactttgtcacgcttcttggctctgagtgctttgaggtccgttcctggaggccagggactgagcaaggtggctatttcctaasgaccaggtaggctgtctccccattccattctgcctgagggaggagcatgctctccctgcccctctgtcccttggaacaccactggtcttacttagtggcctgaggcttctgtcaactctgaggccgggtgaggtccccccaccccgggacctgggccctgtccccatcttcctcacccaggagcagggagaagcaattccaccccccctactccagccccatcacttccaatcacctgcccatctcctgcaataacccacgctctccatggctcctcagggccgacagcatggctgtctc

SEQ ID NO: 2561 - DNA, 600 bp, Bovine  MMBT03219
ccaaggtcagaccacttgtcagtgggcacagaaggggctacaaaataagtagaataaggggaaacctgacactggagtgaagatttcctcattactatactgcctcacctcaacaactcaagcatttttaaaatccagcaactaatttaagtacaaagaaactgccacatgcctgagagagagattttcattatcatttttataatagtcttaccagttctactcttggttttaaatattctctcaaatcttttctccagcatacttatatcgtctctcaaatcttttctccaatatacytataacaatacccagtcatttaactcaatccaccatttgatctgcatacaacttctcctgcatctttgattcaagttttgattctgccatctaacaagccaygcgatctttgggaagatgtcagttaaccaatttcagccttgtcttccttagctttaagatggggataactacacctatcgccagagttctttatgaaattaattcagttaatatataaggaaatgtttgacgtgctaacccaaacgttagaagcggtcatcaccaccatcatcactgttagagatacgtgaattcttg

SEQ ID NO: 2562 - DNA, 600 bp, Bovine  MMBT04957
ttcccagtgcagtgtcttctgctaaattgtaggttttttctttgacattctctcacatcaaactgtctgtcaaagctaaattactccctctcacttcaagcctttccctggctatttaactctttgtcaatcctcctagccttttttcttgcttgactgctcattccatacatcagtttcactggcactttaccatctaaaatggcccttcctagtggggaagctcctgttctttatgaccactgacagaagggcgttaattcctataacctgcccgctcatctccactcattatacccyctcacctccccagtcagtctctggcaccagtctctggattgtcatcaaaaaatacacactgactgctaatttagatagctgataacagtttcactttatggatcagccatctcctctttgttccatccaggaaatcccaggccgggtttccaattcatttttyctggcctctatagccaggaggtacaaggagtaggcagaagtgtaatattgcttagtggagaagaagattcccctggatttcatttacttcacataaggagaacaggctcatagtttaattccagctgaaaaacttct

SEQ ID NO: 2563 - DNA, 600 bp, Bovine  MMBT07632
agctccccaggctcctytgtccatgggattcgccaggcaagaatactggaatgggttgccatgccctcctccagagggtcttcccgaccgagagatcaaacctgcatctgtctcctgcatggcaagcaggttctttaccactagcgccacctggaggcccaaatggaagcagtcgttattatccgttgttcttaagcaggacgagtgtcctctgcttagggatgggctgcgaattaaaacaagagaacatgtgacatccatgagctcccttagatcctcttatgtaggcatcatcctctstagcttttgaagtttttcttagtttggggaaaggcttgcctctaagtttcccaaagtaagaatgtgtgtgtttgagttgtatgtgcataatgtttagatgatgctaaagctgaaactccagtactttgtccacctcatgcgaagagttgactcattggaaaagactgatgctgggagggattgggggcaggaggagaaggggacgacagaggatgagacggctggatggcatcactgactcgatggacatgagtttgagtgaactccgggggatagtgatggacagggaggcctggcgtg

SEQ ID NO: 2564 - DNA, 600 bp, Bovine  MMBT10569
aagatcctgcttgctgtgcagcaggtgttacttcaaatatttccatgcactgttagcttgatggtaattttttaaaaaagaaaaagaaaataaactcttaaactgtaatttaatcccactgtgcttccaattctagaatcttgtacataaaatgacacagtttaaacatcgcagacaggtctcttcttgccctgagcaggttttggagggtctcactgaaaagagagaccttctccttcgtgggaacacagttcttaataatgtcaggcctccaggaagagcggggctagtccttactckgcaaaataatggggaaagaaaaaggaatctttctgtgccatgcattgtgctaattctcagcagtgtgttttaaggagggtattttctacagagaaaggtaactaatcgagggttacgtcttgggcgcatcacctccctctccagggtttagtatcctcagaagtaaatttgtattctgtcatttatccatccacctggccacccagccagaagaatttccctggtgcctgctccagggatgacaaacctgttccatcgtaagagcattgagaaggattctgaggtcacgtctcaactcag

SEQ ID NO: 2565 - DNA, 602 bp, Bovine  MMBT11981
  misc_feature (1)..(2): n is any nucleotide
nncctcgcctgatggctgtagatattacacctccagctcaaaatggaactcatccccctgtgctcacttccaccccacttcggtaagatcaagtactaattctctacacccgcccaggkccacsmgcccagaggcaccgactccccagcctcacctccccactgtcccccagctgtagaccctctcctttccacctgcaccgactcggcccaaaccagagccttatcgagtctggagagatgctgaccaaccggrttaccaagacctgtctcccctacccatcttcaacctactcstgatcmgcactgaatttttaacctattggcatccttctctaacattaagatagaaaacagcagagaaaccaggtaggttatttttaaatttcaagaatcagatgtcaaaaatggtttctaaacacctctcaactcacccatttccatggatattaggtacttacagcactatcaaattcaatgcttgtaattcctgcattactgccagacagggagcccttgaactcacatttgtctgcataaaaacaaagatgccaacataccaattaaaacgaggcacttgaaacacaagggaagctaattaca

SEQ ID NO: 2566 - DNA, 600 bp, Bovine  MMBT14107
cttgaggaatttcctactcagataccattgaaatgagaggttgtgaatctgacgatgagtatatttcaaaatgatatactctccggagctcaattcacagaaggttccattactctgtcccctccctccctctggatatagtatgaaagtatgaggggctgaagtctctgaagctgtggctcccggactggcagcccctggggctgctagtggagtataktttcctccatgcagttgaggaaaatctcaatgcagaagggttatccaggccacagatctgttctgactggttaacaagarggactgtgatgaggacttggctgtttagattaaaatgcatcgccggctctgggaacaagcacacatcagtagtaaaggccgtttaaacctttggggacagccttatgtttagattacattaattcataaatattatactaaataccacttaaattggacttaaatgacttcaaagataatgcattataatatggctatccagagagcactagtctttatgtctcccagtaactcagtctttgctgcctcctatcctgctagacaagaccaaagttatgaatggattgtggcttgttcatg

SEQ ID NO: 2567 - DNA, 598 bp, Bovine  MMBT14320
  misc_feature (1)..(99): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagacgtctgaagagccgtgggacccagcaggtgtgtgtccaggacacagaggacaagctgcggggcctcgattgagcttctggtctgagatttgtgttttcccacgataactacaagaaccaaagcaaacagacgctggacgcccccggatgaacccatgtcattaaaccccactggaaaacagcttaaaagaaaaargattccaytgatttccgtattcatttgcacaagctgcagagcctctttcttttatktttatcagggaacatgttgaaccagccctccaaattaaggaaataactttacgaactccagttttacgttttcttattttagaaatattcattgccttcctatgtgtccctcatgtccttatataaaagcatttttctctcccatttgccaatttttaatgatttttctttccttctacttacaacaaagccatcatttcaaattaattaagttttcattaaaatgtatgattgtaatgtcc

SEQ ID NO: 2568 - DNA, 600 bp, Bovine  MMBT00191
agatctcggatgtggcaactaagacccagtgtagccaaaaaaccaaaaataattaaaaatatgtttttaaaaaaggaaaccagattatccaagaggggtcgaacctagaaactcagaatgtaggtgtatgtgcggtttggatggtcatggggttcacagagccccgtgtctggagtcccttgtcccagagtcagtgccccctgcttggtctgtggtgggggaggggctttcctgtcacttcagaagattgtgggtcacaaggcccgaatttggtgagtcttgaaatcagccggcccaggycctctggtgacccgggtctctcttatcatatctagagasatgactccaatatcaacgatttaggctttccttatgggttagcctgggaaccacaccacattgtttggttaaacctcgagtacggacggacttaataatgaactgttgggccagtgctacttgcttgacctccagggctgtctttkgctgccgctccctctcccccagagcagtgtcctctcgggaaatgcagctgaccaggctgcatccgtgggaaggcctggccctgctgaggctgcaggaaatgaccctcttagcagc

SEQ ID NO: 2569 - DNA, 600 bp, Bovine  MMBT00467
cctcctaagctttctctatttaggggtgaaggttgtctttgttgaggtttgagagagtaattcctccctgtatgagactcccctcagaccctgaaggtccctccagcctccccggagggtacagatgagaggaagtagagcacagttccaggccccgctctgttccccgcccaagaccggaccatccttctttttctttttctttttctttattgttaattggaggataattgctttacaatattgtgttggtttctgccatacatcaacgtgaatcaggcttaggcatcccgccccctytaggctgtcaccaagcacgggtttgagcttcctgagttgtatggcagattcccaccagctatctaatttttacacatggtagtgtatgtgtttccccgctactctctcagtccatccaaccgtctccttcccctactgtgtccacaagtctgggcagtccttcttgtctgatctcgggggtcctggaagcgttttcttgaaccaccgcatcatggctatgctatgctaagtctcttcagttgtatccaactctgtgcgaccccatagatggcagcccagcaggctcccccatccctggga

SEQ ID NO: 2570 - DNA, 598 bp, Bovine  MMBT03751
  misc_feature (1)..(10): n is any nucleotide
nnnnnnnnnngaataggcaatcaactgacaggtcattgctgaatcaaggaattatacccttttctttggcatatcacagctcatgaaggctaacattttggtgactgtttcaggaaaagaaatactgtactgtatttcctctcttcccttcaatatctgttatacaaagcaaacaaacctgtttacagaacagccagccctttggttgagtaaatgacaggtaggaaattaagctgttaatacaggaggatgactaagtgaggaaatccgtcttttgtcaaccactcttacatttttatyattttcaagtagaatctgctttcggtttcagtgggggtgttagatgtatgtggcttaatggattttgtacttgaaattctggcttccctcttttgcttacaatccaacatcacagtagaaaataatgcaaatagtcttctaaatgattgatawacagtaatgatttaggcttatttattgagtcagagctccacacctgttctgtgtcataacaacttcctccaagaatgagtttttttttttttttaagccatcctttcttgcaatgccagaggcattaaaaatctctaaattgaat

SEQ ID NO: 2571 - DNA, 600 bp, Bovine  MMBT07051
gtccacctggaaattccagttcttatctggttaagcagcattccagttgttttaggatggtggtcctccctaagctaactccctcgaggatctttttacctttgcctctagcactgcccatgtgggccaggtgatgagatcactgtaagccagaccctgacatctgaggagctaacagggcctacagttggattcggtgacatccacagggttccacctgactcttaacttggtgagggaccgtggctgtgattgcaaaagcctccgttgtggggcctctctgtttacctgggcctgcgmggtcgctggcctaggagagagatcttcgatcgtgttctaaaggccagaccttccaagttggaaggtcgtggtggcctgaaggataggggacagggcctggcaagaagctggttctgggtgaacgtggcctgaagggattcgtccttaggaggcagaagggctgagtcacacgctcagtgtttcaggttccacttttcagcctggccctgcccgccccttccctgtacaaatgcaggccaggggctgtattattggctgttgctgaattctttggcagggattttaatgtctggtctgggt

SEQ ID NO: 2572 - DNA, 598 bp, Bovine  MMBT07282
  misc_feature (1)..(11): n is any nucleotide
nnnnnnnnnnngtctgggcttatcctgggggttaagcagaggcaggacctggtaggtgtatgtttcagagcccygccctctggccggtgagatgttagggaygggatggaagagaayggggtctgagtccctctctctctttctccccscctcactctcgtccctccctttgctcgagggcgtcaggatttcccaggtgcagctggcggattcgggcaccttcacctgtgtggccgcgagccccgcaggtgtggccaacaggcacttcatcttgcaggtgctcggtacggagcagggggygggttaccaggccctttggcctcagggttgagaatsaaggccctgtcccygcccctcccctctgagtggaaccgagggytggccctcagggatgtcaaggcagggcacacactcagcctctggctcattcagtcactctttcattgatctcacaagtggttctcggacacgagggtgccagggcctcaccaggccccgggatacggcagtaagcagaggtggccgctgmcactaggaggcccatgaggaaaacagctctgtagaaagacaattaaaattccaggcgactggtgatgcc

SEQ ID NO: 2573 - DNA, 600 bp, Bovine  MMBT07509
aacatctctggtcaaggaaactactctaaccaagaaaagcttcatggagtcaaaggacttggttttagttaagaaggggtacaaagcgctccaaggctaggagtgatgtctagtgccaaccacagtgagaacagtgattgtgtaatgacataagcattcgatggtgatgcttactgacctcagagaggaagagtaggcaactaaaatcatattggcagagtcaagaccgactaggacacatgacaaaagcatgtctctaaataagggcttgctatcgagtcaaacagaagccttatctcrtaggtatttaaagttaggttgataagactaaccggctasagcaaggctaagaaggaaattgatgacttaaatgtgraaacttagataatgtaggaaacagaaatatactaaattttaagagctagaatggcacacaaaggaaraacaaagaaaatgccagagcggtggaatcaagcactgactaaaaaaaagaaaaagaaaaacgaagctggcagctggtaaaaaaaaaacaaaactgcatgaatccagatagaacctacacccacctaatgcatatagttaaaccatgttaagggagag

SEQ ID NO: 2574 - DNA, 600 bp, Bovine  MMBT07821
tccagctattccactcttgggctaataaatctggagaaaattctaatttgaaaagatacgtgtaccccagtgtttatagcagcactatttataatagccaagtcatggaagcaacctaaatgtccattgacagataaatggaaaaagaaaaaactgtgtgtgtgtgtgtatacacacaatgggatattagccataaaaaagaaagaaagaataatgctatttgcagcagtatggatgaacctagagattatcatagtaactgaagtaagtcagataaagacagctaatcatgatattatrtgtgcagtctaaaagaaatggggcaagtgaacttacttayaaacagcagtgactcatagaaaacaaacttatggttaccagagaggaaagggggaatgtgataaatagggagttttggactgacatatacacactactgtatatacgatagatacaccacaggggcctcctgtataaygcaaggtatgtgcaygcacacgcccagtcacgtcagactcttggcagccctatagactgtagcctgccaggctcctctgccatgggattttccaggcaagaatcctggaatgggttcatttt

SEQ ID NO: 2575 - DNA, 600 bp, Bovine  MMBT10294
taggaaggttgtggcaacatcctaccccaataaaattttattcatgctttcagttacatagaaaattattctctyttttcaaaatatgtgaattctcactactttctgaaggatcataaattcagaattattttgatcrgtagaggaattgttgttaacacaagttagtgtttcttgaggtgattatcacctggacattctccttttgccactccagacccttttccattctgctctgagttcctaaacctgacctctataaactgcaactgaaacctttgccagctggtttccaatggrtttggccaaagcggagaactaaataagcaggagatacctggagaaaggaaggaggcagggagaaaaggggagagaggacagagtggaaacagggtgttttccaccagctccctcatttcagactttggtggccagtggctgcattcctctctcataggtttcgcattcagttgggggcctctctcccaaggacagccatagctaagctatggacccttcctgttctggtaactttctccctctccttgccccttttggtcctgttgtttagtcactaagtcttgtccaagtctgcagcac

SEQ ID NO: 2576 - DNA, 601 bp, Bovine  MMBT10567
  misc_feature (1)..(1): n is any nucleotide
nacactgtgctgcgcacctcccaagctcatttaattgtcaaggcgtattgtcctcactctgcaagaaagttccagaagcacagagaggtcaagtaatgccctatatgggtgcacagcaaaaagtggtgtatctgggatccaaacccargctatttgataataatgaccaaaaaaaaaaaaaaaactgtactaaaacccaaaaggacagagagtattctgtcctggggggctgagcaggaggaggagcccttctaatcccttcggcactacccatgaaggcccttctccaatcccggtgtakccctggtttacagatgcaaatacatctgcccttttcccctcccctcctatcagttcaggagtcaccatttgaattctgctctccttgaaagcatcaggcagtcagaaatcctgccagctggaccccattcaagtccagttgcgtctgcctgactgggcagaacccaaccatccgtgtggaaatactcagccgataacagccaaggggatgcggccaacacggggaaaatggatggttcccagattggcttgtttggcctccagctcaggataatatatgagcagtgacgtcaaacaaatg

SEQ ID NO: 2577 - DNA, 600 bp, Bovine  MMBT11517
aaaagataagtaactttaaatgtttagacgttacctataacctattaatcacttttatttatcttctgataaaaatttcactacaaggatagctaattaaaaaaaagcagttattctgataggcaaattctgaacaacctgataaaacgataatttttactgtttgtatgccttagatcacttttgaaataagtgyaaaatggtttatcttacctgtaccactgaggaattgaggtactctgcacatacccctaagggctgcactagtgctgagactgcctgaaaaaaagacagcaaatktgagaaataaatgtgagcaagttctttcctttcaacattaaacaaatccttttttatatgtcagagaacattttatmctcttgggcaggaaaagctgatataaagatgtcagttcatttaaattattgtagaaatttaatgtaacttaaatcatactatgccaataaaacttctttcaaggcttggatgagatgattctaaagttcacattgtagaataataaaaatttttatttgaaaaacgagagaatagtgggggaaggaatgaaatgtgcctttaatgtgcctttaacaaagaaaa

SEQ ID NO: 2578 - DNA, 461 bp, Bovine  MMBT12774
cagttgtattaatacattctataatttccttataaataaaccatacattaaagccccattgctgcttttccccatcttttaatactgagaaaaataaatcccatgaattttccttgaaatcttactagatcatccaaaatacattctaggggaaagttacaaacacaattacagtagacataaattcacaagtgacttacagttgaacttaaatcaggaagaaactcctacaatttatttcttttccatcacccttgtgtttcagtgtaagcacctaattcaatgcttttctcagaagcyccatgtagtaaaagtcattcctggagcacagtgcaaaggttaagaactttggacctctactcatctgagtttgaatcttgcctttgtttctcagtaactatgtgaccttaataagtatctgccttcttttttttaattaaaaaaaatttttttttaatttt

SEQ ID NO: 2579 - DNA, 600 bp, Bovine  MMBT13361
gttgaagcyctcggcacagcagagaactggggacttyagggcctagagggccccggggtgataggactagtctcttcaactttacagagggatcttgggtatcccttggccagggtcaaggggtaagggtcctggtgtgaagaccagagccccagtctcctcacagtcagcaccttgttttgtccaatgctcagacccacccttccctctccagcaccaccctagtcctcagagtgagcgctgtagggacccgtgtccctctaagggtcaacttcaccctgacatgttcataaataactkgccttgattctgtgctcaggaccccataccctaaagcctgyagtggagctttrgcagtaagggggcaaaagaggcctcatgtatgttggctgcattctttatgactgcatacrgccattgtctcattgtaatgcacacagcagtcttatgattatttccgtccaacagccgaggctgaacaagcagttcaagatcgggtaagtagtaagtgcttggtataaaaacttggaattcgtgtgaccagttctttccaaagtgcagttctctgagcagcctgtgaagatggtcagaacttgtgct

SEQ ID NO: 2580 - DNA, 600 bp, Bovine  MMBT13680
atacaaaagcagactgttttcctgaggctggagagctgcaagttcactcctctgtacactcgcaagttaaatatgggtgttgacgtgtcagtgctggtatcatcttttaattacgttctccaccctctgttcccagacgaagtgagtggggtcaagtacccccctaagctccagggcctctctagagctctgctggcagtgggcccaagggcccctgggcacaagcagtgtccagcttggtcccttcgtcagctctgggcacgtgctctggcttgactgctgggtgctggccagaggggyagtggagcagggccaacgcattaggagaaagtgctgggccgggtttcagttctytgattagactgaaagatttrgctgccaattgtcatcagccaaatttctcacactttgcctgatgagtcacttgtgctggtttccaagtggaacagaaggctctgggaaatttgcagtgcttattttagatctgcttcagggagggggctgagtgtccgatgtgatcctggtttgcctcacatcagggctttgtgcgagggactgtggaacgctcttccaagagtaaacagcttctaactaaggctt

SEQ ID NO: 2581 - DNA, 600 bp, Bovine  MMBT13689
ctcactgataaatttaatgtagtaccattaaaatgaaagccccagcacgaaggacccaatgcaaatataaataaagagtttttttttttttttttaaagaacaggttgtcaatattagagctgaaaattttgtacaggttctggtaagattacttaagaagcaaatcaaaatgcttaagctgtagctgtttaacatgattataagtgctgattattcaaatgaaattaattagtcacaaattccccaagaacattaagctactcctcagtggcagaaaaacyggtgattttactctttcrttgaaatatacgctgggtttttgaaartatgaacaattcctggaaatatgaaagcaactgaagatttcttggtcaggatttaaagaaagatcaaaacccacttagttccacaatcaatatagastgtgaaggcaggaaaaagctgagragccatcttgaaggcagccaggcagaargaattctctggtactcgaccttttgtagtaaaaggccattttggatctactgatgggatgtggcccacccatggtggaagcctcctgcagctttaaggacaatattaaaatgggacctctgtgg

SEQ ID NO: 2582 - DNA, 600 bp, Bovine  MMBT14827
acagagaatacagttttattgtttcagaagtggcccagacaaaaatagcaccatgagaagaaacaagcttcctagtaagatcaaaattaattatggtttttctaaaaaaacttaaaagacttttatatactcaattccagtaaacctcagaggacacgctactgaaacaaaagaagttaagaccagaaagaatttccacagatttgagaaaactcaatgaccctttcagtctgttaggcaaacttgtgttctgtaggtatgttttagaattttgtaagtaaccatgtgatcatagatgayaggaggaggagcgaagaagaggagcaaaattgtacagaatgaacaaaaaaattaagagaaactcatacagattacaaagatgatcaggaggtcagttttctaaaatgtaggcactgttatcaacctcagagcaatggtcctcaactgtggccctttcgccccccaccccagaagttactaggcaatggccaaagacctggtagctcagacagtaaagaatccgcctgcaatgcaggagacctggtttgatccctgcgttgcgaaggtcctctggaggaaggcatgacaacccactccagt

SEQ ID NO: 2583 - DNA, 600 bp, Bovine  MMBT17641
actttcaatgactcatggccaaagaaatcgggagcacaactagctgagaagtggaaattttccctgcaagacccagagcccagagttagtgacattccatctctatatcaggaaagatcaccttaagatttctgtcattctggccacacaggtcggtggcggagtgtttactgggcccctccaccagcaccagttaggtacaatccacaaaggtcttgctggatttcattgcttcttctcagaagacagttttacattcctctgaatgccttaaatttacctctggtgggatatcatgaytgattccttgacttttttctttttgcttataaataattctttatgtctcccccatgcaatggagggcagagcagggggttgtatccctgccctcatgcagggaatggaggtcaatgtatactgatcttattgccagctgccctgtggccttgcggtgggaaatggtggggggtggtctacagccccctttcttctaacattggtctctcttcaccacatcaccatagtggagctgaggggctggaggtgctaggagctgaggtaaggaygcttatctagggaaaaaaaaaatgtccccay

SEQ ID NO: 2584 - DNA, 600 bp, Bovine  MMBT17701
tcctccagagacacagtctttattgctagtactgtttgcatgttgcagtgatatagaattgtcttggatcttcagtggaccgtgttgcaggttgttacatgctggctcaaatttgattccatgattttctccacagttgtggtcataccatctatccctcatccaagtttgaaccatggattccttgccaagttaattcccgagcagagctttgcccactcattttacaaaggtaatattgacctcatctcctgacctgtttgggtattcttaaatttcatcaattgttatacaataacyattcattaatgtagttgtttatagacatctcagcatacggctcaggtttcatggagatataatacgttgtatttgtacctggctattgagagcaaaatagtttttatatttgtattcccttgtatttctttaagtatcatcttcaaattaaggctgcctaattatatggataataagatgcacagtggtggcatgcagaagagatcacagaaaagtcccaccatgttaatgggaccgaattagctctaaaatgaaggctactgtagaatgacaagtaaaaagattttaaacaagcctcaa

SEQ ID NO: 2585 - DNA, 600 bp, Bovine  MMBT18050
cgctgtctgtcagcctagtggcagccaatcacagccctcaggtccagtgcctccccgcccacccccttctccgacctcctccttccaggagaggggttcaggggaaaagaaggcctgtaccgggtctgtgggtggcctgggtctcagctcctctggaagcagcagggtagggtgggtggggcagacctgaggttcttcctgcccttgtgggggcagttgaggaaggttctggaaaccctrtgtgcaagcaccgtgagggcagggaccaccttgcctgtctagctcactgtggaattcacrgctcccccccagaaccagtgatgcctcagaggctttcgattcttgtcgaggaaggaagggcgggagggagaaagagaaggcttgggccaggctaggttaagcagagaggagcaatacaggagagcggggaaaggcctgaaaaaaagctctgggttcctttccaggcctccctccatcccctccagagacgtcggaggagggaagaccaaagacagtctccctctccgctcctggcaggagctgcagggctctgactcagacagttggtaactgcccttgatgtgttatatgtctccatgg

SEQ ID NO: 2586 - DNA, 600 bp, Bovine  MMBT18246
tcccaccaccaacacacacacatcaccctgctgctgaaattactcatgtccttaggatcaagttcaagtgtcttgtcaggtcctccagggtcctgtgtggcctgaccctacctctcctccattgtgattcctggtcagccaatgtcacctcctcagggaagcctgccgtaaccactgccacgaacccattaggctagttctcaggactatcttgcctttttaaaaaaaaaaaaaaactctttatttttatttatggaggtaggtacgcccatttcactgctgaagacactgagggccaamtgrcactgagctaggttagcctcacggggctacttggaaagtaagcggtgtttgcagactccttattatcatcattgttattgttattattattggctgttacatgcagcatgtgggatcttagttcctccaccaaggatcgaaccyatgccccctgtactgaaagtagagtcttaacccactggaccaccagggacgtccccttactttttttgaaaaatttacttttcaaactgagatacgattgacatacaaaaaaacctgtacatttttaatcgtacatcctgataagtttgaagc

SEQ ID NO: 2587 - DNA, 600 bp, Bovine  MMBT19520
tgggagaggtgcaggttgcctcgccccagcctcgaccagaagtcctgagtgagaacaccaatggcctttccagcactcctgcagagccagacctcagccccagaacagctgccaaggccctgatgcaggccagtgagcatgtgcccacgcaggcagccatgtcctctcctgacattgtcagtgaggtggggaaggcatctcccacactcaactctcctggcaatactcagctgtcagggggcagagagcccacagcaccagccctgtgttctgcagcaggcaaggatttaatacctgcarcatttacaatgccagccaatcagcacatccacccagttgtcccaggcaaccagccccatgccagcccccagtcagggcctgaagataccctggtgaaatcacagagaactgcagatggagggcaacctgagaagtcaagttgtccggtggtggtcatctgtggcaaagatcaaatrccctgtgattttccttctcaagaaayaatgcagggaatrgtgcaaactgaagatacagcagccaggtcgttcagtcctacttccgctactgtaggtggacccgaagcagaaaggcagcaagctg

SEQ ID NO: 2588 - DNA, 601 bp, Bovine  MMBT21018
  misc_feature (1)..(1): n is any nucleotide
nctccaaacaagagtttcttctagataaagaatgacaagcaaatgccctacagaatgacaaatgttgcaggtggatctgatagggaccatctttacaaggagaccaagttagctgaatactttcggcttatactgtgaataaggatcctcagaaacaagtccatttttctgatcctcatatgtaatcttyataaataaatatttctttgctttacatctgygtggaaaatttgcctcctacacaagccccaccttccagccaggtccaaatctctcactacyaatgttatcattatccttkggagtccagctgctttgggttatgaggattttttgcaaatacgaaccraagggagcaaaacataaagcacttccatttttttccttcccatttccccaagttaaataacagtttattctgcaggctttcaaatcactcccacaaaattggcaatccaagacaatcgacacattcatgctaatccacccagaagtaaatacactgtggtaaaactgtgacatttgcaaaggccgtagctccccaattactgaggaattaactagggatataatgagggagggccaagtgtgattcagccca

SEQ ID NO: 2589 - DNA, 600 bp, Bovine  MMBT21043
acaaactctctttgttagcttrtagattaaagaaaataaatacatacgtagagttaatactaagttataggagagtttcttcaaatagctaaaatttaggagsctccaccaaagtaacrgtaaatatgactaaattatatcatgcctaaagcttgatgtgtatgtctgatttgacatatttcagaggtgctatttactctgtaaactgttctacatttcaaaaactaagattcttggggttcataagataaaagttaaaattaatatttcagaaattaattttctgagcatttgggtggrtgctgacaatagttgctaacttcttcatttctgatcactagttctaatcattagttgtttttcttgggtatttagaactgattttttttttttctctaccttatatacctctatagaaaaaggtggattgtttttcaaactcagaaacaaattcagacctgaaatgggcctgttacatgttaaatggcaggagttcataaaactgaaaacttyccattgctcacattaagccagtgttggagcaaataaacaaaatcatcttttgcttataattttaatcatcttaaaaactgtaaagga

SEQ ID NO: 2590 - DNA, 600 bp, Bovine  MMBT00672
cataaatttcgtgctttggcactcccgcatgagatcaagccctggaaaagatggttgctgcagagggcagggtctcaatgtcattgtctcggtgattagcaatggtcttttctaaatgccccttaggcttaacaataatcgaatgcattttaaaaattaggtctccttccgttcaaagcaaagatgtcatctgtaaacattcatcaacacccatcagaagactcttctttgctggggttctttcctgctcattaacatagggctgtcattgctttagggcccaccatgcgcttgctgggygtgtgcatgcatcatttctctccagaaacactgccaagagacaagacaaactctctggtggaaaaaaaagcattggcttaagaatgagacttggattctagtcctggattggtccctggccagccatgcaaacttggacagttcatgtaaacatctctgaccctcagtttcttcatctataaaatggggatgttgttatacatctgcctcaaactattggaaaattgtaccgtggtcaacaaattcacgttaagctgcaaagtgtttttttaagcactgactccagtgtgcaaggcctta

SEQ ID NO: 2591 - DNA, 600 bp, Bovine  MMBT00789
atgaaattatccttacaactcttatttctaaaaggaggatcttgaaagacacacagttgccaaagcctgtccctatagcttgtgaatataacaacagcttaaaagtttgtaattttgaataattatctttattaataaactgctgccctaaaaataatttttaaattgttttatgaaggtataactagttacaagttttctttcttaagcatgagtatgagcattggtacttgtatcaaattctacacacaggaaaaagaaatctgtcagaatatcacacctgataaaaattagcaatgyaaaaactcattcgggcaagattcatcactggattttaaaaactattgactataagcttgttgaggaacagagctttcaacatggcctccaagaatcatcccacatactgcttattaattataaaggaaaaattgtgccctgaacatggtgagatctggcagtaaactttaaataagggggaattccctggaagtccagtgggtgggactctgtgctttcattgccaagagccagggtttgatctctgctgggggaactaagatcccattagctgcacagtaatggcaccccactccagta

SEQ ID NO: 2592 - DNA, 600 bp, Bovine  MMBT02322
attccaaaaatgttcatgcagaaggtatgtggagacagaccccaagacagtgagcatggaagctgtgagctcaatgaagagtttatattcaagaaaatagatgatggtttgtactaccaagaaaattttggtagtagcagtgaaaatggttaaggttgtctagattaaatcaaaatgtaaggaaataaaccaaggtaatgggacagattaactggatatggcacttcaaaacagaaataaatttaagatggtttctaggcttaagcaactgagtgactaatgaaaatattcatcaagatkaagaatatttggcaggagttagggatgtgtgtaaagacatgagtytagtttgaccttttatgtttgaggtgctcaagggagatatttagattggwtttggattagatttggaaattttatgttaaatatgatatttcaaaacgtgagacagaatgaaattacccaaggagggagtacagatagagaawcaaagagagctgaggcatcgtagcagagaagtacaagctagtaagggagacttggaagaagtagacagaaagataagagaaaaataagagaatgagatacaataaaggccaa

SEQ ID NO: 2593 - DNA, 600 bp, Bovine  MMBT04167
caagttttagcaagaaaccattttatagctatttttaatctcccacctgaaaacattagttgactctggaaattctaatccctttaaaacccagcagcatcaaagcaaatagtcatgatcccttaagaggataaatatgctgattttaattaaagactaaattatgtcacttggtgtataatttttgcatctgtactttgagtagtatttatatatcatgtgcctttcattaatgaaaaattgaaaagaaagtatatattttgaagaaaagcctattgacagagacactttaaaagagcwgtaccttgaattttccaagaatttaagataataggaaaaaagtcctggtgtgtgctactatcagatgaaccttgaaaacactatgcaaagtaaaagagttattcagtcgctcagctgtgtccaacactttgcaaccccatgaactgtagcctgccaggctcctcagtccatggaattttccaggcaagaatactgaagtgggttgccacttcctactccaggtgatcttcccaacccaattttcaaacctgcgtctcctgctttggcaggtggattccagtaactgtggttatttatttt

SEQ ID NO: 2594 - DNA, 513 bp, Bovine  MMBT04281
ctgcctttgtggcacgcatcactgcattttcctgtctctgcartgggtgagcagacctttagaggagatacttaaaggtctatggaagtgtctgaaagatttgatgactaatcccaccccctccaccccatatctaggaccttgcaagtgatctcaaattttctgtacaaatataataaaatgatgtttttgtttacaatacattagtttttatccaaggtttacaaaatattaaaacttttccctttgttaatgaagcaacaagaaaatacaacctgtgcccaagaaactctttacaaytccaactctcaaactttctcatttttaacagtcatggctatctaaattcaaagacttttgccaatgcagagaatactaagtacagttgcctctggatctgaactgaaacagaattaaaattcttaaaattatatttcattccacacttcaaaaggaaacttttgaagtcaacataactcacacatcaaaacctccaatgaaagacctcattgg

SEQ ID NO: 2595 - DNA, 600 bp, Bovine  MMBT07805
ctcactttatgaaactctgggggaaagcttaccttcctggggctttatctgagtcccaaggcaagagccccctgagattttgcctgtcaacagtttacatttcactcaaactttctccagggaggactactgttgggatgttctttgtgcagtagcctgaaattattataataatggcagaggtgtccattttcatgatagtctggcatctagtatttactgggtaactactgcatgcctggcattatgctaggcatattgtatacacactttcattcatttatattcacatcaatcagyaagagaatcattgtttcccccgttttccaaatgaaactcaaaaagctctacctgcacatggccacacagtctgtaaggagatctgcaattctgagtctaattggatccccagtcctgtctgccttctcaggtcagctcctgtaactggctttctctggctttatagcccattgtgctgactgtctgatatcagtggatagaaaacacagaagctttaaacttcaacatgcaaatattatatttatttttttaagctttttattttgtgttggaatatagtcgattaacaatgttgtgata

SEQ ID NO: 2596 - DNA, 598 bp, Bovine  MMBT07841
  misc_feature (1)..(135): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatgaatcatacgcagacactattaaacaatgacacatgaaggcagcccccttaaaataaaccactcccccttaaaataaagtaattaaaaaaatacagaagttcttataaaragatkatgtgttatctttttcccccttttaatcattattcagattcaggmatttaaagagttgtctaaaaaccctccagtcaaatgctttgtgcagcgttcaatatgtaacactctagctaatggaaaaagcaggcggtggaagggagaactttctgttgtcaagctgaagagtgcttcaaagaagattgtcatttgaaactctgttgtcagcaatgaaggattccaaatgccgctgaacccagaactctgactgtggtatgtttaaataagtatatttaaacattaggaattctattttacttttttgtttccttaaaaatatgtaagaagccaacaaagaattata

SEQ ID NO: 2597 - DNA, 600 bp, Bovine  MMBT07862
tcaactcccctttcatttaaattctactccacctcttatgcccaattcaaggccccttttctccagaaatccttccctgaccactctaaaccctctattttctaaactcctgttgagtggttaaagtcaacactacagtttaataataacttaccagttgttctatatgtgtccacctgcctctccaaattagatgtttcttaaaggcaagaactgttccacatgctttcatttactcccccacatttctagacccaaagtaagcattcatttaattaacttgcaattaaaatagcttakttttatacaacttcacatattacagagcaatttcacctatatttttcttttgatccttaaattgcttctgaggtgtataggcattacttcctatggcatatttttttaaaaatcaccaaagtcagactcctaaaggtgaagattaatttttctgagataaagttccctaatctgtcaataaatttcaagcttaacccaaaaaatgcttcctattttaaaagatgagcactctcaaagttctgaaatagatttttagayggattaacaccaccaaccagttcaattaataaataattgtga

SEQ ID NO: 2598 - DNA, 600 bp, Bovine  MMBT11654
cgtggaggcagctgtactcagctgaggctccattttgctgtgactaacctttcctacttcgcctaggactttccagatttcatcactgaagcgcctgtctcctgggacaacctctcagctccaggcaaacaggaatggttggtcagccttcttcatttaccgcagggccggcccacttgcacctctaggcaaatcagccttgttcctaccctttatttacaattgacrtgaatgagtcctgtctttttcctgtcctcaggcatggtgacaccaggcttgtcaagagtccaacctatgaaytttatattcaataaaagtttcgttattggccttattttggacccaagcaaatgaaacaagatacattacggaaaacaaaaagaggccaggccttgctcttacctagatgctctcaaagtcacacgtttacttcctctttgtattttctctcacctctctcctccaccttaagtcaccctcagctcttaaataaaagcccccctaagaagtcaagtggccccaggaccccgcacaccctctggcagggaggggcagtgtggggctgctggcgggtgcccttgggaatcctctgacatgcag

SEQ ID NO: 2599 - DNA, 600 bp, Bovine  MMBT11712
ttgtaatctagcttttttttttttttttccattggaagacaattgcttcacaacatagtcccagtctctaccatacagcaacatgagtcagtcatacatgtttttaaccaagggaaatactagatgggagaaaagggcttaaaagcagacagtaaaagttatattaggagctattgccacctcaagctccaacataaattagcataaattatgatgcaattaaatcattaaagatgacttaatttgttgaatatgaactgaaaaaagcacagtaaaaggaatatctctggctttagctgraagaatgacatatcaactggctcatgtttcagctgatgagaaaattgccacaactcattcctagaaaagagacactgctctttgaaagtgttttacacaactacaaagcacaggacagatgaaagtagctgttattttgctattttgctacgttcagaccagcagctttaaatatgatacccttaaagaggcagctgagagagacaaataagatactatgtatggaatatttcttaaaagctgaatgtttttagaagcaccatttggtcagttatcctagagtctcattagagcatcaca

SEQ ID NO: 2600 - DNA, 600 bp, Bovine  MMBT12106
atatgaatcatgggaccaaagaaatgagttaaaaagtaaacttatgtcctatcctacttaattttcaaatttaatcactgaaatccagtgtattagtaaaagtcaayatagttttatataagacatgtaataaattcaggttttaaaacttatatgcatgactttatagacatttgatctctgtaaatttcattgtttccatctgtgacatgaattgtctaataatacctgtattagtttacagtgtccttgtgggaaatcagtgaaaaaatacatatgttattttaaatggtgacacartctttatggattagtaatcagtattctggttttcattattgttggtatatctgcctgacctctggatatattcagcaatcaaaaactgggtggaaaaaaccaggaactttatgccatagcaatttcaacttttccgaataaacaagaagaccttgtatatatgtatatatgaaacagatttggcatttgtctcatctaattttctgtttatattgatttacaactgtgagaaaacaaatttctacagaatcagcatgagtacttagtacaggtgaatattatgagtaagtaatttttcag

SEQ ID NO: 2601 - DNA, 600 bp, Bovine  MMBT14855
cagattgcactactttggagcgcaggtgatgaaatctgggtattgaattacactgaaccataaacttcatttgttcttaggtgcacagtgatttgctgtaataatgatcatccatttgctggacagctgagattttttaaaagcttgattgcttttggcattgcattattagtcccgaaagaatgcaacacatttgtagcaattctcaatttgtacaagctacagtatccatctcttaacaaatgttggccatttaagacctgtgtgttagacctctgtgtttttcttggccattctacracagsrtaagtacttttgtttttcattaacaccatcaggaatatgtacatctctaaaatttgaaggggrttaatttgagttctgttttatgaacaaaagggccaagaaaagtcccccatgaagggtacatgctgtcgattgtctttggtaaatgaaagtcaaacaatttcagacaagtccttttctaagaaatgcactgcatatctcaatccaaatactcatctgatgagagtctaaaacccctactgaattacattggatgagaaccttgatttttcacgatcactgtagaaatygact

SEQ ID NO: 2602 - DNA, 600 bp, Bovine  MMBT18126
ggaggagggggagaactgttcagcccatgaccatgtgtgagcagggaaaaggtctggtcaggaagatggttgagggtggatcagccagagtgagacagagaggcagaaaaaatccaccagcaagattcaactgagcacatcagggggctgactcagcccctgctttggagttttccagagctttcaaagaaatagatctcagaaaaaacagccccagccacgaggcacatcctccgctcagaaaggggaggaggcagtgctggccaccagggtcaccggagccctttgttagcgagaacrggccacttgaagggaaatcgatcctggctaagcatgaagcagctgctcccagccaaagctgctacagagaggccctttgcaccctctcctccggggctgggacaggagccagcaggagcctgaggattgttctgccaggtggcgggtctcggaagggccttcaatcagcatgcattgtggccgctggctcctacgtccatccaaagtgaagtttcagcatcacctgcactcaccagagatccggcctcatatggaatggttaacattatcatcagccttgccaagtgccatccatgtgcg

SEQ ID NO: 2603 - DNA, 600 bp, Bovine  MMBT19549
taacattattttaagtttgtaatgaaaagctgttataaccactacatttataatacttaaattattaaatatgtaaaatttactcactcataataaaagtcaggttgcagatagtgtatagattattataaaaccaagtatttcaagttttcaagttaaactttaataaaatgcaaattagaatcatacggttttctacaacaatttttgcccttctcttgtttagcttttcattttaaatatgaaatttttcatctccaaatgtgcagagctgggagagtcttttgattagtaaaatcrtttttatcccawctccatagtgggttgccatttccttctccaatagtagaaagaaacrtaagtcaactcagttaagatttttaaaagattaagtacacgcttagattaggttaattatattaaatgtattattttttcccctttgttaatttttacaattttttgctggtgctgggtcttcattgctattcaggctttctctaattgcggcgagcaggggctgctcaacgttcattgagatgtgtgggcttctcatttcgatagtttctcttgttgtagagcactggctccagggcgcat

SEQ ID NO: 2604 - DNA, 601 bp, Bovine  MMBT00153
  misc_feature (1)..(1): n is any nucleotide
naggataatatagytggatggcatcacagactcgatggacatgagtctgagcaagctccgggagttggtgatggacagggaagcctggtgtgctgcagtctggggtygcaaagagttggacatgactgagcgactgaactgaactgattcagaggaaagaagtttcagtactataaatatttgagttcatttktggcagaagccagcacaatattgtaaagcaattatcctccaataaaaaattagaaaaaaattgaaaggcattaatataaaacagctgtggtataggaagaagtgaacyttcatattcactgagctcttacctgacacataaaaataaccactatctgaattcccatttaaaaattcagaagccaaagaaagatttgtttatatactttgacacttcttctgtcccaatatgagtatccttgtcttgatatgttacaacattaacattttacattatgcatgagtggtcttttccccttagtttgaaaccaacccaaatgcaggtgatattttttcctaaatttgtttctttgctggtttcaaatagggaggaactcatgtttaaaataaaaaatgaaaaattttaaag

SEQ ID NO: 2605 - DNA, 600 bp, Bovine  MMBT02354
tatcccctaatctgagtcatctcactcaccctctaaggccatgtagctcttgctgttctctgttgcatgaagtggcctttatgcttcagaaaatttaaaggtcattttcctttctttgaaacctcactacattttattacttaaagtgtcagtttcagtaaaagaaaacagagaggtgaattgttattttactggtgataaccagagctttggggagtacccctgagagttgttttcaaccgtgggtcataatgccaatgtcccagactgagttcccttcccttttaaacaccataaacrataacccaacaatggcactgtattcctggtgtgaaatgaaagttgtcccataagaaattgcttcaccaaagaaaacatttataaataagaaaagaagtgagctcactgaataaacaatgaacattaggagagggctaaatgattttgcccttcaaagctagttcttttagaagattttgtgaaattaacatccactacagcttcatggtaagcttctaggataaatcattagatatttacctaagtggagccttttgtrgtaaataggaagcaacaggtaataccttacaaagtcccttt

SEQ ID NO: 2606 - DNA, 600 bp, Bovine  MMBT04784
caaaggggatgaggaaaaaaaggcacatgaaataagcatatggtttagattttccataaaatgtcctgggattagcccaagccacaaggacttttttttttttaatagaygacgtgccacatatgcagagcctctagaagggaaatttcaagcagtttgtttaagactgtccaaggaaggttcatgttttaaaactagcatactttactaggcttcttcgatccctaaagaagattcagggggtggggtrgggctataaatcttccaaaattgtatgtaaaatggtatgtgtatgtgcawtgtcttcagaagagaggcctttgtatcaaatttccaaaaagattagacctctgatctaaagaataagatgaatgcttcttttttctgcagacctaaacttattgctatacctgtgatcagaaacagggagtacacaaacagtgattcatcaactttcaaaggaaatatcagcaaaaaggttacyacttactggttcccctggcaggctttttcctggaggaccagcctcaccttttggacctggaagtccaggagggcctgtaatcccacctgggtctccctgaggaaacaaggtaagat

SEQ ID NO: 2607 - DNA, 600 bp, Bovine  MMBT05873
aaaatctgcactattttcaaggtccacagccaaatcccaccagctgtctcctgcctcaccctctgaatatttttgttacattttggattcttgaacaccagtggaagtgataacgaagaaaagcacaactgcttggcgtgtaaaatgcaaactttttaaaaaccaccagccactggataccttaccgagaggaatatctatcagccaaaatacaaactgattttgtcaaatgaggtcacttctttcaaagccgcaactggtggtctgaccgagcttgtgcggtgtatgtctgtgctgagmtgctgtgttttctgcatcaagagagaagacaccccaaaccaacacctctgccctcaggacgtgacctggggactgaggaggagcggggaggacggaggaggggggggtggagccatggccctgagggggcaccccctacaggaggagccagcagggccccaggcaggacttggagaccttggtggaatagcgtctcaggcctcttaagtcaagactagatgccaaaaacgtgaggcccagaaattaacttctcaagcagtcttttacacaacacagaaaaccaccaggccatctatattt

SEQ ID NO: 2608 - DNA, 600 bp, Bovine  MMBT06130
agatgagctcagcctttcttgttttcctttttattatttcctccacatccggcctttcattctgtatttactccacttatcaatgagattacatccaaaagatgaaatgaggacaggactagataatttggaaaatccttccttggtcttttttcagcttcttctaaagtatgctatttagtcccattaatgtggctstaaagctatgaataaactacctgawagagaaaagaactgcctccctgaaaatgctgctgctactgcttcagtcgtgtccatctctgtgcgaccccatagacrgcagcccaccaggctcctctgtccctgggattctccaggcaagaagactggagtggggtgccatttccttctccactgaaaatgctaagtggttctaaaaatatcttttcttaaaacaaataaatgaaaaataaacagatcacaggytcttcccttgacagtaaataaacaatccawaatagattcatcaaaaataacaagaaagatgacgcatgatatagaaatgttatattcttatttgtgttgagattaacacttcaatttgttacattgctggaatccctyactttcatctcagtt

SEQ ID NO: 2609 - DNA, 598 bp, Bovine  MMBT07537
  misc_feature (1)..(35): n is any nucleotide
nnnnnnnnnnnnnnnnnnnnnnnnnnnnnnnnnnnactgcccagggcggtgggggtggaggattgggctcatctctcacctgggcctcctggatggttcccacggtccactcctccccggagcggcagaggtgcgcacaggactgcagctccctcaataaaatccccagagcccccgctgccttgggatcagatacaagctcctgaagcctgggtctcaggcccccttgccctcaacctgagctgccttcagccctctttgagttgctagaatctgatgagcctttgccctcaccatccsctctgccctaatgtcctttctcccactcttcctggcaaacaccgaatagccttcaagtctttgcttaaatataacctccttggagaaaccttcccctgccatcctatctaaaggtgacctcctcacacttcctcagagcgccctgtatttttccttcagggtgcttattgtcagttatggttacacctttacttggggggttgttggttcatgtctgcctctctcagaagactgaaagcaccaccaagrgtgttgggtttaacatctgggttattctgcatccctgcgcttagcatgg

SEQ ID NO: 2610 - DNA, 600 bp, Bovine  MMBT08471
aaataaacaaacccccaaaagagaattccctggtgccttccattgcagggggcatgggttccattcctagttggggaattaagaccctgcatgctgcatgatgtggccaaaacgaaaacaaaccaaaggaaaccacctgaaatgtgacctctgtctgaagttaactctggttccctggggcattgcgacttctggcctccctttggcttcytctgtatcaagcctctgagacagaagtctcgtctgttagggcgcattctcattcgtctgtgtaccttccaggctttgagctcctggggygtgaggctggtgttttgcttatttctgaatctcyggctckcagctctgacctagcaggcattaggcactcgaagcacggtctgagataaacaataggtacgtcgtgatcatcagcggatggtggttgattccaaagcacagacttttgatgggagccttggttctgttaccttcatgccggcttgatctctctaagcctcagtttcctcatctgcaaaatgtacttgtgaagattcagtgaaattctgtgtgtaaagagcttaacacaggacactcaatgatgctgcttattattagcta

SEQ ID NO: 2611 - DNA, 600 bp, Bovine  MMBT08611
tgcttctagtgcttctgtcatatcaactccctgtagctgcttctgcccacagatccatagctggctttaagagctgtgtcctcttcctacaagtggtcccacttatctccgaaatggctgttccaagatgggggttaacaacagggctttgtcattgtgatgtttgtatctataatacattgtgcaaagctgcctttcttcttttgacattatattgtaagtatccctctatgtcactttaactcttcaaaaactttgtcctttataacactctaagacattttctaaatacaaaagcartgattggtcaatgcaaacaacttggcagaagtaaaacagaaaaacacaagggatgataacacactatttatgcttatcattttagtgtatatacttccagtattttcttttgttattttttcaccttttctttttcacttattattctttaataaatgttttccaagtgattgtgtatttttttacactatgattacttaatggctgaatatcagcatagtatctgttgtatactattatcataattttaccaatgatcatgttaaaatttaattaaaaaaacaaatgtgatgactatcc

SEQ ID NO: 2612 - DNA, 600 bp, Bovine  MMBT09282
tcctaaaggtgatgaaaatgaagtcccyccaggtttaaccagaggagcctgagattgacggtgccttctggaaagacagctctggctgcagcacagaaggtgggtcagggcaagccaataggaagcaatggggtgtgtggggggagtccatttccaagccattgcagcaatcggggcaggaggtaagaacggctgctaccaggggagggaaagagaagagcatttgagagagatccagaaagtggaacaaacatttgagggatgaaggatgaatttggagaaactctaccagaggcttcygcccccatgggaccagagaagggaggtctgacagataaaggacatgaccttttaaagggtgatgagacttccctggtggtccagtggctaagatcccatgctcccaatgcagaaggctggagttcgatccctggttagggaactagatcccacagaccacaactaagagttcccatgctrtgactaaaggtcccacatgctccagcaaagaatgaggatcccaaatgatgcaaccaagacctggcacagccaaataaataaatraaataaatattgaaggaaaaaaagcatgataagacc

SEQ ID NO: 2613 - DNA, 600 bp, Bovine  MMBT09302
tgtttaacaggcttaaaacaaaatgtgtcagagatcaagagtaagttatctgatatgtcaagtgcataaggtcaaaggtccaattttattaggtcagaggtggtataaataaaatcttatatgtcaaagaagaagggtcacagataaggtgtatataatataaagacatcacagatgacaagcaataactttaagtagaacaagtatgtttactatagttaccctcactgattaaaaatgaaatgtgtgtatgagtaagtataaaatggcctttatatatcatgtaaactcatatgcacrcttggtttgaggaaaagggggctattaccaaaaataactacatgaatgaagtgaaaacttaaagaaaatgtaatacttctaaactgaaacagtacayaaaatgaatatctcaatccaacctcaaaccacaacagctaaacatcaaactatgctgtagtagctacaaaagttatacaatactatatatttttcttccaaagtaaatgtgtgaattaaatatcccttccttctctatttttctcaatgagataaaaacacataaaatttagatttcagtttacatagtagcagtgctgcaca

SEQ ID NO: 2614 - DNA, 600 bp, Bovine  MMBT09398
aggccccccatgtacttccatgggcctcactgttcttactgattaggctgaccttagaaacacactgttgattgttacatttcttgtaaacgtgctgcrtgcctttctggacacaaatgtcatagtggcctgtgatgtgtcaggtgggcatccctgctggggattttgtcacgagtttttaagggccagtgactgaagccccaacttggtggggtcacaggcaccagcttggccaagggggacttcctctgatttgtctggaaatagtgacttccttacagctgcacagggacagtgtckggtgaacgccaactacaagcctccaacgtccagttccaacgctggacaacctggtgaagggtcagatactggaaagaggatagcgttcctcatgccaatctgttctaaggagcctcaggtcccgctgccaagatggtgtccccgcaggccagctttagggagctgtccacactctgacagcagctgtggttagtccacagcacataggaatgacgaggctggctgtcttcggtgccatgggcaaagcgttcccaggctgccctccctgcatacctcagagctgaccgccctcacagttgc

SEQ ID NO: 2615 - DNA, 600 bp, Bovine  MMBT11869
tgtggtctctggcaacgagcgcatttctcaagtgaaaagataaagacagaaacctattttaaaattaagtctcagaggctctcaagtgagacycaagttttgaaaagtaattgcacccccaaagctcaggatttccaagaaatatttattttatttttcatgccaataggaaagcgggacaccccagagttatgcacaaaggcattttcttctaccagcacaagrgatatacggccaaggtgaaaagtatagatctgccttaatttcttggaaagcccttgaaacgtaggttcagattcyagagacttcacatgagtctgccttccccaccctcaaggatccgagttgcacttgctccttcttggtcttactcygtgccctcttgcagagttcatatacagagcctataattaggcgttcaccacgcttgaaagcatatgttttccacaaccataccactaacctcagaaaacatactctacataaatagacaaaaggccacgaagaaagayttgtttttaagttttagataatttctatcacagtcaaggaatactgttagcagagactttttttggtaagaaatttaattactgcatt

SEQ ID NO: 2616 - DNA, 600 bp, Bovine  MMBT13679
ggactgtgggaactcagggacctttgttagtaggagtgactcctggtgggatttcctggggcagtgctgggaggggagggcgcacctgaaggtccagctagcatccccttctgttcccagtctctccacagcagggcagcagctgccctgagcatccagttcccagggacctgcctgtgggcctgtgtttgggcatctgagaaacggcttcccacagcccccatccccccaccccctgcccgctctgcgcataatctgaatttccgaacagtcattatctgcratatttaatccaaattygcttctctaccctcctccgttwccccttattaaaataattttagagttttagtaacaraggtctttttcaaaggatttctgataagaagtggactctcaagaagccttttgggaattatggatgtagcatgtgtttgctsatttcatgaagataagatttttccttgaagataagtcgatctgatgatcaggacacacaagtggtggtgactattgttgatattcatacasttcacctgcagtgctgttgtgtattctgtttgtagaatccacccccatacagttggagggcttttttat

SEQ ID NO: 2617 - DNA, 600 bp, Bovine  MMBT14865
caatctttgaactgaagatttctctattttacttagaagcaaatgagcaaggctttccagggtagcctgratttagttaatcaatcgtggaaatggycccattcaactagaataaaattccaagaaaaaagatatatcttagggtaaggggagttaartgggggaaaaaaagggaaatagaagttcaaaagccaaaaattttacttgcatattttrtccatcttctcacctgctgtttttatcttttaattttttatctccctaattgtgtcatcagggagcattctatgcttcattgtrtgatgctattaaatcttaagttaaaaaataattttaaatctctgccacctgaattctactttcctatctagatcctgaggttgaatgatattgaatggtagtctgtgcgtgtgtctgcatgtgtccttatgaggttttcaagctaaaaattttttgctacatctgctcttgtattccataaatgacacaactggaacattggagataagttatgtattcgatttatctatttaaataatttgggaattgccttgtgaggcaattcactggagaaaggaggaagtcccccaggagttgatc

SEQ ID NO: 2618 - DNA, 600 bp, Bovine  MMBT15564
gccttccattgcagggggcatgggttccattcctagttggggaattaagaccctgcatgctgcatgatgtggccaaaacgaaaacaaaccaaaggaaaccacctgaaatgtgacctctgtctgaagttaactctggttccctggggcattgcgacttctggcctccctttggcttcytctgtatcaagcctctgagacagaagtctcgtctgttagggcgcattctcattcgtctgtgtaccttccaggctttgagctcctggggygtgaggctggtgttttgcttatttctgaatctcyggctckcagctctgacctagcaggcattaggcactcgaagcacggtctgagataaacaataggtacgtcgtgatcatcagcggatggtggttgattccaaagcacagacttttgatgggagccttggttctgttaccttcatgccggcttgatctctctaagcctcagtttcctcatctgcaaaatgtacttgtgaagattcagtgaaattctgtgtgtaaagagcttaacacaggacactcaatgatgctgcttattattagctaaacctgtctcagtccttactttaccctgaggagt

SEQ ID NO: 2619 - DNA, 600 bp, Bovine  MMBT16097
atgccttttagtggaggagaaagcaagtgagcacagaaggaaccatctcccgtggtctagggtggagccggcctcagccgccctctaatagtggggcggtcgctccaggaagctgccgagtttacgtgcaggtgagggaagagcctgtgggcctggatggcagcggggaggaggccactcggccttgtcgcattattggctgtgaacagtctgagactgcttggccagacgaccccagaatccttacggtaacacgtaggaaagtacagagtgaagaatcagttaggtgctgtttgtcarggttctagacaagtgctggtacgtggcatggggtcgggcagtgcagcacagcctcaaccagggagccagcctgccttgctctgcatccctggtgggtgtggccatgagggggaagggagaggagtcagctcagggcagctgggatccttccttcctctgtgaggttcccctgcagctgctacaagtcgacctccagctgggggtggcctgcagtgccttccatggcaggtcttcaccctgaggcctgcccccggtctgtgtgcctctcgctggctgctgctcagagtcagtgtcctgtca

SEQ ID NO: 2620 - DNA, 600 bp, Bovine  MMBT18609
ccaccctcaccacactcaccatcttttgaactatgtaatgagattttgtattgtgtcatagtcctttaaaaattgtttcctaaataataagaatctgtgtcctttaagtgtgagtgtaaccctcactcaaggggaacagctgtaagtgaaagaattaaaagcagatggggctaggcatggtcattcctttagggagagctggagagtgcaagaggaccagaggaaactattaggccaggataaattaattgctgcatgggagccatgaattgctattggagaagccctctggtgttaatyaggcaattaacacttgggttaaaaatagtagctaagttcaagttgaaacagatagggttgaaagcaatgaaaatgctctgaggcaattaaaggtgcatataaggtgaaaacacatatattttaagaaactgaactgctaaattagtaagtgttcatacaagattaaaaaaaattcsctctaaccatggtattacatagataaaagaatgtaacatatagtattgaagaatttacttaggttaaaagacatgggtgggtggagagcttattccttcatctgtacagtacttctccacttta

SEQ ID NO: 2621 - DNA, 600 bp, Bovine  MMBT19091
aaaaacttggagaatgaactagaaaatgttttatagggcatttttttgtaaactgatttaaaacttgcatgacttccttcattatgattatactgacaggaaacttgtgttgtctaaattctggaaaagatacatacaacttgaaagaaatattaattttcatccagtcaagtaattcctcagaaggaggaatagctagtctgtygggtcttgtgacttcagtggtgcctttgtaatctagactgtcaaggccaggagattactgtcattttgcattttgtgtattttgaggagttttaytccattttcattctcaattcctttccatttcataagccacaactaattatcttaaccatttccactagtaagaactgrttgtrgytgtggtgttacagatcttgcctgttttctttccaaatttcttatccacatgcttcacgatagtctctcgcctcttctttttgcccccattctctcgttttttgacttctgaggactccttgatgacgatggaaaacagagtctctgcctcacattgtgaaatgtgcatgacttagctactattccaacaaacatttctcagacagtgtgggccgg

SEQ ID NO: 2622 - DNA, 600 bp, Bovine  MMBT19246
aataacacccgggttgcctgctcctgagagcatctgcatcactaggacagtttgataatgagattttgtataaaagaaatggacattttttgagagaagtcatgatgtaaagtgtattcttagtaagacatataagagaagctgaaataaaatccttgtaaatttcagtggtgagactatttccagaattagagctctctaattaatgattttttggaacttgttttaatygaagtcctcatatgtcaactcataattttactgggacytataatttgcaaagtgcttttaaaatttacyckcctccccccaaatcctatataataaacaactaatttcttctgagataatttattcttagctcaggctaagaatgctgcttaaagttttatgaaacatctacaaacataacagatcatgcycattttcttagcttttattcttactttgttcccttggcctcaaatccataatttcctgagggcatttcagtgcactttaccttagagaaaaactagttaactacgtcctaatctcacgtcatgagaaattcacaaaccccttccagtgaatgcagactaaatgctgtatctggrgatc

SEQ ID NO: 2623 - DNA, 588 bp, Bovine  MMBT19570
tgcattcatctctttgcacccaactaggacaactttttacattacacagctcagtctggcttctcaagggcctgaactaccagaacacggctttagytcmacttttgcatttttttctagctagtagttacccamactgagagtcyggattccctaaagrcaaaagcaagcctatgctaatataaaatgaagttttgaagtaacagacctttcttaaagaacttcatagataatttttggagggggtgggactcaaggtcatataacataagcttagttcacaaaatacttctttctagytatttyttctttctttgaccagctttatccattacttccacttcaaacattatatacacactgataaattttagaaacagtattttaaatctcatgctttctttcccaagtttctggcccatgttaataactatgcctgggcacctcaaccgggagtcctacagagaatggaaacaattcagtcttattttcaagaacttgttctatcactttttaagttcctgaccttatcatccattcttctgtcaaaaacctagaaggcatcccagaatttccttctttctcata

SEQ ID NO: 2624 - DNA, 600 bp, Bovine  MMBT20818
gctgctctgcctccatcttttggaaggcagctgccttgctttatataaaggcctgcaaagtcccagggggatttctctcagccaagtccrtgctctgactctgatgtattgtccctgagcacattgtcaagtcctatagaaagggttggcagttggagcgagacttactctgtcgctggagtttctcagaattctaatctatcaagccagcccatgcacatacattaaaagtacattaaattttctgtggatttctctatttttcccctatgggttttttttgttgttgttgctttgccrtgactgaaagtcattgtgtaggagtraaaatatcttctaagaggagcttgtcacttgctagagtttaattcatttagattctttgcattcttggcaatctaatgagtttaaagaaacaaaagaaaacaaaaagcacttctgtccacctgaagggcttgwcagtttctagttttgcttcagttcagttcagtcgctcagtcatgtccgactctttgtaaatcctaactatgaagtaattttttttctagggagcaatatatatcagtctccttgttctccctctgcactttattctcattc

SEQ ID NO: 2625 - DNA, 600 bp, Bovine  MMBT21116
cgaggtgagaaacatcaaacaatgaatggcatgaaaaattttaatttagataaaactgaacctatgttacattacagagctattgtcttaaaaaaaaaagccctctactctaaataaaactatgccctctactttccaaacgaagcaatattaaaaccttatttgtacatgtgcctaacgtcatctaaatctcacaaaaatactgaggtactcrgagtatcataactgtcttcttgttggtttaactaaagagataacgtaggagattcatagacttgccaaccaggagccatccctatyatatgactcckctaagatctaagtcctcagttttgttctctgaaaaaagggggatgatattacttcaaaatattcttaaagctgctgtattttctctcaccatagattagtgttcacgttctagaatgtaacattattctagtttttaaaattcagcctattctgagtcattcatgttgctgaatgaatcaataatttgttcctctttattgctaaataaaactctactgtgtgaatataccacaatttgtttatccattctccagttgagggacatatgcattatttttaattttggct

SEQ ID NO: 2626 - DNA, 600 bp, Bovine  MMBT00624
taaagaaccccaaagtgagggagtgtcagaagattggagggtagtgggtgagggaggactggttctaggaagggactaatgggcgacactgagcatgcccaagtgtttccaagcaccgcagagaaaacgcccccttaactcggcctacactgcgactgcggctcagtgcccagctctgaggatgcagaagaatcacccctctgccctgggatttctccagctggtggggaaggcagatttggacacaagtaaccatgctgcaacggctgcgtgtgaggaacatgttgatcagatgtacaytgcttgcattgggggtaacccggggcacagtgggaagactgactgcaagtggaagagaaaggaagggttcttggtggtaatggctttggaatggctttgaagaagggtggggtatatacagatggaaatggggacaagggtgctcaaggaagagggaattgcctaagcaaaggcatgaaggcaagaaccctctggggatgctggagagtcccacatggcccgcaggtggccataagtggctgtagatagctgatttgggcctctaggcagaactaagggccgttccccactcccacagcg

SEQ ID NO: 2627 - DNA, 600 bp, Bovine  MMBT00625
ttaggatggactggttggatctccttgcagtccaagggactctcaagagtcttctccaacaccacagttcaaaagcatcaattcttcggcgctcagctttctttatagtccaactctcacatccatacatgactgctggaaaaaccatagccttgactagacaggagggtcagggtctaaacaagcccattccaaggcagttttacttcaratgaagagcttccataacrcttgacttcccctccagagtcctcctccctcctgattctcccagtacctaaccaggctttgcccatggcwgcactccacacacacaaaccatctgtgcctgtcctagcctgctcacccttctgctgcagacctgccagcctggggggcrggggtggggggtgcggttggctaatgtcaatctgggaacactcttgttccaggcttttaggcaatgactcaattttcacagctagagctcaaaactcatcacataaatgtatgactgtggggcctttttaagtattgtgaacacctaggataaggggataaaaaataatcattccaaagcatcttaatcaaaatgatgcaggatcctttttcccaacaaga

SEQ ID NO: 2628 - DNA, 600 bp, Bovine  MMBT00682
tagagaaacagaattttagaggaggcaggacacgtggtgcctggaccgtctcattatttggttggtgcaggagcagtgtgttcaagtgctctgtcgttagtggcaaagctggcaaagcagatctgagtccagtgccctttccaccacaccatgatgatcacttctctttttaattaaaaatgccctattcctggccccttattgacaagttgttcatagctcttaatttctggggttctcgaaactgtttaatgagcatatctggattaaatccagatactctgacgataaatggtgctyctttcaagatacctatctatgtaagtacagcagagaatccataagttccccatcagtttccccattttaacatcatggctcttttcccgtagccctctgagaaatcagttctatatatatacctctgcttctttctgtcaccatctcttgtcacacatgctcctctgactatggatgccacttttaaaataatgatagctagggatcaatactgaaatattttcaataaattcttatttatcctgtaatatcggcattacagagtttctagttatgtatttaacaggttttccttttctc

SEQ ID NO: 2629 - DNA, 600 bp, Bovine  MMBT00748
gaacaaggaaatggatgcaaagaagtccttaactacatgtgtttaatgatcataacaatttattataaaatgcttagagctacagtcatgctcatgggatgaatgattttcacaaaataaaaacagctgtgggaaaatcacaaactgtaacagtatcaataaaagcaataaaatgaaaagatgtaccttgaagtattattcaagtagatgacgcatatacaattagcttttatgctatatatgactcaattaaaatgcaattattaaaaagttgaacatataaacagtatcagccaacawaacacrtgaacttttttaatgcattggaatatcttgatcaatatgtacttaaaaaaaggttgtattatactttctgctttacaacttgctatagaacaagaatagaaaatgccacgtagatagggtggaggactccaggtttcacatgatagcatctgcactacgactaatagaaatggatcagtgttgattaggagtaaaagctgatggtaacatcggccataaatgcaaggcaaatttcatagcaaaatctaaaacagataaacatctactgcatattgttacccatatttctagaaa

SEQ ID NO: 2630 - DNA, 601 bp, Bovine  MMBT00807
  misc_feature (1)..(1): n is any nucleotide
ngttatcaaaaattatttttaaaataatttagaagattgctgataaaagataaatatgaaaaagtaaattatatttctgtactccagcacaacaaaagttagaaaagaaaacattttaaatatgtagtaataatttatgataaatacaaacaaaatataaaatactctggaataaacttatgaaaaagtatagaagacctttatggaaaaaaacattctaaaacttttttatcaagagattatcaaagaagacaaaawaaagtatggtttctaaaaattattctaccttaaatcttctatktagtacctccttcaatttcagattaagtaccagttcctcagayagttcttatcagaatagcatttatgtacagtgtaggtattttttcactrttctctccctctcagtcygctgttcctctccttaacattcattaggacaatcattttatgtatgtttatgcamtttcctgttacaatataagttgtaacatgagccatgttacatgtttgaccattctatccttagtacttactacttagaaatgtgataagtatttgtagaataaattaatgatttcaggaaggtgaaatattagta

SEQ ID NO: 2631 - DNA, 600 bp, Bovine  MMBT01002
tttattctgatccttgctgtctggagcatcttccagcatattmacttatgactttgaaaggtcacatatttggttttataggggcctctatgtcaaactgggctttaaaatagcttatgcttttkcacttagaaaatctgtacagtaattctatgtatactttattgaataactagattttgaaggtaaaatgaagaatgtgtgtagtctgaaaggtttatactcttccttgatgttattagcaatgagaagtttcctatgaatgaaatcattgttaaagtttgttttccgttttgtttwctttgcttctgaagatgttttgaaaccttgatttctgggaatggaattctttatatgcttcctaggarrggaaatataacacatcacttagaataattcrtaccagaaaagcaacatccttcttgtccccgtaatattgtagtggaacaaatcacccatcctccagttcaacgacaatgagatgggaagaagaggcatttgttttgtacaaattaaatctcccaaatgtattttttaaaaatagcttcattgttttcaaatacacatggtgatttagggtgatgctattgctatccttag

SEQ ID NO: 2632 - DNA, 598 bp, Bovine  MMBT01267
  misc_feature (1)..(139): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatgattctggttgactttttcgttatccagattccacttgaccatcagagtgaccacttgacccacccagagggtgctcatcattcttcacaatggttatatcaacacttgcttcttaagatatctctccacgtgagattgatgggatgacacagcaygtggtgtgcacatgacaatcattcagagatatgggagtgyattagatgtctccccttgagtcaacaacayactcagatatcccagtcttttccatattgtgcctatgtttggacttctcagtcacatcaccatcctaaccatattctagtagtttttcagtgtstctgcttttgtagtrtttccccacttattcatatctaagatttaatcaccaagacrtattgaagacatctttttttttgtatgtttgttttgatagtgtaaggaaatgtagaaacatttgttcttgggagataa

SEQ ID NO: 2633 - DNA, 600 bp, Bovine  MMBT01282
aatcaaagaaatggattttctttgtgtgtggtgaggactcaagatttactctcctaaaaacttttgtatttaatatagagcagtgttaattttacatattttgttgaagagaaagtcccaggtcatcacagttttaatatgcactttataactggaaatttaagtactgtttgacagtcttcattcatttcctcctccctttactccctgtctctggtaaccagaaatttgcttcatttttttctttgtttttgaagtrtaattggtctgtactatgttagttcctgttatacaacytastgagttttttttctgtgcattttgaaatgatcaccacaaaaggtctagggtgctcaagggaggaggtgagatcagtgtcttcctactccactatcttgatcacacttttgtaatcattccactcagaaagcatgttgtataccttttcagctagatcctctagcatttttatcctaggaattttcaagartcagtctgacatttcatcatctagactatctctggttctgctttcattgactctttccttattgttcacaggttacattttcttgattcttatttttytttttatcatat

SEQ ID NO: 2634 - DNA, 600 bp, Bovine  MMBT01283
tcccgcatccaagtagcctcattgaaagtgctttgtgccgtgtttcaagccttagagttaccgtgtgcagagcaggcatccttgggcaatgagagcagggcatccctcacctgggctccctgctaccctgtgcctggagcgctcttggctgcarctgcttcgttgagcttgaggaatccaaagctgtgtgcagggaccaggagcgatgcagatgaaatagcacaaaacagaaaggttaacacattctgtcagctcccactttacattcacagtgaaaacaacaatagaaacgttctcaascataaaagaattttctactccaactgctccgagaagaaaaatgcctcacaaacagcatcttcactcagacatcaaactgcttggctgacagcattttaatcaaaaactccaaagaaagatgagtggaatttacaaagaaacaccgagagaaaataaatgaagacattcactgcacttctgtaggtgaagagtcagcagagccttatgcttctgccctggaggctcacagccctgtcatcggaccaattactctgagttcgtggatagtgacccaagcagcaccagggtcccttgggacat

SEQ ID NO: 2635 - DNA, 598 bp, Bovine  MMBT01587
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnntgcttgcatttaactcttttctttgcagattgtaaagggcttgagagtgtttttgaggaactgaatgtctaaatcctttggaagagctgtcaaagtgggatagtgtagttaataggatgaaaacttggggaaagacagacattttacctattttatcatgtaggactatggggctttcctagctcctcttattatgtttgcagtgttgcagtttcatcacatctayatgtgatgaacattaattattagatcttactattagacctactatctgatgagcctgatgggaaatgattatgaaatccttggaagttatgaccctagcctttgagaaccttgtaatttgatattctttccttgactcatttttagatctgtgttctacccttatccctgataccaaatgtcacctcatatccatttccatcttgatattgccttacagaaaaactctaagcaagacatgaatgataacttactmtaaaattcccagtgaggtcattcttcatctttcattttgttaa

SEQ ID NO: 2636 - DNA, 600 bp, Bovine  MMBT01823
actggagaaggctgtgagttgctttagaatgagacaaaacggtgtctcctgtgctttctgaagacgggctgctctccgtgtgggcgcttctgtgaagctctgtgtcacccacaccacccgttacagtgttcacaacattcacatatctgatccggaggaaatgtagctggtgctctgtttattcctgttacctcctgtcttgaagcaaaatgccagtgcttcaggcaacccggagtggtaaacatcagctgggaagaagtctttatttagagaatttatcacagaatgaatttttgaagrccaattattaagaaagtggaagcaccatttataaggtgtaccattggtacaagtagatatttctaattatgcatttctgatgcattcatgagcagcgtcattgctattatggtctccaacacatatttgtaaatgatacacagattattccactttggatgcccaccaattgtgtgcattcacaaaacagatttctgtgctgttaaggagatataatataggctgaggatttgatacggtgctaataaaattaaaaaattttaaaaacctgccaaatgggtaagatgtttgcgctatcat

SEQ ID NO: 2637 - DNA, 600 bp, Bovine  MMBT01861
agtttttattcatcgccatgggacctaacctccacatataaaatggcttaaatagaaaaatatgttttgaaaagcaaaacaaagatgtaaaaaacgattttgaaatatccattcataggttgtgaactacctgtaagggttaaatcttgtgtttcctaccctgaacgtgccgaagtctgttttccaggacacttggttgacgccgcaggagcattgtcttatttggtgtactgcgtgtcccagagctcagccagccaggcagtagcaccaggaacagcaacactgaattttccctcctgrtccctgttcatggaaccatcaaatgtgcccccagagcctctccatcacggaggcagcacaaatcactgtttttatcaggtccactgactcgcatagcctggtttttctgcacataaagaggtgcaacaagtggaggatttaatggcccagaattcagctatagatattcccttacgttttcattttactataatcagatggttttctgttgctgctgctrctaagtcacctcagtcgtgtccgactctgtgtgaccacatagacggcagcccaccaggctgccccgtccctgggatcctc

SEQ ID NO: 2638 - DNA, 602 bp, Bovine  MMBT01942
  misc_feature (1)..(2): n is any nucleotide
nngctcaacctcgcctgatggctgtagatattacacctccagctcaaaatggaactcatccccctgtgctcacttccaccccacttcggtaagatcaagtactaattctctacacccgcccaggkccacsmgcccagaggcaccgactccccagcctcacctccccactgtcccccagctgtagaccctctcctttccacctgcaccgactcggcccaaaccagagccttatcgagtctggagagatgctgaccaaccggrttaccaagacctgtctcccctacccatcttcaacctactcstgatcmgcactgaatttttaacctattggcatccttctctaacattaagatagaaaacagcagagaaaccaggtaggttatttttaaatttcaagaatcagatgtcaaaaatggtttctaaacacctctcaactcacccatttccatggatattaggtacttacagcactatcaaattcaatgcttgtaattcctgcattactgccagacagggagcccttgaactcacatttgtctgcataaaaacaaagatgccaacataccaattaaaacgaggcacttgaaacacaagggaagcta

SEQ ID NO: 2639 - DNA, 600 bp, Bovine  MMBT01945
agggcagatgagaaagagagcagcgaggagcatcaaagctgagagcagaaaacatgagagcacagagggacaagaaatggatgaaacccacttattaaaatatcgagattctccctggtgtgctgcttacagaaatacccaaaggggaggaacaaggacaggaataaaggaaaagatgaacaaatacacaacgtgcaaagattagcacataaagagaagacatggaaatagaactrccaagaaattgaattctaagtaaatactatgtaatggggcaaacagggccatttttaatggacwcaaacccaatccaatatgagaagataatgatggtagagctttacatgctggcttaagccraataaagcaaaaattattgtaattgcaaaggacattgaacagaagagygattgtaagattttaaatggtatggggagggaggagggaggagggttcaggatggggaacacatgtatacctgtggcagattcattttgatatatggcaaaaccaatacaatattgtaaagttaaaaaatwaaattaaattwaaaaaataaataaataaagcaatactgtcagctcagaagagatcaaacac

SEQ ID NO: 2640 - DNA, 600 bp, Bovine  MMBT02283
gttgccctggagaacagtaaggaggttcctcgaaattaaaaatagaactatcatgtatgatctagcaatcctactctgggtatatatccaaaagaactgtaatcatgatcttgaaatggtatctgcgcttctctgttcactaccatccaaccatctcctcctctgtcgatggcatcaccgactcgaaggacatgagaytgagcaagcttcaggagtaggtgatggacagggacccctggcrtgctgcagtccatggggtcgcaaagagtcagacacaactgagcagctgaactgatgttyactacagcaatattcatgaataccaagaaatgtaaacaaatatctgtcaatagataaataaatataatgtcttagccatttaagaagtaaatcctatctctattttctacattctttttgtcttgcctaggcatgctttgaaagaatatgaatatagctatttcactgattgattataatattccttgatagattgactcttaatggcttataaataatccctatccaatccccctgattctcaagtgtaggataactgataaagacctgaattatttcagatcagagaaatagctggat

SEQ ID NO: 2641 - DNA, 600 bp, Bovine  MMBT02314
tgttcctcatgctgacacagacatacactcgggcagttaaactatagccagtcttctatttggctccaggtaaaggaattaacagcttgtagggaagctaattagatccaattattattcaactgacctaatttgacattcaatgtctgggaagaagtcatatgaattaactgaatagagatttaactactatatacatatgagctccatggataatttattcctaatgaaactcatttggagaagaggaatgtactgattgagacaaaacaataaaaaaaaaaaaaaaaaagagggagrtgatctaatgcaaaactcctaaaggaatatgagagtgtaacataacttgtattcattcattcttctactcatttatgtattttttcaaagcaaactctttctgtgagtaaaacaaaagccyttaattttatttttaaaakcctgagcctcaatttgcttatttgataaggtgattagatgaactgatcaataagtcctttcttctatggcatttttttctcccaatatgtcatttatttaaaatggtaactagatgtaagacacgcttcattttgtrggttccagttggtaagtaaaatc

SEQ ID NO: 2642 - DNA, 600 bp, Bovine  MMBT02603
ttggccctttcccgcatcctgctactgccctgatctgggaggtcacttctccatgccttggcctggaaggcacttgtcacatcactttggaattgtcttctgtgatgctctcccctcctagcttctgagctatttgagagcagtgaccacatcttactcgtttttgtaaccctagtgccaagcccactctgaagcttcacaatgctttgtaagtgactgaatggtctgggttttcatatcctaactgcttctctctccacagcctgtcttctctcacacacagcattcctgctgtcatcyaacgaatctgtcttaagtgctccactgaaaaacctgctctgatgtcttcaatgactcccattgctctcggcatagtgttgaaccagcattgtctgccttcctacatccacgtctactccacaacttactggctcaatcttagctaaccttctaggtggtctgtgaaacaaatcttgctttggattttcctctyggccattccacattctcttgcatttctaaaacgaaagagattgggccagccctctctgcttgtgcttaggctgttctcctagttgggaatatccctacctcctactt

SEQ ID NO: 2643 - DNA, 600 bp, Bovine  MMBT02617
tatatggaaagaagataacttctgaattctgaaacacacctgttaccaagtaggaactgtttctaataattgttatgtaactttattcttataggccaaagagtgtggccagatgcaaaacaagtggctgatgataaacattcaaaatgtacaagactttgcatgccagtgcctcaaccgtgacgtatggagcaatgaagctgtgaagaatattatccgggaacatttcattttctggcaggtgggagagttaatcagacattttatagcattttactttggtagtatgtggtttctagraggaggaagtaggttataagctgaaaaaaaatagctgaattaaattattacatatgaaaacatagagctacccataatggctaagatagtaaagacaaaagaaaattagagcatcagtgaagagaaggagggaaaaacagaaccaagccaaaaaaaaaaaaaagaaccaagccatataaccatatagtacacatacttgagaagaattttaacatcattttttaagcatcttgaaaagagtgtatagctatactgtttaacagaaatgtaatatgattaaaattttattgtagccacatt

SEQ ID NO: 2644 - DNA, 598 bp, Bovine  MMBT02901
  misc_feature (1)..(96): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaattgattgaaagttatttcttgtttctagcaaatgagattgctttctaccctcacaagtgttttaataattaattattaagttaaatttttatgaactttagaaatgtaactcaaaatatatgaacaagccttgagcatattttaaaataattgatacagttattagaaggtataaatttttaattatagttgcctttgwgaaaaaaacaaggcccagtayaacctcatttttcccttgaaggtgaaatcctcatttaaagatactaattctaataacattggccaaatgtacggactgagacatttaaagtaattatgaatttgtaagtgatgtaataatttcattttgagaagattttttttacttaatcttctaaggcttttgaacttccctggtggctcagatggtaaagcgtctgcctacaatacaggagacccaggtycaatccctgggtcgggaagatcctctggagaaggaaatggcaacccactccagt

SEQ ID NO: 2645 - DNA, 600 bp, Bovine  MMBT03030
gtactcatttgggtgtctacctcattctccctctgtctaggtcatcatatcctattggatatgcctcctgaatagcttaaatccatatattttcacagtcagtctcctggtctaacctactgaactgccatttcttgataactccctaatccaggccaccaccctctctcacctaaaacgctacagtagtctcctactccttttattccattcttgacattatagcttagagaagtctttaaaatgtagcatgtaaatacaatgatttctttttctacttaaaccattcagaatcctctktcgttactaggataaaagcaacatccttaaacatgaactctttctggccaaacttagcatcttcatcttcatttaattatctccatttaatctctgttcttcccacactggatacctttcaattcctcaattcactgtccttcttcccacctcataaacttttcatattctattccctctagtggattgcttcttcacttgattacttgtcatttacttacaatagcttttcctgagtctcaggaccagattcgatacccatactaagtgaaccctgctcttaacttcataacaccgagg

SEQ ID NO: 2646 - DNA, 600 bp, Bovine  MMBT03054
agaatcccagggatgggrgagcctggtgggctgccctctatggggtcacacagagtcggacacgactgaagtgacttagcagcagcagcagcatgattactcttcattttaaatttcaacaaaggtgtagaaagtagtactaagcaaatgtattgyatgagttatacaaatttccatgggtttgtgataaactgagttcttcagatttaagatctattttattctgagtcatttacaacttaacactggctctgctgccaatcaaaatgacaactgcaaattcattcatgaacttgatcygagaagagaaatccctacagatgattttaagtaaagggaaagtagaggagaaaattacatctgtagaaactaggtgttattgtccattatggttgctaaaattactagcagttcgtcagagaagtgagtgaaatggatcccaagaactggctcataatttggaagctgagattagaaagagaaagcttaagatccatatgacaaatatatgtgagctagagtggcacagtttctcatctagaaacaaacaaaaaacacctgaaaagaaatcttaatagaaaaccttgaacttttgggaga

SEQ ID NO: 2647 - DNA, 600 bp, Bovine  MMBT03076
aaaaataatccatagaagtctataaaatattaaataattttggtttatctccaatttttactatttcttaagagcctcagaggaaaggcagtttcaagcatttgagctatcttaagaaaaatgaatttttaaaaaatccaaagtattattcacataataggatgagctttccataaagctctagggtaaagcaagattaggttacatcttacattcactgtgtttagcaccataaagcatttttcacacacttgcagactcggatattctatgagctagtctctgagatattccatgaartcaaacaccaaggactgtctacaaacaaggaaagtgtgcattaaaagctactagctacagggacttccttggtggaccagtggttaagactctgtgatcccaatgcagggacatgggttccatccctggttggggaattaagatcatgcaagtcacaaagttataataaattgtaagtgttagttgctcagttgtgtctgactctttgcgattccatggactgtagcctgccaggctcctctgcccataggattctccaggcgagaatactggagtgggtgccattcccttcttcagggg

SEQ ID NO: 2648 - DNA, 600 bp, Bovine  MMBT03628
ggagcttgaaagtaaaactgtaaatgatcccatctgtgattcttggctgatgattcctctggggtggaccaaagagggggaaatcagaagcaagggtccgctttgctttaaacaaaatatcgttacccttctagcatcttcctcgcttggggtattttccaagtgaaagttcattaggaagacacgaaagcacgttttgctaatatccatcaaagagagggggttcagtttcaaagtgcagaagaaatacaatagtgttgaagcaaaatacatgaaaaagatcttatggcccccgcaagygagaaagaaacagggactggtgacttaggtttttttttttaagtcaatctttatttgggacaaaagattgagtcccaggaaaatgagtgtctcctgggctttctcttatttacattaggcagcctgaaccaaacattttggtgtatttgtaaatgtttgggtttcccatttcatattttctcctgttggcaccaaagctgaagggctcagaatttctcaaacaaggttcttacccacggtgatgactattattaacatgtattgatctagaggatatacagaaacaggattaagtgcaga

SEQ ID NO: 2649 - DNA, 600 bp, Bovine  MMBT03764
ctaaaatacttactagatcttaagaagatataggaaccaaagttgtatttatttttaatacatctggtaaaccaggcaaatctttaagacactgtgtttgtcactgcacttcaagcattgtcagttcattggatttcatgatgtctaggatgctttatactcattgaagatgcaatttcttctattcttcttttacataaatattaatataagagttaggcaagcatccaaaaaacctgtttgacttgatttgtttttctcatcttcattcattttttgcttcatttatattctcctttmtcctccctttgaatataaaatgagttgcttcttaaagtttctggtatagtttagcatttattttttaagtaactttttccatatgtttgtttttacctccatgaagtctctgtgtttcagcgttcttcaccctctactcctaaactaaaggaaaacaaaagaaaagaaaaactttagctttccttgttgtgtttggctatgatctgtaaaatcagtcaatcccagctctctaccctaagtttataattttaattagcttctgtataaaatttccctcctgactccattgcccagttaaaa

SEQ ID NO: 2650 - DNA, 600 bp, Bovine  MMBT03785
taacaggagagaacatgtaatatctcaaggtttatttctattttattaatcattcctcctgtattacagtatctctaaattaaacataaattggttgctgtcaaaattccaggttttaaaaaaaactattacataatgactttgaacttgaactagataatccacaattatttaccatgatttctgaactcacgtgaatacaccctgagaacataaagagcttcagcactgatgctatttttacacgagcctagttggttgatttgttttctttggttttgtttttcgctaagaggatayaggagagtggttattaacatttttagacttaatgtacaaaactctcatgtaagttgtacatagttgctatttcatgttggcaaacctgacaggctttcatcataatatagtgcattaaaatccctcatttgactaaacatgggcaaatggcaaaccagctggttatgcaataatccagatgagcttaaaagttctggagaagagatgagttgctaaatgttgtgactgaatcaagattttcttgtcaaacataattagctgaatatggaagcaggtcagcagttagactgttctgtccgt

SEQ ID NO: 2651 - DNA, 600 bp, Bovine  MMBT04165
gaaataaaacaatatttggggtaagtttgtgagattctcttattgctctaattgcaacatgtaattctagggaaaattagggacttggctcattcaaggatatcacattcgttagaagaaaagagatcatattaagtcagtggtagttttaagaggtagacattgttaaagatatacatttgaaggaatagttggaggcagtagaaatggacttattagttgccttttcacagcctttctgtataatcaactccatttttttataattctgaaaatcaaatatacattgttttatttctrtaaatgatctctgtataataacagtttgtgatggaccaaatgctgttagataatgtaaatagtccaggttgaaaatacaggtatgttgataaagatctataaatatgtaaaagcctatacagaatagtaatattttactggcaaagagaaaagtgtccgttgacagtgcatttttcagtctattctttctgagaaagtctcagattagagatattgtaagctcttacttaagttctgagtaagttgttaatagctgagtgatatattgttttaaagaataaaactattatttattgtcag

SEQ ID NO: 2652 - DNA, 600 bp, Bovine  MMBT05503
ggcattttaaagcctggcctctgacccattgtaggtagcctgtctaccacaaggtagactcagctttaccatgcctaaacaaacttgaaattccttgctgtaaaccctgtcagtttctctgccaggccaaataggtcaaaattctttggccaaagatttcctacgaccataaaatgaatgaaacatgggttccgtttagtgtacatgctacttcctggatggtcagttatacagttattgcatttcttccttctggcctcatatactctgaaagccctagtgcccttccctagatattaygtaacatcatgaagttgtgttaattatccaggtatgttctgtggacatagttgagcttttaataaatatgagtcgtaggattagatggctgaccaggttctaacctgaatccttactgaaagatattgaccaccatgcttttcagaatgtgcaggaagatcttttgagagagtaaaaaaggacaataaaattttgctttttattttttctttactctcatggtgcttctattttatgtatattttaaaacacatataatatgtaaatatagtaatatatgtttataatgatggtaagggg

SEQ ID NO: 2653 - DNA, 598 bp, Bovine  MMBT05862
  misc_feature (1)..(71): n is any nucleotide
nnnnnnnnnnnnnnnnnnnnnnnnnnnnnnnnnnnnnnnnnnnnnnnnnnnnnnnnnnnnnnnnnnnnnnntgtcccaccgctttgtgtgattgaccttaagcttcaaaaagcaaagtgtataatctttgcttcgccctactttctcagataagcgcgctcttgtgtcccatttagtgtggatttaagacaagagaaaaaaaaataatcaagaaaatgagttgggttctaaaaaccagactggcaaaagggaatacggacagtgtcttaaaaccttaaggaggagggaaagcgagctggycggggctttaatcccaaaggacctaccttccctccatttcctgggccatttccactccaagctaatcttcagcaacaactgaaccacgttgggatgcgtcgctcatgtaaaatcagaaacctttcacagccactgagttctccttttaattaggccggtccagccgagttaggagcggacactgaccagctcagccttgcactatcctgcckggtcgaggtcgccccagaggcttcacaccctagctgtatgcagctcgcgggcagcagggggcgctgcggaacctccrtcccttccc

SEQ ID NO: 2654 - DNA, 598 bp, Bovine  MMBT06132
  misc_feature (1)..(75): n is any nucleotide
nnnnnnnnnnnnnnnnnnnnnnnnnnnnnnnnnnnnnnnnnnnnnnnnnnnnnnnnnnnnnnnnnnnnnnnnnnnataagactgaaacccttttcctccctttatcaagtggttcaagttttcctcaacccatccctgtctttagtctgtgtaattattttattattctcaatcataattgagaaaaaaattaaatcaaaccctaaggtcttaagaagaaagaaaaaagttgaaattctattaagatacactcaacttagtttcaaaggtaagttactccaattacaagttaaggaaaartcagaggaataaattttacaaaaatattctaatatatttctgaacatggaaacatgactggcaaagtgcaggaaattcttatacaaattcattaagaccagaggaaaagcstttttgatgtgagaccagtacttytcaaattagtattcatgggcttcagtatagggcaaatctggggaaatgctgattcagtaggtctgaggttgagcctgaggatttcgcattttttgtcttctgccaggtgayactatgtgctcgtctgcagacatactttgaattgcaaggtttgaaagtgtat

SEQ ID NO: 2655 - DNA, 600 bp, Bovine  MMBT06135
aaatttcctttttgattagctctcccttttcttatgtcctctgttccctttcaacaatcactttgatgaaaacgggtagaaaggagctaaattccttgatggaggaaagagcttgcataaagatttctaatgcagatggagatgaaggccagaggtattaaggaagcagtcaatgtttcagataataatagaaagccacatgtaaagcacagccaggaaatgacttgatgtattcgagtgttcaaacactcattttcttattaagaaacatggtctttactagccacaggaaaagctccwtgctacttttgcctgctggaatgtaggatacacatttcattggtctctgttcctgaaatctgtggcttgaaacttggagagcagaaaggtcattagatttagctggcctaaaataatacttcatgaaccaattccgattgtcaagtaaaagcattggcttgggatctaaaaacctgtaaktctttggaatgaattaattgacatctttttaaaatgttaaatttatttgcaacatttaggaaaatgtgtagtctccatgaacacaggactgccttttaagtgaaagattttattttaagc

SEQ ID NO: 2656 - DNA, 600 bp, Bovine  MMBT07128
tcctttaattaaatgaaggggggaggtgtagttattttcaactctccgcacaaattactacccagtggaaacagaattgtgtattgtaagtagtactcattctatttattgtgccgtctattgatgtgtgttggacttgttctattttggaggcactgccatggtaactgggctcctgacaaaggcctgtgtcagagccaaacttgtacatgcagaacttcagataagtgatgaaataaagaatcaacctcagtaggctcaaaaataacaatttggagaatcatgttttgctcctgagtrttttcatccacaaagttgggaagttctgagaggcaaatcatgggatttactggacatcaaactggatctgagcaaaagggtggaaggaagtctattttcacagtctcttagcacccccctgtcaacttctctggctctgcctttgggttaggctcacagttttagggaaaaaatacaagctggtgttcagcctttagagaaccagggtgtctttagaggatttgccttgactccaccgccctgagatgtggccctgaatctgcccttagatagctcaggggcttcaccaaaccaggattc

SEQ ID NO: 2657 - DNA, 600 bp, Bovine  MMBT07613
agagtcttcaaaaatattttcaaggcattactaacgaggacaaagtggaaggcagcataatcttaagctccaggtttcctggtgcgtcagctgtgtaacgtattagctataaatgacctcagagtttctcaagcagatcaatgttttgttttttttgtaaatatattaatttagttcttcaaacatccaaggttttattatgggatgcctcaatttatcagtgttttcaaaagtttgataaggaagagtgatggcaaacaatgatttctccctgtcagaagggaagcgacacttcaaatktcttattcacctcttaaaaccgggaacagactctagtcacgaggtgagaaacatcaaacaatgaatggcatgaaaaattttaatttagataaaactgaacctatgttacattacagagctattgtcttaaaaaaaaaagccctctactctaaataaaactatgccctctactttccaaacgaagcaatattaaaaccttatttgtacatgtgcctaacgtcatctaaatctcacaaaaatactgaggtactcrgagtatcataactgtcttcttgttggtttaactaaagagataacgta

SEQ ID NO: 2658 - DNA, 601 bp, Bovine  MMBT07614
  misc_feature (1)..(1): n is any nucleotide
nctaaaatttgtattgaactctcaaagaaacagtgaattgttatatatattattgtgttcttaaaagtgattttattgttgtatgtagggaaaagcctgtccttttctttctttttttgcataaaacaaaaggtatttgtcttttaaatttttaaaggcttcttttaagagtttttttttaaacatctgctttaagatctattcaagactgaaatgtattttgtttaaaggtataatctctgtgaaacttaggacagtaacttctaatcaggctacagttctctgaaagggtcagtaaaakcatcatctatgcaactgatgaatctcacaggattccttcacagttttcctgattctttgactaatagtttcaacagtttagcctatagaatcatattctatatttgttattttcattygtgttctgtacatttctaaatcaagcatagccattttttcagaaagtgatagttatatatggaggaaaataggaggcaagccaacccccacckccaaggaaaaaagtatttctaaataacaggtaacttatatctaattggattaatttttcattttaggacttgaatgctgttgcttttag

SEQ ID NO: 2659 - DNA, 600 bp, Bovine  MMBT07625
ctcattgaaacagggaaagggtggttgtctgatttcattgaggaggatatcactcagtaaccatgttctgtccctgcctcatccctacctccctgttatctcctattactgagtcagggttctacagagatcctcttctagtttctgaaggcttttaggtttggccttctaaccctctgtgaaaccttgcttccatctattttctgtattcatgtattatgttmtctctccatttcaatgaagatggagttttgtatytgtttcttattagagtggttttaggatatatagaaagaagayatgcctttacattgccatcckaaaatcaagtctagtagtagctcttgatgagcctatatcctcagtgaatctgaaaaaaacaacccrattcaaagaacttttacaaaaaacatgcaggatttcccagctgtgaaacaccactgtagacttaaatatatattcaagtggatggcttccctgatagctcagttggtaaagaatccaccagtttgattcctgggtagggaagatccactggaaaagggacaggctacccacttcagtattcttgggcttcccttgtggctcagctggtaaaga

SEQ ID NO: 2660 - DNA, 600 bp, Bovine  MMBT07628
tgaattaaagtrtactttagctaatacagctagcctaggtaaatagcacggtagggctggatcactaggtaaagactggctgcagggctgcccgctttcatcctgttggtattagtttcaatgtctaaatagtattctagtgtgctgttacagacactttctcaggtattaaagtcattggtatgatcaatttgtacaatgttctaaggcacctcaatctcttctctcctttcaccttcagtacggttccacttcaggtatttcttgaacctctgtttttcaaggctcaggagtgattayccctggaaatctctgaaacatgatcactgccaccaagaagtccaggttctgcaaaagaaagctgaggacatctgcttacctttcctgatgctctctgaggtaacatagaaattcccaggcctctcttgacttttttctgcaaaaactgtgagataaacagcattctaagtaaagccaaatagtaccttttctaagaagctttataatattttatacatttagcagaaaaattaccaaaatcttgtccaaaataaataataatggatcacaacttggaccactgcatgcagttctgtaaat

SEQ ID NO: 2661 - DNA, 600 bp, Bovine  MMBT07630
acacaagaaaacggttacatttccattgttatcaaccagcatcttatcctcatttctctgcttagaatgtatgagagcaaaattttccaaaggtgttttttgatgatttctagtttttttcatttgttttgaacaaagataattgattgagattctcaaccaaatgtggttgagattctgaagattatgtctagattctggaaattctctcttgagcaagaaagaaatgggtcgtgaagatgacgcctctttccaaagtgcatccattaacacctactgttttctgatggacaggctctrtggagaatttcctcgattattcaggaagagaaaaacattatttttcaagaaataaaaatgcagtttttttttaagtgctgaccaaggggctggcgctaaattggcagaaggattcctttgtctcttatttgactttgctgggcatccacttggttcaggttagaaggatgctggccttcacagttcatttaactccaagagcatccggctttgttgaagtgtaggcattgatagtcatctgttttgactctaacagggaggacttggccctgttcaatctgtgcccattccccattatta

SEQ ID NO: 2662 - DNA, 600 bp, Bovine  MMBT07642
gcaaagtaaagatgcaatggaacaggtaacttaaccyacctctactgcagttctagatatggaatttgggctgggagcgctcagcctgcatttaacctgttgggcaggagggtggggctaaatggggcggggggacgggcggagctgccatccccttcccccagtgaccacaaggcttcaaggtctccagtccacatcccgcacactatctcaggttccaaagcttgcgatcctcccccagggccggccccctgaactctgaccaccttcccgctattagatcttggggtggagggaacygaggagggtagccaacaggatcaatgtaggataggcaggctgtcaaccttcatcccagatgtccacccgcctagtgtaggcggtatccctctctgcccagtaggatgatggtctctcckggcctgagagcccctcccccgctaccctcgccttccttcatcctggacagtttgcggttctctcctctcctcagatctaacctcagtctctcctgctgcagctcgaggacgagctctccttcgatcccgccagacgccaggagacgtgacccagatcccggggagcactgttcaccacgcg

SEQ ID NO: 2663 - DNA, 600 bp, Bovine  MMBT07646
tggtatcaaaagatttgtgtacatattttatcacactgtcccttttaaacaggtccctatagctcagtccccccgccttctgttcccccacccaagaagtccctgggaactcagtcccccaagaaagctgcagagaagcagcagactgtggagagcagcgaggagagcagcgatgagtctggtgagtcatcttccgtggtgggtcttggaagtgtgtgaggagtagggaaggagatgcttctgttcccttctgcttttctctgaagcaccacagggctgatgctctgtgtgggtctttgyatccttgttgtttttggctgtgtcacatgtcttgcggaggtctcagttccctgaccagagatcgaacccgggccatggaagtgaaagcccagagtcctaatcactaggccaccagggaactccctacgcttcttttacttgcctctggtgggactctggacccagcctaatgccattgcttctctcaagattcaagttctgaggaagaaaagaaacctccagctaaggcagtcatcgccaaggcagctactaaagcagctccagcaaagaaggcagcagagagctcttcagacagctcgg

SEQ ID NO: 2664 - DNA, 600 bp, Bovine  MMBT07855
accatctatctacccctaaaccagcacaagaagcagcagacgatgaatgatagcagatccaattcaggatcaccactgtacttgccatataaatataatttcctgtctcccttcttcctccctctcccaacccagttgcaccctgggcataagcacttcctctctcctcatatatttctatttgcacacatggcacaggatgacagcctattgatagtgtttcatattacagactcacagacctaggaaacgctatagctggcagcaggcgaccaccgaatgtccgtcattactttactmtcatcagcactcacctgagtggtctttgttgatcctgctttgcgtttgcttttagccaagcagccccaaaccaggccttttacttagaattctcgcttattgctttttgagaacaaaactgctgctctttctttctgctaaaccccacttgaggaggtgttgagatctgctcagaggcaggagggaactagagccactgatttaataaaagcaactgaggatcaccactgggtccaaattccacttaactgaggacatttacatctgatctgtgacgatgtagaataacatggacttacg

SEQ ID NO: 2665 - DNA, 600 bp, Bovine  MMBT07860
gtaataacatctcctgaaaaaaaaatttgtgacccctgtaggaaaactttgctcccttgaagttggtgctgcctgagtctttgaagctccatccaccctaaattcacaacgtttctaatcacctttcaaaatcagatacttctcctgcagtaatgatggatgtacaggtgtagggatgttttagaatatgtgcatccacattactgctgttgtgtcatttccttctttcctacttctaaaaaagtttgaaaggttatttaaatgcttttgtgaacacagtttttgaaaaacataggaaayacaactaaactttaatcacttagatattcagtggttcttctactggtccctggctctgttcccttttctgtctaaaattgggacctcctaggaaaggcttgcttgtattttttgaatttgtattttgtttgccttgttgcacttgctaaggcagcctgccaggactctttgtyctgcccttccaaagctccttytgtctccccagtcttggatttagcctggggttagtgtatttggtatatacactgacattaaataagcaccacacaatgtgaatttgctatgagaaaattctcaraa

SEQ ID NO: 2666 - DNA, 600 bp, Bovine  MMBT08551
taccccaaattcactggggactgtgggaactcagggacctttgttagtaggagtgactcctggtgggatttcctggggcagtgctgggaggggagggcgcacctgaaggtccagctagcatccccttctgttcccagtctctccacagcagggcagcagctgccctgagcatccagttcccagggacctgcctgtgggcctgtgtttgggcatctgagaaacggcttcccacagcccccatccccccaccccctgcccgctctgcgcataatctgaatttccgaacagtcattatctgcratatttaatccaaattygcttctctaccctcctccgttwccccttattaaaataattttagagttttagtaacaraggtctttttcaaaggatttctgataagaagtggactctcaagaagccttttgggaattatggatgtagcatgtgtttgctsatttcatgaagataagatttttccttgaagataagtcgatctgatgatcaggacacacaagtggtggtgactattgttgatattcatacasttcacctgcagtgctgttgtgtattctgtttgtagaatccacccccatacag

SEQ ID NO: 2667 - DNA, 600 bp, Bovine  MMBT08561
gctctgaaaggatgaactggtgcaagtgaaggtgagacatgaggtctgagggcagaggaagtgggttttctcttaagctagtgacaacccctgttcatgatggaatggtgggctgtgcctgtggccctcatccagctcctcgccagggacaaagtaacccaaaaggagacaaatatctctgggccacccaggccagccctctgtcagcagcagcactacctggaggaaagacactttgcacacgcactttgcacacacaggccttgatattgaatgaacttgcatctttgttttgttccrtgcacttacccttgatttagtgcatatttaaatcgactscactgtgttcctggatattccttgcatgtgtgtggcattttaatcccattattctctcttggcagaatggtccttgtgattgcctgtgacaggtagttcttaacatcccaaggatggcaagaatgggcatagccgtcaaataatcatagagtgtctttgaacaaaatgcttacaaaataaacaaatccaaacatcaaagcagtgggaagatgaaacagtaaatgaaatgagagtgcattagaagagaacttcagagtgtta

SEQ ID NO: 2668 - DNA, 600 bp, Bovine  MMBT08581
atcataaagatgtcagctctcactgataaatttaatgtagtaccattaaaatgaaagccccagcacgaaggacccaatgcaaatataaataaagagtttttttttttttttttaaagaacaggttgtcaatattagagctgaaaattttgtacaggttctggtaagattacttaagaagcaaatcaaaatgcttaagctgtagctgtttaacatgattataagtgctgattattcaaatgaaattaattagtcacaaattccccaagaacattaagctactcctcagtggcagaaaaacyggtgattttactctttcrttgaaatatacgctgggtttttgaaartatgaacaattcctggaaatatgaaagcaactgaagatttcttggtcaggatttaaagaaagatcaaaacccacttagttccacaatcaatatagastgtgaaggcaggaaaaagctgagragccatcttgaaggcagccaggcagaargaattctctggtactcgaccttttgtagtaaaaggccattttggatctactgatgggatgtggcccacccatggtggaagcctcctgcagctttaaggacaatatt

SEQ ID NO: 2669 - DNA, 600 bp, Bovine  MMBT08651
gaaaacaaataatataaaacccagagaaatctatataaaatgttaagactatcaactagttcttaagcctgcataaatcttggtccttcatatgacattgttaccaaaaagatatccagagatgtttcatcttaatgttttcacatgtacatcaaaagaatatgaatgcttccaagatgttagtctgtttcattgaatttcacagctttgcatcccatgtcaggawgctgtagcagagttgtgctgatacccggcgcagaatgccagcacatgcatatgctgacacagatgctaaatgargagtcaagactgtagcactcagatgtatcccaccccagacttttctcatctaaatttaaagcctaggtggcccctgcaggctttccctaaacttgccctctggctatgactckagactaaccatcttaaatctcagatgaatagcactgtccatattgtagaagcgtggcacttgatacatttcccaggcctgaggctgcagtctttattgccagagtagtaaaccatggggtgtagtcactgtggtcagcaagctgtttgtctgcctaatatctctgtggtcaccattccttcatgatt

SEQ ID NO: 2670 - DNA, 600 bp, Bovine  MMBT09192
ttggtgtagtcaataaaacagaaatagatgtttttctggaactttcttgctttttcaatgatccactggatatacctggaaaggtttgggggaatcttaatgcatattactaagttaaagaaaccaatctgaaaaggctatatactgtatgattccaattatatgacattacggaaaactcgaaactttggagacagtaaaaaagatatgtgatttccaggagtttaggggtaagggaagaataagtgcaacatagggatttttagagctgtgagtttattctatatgatactgtagttktgactacatatcattatacatttgtccaaactcagaatttacaatacaaagtgcgaatcctaacataaactcaggactttagttaataattatgcatcagtgttggtttatcaattgcaacaattctgcactggtgcagggtgttgatggtgaggaaaactgtgtgtgtgtgtctgtgtatgtgtgtgggaatagggtatattgggtctctgctatgttgtattcaattttgctattgacctgaaagttccctaaaaagtaaagtctactgtaagtatgcttgggcatgaatacatagat

SEQ ID NO: 2671 - DNA, 598 bp, Bovine  MMBT09864
  misc_feature (1)..(14): n is any nucleotide
nnnnnnnnnnnnnnttcctctcattcattcctgtttctcctcggactccctgaatccagatgatttctccccgagaggaagcacgtcaggacgacgttcaggctcatgcttaatgactaaggccttctgagacacctcrctggaaagctgccctatggtttgctaactgaacgagcagggtggcagagaaaaggcctttactgttctttttagatggcctcacacatttaccctcagctcttggtaaagaagaatcgattcatctcacaacctccgctgttgccatggcacccacctggmtgtagctggagagaagcacccactgttcttgttcagtctctaagtcacgtcatactttgcaaccccatggaccacaatacaccaggctcccctgtccccgacyatctcccagactttgctcaaattcacatccactgaggcggtgatgccatccaaycatctcaycctccgccaccccttctctttctgccttcaataattataaaagcttacacatrtcaaccatacaggaactatttgttaataaatgatctgtcctaatacttacaaatgcaaagcataactccatcctggtaaa

SEQ ID NO: 2672 - DNA, 598 bp, Bovine  MMBT10170
  misc_feature (1)..(92): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtagcaggaaaaacagccctgtatgagaagacaaacaggcatggccgtgtgacaataaaactttattaacaaaacaagcagagggccggattcagcctttgggcaggagtttgctgaccctgatttagatgaacccctgctacacaatgtaattgaaaatcttaggatgcaccaaataacaggagaaaagcggcccaaatagagtygggtggaggaaagaaacgaagctgctttgctttctggacttggttttctcatggaagtgtgtgccaggtgctgtaaggagaggctcagagaaaaggggcggggggctcacctaggcaggctgtggcagtggtgtcaggcgcgtacccagcctggcagtggcaacggaaggagccaaggctattgatgcattcaccatgagggcacaggtgagggagcacacggcactcatccacatctgaggacaagcagggcttggctggggctacccaccttggtcactgggacacgccacctccc

SEQ ID NO: 2673 - DNA, 600 bp, Bovine  MMBT10172
ctgatcagaaaagactgtcaggcagggggattattctacagccagacagttgggctgcagggtgagtaaaaagttgcccagtcagaaggccagggagccataccagcacacagttytggcagtagagcaggctgctacacacctctatttgggcagtagaattgtcgggaagctgcatggtcatgttaattgtcatgggatgctgggtggctrttcgaccaatgagtttggcagtggggcagcctcaccactgtagaaccaagagcaaaagaatgaggtgtttgacaggcagatgaaccrtcagacagggactcggacagctagagaaagcagcagaatgaccagaaattgcccatccagatgagaaaccgtggaaggggcggccgtggtggctgcgcaccctgaaaccgccacctgcccggcccctcgggaatgaaacagagcgtggccaaccaggcctgaagcgctccgtcagccgagagcgctacgtggagaccttggtggtggctgacaagatgatggtggcctaccacggacgccgggatgtggaacagtacgtgctggccatcatgaacattgtaagtgcctccscctccctgg

SEQ ID NO: 2674 - DNA, 598 bp, Bovine  MMBT10272
  misc_feature (1)..(39): n is any nucleotide
nnnnnnnnnnnnnnnnnnnnnnnnnnnnnnnnnnnnnnncgcactccgcgcactcgtagggcttctccccagtgtggatgacgtagtgctggatgaggtgcgctcggctgctgaacgccttctcacagtccttgcactcgaagggtttttcgccggagtgggtccgatggtggcggatgaaggtggagcggtgggtgaaggccttgcggcactggctgcacgtgtagggcttctccccggtgtgcgccggctggtgctgccggaggtaggacctgcgcttgaaggccttgccgcactcgscgcactggaatggcttctccccggtgtggatgaggtagtggcggatcagcgtggagctctggctgaaggctttcccacacgcgttgcactcatagggcttcatgcccgtgtgaatccgctggtggcgcacgaggtaccatttcctgttgaaagccttcccgcactgcttgcacttgtagaggtgatggctgggggggccttttccaggtcgctgtgggtcacgttcatggagaacatccccccgagagacgctcttctggaacgcccctaagtgcagaccatcacctgcccctaaacc

SEQ ID NO: 2675 - DNA, 600 bp, Bovine  MMBT11402
tctaatcattcgcttaatcggataaactgtatggttcgtgcgagagtgccagctatcctgagggagacttcagagggaaccagatactagatggttcgattagtcttttgccgctatatccaggtcaggcaactgatttgcaacttaggaccactacagagtttcctctgaagaaaaagaccacgtggcactctatttatctctgcattcatctctttgcacccaactaggacaactttttacattacacagctcagtctggcttctcaagggcctgaactaccagaacacggctttagytcmacttttgcatttttttctagctagtagttacccamactgagagtcyggattccctaaagrcaaaagcaagcctatgctaatataaaatgaagttttgaagtaacagacctttcttaaagaacttcatagataatttttggagggggtgggactcaaggtcatataacataagcttagttcacaaaatacttctttctagytatttyttctttctttgaccagctttatccattacttccacttcaaacattatatacacactgataaattttagaaacagtattttaaatctcatgc

SEQ ID NO: 2676 - DNA, 598 bp, Bovine  MMBT11506
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnnggcacagcaacaggcagactctcggccgtagtgggaggggtggtggtgatgcaaggggctgagctgctcaatctgccccaggcccactcacctgccttgtgttcggactcccagaaccacccttcctgatagcccggggccagggaccacaaagcaacttctccctccctgcccctgccttctcccagtggttctggtctcggaccacatcgcacgagccagtgcaggakccctgctggggacacaaaggactgaaagcgacgggatctggggtgagtggcatcgatgcaaagcagctcagagttctgctcaatgatctcggaaatttcttgtccattcttccactttcagggtcttacacattcacgaaggcaacaggcttgtagtgggttgccaagcctctcatctattgcttcgtcctgtygccatagagtcctgacccttcttttccctgctccaacactgcctgcggctcctcactgtgcccgcaaccaattcctactcttaagccagacttgctacactctg

SEQ ID NO: 2677 - DNA, 601 bp, Bovine  MMBT11563
  misc_feature (1)..(1): n is any nucleotide
naaaagataaatatgaaaaagtaaattatatttctgtactccagcacaacaaaagttagaaaagaaaacattttaaatatgtagtaataatttatgataaatacaaacaaaatataaaatactctggaataaacttatgaaaaagtatagaagacctttatggaaaaaaacattctaaaacttttttatcaagagattatcaaagaagacaaaawaaagtatggtttctaaaaattattctaccttaaatcttctatktagtacctccttcaatttcagattaagtaccagttcctcagayagttcttatcagaatagcatttatgtacagtgtaggtattttttcactrttctctccctctcagtcygctgttcctctccttaacattcattaggacaatcattttatgtatgtttatgcamtttcctgttacaatataagttgtaacatgagccatgttacatgtttgaccattctatccttagtacttactacttagaaatgtgataagtatttgtagaataaattaatgatttcaggaaggtgaaatattagtaacaaatctagtcttgtttcaccactcctttccaaggactgttt

SEQ ID NO: 2678 - DNA, 600 bp, Bovine  MMBT12109
cattgtatgaaatgtatattctttatgagatagtctagcaaaatagccacaaatttctttaactctataagcatccctaactctcataaatcaacatatatttaaatatttaacatrtgccaaaaatataaaatatgggtttttttatttaagtctatatcaccagggcaattttcatcaattgaagccacagtaattaccatttattaccactagaataatgtataatccctcactttctgttttcaaagcatgtggttggttaaagatacggttgaaataaaattcatggcagtatasttggagataattctatgctctcttatgaaatggattttacmgaagtaagtaaaggtaaaggaaaggaaaatgtaggagatgctaagcaaataattgcccatttagtttattaagtgtcctagtttgcatttaatgaaggaaagtagaatttattgattgccatcaaatgcctaatattatcaaactagttcacattttctaatttagtttttaaaacaatacatgtatagaacagtcttttggactctgtgggaragggagasggtgggatgatttgggagaatggtattgaaatatgta

SEQ ID NO: 2679 - DNA, 600 bp, Bovine  MMBT12155
tgtccatgggcttttccaggcaagaatactggagtgggttgccatgccctcaggggatcttcttggtccagagaaatacaatgacatgcctctataagagacagaggaaaagacacagacacaaagggaaggccatgtaaagaaggaagcacagactgtagataaasagctgcaaaccaggaaatgcatggaagagcaagtaattctccccttgagccttcagagtgaatgtggcccttctgattcattgatttctgatttttgacctccagagctgtgaaagactacctctgttgtttkaggccatcaagttagtatgttatggcaaccccaggaaactgatatacttagaacaagaattgtttcacaaagaggtaatggaatggattagaaacaacatttatgcaagatagactcagattttaacctagattttctctgtacaaattgtgtgatataaaaaaggaagttacttaatatctctgatcgtcatgcttctcattagcaaagtgatggtaagttttcaatgtagggtcactgtgggatatggagatatgtaaaacacctcacttactgtaagcattacaacagcagaatatt

SEQ ID NO: 2680 - DNA, 600 bp, Bovine  MMBT12157
catgcttcctaattggaccctggggacctgagaactgccatagtttattgcactattttactcatcacactgctggttgtaaaagaaaacgcttcccacgtttctgtaacacatatgtacgttttaatagctggacattaccactaacagagtatctttgctataaatcacagctatcagtccactctactttatccgccccatactcacaatggagattcttctgttttaaccacttaccttccaaaccttgtagttccagtatgacttttcttttttaactacttaagagaatcttgyttggggcaaccgtagcatcctgtggtttaaaaaaaaaaacaaaaacaaaacagataactgtgccttgactgagtacccatcccatgcaccatcccatcctctgtagcccgcaggacactgagcatccccacccatgtgctatgttggaaagttgcttggccattctgaagtgctttctcaattgtacatgtgaatgtttggagggcagaaatgactaagggaaaaaaggaasgtaaaaaaagcagtagctttcacttctctttgttgaatcacaacttagagagtaacttgggagatgtg

SEQ ID NO: 2681 - DNA, 601 bp, Bovine  MMBT12158
  misc_feature (1)..(1): n is any nucleotide
ngtcccagactgagttcccttcccttttaaacaccataaacrataacccaacaatggcactgtattcctggtgtgaaatgaaagttgtcccataagaaattgcttcaccaaagaaaacatttataaataagaaaagaagtgagctcactgaataaacaatgaacattaggagagggctaaatgattttgcccttcaaagctagttcttttagaagattttgtgaaattaacatccactacagcttcatggtaagcttctaggataaatcattagatatttacctaagtggagccttttgtrgtaaataggaagcaacaggtaataccttacaaagtcccttttgtttgtctgttttggacctatactgttaatagtaagatcttataaaaaattattttgttgctgctcagtcactcagttgtgtctgactctttgtgaccccatggactgcagtaggccaggtttccctgtccttcactatctcccagagcttgctcaaactcacctccgttgagtcaacgatgccattctaccatctcattctttgttgactgcttctcctcctgtcctcaatctttcccactttctaaagatacaaag

SEQ ID NO: 2682 - DNA, 600 bp, Bovine  MMBT12220
aatataggaaagaatacaattttacaaattaaattatccagaatgctaacatcttgagaaaactaccatcagtggtttagatgcattttgtagtttagttatagtttaaaacattgacctttttgtcttatttcctatatatgaaaatttaaaaaaacactttgaaaaatgtatacattaacatactacaattgtctagaattctacaagtcataaataacactcaatgtttttagtatatttattttatattatagtattatatgagcatatgtatttgtatactgaatattagttacygaaagaacatcattggtcygagattcaaaagagtatgaaaagggggctatatgtcagataatatcacatcttaagtgatttactattatttctcaattaaaatagaagcaacacagtggatcatgtaattcaatatgagttttaattatcaagaaaatcattagttaagtttattgkctattaagatggcttttatttattttcctaaggaaaccaataactgagagagacaaaacaaaaacttttggtttaataatgcactgagcctagtagctcaactgtatagtttccatattatta

SEQ ID NO: 2683 - DNA, 600 bp, Bovine  MMBT12348
ctaaagggcaaaacaaaattagggattttcctcactgttttggaaaaaatgactacakagaacatcaactttgaagaagccaactacttaaagttgtaacaatgattgtctttgaaaagattcagtagttaagtactgtttggggagaaaaaartgttaaactattcagtagagtggatatgaccctatcacaaatgtagaggaagtacctttaaggctttttaaaaataggttttrtattataaagtaattagcctccaattaaaataaacatattaaaaacatgaaaataaaaatagsttttagttgccacttatgaataatcataattartattaaatatcatttatagaatgtattaaatttttagactggcaaaaagtgtggattaaaayagaacttaaatattatatcttaaatatcaaatgaggtcttcttatcaccacagacatatttttcaatgtggtggaataattaataataagcaagccctgtcagcactgaccccttaayagtggcagagataagccagcctcccacccaagggagcaattggagggattttctcattggtatcatgactttattattaatcacaga

SEQ ID NO: 2684 - DNA, 600 bp, Bovine  MMBT12471
gtccatggggtcaaaaagagtcggacacgactgaacgggcttcacttcccttcaggcttycttagatgattagagaaagcattgccctgcactttttcctcagtcttgtcccctctgatatggcacccaggtctctgtggttcctcagagcctcctgacaataatgagatgcaggaattgtctgggcccctaggcacccctagtgcctctgtctttcagtgtcacatgcacagtcttcttggctacaccagaaacattttgttcctctcactgagtgaaggagctctgagaacccctctkgaccattggcctgggatcctcacactgcacctcttctctacgcccataaccatgatgaaatggaaaactccacagctggtccctgactcccagtagaggtgggaagcgaagcataggccttccctagtcttacaccctcacatttctctgtgcactatcatcccctacagtcacctctttgacactgaaggcacgatgacaggggtcagtgccacttttcaaaacccagcaccagtttcttttctgaatttcttagagctctctcttctcaccctggaggtattttaatatctcctactg

SEQ ID NO: 2685 - DNA, 600 bp, Bovine  MMBT12501
tcttctaattttccttcctataaaatagaaaaagaagatctatgaaaataaattcacaacaattgatttaacaaataatattgagtctaatcagtaacaaaatcatataacaaaccatgtaacaaatacattagtgaagaacttttcttttttaaaattattttccattatggttcatcataggatactaaacatagttctctgtgctagacagaaggaccttgtttatccattccatatataatagcatatatctgctaaccccaacatcacaccatccctcctccaaccctctccccsttggcaatcacgagtctattctctatgtctgtgagtctgtttttgttttgtacatagattcatttgtatcatattttagattccaaatataagtggtaacatatgctatatgtctttctctttatgatttacttcagttagtatgataatctttagttgcatccttgttgctacaagtagcattatttcattcttttttaaatggctcagtagtactccattgtatatatgtaccacatcttcattcattcatctgttgatggacatttaggttgtttcccagtcttggctattgtgaat

SEQ ID NO: 2686 - DNA, 600 bp, Bovine  MMBT12551
gagagacctattattgctgagctttctacaacatcaaaagcaagaaaattcataggcattatttgcctctaacctgttttattccactaggtaagattttgccaaagtctggagattgcatatattgcccagaaatggcaatagaggtgagagtcaaaagtctcaggaagctctttcaaaaagccaatagattcagttgtaattttcagcatattttaaaaactcgaagttaatcccttatttaactaataatcatatccttttactagaaggagagtctaaacgatttgtttggatttytaatactttcatttatttcttcatttctaaacttgcttactgatattaatttgggggastggagtggcaatatgaaatgattttgctctaaaacttgtaagacatcctttcagataactgaagacaccaaagaaggctacaaggctatacaaatagaaataaaaatccactatgaatcttctgcttagrgaraaacatttaagcactgaagcagagtgaaccagtagaggggcatataaagaaagaaatggcaggagagacgrgttagtggttagtattcttttcctaaaattttgaaaa

SEQ ID NO: 2687 - DNA, 600 bp, Bovine  MMBT12769
ttccatacatcagtttcactggcactttaccatctaaaatggcccttcctagtggggaagctcctgttctttatgaccactgacagaagggcgttaattcctataacctgcccgctcatctccactcattatacccyctcacctccccagtcagtctctggcaccagtctctggattgtcatcaaaaaatacacactgactgctaatttagatagctgataacagtttcactttatggatcagccatctcctctttgttccatccaggaaatcccaggccgggtttccaattcatttttyctggcctctatagccaggaggtacaaggagtaggcagaagtgtaatattgcttagtggagaagaagattcccctggatttcatttacttcacataaggagaacaggctcatagtttaattccagctgaaaaacttctatatattaagacagcaaacttatttgtcagaaacctatttaatcctacttttagttatactctttaaaattcagtgagttcctgcctgggaagtctttgctttgcttgtttttaattattaactaatttttgactgtttcatcctgttatgaaccctccaata

SEQ ID NO: 2688 - DNA, 600 bp, Bovine  MMBT13042
ccttctcactcgaggttgaaaatatttatttccgcgagctgccacagagttctcaaatgcctcttgtgtcattgccttcagagcagatttacgagaaaagctttccctgatcacaaaatagtctaaccagacttggctttaaattaattgtggctctttccacaagacgaatctgtcattggagatttaccatcatattccaaagaatgtgcctcaggctcagaagacgtctacgatgagttctaacaaagctttgaacaataactgactcttttaaaccaactgtgtacaggcaagtcrgtactccgaaagagacaccacttagtgacctaggtattgctgtgttttcttatttcgtggttgcaggttcaggcggaaggatttttcctaaggcattttccycattggacaggtttactgtcttttagtcctttaacttggttttccatctggacatgtgtatagtgacttttcatcttgaaactgcatttttctttactatttgaartcccccccatatttttatatttgaaatccactcccctcgtatcagtcatttctatttcaattttgtattgtgaaatcgctcatctgtgctct

SEQ ID NO: 2689 - DNA, 600 bp, Bovine  MMBT13335
ctgggaatggagagtgggaagaactaacacttaatgagcagtagctcagaagtacagcttaagacttcaacccgattttaaaggctttgtaacatatagaaagatgggaccccagaaacagtctgaataattttgggggagatggcccttggtcaggcttcatctaaatggttctaggaagaaaggcttcagccttatttcaaagtgcccactgagggcacaactgctaggtaatttctctaagaacaaattctggtttctgtaccatttgaatccttcttgataataatatgcataagsagaaacaacaagaatataatttggaagttttaaaactggtttattctaaggaaggctttaacttaacaaaaaaagaatgcgtagatgtcagtttcagaaacaatttttcctgcacatcttctagcttagtaatttagtggcaacaagagtcattaatgctgtcaaaaacagcagtgaggtttaaaaataaaaattcaaacaataatatccttcacgtttttaatatgtcatttactgaattggcaatcacaactgagatttacgacagccttctagttagaaaaaacaaatgaatcgtac

SEQ ID NO: 2690 - DNA, 600 bp, Bovine  MMBT13478
tgccaccactttttgtctgtgactatggacaagtcacttgatgcttctgagcctcaatctctccattcataaagtgaataatagtactttctgtttagggtagtttgaggatccgtgtctgacatggagtaagaactatgtagctagttattattatctttgcttggggagcaaaggattgcttcctttactgtgtccaggacaaawgcagaccatccccagggatgctttctggttcagtgctggactgtgctgtgtttgtgatcccttgcctagtttcatctagcagaggagaaagamcattggacttgggggtcagaaaacttgatttaggatgccttcttccactaatgagataagtacacttgggaaaaattccttattctgtccaagtctcagtttcctaatttgtccaggggcacactcacctggggctcactgatatatcgtgagactcaaattagatacccagtttatacgggtgtgctgtgtaggctggaaagcactctatggatggaagatggtggcagcaagggatgagctattggataatgggcttttgatgtcaggggctgtcccagtcccttctgatggccttgg

SEQ ID NO: 2691 - DNA, 600 bp, Bovine  MMBT13844
ttgtgaggataagaaagcatagcttgcgggcgtgctgcaactcggcagacacacagtgggcatgttggtgaatattagtatattcactcatagtatgcagatcatatggggaatgttgttttccacattgattgctaatgtttagggaggctcttgaaatactaaaagccacattgagaaaacagagctgtttctttacccaaaagagaaaggaaaagaaaaattgtcttcacatatttcaaagtcaatcagtagataagggaaaggtattttcaaggcctaggcggctaggtgggagcyacaaagttgttgaaaggtagatttcattcattcattattctgcgccatttatgtaccagatcccggggatgaatagaacagataaaaatcaatakaaggttaatgcaaaagtaatgtaaaaaccagttattgatacctagcaataccgtaggctgctttgtcaactattaaggtcccagtggaaatggcgaattgaaggtgaatgaccaaacrttactgtttagaggcagtctgtgtaccagaagagaaaattgagtagtgacctttatagttgattccagtttgtaagtatccataatt

SEQ ID NO: 2692 - DNA, 600 bp, Bovine  MMBT13959
ttatctgtaaatagaactggggggaagaattagtaaataaccagggcctcttcccaaaagggctatagccaaagctcttcttagcctctctgaatgatctctcaacattccagcagtctgagttgtggtaccaggcgtgataagctattgtgaagagaggtytagaaattgtcagttaccaatatttttttagtccctattgtggatcaagaattgtgctaaatggactagatatataagaggcttcccttcttcaaggaggattagaaagactgatgttaacaagtaagcagtttggtkgtttattaagtgcaaagtgttttgagagaaattattccataacatcttacggaaaaacccaaacaaactttttggccaacccaacgatagcgtcctttgggagtggtaccactttaaatggggtggcctagaaaggcttctgaagcctttatgtttgcatggaggcctaaaggataattttttaagtcttagccatctttatgctatggatccttttggctttctaatgactctttgatgaccctcttaaaatacataaaatacacagaattacaaagggaattggttatattgaaatga

SEQ ID NO: 2693 - DNA, 600 bp, Bovine  MMBT14214
ctccctgggccatccctctgcctctcctcgcactgggctcccgcccccagggagctccagacatcaccggaacttcctgggcattagcctgggcaggggcacggttttaaccagtgggaacagtcaagctagaagaatgcatgttcccaggcccagcttgcggtgctggggccgtagatgaggagggggactgttttttaaatcgcttgggaatatcctttcttttgggcgtagaacccagctcttgctttttgaggaaacttccttctctttcatcctgtagaaagtatttttcgattygacccattygtggattgtaaagtcaaggttgtggggtagagacagtattttgcaaaatgaaataggatagaaaattattagaaagtttcccacaataagaaaaaagtgaaagaaagtgaagtcgctcagtcgtgtcctcatggactgtagcccaccaggctcctcagtccatggaattttccaggcaagagtactggagtgggttgccatttccttctccaggggatcttcccaacccagggattgaacccaggtctcccgcactgcaggcagatgctttaccgtctgagccaccaggga

SEQ ID NO: 2694 - DNA, 598 bp, Bovine  MMBT14733
  misc_feature (1)..(49): n is any nucleotide
nnnnnnnnnnnnnnnnnnnnnnnnnnnnnnnnnnnnnnnnnnnnnnnnnctgagttctaattctaagatagttaaagacaaattcaaagttgttttaggcaatctaggtagcataagtttactacaattctccagtcatctagtaacctttttatattaaattaacaaagatttgggtaagcattctcaagaatgagtgttttatatgtactggaaaaaaggaaagtggtcatcccttagactgytgaatggctaataaattcaaagaattattcttgtctattaacacttgcagaattrtgttatgaaatattgagaaagaaatatggagtttactattcaatcacaaacacagcttatttcattattcttagcattatttmaagaaataattcatggaatgtctcatatacaaaaggataattcatttctagtatctttcaagtatatttttggttcatcattaaatatgtgcaattccttcagtcaaacacattaaccctctttataaaacagtttgacagaaaatagacaaatctaaaattatgttccttctaaattattaggatgtttcattaacaaaaaacatttcttagtt

SEQ ID NO: 2695 - DNA, 600 bp, Bovine  MMBT14963
aaaaagagaaacagactcacagacttagagaatgcacttttggttactagggggcaggagaggggaggggagagataggttgggggtttggggattgacatgtaaacactgctattatttaaaatggtaaaccaccaaggacctactgtatagcacagggagttctgctcaatattttgtaatagcctaaagggaaaagaaatgaaaaagaatagatatttgtatatgtrtaactgaatcattttgctgtacacctgaaactaacacaatgttgtcaaccaactattgtccaatataaastaaaaatcaaaaaaagaattatcctgcaatgtagttgtcaattaaaatcaaagctcatattgttttaaaatatttaatcaagaaactctaacttaggtataatttgcagctaaatgtaaaactagaatacaacttaaagacaatgtaggtcagaagtggttcctaaccttgactgtgctttagaattacttgggtagttcttaaaatgtcttaatgccctactgcacaataaatcatattggaataagagacacaagtatcagtacttttaaacctgattgaacaattttgttatgtagc

SEQ ID NO: 2696 - DNA, 600 bp, Bovine  MMBT15500
tcacatcaagaatattctgtttagtaaggaaaataagtttgcaatacatttgagaaatattctcatcccaataactacatatccacgtgcataatatttaaattattatgttttagttaccggaaamaattcatgtatagagagcattttgccattgaaaatgctgactgtaaagatctttgatttctataaggttatttcttctgagggtgggtgctgggatgtcccttgattatacactcacttgtaagaygttaattccttggtctaagatgaaatgtccctgagtctccctaggtyatgtgagtggggctgaactggaataacaggtaaatagaaggggagtgaacaaaacagggaaaaaaatatacagtggaaattttagaatgtatgttatggaaagagaacgaaacagcttatctagttgctaattgcttactcagtttttccattcttccctgcctcttttctgcttcctttcctcatttgagtgatcatgttcctttccaaaatcaccaggaytccatagacaattgctctggtgaacggataagggcactcmtctctccccctctacccctcctctctctctctctctga

SEQ ID NO: 2697 - DNA, 600 bp, Bovine  MMBT16004
aatcattcgcttaatcggataaactgtatggttcgtgcgagagtgccagctatcctgagggagacttcagagggaaccagatactagatggttcgattagtcttttgccgctatatccaggtcaggcaactgatttgcaacttaggaccactacagagtttcctctgaagaaaaagaccacgtggcactctatttatctctgcattcatctctttgcacccaactaggacaactttttacattacacagctcagtctggcttctcaagggcctgaactaccagaacacggctttagytcmacttttgcatttttttctagctagtagttacccamactgagagtcyggattccctaaagrcaaaagcaagcctatgctaatataaaatgaagttttgaagtaacagacctttcttaaagaacttcatagataatttttggagggggtgggactcaaggtcatataacataagcttagttcacaaaatacttctttctagytatttyttctttctttgaccagctttatccattacttccacttcaaacattatatacacactgataaattttagaaacagtattttaaatctcatgcttt

SEQ ID NO: 2698 - DNA, 600 bp, Bovine  MMBT16115
agaaactgtgacctttgaaagaggaaccaaccaagccccaggtaatctggaagatagggaactgggtgaataaacgcctcactctttctctcctccaccctttgatctcccactagaggtttggccaaatgcaatcagaaaccagagaatgagagagccctgttagcgcaacccacagcagtcagcctccaaggacacaaagcaggtgataagggtggagaaaggtctggagaaacaagtggaagatattcggtatagcaaccaaggacgttcttctgcagataatcatgagccaaaatygataatacacacacacatgttctaagtcrtctgatcttcccacttctcattcagtaaccctcactgaacactatcccctgtgagtaaggcaactgcttcttaggcaaacgaagtaaaaacacacccaggatttctaataagcaattatagatctttaaatttatagatgatctggttttctgtatttatattataatattcttycattagcctgttctagctgggctaagcacaaagctttttgcccacagatgagacatgagccctggagacccttaagggttactggctataatatag

SEQ ID NO: 2699 - DNA, 494 bp, Bovine  MMBT16301
ttttatctttcagaaaaaaatcagccttatgcttatcacacatcttggacagtggatcaaactcactgatccaaattctgatgaaaaaatatcactgttctgaaatagttaagatttattttgcactcagtgtacctttaaaaatatgccagcattgcacatagcaggactgatactttttctccttttctttgctgctaggctgacatgttaaataactgtcaagaaaccaaagataaacagacctgaagggaggcgaagttctttcaggcaaactctgttatgcccaaatgttacatragagcaagagcccacaccctagtttacctgtctcttcagatactggggagagtagagaaacctgagaaaacagatctgttctattttcctgatcactgccactgctcagggttgagactggactcctatttgtgccttttttaagtcacaattcacagatagtatggtatccttgtcaccaaccgaagtataag

SEQ ID NO: 2700 - DNA, 600 bp, Bovine  MMBT16302
gagtatgaaattaaaattgaaagccaattttgactttaaagaaggactttaaaattgaagtccttctacttcagcaagactcttgccccaaggagaaraatactccagggagacaggacagtgtcttagaccagcttttgctcatgaaagagaaagctagttttcagaaacagcgtgatgcttagagaagcagagaggagagatggtagtcagagccctaagtgggtttctggccatttccacattcaggttttataccttggagaggactgatgatccttctctcctgactttggtgamcatctccttgtccctttaataaagaaccaaaggtctgtttttgtttgttatttacttccacaaactgaaatgagacttttactaggttgttcctayttcttcaggctggcattgtgattaaaaaaaaaaaaatgtgtcttcacacattctgtaaaatattcaggaggctgagggagcctgtaagtgaatatagaaacataattagatagattgataagaaccacctcctaggacaggacatcaccttgggagcacaccacttgtggaaggcttgttgacattttattatccaccctgcaa

SEQ ID NO: 2701 - DNA, 600 bp, Bovine  MMBT16355
catatgtttagaaggtaaaccataagcatktattgagcataaccaagttaaaagcagttcaactgatactttatttttttaattgatttttgattggaggacaattgctttacaatgttgtattggtttctgccttacattgacacgaatcagccataggtatacacatgtgccctccctttttaacctccttcccacctcccatcccatcccacccgtctaggttgtcacagagtacctggttgagctctcagcatcacagagcaaatttccactggttatctattttacatatggtartgtttatgcttcagtctactctctcaatttgtcccaccctccccttccccactgtgtccacaaatccattctctatgtctgcatttctattgcttcatcagtaccatttttctagattccatatatatgtattaatatagaatatttgcttttttctttctgagttacttcattctgtataacaggctttaagttcatccacttcactagaactcactcaaatctgttcctttttatgactgagtaatattccattgtgtgtgtgtgtgtgtgtgtgtgtgtgtgtgtgtgtgtgcgcac

SEQ ID NO: 2702 - DNA, 600 bp, Bovine  MMBT16455
caggagagattctttgccaggctaaaaccttattgtttttgtcaaaaaaaaagtaactaaaataatttaattcacaaattttctcacagaaaaatatttttaaatcattatttttgttttgttttgttttttggtaaagaatttatgcctatgattcctgatgctgccaaatgagctttttcttgggctgagctttggcaaattcctttggtagtgctcatgttccctagacaactagataatgaaaaaatatctattggggttcatacaacaccaaagaaaccagcctgggaaatgaaytttgtctcacttgttcagcagttattcctctgagacagaagcatctggcctcactgattaaaactgcttcacctgcctggaggcagtttataatccaattttcaatctaaatccaggaatttcactgctgtgattcttcacactgaagaaatcagtgtgcctctgcttgagaaaagagttagcctgtaagtttaacaaaatcccatgctccaggcgctgtgacctaggattcaatcggtgctttgcactgtggcctggcactctacagagtgtgtttaaccagccgtggaagaaagtaga

SEQ ID NO: 2703 - DNA, 600 bp, Bovine  MMBT16546
gggatacgcttgaaggaccccagaggacacctccaacttcagtgtcttttatgtactatttttttcctttatatacattctccgataaagtttagtttttaaagaaggcacataagagattatcatcaataaactaagagaattatgacaacatattgtaatcagagttctatgcaggtggtctccctctcaaaatatctcactgcacaaatgaaaaaggtcttttccatctaactaagcatttatcacacactgtggccataatttttgcagtctatggtgcaacagcaaaatgagcayggattcttttttcttcactatttcatggctaaagatttgttcttactctagatcttcgcaacctcagtatatatgattatttttctttccgtgttaaatctttcaccttttcacttagaaagcattttacagatttatcttcggcacctttgcattgccagcatcaatactcctatacttgagggctcattacgaagtaaaacaagggtggctggaacagaaggcactgagcttccaggacaatcgatctgatgacacatgacccagatggccaccaagtgtctaacaggcggatacgct

SEQ ID NO: 2704 - DNA, 445 bp, Bovine  MMBT17291
aaagcaaatgtttcaactgagtgtctgcctcttagaacctttgagacagctggatgggctgttttatgtcttctctagcatagggctgataacttcatattatgactaatactttctattttgcacaatcaattacttcatggaaaaatccaagaatgctttatatattaagtttattttctcaggttctgaacagagaattaatcttgaatgattggatttcattctagtatgagatacttgtggatttctttgaaaggaaaaatcagaattagtttaaaggaagacaagaccaagagractgattagtgaggtaactgttaagttgaaaatggagaaaataacaatctctaccccaaaacccctcccagtattcctttgaagtcctcttaatagatgggctatatctaaattggcatctgaagctgttacgccaaggacattc

SEQ ID NO: 2705 - DNA, 553 bp, Bovine  MMBT17402
tagaatgaaaaatatttttatatttttaaaactytttttcttcctcaaagaatgagaagaggcttataaaatagaaaaaacaaggaaaaattcattttgagatagaaaatcaagttcaggaagaaagtgtatagatactacttggttattaaagttgaygctcaaatttgtttctgagcttccagacaggcaaaggagatgaagtattaagagtgactgatttaagttgttagtgaaaagaaaacacaggagtttctcaagacaaatcagttattcttcaaattttaatctaaaaaataycattttgtaaatgtccaatgtgtgatattattggcatttgttggggtttagaaaattcttagaaataaaatatttcaagcatttggaagtgtatataaaacaatataatgagcatatgtgtatcctacacatagcttaagaattaaaatattataattaacacctttttgtacctttctacaattctgtttcttggtatctctacccagaattaatcattctccgaatttagtgtctctcatcttcaatttaa

SEQ ID NO: 2706 - DNA, 600 bp, Bovine  MMBT17412
attatacttcatctacagacttctactgtatttgagtaaattttagataaattctctcatagaatatgatgctatttttgaatgggccatcattattcactaactgtactaaattttgtctcggtgaaggaaagtagaagatgataaagaagacaaaaagtgcaaagcaaaaggctggaaagcctaaggaatattgtcctgaatgttctgtgtctcaacatctccaggctacctcctgtgaacctagcaaagcatcagtggggcttctctcccttctgacttttggttgggcaaggccaktgggaggcmstagtagaggactggaggrtgggagaaaatgaggtctgcgttttcttttctggtttcctcctgacagagctttatcagaggctgtgtttctttccaaggccatgattcctgaaggccttgttatagatgcagttccccctgctccttattccttcaggtcacagaggaggcaacgtcttcctctacttcctccacaaatcatcaggaatcttatgattcctagcggaatcatctcccacattgatttcttttacctctgtcccatgtctatattctgtcatccccccctct

SEQ ID NO: 2707 - DNA, 532 bp, Bovine  MMBT17452
ctatttcagaagctgagtgagcccagagtcactgtggcattttggaactacttctggtgggggagggggaagactgctaccccaccctcaggatcagaagtatgagccagccatcatcatcatcatccggtcaggggcttcccacagagagactgtgggaaggggaggggactcaggcctcctggaaggagagggaggaagaataggggtagtatatagggacatgagaggctcagaggcacaggtgaaactctaatacatacgtgatgaatgggaaaaggatattcttgttctccatayaggtacacacacatgcacacacacacgtaaggacaaataatgtcagtatacagctaacacgttcataggcaacaccctccagcacacacagacacaggcacacacacacattgctcaaagacacaccctcatacactcagtcataacaaatatgtgtgtaatggaaaggcacatgcttgttttacacacacacatggcaatcaaacagaaacacacaaagagatacccaaat

SEQ ID NO: 2708 - DNA, 600 bp, Bovine  MMBT17495
gctccctgaacaccaagctctttcctacttaacaactttgtactggatgctctttcccctgtacttaactggttccttgccattcagcagaattatcatctcagagcccttcccaaccacccactgaagtagtagctcccagtcatatcacatcatcctattttaattattactaactgttatttttcttactgatgatcatcagtatccctgactaatggtatattccaggagagtaaggaccttgcctgtctttttactgctattatcagcccataacagagtccagctctgttataygtgctgaatgaatgaatgagaaataatgactaaggaaactcctactttaaagtgaggtcatgcctccaaataggctagctaaccttatagaagtttggactcgggtcacaaaacgacaagaacttgaagggtcgtaagccatccgaaggcagtggcttctgctcttactacctgaggaaggatgcatcagagaccagcatgctaaaatcgcttcatccttggctctctcccaactgtgttacaatataatttggagaaatttaaccctcccctgcaaccccctctaccacccctgcaaag

SEQ ID NO: 2709 - DNA, 600 bp, Bovine  MMBT17725
tatttataagcagttttcaatcctgatctgaattctaagtagatattgtataacatgacagaaataggacatcaaaatttatgaaaaatttggagaagtagggaagcataatgcacacatgcatgcacatgcacacatgcacacacacaatttcaaaatttattaagaatccagcacatttctgatacatgttgggtattcaataaacacttgttgagggaattatgaaaaataaatacaattattcatcagttaagacaacctcttatagtgatgacattaaaaataattatatgtcartgataaaggataatatttcagtgcatataggttttgcagtattagcaaagaaaccctgatattttaaatgctatatatttgatggagaatcatgaattattttcaattatattttgaaaataacaacattaaatattaatgytttatgaagaatgtctttctcttttttaaaaatgtaaaacaattcagtaagtggttctaaaaatgagaaaaaattaactggaaactatttaatgtttaagatgcttcagattataaacttttaaaggaccaggatatttaggaaatcagtagaatgac

SEQ ID NO: 2710 - DNA, 600 bp, Bovine  MMBT17836
actgaaaataataatcaaatatactctcaaattatgtctatgtgtttgttagtagaaatgacacctcaaggtcctgcacatgataagggtagagtatgattttttcttttgaaaaaaagatgtattctgatgtctctaaataaagacagattcgtgcttctgtttcataatcattttctccatcttgttttccctggtagtatgcaatttccattcttttcgttattgaaaagcaagatagttaaattagaggtatataattcactaatcatgtgatttggtgttataactattattagkaataagttgctaaccctaagccttacatttttctttctctctatgcaaccttggagaacctcagcaaagactcagcatctattttcctgctcttttttcctactgtctatgcataaacatagcacaaggataagtcagcaaatgccactttggagtggccgtggtgggagaggacaatggtagcagacagaaaattttagatcttgcatagttcatgaatttgattcataattatgaaaatttaggaagaggtcccatcaaagaattttagttttaataggtacaatgactgagaaaaat

SEQ ID NO: 2711 - DNA, 600 bp, Bovine  MMBT17850
cttttcttcaaattacagggcctgcggggactgggaagactgagtctgtcaaggcccttggccaccagctgggccgctttgttctagttttcaactgtgacgagacctttgatttccaggtgagaggctcctgggggactgcctagagcagggggccgggtggggagcgcagcccacgcctctgggggccgtgagcsgtgcacacagcgctctttttgggaaccgggttactggagctgtttgaggggccagccggtgcatgacgccaacttgagcctcacgtcttcaggttaactcttmagtgtaacgaatctttctggtggtgtctgtgtttaggaaaaacaaatagcgaaggtttttttttaaacaacaaaaagtgttagctctgtcactggaattttttgcacaagagggaaaataatacattacatctgttcatctgtgaatggagtacttgctacatgtagggctgggctccttgcctcacgggtgaagctggttccactttcacagcccttctccaccccactgcactcctctgggaggaaggtggtattactcgtgtttcaaagatgagcagacaggtctcaggatgtgatt

SEQ ID NO: 2712 - DNA, 600 bp, Bovine  MMBT18085
tgagcatttcaaattgttacttgaaagccatgtagtgatagcattttctttttttttttaatatagggaataaactaattactattaacaatatagtatcactatggaatcattacaagatcatcatatgaataaagaaaccattgttgagcaaactatatatatttagcaaatattaaaaaaattaaatgctttcatcatgatcctttaggaatttttgtaattattgttcttatttcttttgctttaaaatttggccatttgagaagtaaaattaaattgttctatgaagagaaaatsagagaagggctagaggataagggtagaatttagactaattgccagttaatgtgtccatgtagttcagaaagaattgaaaacagttttaagaaacccttattcatgtcagctcgctctaattggtagtaaaacaatccacatatggaaatgaaattagaaacccaggggaaaaaagtcaaagctaaaatgaaagcaaattgcatagcaaacattacttacattatgatatcaaataagggaaacagtacaataaatgaaataacatgagcaaaaaaagaaatttgacttctatttgcatgc

SEQ ID NO: 2713 - DNA, 600 bp, Bovine  MMBT18106
atgcaataagggaaaaaacatgcaattaatatcctaagttgggaaaagacacaattgatattattaattgaagcaactactttagaacaggtattttataaagtctttcatgagtttgggtaaactccaggagttggtgatggacagggaggcctggcgtgctgtggttcatggggtcgcaaagagtcagacacgactgaatgattgaactgaactgaacttataaggtctttgcaggttgagatccaaaccaaactaatttaactgctaataagagttaagcaaatcagcatgggcatrctgatagagaattcaataattctgtcagtcatgactggtgcttgtgtaattaatcatttatatacttcaaagaattagagtagaataatactgacttaatatgaaaaccattctgtactcttgatgacttgaaagcattttyaatatcttccaatagccttttataaatgaagaarccatcagaaattaaaaaataatatgcataggtactactgatatgttagtctactcataaaatgagcattaagaaatcttctttgtgtatgtgtgtgtgtgtgtgtaataaagttttattgaagt

SEQ ID NO: 2714 - DNA, 600 bp, Bovine  MMBT18165
gaaaaaaagagccatggcccaataaggacagagaaagagacgagggaaaaacagaaaaaacagacctttagaaaagagaaagaagacagacaaaggagttgctcacctagcggacctgggaaagcttccaaggggtggaggtggggaggaagcaggaaaaaaggctgtttggagttggcagacacctataagaagccaccccagttttgtcataaaatcaaaaaaggaacagaaattggaggcttcaagttctggaggcaggaatacagggtgcgcctgaaataaaggtagttggttgaragtgtccaaaaggatcttctagaccagggtgggtaaactatgacctgtctaatttacagcctatttttgtactgtctgtaagcaaagaatgtttattttatatttaaagggttttttgatttgattgctttgcttttttaagagacagagaagaaggaagaggaagagaagaatctgtggtagagaccaaagtgttgcccacaaagtctaaactctactcgctggcgctttacagaaaatttgctgacacttgatctcaagtcccagattcctatctagagaggaagttacccctcccca

SEQ ID NO: 2715 - DNA, 602 bp, Bovine  MMBT18551
  misc_feature (1)..(2): n is any nucleotide
nnttgagatacacgacagtgagcagcagcaaagattttccctgatccttcaatacaatcccaccttagaacattctccaaatagcactgctgtgctttctrtgtacctctattatgatactaatccatttgtgcactgaataagcaattattgaagatcgtttgtgagccaggcaaggtgccaggattttttttttttaattttacattagctcattaagttattataagaatctatcagattttatcatccccctccacccacatttaaagatgaagacacaatctcaggaagatgaagamatgtgctctatgcactgtcagcatggcagtcttccttttttagtagtctgtgtatcattcgtacttagtctacagtattacagttttccatatacctacctacctcccctggagactgtgaacttcctgaggacagactgtctatttctcctttgtatattaccagttcacagaatactgctagagatgatgtgttgtttcacaataaatgttgttggacagaagactgaatggactcccaaactgtggatgctttgctctttataaatgtctcttgtttatgttatctgagttcatgtg

SEQ ID NO: 2716 - DNA, 600 bp, Bovine  MMBT18562
aatttgctttgcagaaccacaacaaataattattttagtattacatgggctctatttattacaaaaaaggacttgtttatctaaaccaagtcacgtattttatctggccaccagtcctagttctctgcacactcccatggaggtttcacgggcagcagtaagagcagtactggaaaaggttcaattagtctgtgatgatttcagtgatcacaaagggtcaaaccactggaatttaacctgctggaaatgagacctgagaagagtatcgcaaagttctaatgactcaactgcttaaattcyattcattctgcatctgccggtagcccagtcgttgtcttggaacaataagccacttgtgtggcatagtcagtaggtacaatactgtagttgagagccattcaacccatccaggtcagtgtgtaagtttaattagtggaactgtaattgagtaaggcatagggacatcgtgtgagtcacttcttcaaaggaagtatatcttgtcgcaagtcctagttattggcagactgttwgcctcatgaaagatggtgaaagtagaaaatcagtcaaatcacacagcactggaaaagtccacattcaaaa

SEQ ID NO: 2717 - DNA, 600 bp, Bovine  MMBT18985
gaggctctcaagtgagacycaagttttgaaaagtaattgcacccccaaagctcaggatttccaagaaatatttattttatttttcatgccaataggaaagcgggacaccccagagttatgcacaaaggcattttcttctaccagcacaagrgatatacggccaaggtgaaaagtatagatctgccttaatttcttggaaagcccttgaaacgtaggttcagattcyagagacttcacatgagtctgccttccccaccctcaaggatccgagttgcacttgctccttcttggtcttactcygtgccctcttgcagagttcatatacagagcctataattaggcgttcaccacgcttgaaagcatatgttttccacaaccataccactaacctcagaaaacatactctacataaatagacaaaaggccacgaagaaagayttgtttttaagttttagataatttctatcacagtcaaggaatactgttagcagagactttttttggtaagaaatttaattactgcatttaaaattcacataaagcactgtactaaagagtaaagatctgcatagaaaaacatgttgaattaaaaaaggactg

SEQ ID NO: 2718 - DNA, 600 bp, Bovine  MMBT19221
gtttatctcagagaaatccaggctatggagaaggctccactgattttgatattcccttcatctgccctcccagtaaggatgatccgtgtcaccaagataactttgacattatcatgatcagttgcagtgagtcttctgtaaatgtcagaaccagggtcccaggaatcataataagcaaggtttctaggccagataactctgctgacatgttcattagtcttttagtgaatgaataagttttttatgatcaagatatgtatcaatgctgttgtcctgtttataattatagagacaagaaayagactcactgatgcagcattcaagctgagaggaaaagagtagaggaattattacagacgtctggatggtgtccttaattcccccttcagctattgaatctcagctgtctgcaatcaagaactgagtcacaaaatagcttgtattgtgttgctatttctgtttaacagactgtttttcagcatggaaattatgaacaattaaccaggttttaaaatttctataagaaaaacatttaaatgcagctataactttagctataatagcactaagtacaattaaacaaaaatattttaataattg

SEQ ID NO: 2719 - DNA, 600 bp, Bovine  MMBT19222
gttacctctctgaggatgaggtatttcacctgaaaaatgagaatttgatagccatcttacaggtaattgtgagcgttatttaataaacagagtaaaatgcctgataatcatattcaggaaattatggcactcaatacattgtgagagaaatttttaaaaatcagaagtttgcattagatcctcagagttttgaatgtrcattgctcaatgatatttcataaaatattttaaagmgaatattaaagaaattaaaaataatcaaatgagaaacactgaagaatcctgaaaataatcacacarcattttaaaaggatataacagtatattctttaatttcatagtgtatagtagtttgggcaggagttctagagaagggaggaatatagaaagaagtataaagcagggtgtaatgtagaatattgctctttataaatctatatttaagtattgggagaaaagtggccataaaatgttttaacagcagttaaatgctttaagtaacttgcattttagatattccataactatcaaaacaacttgaagattgcttctgtatttgagtgtagacagcttctacttgcctatcttctttccctcctt

SEQ ID NO: 2720 - DNA, 600 bp, Bovine  MMBT19237
tacaaattcaattaagattacacagtagaaaaatactctgacctaatcccaagcatagsttttaaaacaataggcaacttcttttagagtcttcaatactgttattgagaaggataatcaagttgcagaacagcagaggatgacaagatagtcttaagaagctagtgataatgtgatgatgatgaggatgataatgatagaatgagttgataatgggcaggaaaaaaatgttgtggaacacagaatatcattacctaatgttgtttctggagccttggttgtatgagtgacaggttcaaygayggtaggaagaactagccaaaaacaataaaataaaccaaagagatttttaaaatgtatttgaagactaatttcagaagctaatttttaagcttcargacagagagaaaagagacacatacttgttctttgcagatctgaccaaattatggccaatatccattaacctcrtaagacaggttatgcactttgttcaatatcactgtggtcaacaagaagctctagatgtttggttatctgacccttgctagcatggaagactttgctagatgagctttctacacgtttatgaatataaac

SEQ ID NO: 2721 - DNA, 600 bp, Bovine  MMBT19402
catgctgatgtcttcaaccttccctcctggcacatacatcccagtccatccaggccaacttctggggtgtcctctgctgggtctgcattcctcacagccgggtccccagacaaggacataagcattcttgtttttggcttgaaaagctttacatgccagccaacaactgaggagcttctgcttttgcttgaagaagtaacatgagccttgaacactggccttggctcccaggagggtacagggtagcaagaggtgccagactgaggtccagggycatcacaaccaccagccaggctggcygagacagtgcctgtkccctccctccaggcctttgagccacgaccctgccacttggaatataggtagcaytaggtttttaattcaatgtgatttatccttttgtaaatagtacattctcatggtttaaaattcaaaaggtacaaaagctaggaagtggaaattcttgctcctaccctttattcccaccatctgttacctctcctctagtaactaatgttaccagctatatccattgcacttataatacaagtaagtatgtgtgtgtgtatattcatattcatttttccctttttttttaaa

SEQ ID NO: 2722 - DNA, 600 bp, Bovine  MMBT19444
ataaatcactaaaacatttcaaaatgaatgtattcctcttcttcttcttccagttattcaacagacaggatgtaaagcatgaagtttaatacctttaaggaagaagataggccctgttcaatagactgtttaataaatcaggaatatttatgtcccacttagacacattttgaaaacatatcctccattctaggaagtaaagctaaataaattatgttgtaggaggattgttctatgtcattaaatattttagaagttttatttagaatatttcaaaattgcataatgttctatataacrtaacaattccaagtggactttaaaaagacatggatatctttctcaggctgattgtactatataaatttatgtatattaatgcaaagtaactaaacatgaacacctgcacacactacagattctctttacaattaattctaagcatttattgccttaatagtcatatggtactaaaaatgtgctacttttgacattatattacattttgttgtgggcatgccttattggcactgctaacttgagtctccatgatagtaaagagaattcagtccaaatctgcctaattccaatacttatcca

SEQ ID NO: 2723 - DNA, 600 bp, Bovine  MMBT19497
aatggagggttggtatctcttaaaaaaaatagaagctgctaatctggaatatatatttttagaactattaagccatggaaactacttttcacagctcaatttcctaataccatccaatttttgttaacatgtrgtatttttgggggcaatttttttttccatggaataattctagccatttcaaaactgtgcaagaactgacttcattagccaatggattgcattgataagacgcctgaattctaaagggcaaaacaaaattagggattttcctcactgttttggaaaaaatgactacakagaacatcaactttgaagaagccaactacttaaagttgtaacaatgattgtctttgaaaagattcagtagttaagtactgtttggggagaaaaaartgttaaactattcagtagagtggatatgaccctatcacaaatgtagaggaagtacctttaaggctttttaaaaataggttttrtattataaagtaattagcctccaattaaaataaacatattaaaaacatgaaaataaaaatagsttttagttgccacttatgaataatcataattartattaaatatcatttatagaatgta

SEQ ID NO: 2724 - DNA, 600 bp, Bovine  MMBT19499
gtaacaatgattgtctttgaaaagattcagtagttaagtactgtttggggagaaaaaartgttaaactattcagtagagtggatatgaccctatcacaaatgtagaggaagtacctttaaggctttttaaaaataggttttrtattataaagtaattagcctccaattaaaataaacatattaaaaacatgaaaataaaaatagsttttagttgccacttatgaataatcataattartattaaatatcatttatagaatgtattaaatttttagactggcaaaaagtgtggattaaaayagaacttaaatattatatcttaaatatcaaatgaggtcttcttatcaccacagacatatttttcaatgtggtggaataattaataataagcaagccctgtcagcactgaccccttaayagtggcagagataagccagcctcccacccaagggagcaattggagggattttctcattggtatcatgactttattattaatcacagatcctggcaaagcatgtatataagaagatgtatgcagggggaaagcggttagacaggaattagcacaacgtgttagtagttgtctttgaatggagt

SEQ ID NO: 2725 - DNA, 600 bp, Bovine  MMBT19561
ttctagaacattgtttcttactgctttttgccactagatggaagaagcaggttaacaaaatgatatttttggtgttttattcagctctacccagaaacaacccacaacactgtgtttaaaataatgacagtctcagcattcttttttatttttactgaagtatttcttttcatatacatactagatctaaaaagtgtatttcttttgtatttttatagagattaattttctttttattattttaaaggactgaaatttttgaaaacaaccaagaaggaaagcaactgctactggaagagragaggtaagaattataataagatattggtatataaaaaatagatatgtggcaaagtaattcttcaagtgcattactgtccaatacataacaatcctcattcatgtaattattcttttgtgccacaaatgcttactgagcagttggcacattgaaggcactaaacaaagtgctgagaaacacacaagggatgacttgagtgcrgtaactgcttataacatttttacattctacaggggagttgagcaagactcatttatgcatcatttaaaataargtaaagatggataaatactagaaat

SEQ ID NO: 2726 - DNA, 600 bp, Bovine  MMBT19562
ttttgtatttttatagagattaattttctttttattattttaaaggactgaaatttttgaaaacaaccaagaaggaaagcaactgctactggaagagragaggtaagaattataataagatattggtatataaaaaatagatatgtggcaaagtaattcttcaagtgcattactgtccaatacataacaatcctcattcatgtaattattcttttgtgccacaaatgcttactgagcagttggcacattgaaggcactaaacaaagtgctgagaaacacacaagggatgacttgagtgcrgtaactgcttataacatttttacattctacaggggagttgagcaagactcatttatgcatcatttaaaataargtaaagatggataaatactagaaatacaggtacaatattttggacatacagggagtgtaggtttggagtgtcacgttaatctgaggagagcaggaatcacttcatgaagaaactggaattaagagggacagttgatgtggaaggagcagagaatggctttcctatgatagaggcagaatgagcaaaggcacagagcaggaaatagcaggttaaaagcatatataatg

SEQ ID NO: 2727 - DNA, 567 bp, Bovine  MMBT19563
ggaaagcaactgctactggaagagragaggtaagaattataataagatattggtatataaaaaatagatatgtggcaaagtaattcttcaagtgcattactgtccaatacataacaatcctcattcatgtaattattcttttgtgccacaaatgcttactgagcagttggcacattgaaggcactaaacaaagtgctgagaaacacacaagggatgacttgagtgcrgtaactgcttataacatttttacattctacaggggagttgagcaagactcatttatgcatcatttaaaataargtaaagatggataaatactagaaatacaggtacaatattttggacatacagggagtgtaggtttggagtgtcacgttaatctgaggagagcaggaatcacttcatgaagaaactggaattaagagggacagttgatgtggaaggagcagagaatggctttcctatgatagaggcagaatgagcaaaggcacagagcaggaaatagcaggttaaaagcatatataatgtatagtgatgaaaggacagtgcattttaaaaagcaactta

SEQ ID NO: 2728 - DNA, 600 bp, Bovine  MMBT19564
taggtgagcaatgttgatagcctcgactgttggagggaaatggacggattcaagagttacttaggaggcagcatgaacaacacttgataattaggggtgtgaggaaaagaaggggttgacacccagagttctgctgagcaagtgggtagacagtaccacacacggaaaaatatgggatgaaataaaataccggacctgggctaggtgaaattagttcacaatactgaaaatactgagtgtgagrtacctattgaaatgttcagtagacagctggaaatacagattatttcaaaaaggtcracattagaagctgttttataacaataattagcctttttcagtttgtctctgtcatagaaatagacatctgaactcatgctgaaagagaacatttctactctgaatatacttcagctctcaagagtatatacgcaactgaagaggtgtggctgtgaggtgaagggcaaagctttcccacaatgcactagtctctttgaaaatatcacagatactttaaataagagaagagaagtcatggttcctgaaggcatgggatgagagtttgaatgtgggccagtatctcaggcatcataattaatt

SEQ ID NO: 2729 - DNA, 600 bp, Bovine  MMBT19565
caggaaaaatagtaagtaacatgactgtagtaaattaggggcttttagcagtaatctaggtgagcaatgttgatagcctcgactgttggagggaaatggacggattcaagagttacttaggaggcagcatgaacaacacttgataattaggggtgtgaggaaaagaaggggttgacacccagagttctgctgagcaagtgggtagacagtaccacacacggaaaaatatgggatgaaataaaataccggacctgggctaggtgaaattagttcacaatactgaaaatactgagtgtgagrtacctattgaaatgttcagtagacagctggaaatacagattatttcaaaaaggtcracattagaagctgttttataacaataattagcctttttcagtttgtctctgtcatagaaatagacatctgaactcatgctgaaagagaacatttctactctgaatatacttcagctctcaagagtatatacgcaactgaagaggtgtggctgtgaggtgaagggcaaagctttcccacaatgcactagtctctttgaaaatatcacagatactttaaataagagaagagaagtcatggttcctg

SEQ ID NO: 2730 - DNA, 600 bp, Bovine  MMBT19569
gagacttcagagggaaccagatactagatggttcgattagtcttttgccgctatatccaggtcaggcaactgatttgcaacttaggaccactacagagtttcctctgaagaaaaagaccacgtggcactctatttatctctgcattcatctctttgcacccaactaggacaactttttacattacacagctcagtctggcttctcaagggcctgaactaccagaacacggctttagytcmacttttgcatttttttctagctagtagttacccamactgagagtcyggattccctaaagrcaaaagcaagcctatgctaatataaaatgaagttttgaagtaacagacctttcttaaagaacttcatagataatttttggagggggtgggactcaaggtcatataacataagcttagttcacaaaatacttctttctagytatttyttctttctttgaccagctttatccattacttccacttcaaacattatatacacactgataaattttagaaacagtattttaaatctcatgctttctttcccaagtttctggcccatgttaataactatgcctgggcacctcaaccgggagtcct

SEQ ID NO: 2731 - DNA, 598 bp, Bovine  MMBT19768
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggactacatttgatcaaccctcatataacaaacagtatattcattgtatgaatgctgaaaagagaagacagctaaggttttcatgtctaatttctgctgatctacatcatgtagagtcggactgagacacacaggcctacgtagaagcttacattttwaaaaaatgcatctggggcacatttrctgtcatccttctgtctaaataaaataatgccttttttattatgaakaaggcagaacatagttttaaggaacaacttttggtaatctgcaatagcataaaatgctctcatctttcagagtggtacttatataatgagattacatctatttatttttgtatatatgaaagattcatagagcttttggcttttttcacataccttgctttggtgtataaatggcatcctgaagtacagtgatgaatttaaaaaaaatttttttttcaaaaatggcattatgtttatagtatatgcaccag

SEQ ID NO: 2732 - DNA, 601 bp, Bovine  MMBT19929
  misc_feature (1)..(1): n is any nucleotide
ncagccttctaagacttgagccctgctgaaaaccctgaaaagastttctttaagatcccttctagccgatttttttttttcttggcttctgtttctcttcatatcacttttctaatgctttttttctagataacatttctctgaagatagaaaaaacatttccagtgtctgcttagatagggagatagagttagtctggtttctgatgtggcctaattttagatttgattctttacccagactattttgtttgctcttgaatgaggaattctggaaagtaaccggagaggtttgtttagaytcagctggaacatttcagagaggaagacagcaggtattttcagcagatgtttgccatgctgtggattaaaacaaaacgtgagactaatatattctgaaagtggrtctgaaatcccagtgatctttgaaattcttacgtttcagaggctcttggttattcacagcaattcagaccagattttgtcaacattttcaaaaccagaggttagagaattatatgctacatcttcagggatcgtaggtatttataccatctactgccaataaaagctttctgtttctcctgattttgccacatttt

SEQ ID NO: 2733 - DNA, 600 bp, Bovine  MMBT19932
aacataagttgtgctgggcccagttttgctacaattagcattgtgtttatatgccagatactacagaacaggaacacttatttcccttaatgttaacatgataaagctggtgattaatgtttttgatgttcaatcatttgttataaaatattgatataaaatgccatggaagtaaaatagatctatttacatagtgagtaagctcagctctgccagtccagttatgagaggtgatattttagcatctcccagtcaagtcatgagggtacacttagtatactgaaagtgtctggacagttyattaaatggtgctgaaatatcctggccaagctgtcctccgtggacaattaaagcagcctgcttacagtagagctggcctaactgggggcacttcatacattagtttgcatcaaattagggaggctgctagagaatgacaggcgggaaggcctgtctaatagcagagtcctaggggccacacggaagccctgcgttctaggttcagctcagccaccaaccaccagtgtaaacagccttctaagacttgagccctgctgaaaaccctgaaaagastttctttaagatcccttctagccgatt

SEQ ID NO: 2734 - DNA, 600 bp, Bovine  MMBT19933
tacccaatgctactttcactgtggttttaataagggatagcctgttccctggrtggtttccaacaacagtggacacacttgtgcatgtgcgcrcrcacacacacacacacacacacacacacatcatattagactgtgcagccataaggtttgtatttttagatggatatttgcataagcacgtttgaacttatgttcaaaatgtcagatcttgctttatgatgatctaaccaaaaaaaaaaaaaatcagatctacagatttctctaatttagacacatgcaagtatatacagaagcttrtagcaatcagtacaaaagaatacatcatcagaaaagacttgaagaaatagagaacgaactcaggagatgctgtctaatgcctagtctggccatgggggaatatacaaagagaaaatgatggtagcttctaggacaggctgatgatttgagcttaggaatcttattccctgcrtgttaattttgttggaaatgagcaattgaacgtcaagagagggggtgtcagattgaaaaggctttcactggataggtctgggaaaatctgaatgtgaaaaaaaattaagtatagtaatgaaatgtaaa

SEQ ID NO: 2735 - DNA, 598 bp, Bovine  MMBT20413
  misc_feature (1)..(155): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtttctagggattttagtggatagttaatggtgatcactcacaagtatgttgtgaattttatgcaaatatttttaaaaaactattttatcttccacatttagaaaagtcacaaagtcatgtgaagcactccacatattttgstctagtgaaagaataaatatatcacctgtaaaaatctcataatgcacttgcaccaacaataatacaccaaaagtaagacaatgatatagaatacatataaagcatctctgtaaatcttacctcaaaacagtgggaccgattctcccactgtagaaaacaaacgacagtagccagaattctgtgtaaagtgagacagcaatccacctgtattacggttccacttgtattacagtttaccatgaatatattcttcctcatsttagaactgtcattaaaaatggcttttcttcaaacttct

SEQ ID NO: 2736 - DNA, 600 bp, Bovine  MMBT20599
ttaggtcttataaatatctaataaaaggaaagggagtagatcttcaaaggggaatgtattcttggtgatgaaacataaacatctttacttttatttgattatatcctagtacaaattgaatatctattggaattaattctacttctctagattcctgagctaaatcaacatccattctatcaacttagttaaccaaattaattacaaccttgcaggaaaataaaattaagaatgacagacatgctctgtgatacatatctatttcaggaaacttaatttagttaaccatggtggaataascattacttccttaagaaggcacagaatttgctacactcatcaacacagaggagcagcagttattcaagagttattcatgaggttgatgccattcactgaagggacaacctgacaggccccagatcaattttaaaaagttaactaagggtttactgtgaaattctgcaggagatacaaagaaatatgatacagatattgactcttcaactcttgaggggataactcttaggcttgagtagcagcagctgcaagtgaaagctcagaatatgctatctgcagacacgtgttttcaaccaaact

SEQ ID NO: 2737 - DNA, 600 bp, Bovine  MMBT21027
tggaccaggaggcaggccctcaccagacatggaatctgaacacctcttgatcatagagttcccagcctccagaaccgtgagaaataaatttctgttgtttataagccaccaatctatcattttctgttagagtagcccacrtggacgaagacagaacattttcttaaaaaaaaaaaaaagtatacrtcagaatatacctaaagcaaacacaaacatagcaaaacgtttattattgtatcctttaaacagtactgacttgatattcaaagcacagccataaatgcatgcaaagtagagcakcaagtattaaggtgaaaatttggttcagagacttttatagttactctaaaacatctttgctttattgtgagaaattataagaagtttgggaatatatatatgacataaattttacactgtagctctggtgccacatgttccttcatggaatttgttccaaatgaaaagctagaaaactgatttctctcaataaaaatgactataattgaatttggtgactgctctcttgaaagtaactttttgagcctcctttagaagactatcccaatattaatgcacaaattagcagctttatttaac

SEQ ID NO: 2738 - DNA, 600 bp, Bovine  MMBT21097
gcaaacaatgatttctccctgtcagaagggaagcgacacttcaaatktcttattcacctcttaaaaccgggaacagactctagtcacgaggtgagaaacatcaaacaatgaatggcatgaaaaattttaatttagataaaactgaacctatgttacattacagagctattgtcttaaaaaaaaaagccctctactctaaataaaactatgccctctactttccaaacgaagcaatattaaaaccttatttgtacatgtgcctaacgtcatctaaatctcacaaaaatactgaggtactcrgagtatcataactgtcttcttgttggtttaactaaagagataacgtaggagattcatagacttgccaaccaggagccatccctatyatatgactcckctaagatctaagtcctcagttttgttctctgaaaaaagggggatgatattacttcaaaatattcttaaagctgctgtattttctctcaccatagattagtgttcacgttctagaatgtaacattattctagtttttaaaattcagcctattctgagtcattcatgttgctgaatgaatcaataatttgttcctctttattgct

SEQ ID NO: 2739 - DNA, 600 bp, Bovine  MMBT21115
acatcaaacaatgaatggcatgaaaaattttaatttagataaaactgaacctatgttacattacagagctattgtcttaaaaaaaaaagccctctactctaaataaaactatgccctctactttccaaacgaagcaatattaaaaccttatttgtacatgtgcctaacgtcatctaaatctcacaaaaatactgaggtactcrgagtatcataactgtcttcttgttggtttaactaaagagataacgtaggagattcatagacttgccaaccaggagccatccctatyatatgactcckctaagatctaagtcctcagttttgttctctgaaaaaagggggatgatattacttcaaaatattcttaaagctgctgtattttctctcaccatagattagtgttcacgttctagaatgtaacattattctagtttttaaaattcagcctattctgagtcattcatgttgctgaatgaatcaataatttgttcctctttattgctaaataaaactctactgtgtgaatataccacaatttgtttatccattctccagttgagggacatatgcattatttttaattttggctattaagaataa

SEQ ID NO: 2740 - DNA, 600 bp, Bovine  MMBT21702
cattgcagggggcatgggttccattcctagttggggaattaagaccctgcatgctgcatgatgtggccaaaacgaaaacaaaccaaaggaaaccacctgaaatgtgacctctgtctgaagttaactctggttccctggggcattgcgacttctggcctccctttggcttcytctgtatcaagcctctgagacagaagtctcgtctgttagggcgcattctcattcgtctgtgtaccttccaggctttgagctcctggggygtgaggctggtgttttgcttatttctgaatctcyggctckcagctctgacctagcaggcattaggcactcgaagcacggtctgagataaacaataggtacgtcgtgatcatcagcggatggtggttgattccaaagcacagacttttgatgggagccttggttctgttaccttcatgccggcttgatctctctaagcctcagtttcctcatctgcaaaatgtacttgtgaagattcagtgaaattctgtgtgtaaagagcttaacacaggacactcaatgatgctgcttattattagctaaacctgtctcagtccttactttaccctgaggagtagatga

SEQ ID NO: 2741 - DNA, 600 bp, Bovine  MMBT21767
gtcacggcagtggttagaagaagggacttgctgtgtcacagttgcacgaaagatgcttattacatcacagatagggggtttgagtccagactaaaagatgaaagcaagaaaacacatacagcatttgaaatactggttagtataccagaaatcgtttttctttttcttttttcttatgatcagtgtttttgccggttgtcagatcccttaccccaaacgagaatttttaacagaagaagaacctgatgacaaaggagacaaagtaagtattaaagtacagttggcatctggctttgttcrgtgcccccatgacttctggcatggacatctttggttctccctctgagttgagctgtgtctctctgtttaaccaattgagaagaaccagcagcagcagccgggcaataaccacacgaatgggaccggccacccagggaaccaagacagcagtcacacccagggacccccgttgaagaaagtgagagtcgtccctcctaccactacctcaggtggactgatcatgacctcagactatcaggtactcaggctgtctctcagtgacctgcgtgtcagtactgcctgtgggcttgtgagcactgg

SEQ ID NO: 2742 - DNA, 598 bp, Bovine  MMBT22027
  misc_feature (1)..(219): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgccctatgagggtacctgcaggcccacttcttycccgacactgtgctagggagagatgaaggtgcccgcccgcagarggtatagaaggccgcagaggtggacttctgtcctggcatgggctccctgagcaggccctttgctcccagagacaggaagaccctgccctcctgctgtgatcagcatccctttctyatttgcacgttcgtgtcttcaccgctttgctctgtggtatccatttagacttgcaagtaaactttagctaattccaataaaatagccgtgccaagcgctgccagaattctaattgtatttactaagtagctaataaatatttactacaaatctcattgctccataaaattgaagactgcacct

SEQ ID NO: 2743 - DNA, 600 bp, Bovine  MMBT22194
tgtaaattcgccccaggcttctgttcccttggaaacaatgaggctatgatacatatgaatgttgtcttcagagcccccttctctgaagttctgcacctgggctggagattgaggctccatctttgtgtcagagtggctaagatcgtccaccaggggagagtgaaatgttttattcctacagatcctatttccagtagcaacatttctggtagtctctgcttttagagatcaaggtttttctggatgtaagaaagcaggagttactcaaagaaggttataatgtcagagtgtccttgggaraaatattgtttcctattactttgcagctggttttatctttatctgttagcccagcctgatgaatagcaggggtagatttttactttcccagtctgagcttatttttactttctcaaaagtttggggttctgggaaggaaaatgtgatggttaggggatcagtgttcttcagtttttccaaagcctgtgaaaacttgtatctagtctaaatgaacacaaaccattaacaatatttgagaagcagctaggtgggagctgccagcttggctgatatggcagctggggggccccagtcttgggg

SEQ ID NO: 2744 - DNA, 600 bp, Bovine  MMBT22274
accccctccactcacccggtggttgtccagagggtcctggtctcgaggtgccatgttatcaaggtcgctgaacacaggccaatctgggcagggagaaaacagagcaaggcagcagttccayggctggaacaggtcacaaggtccatctaagctgccatcaracctctcttattttaaatttatatttatttttagggccacaccacatggcttgcaagatcttagttccccgaccagagatgaaacccaggccctcggcagtgaaagcgcagaatcctgcagaaagcaccacygaaggcrccactgggccactagggagtttccaaaccttttttatttgacatttataaagtacaaaagcgggagaagaatgttgttggcacctgagaggccacagttcttctttgagaatttacccaaactctctacttgccagctgcctgtactygtcctgatgagcaactagcttagctgctgcgctgccttggggtttccataaggtaaacagtgatacgattgtgtaaygtactggtcagccgtcaatgaggtgcagttgtgaatgaaaaaagaggcatttgtccatttggggtacaaatggga

SEQ ID NO: 2745 - DNA, 600 bp, Bovine  MMBT22718
caactcagataccatataataaagctaaggctgagcaagccacagtgtggccaccctctggagtgtgggatggcatggaaatcatgttgaaactcagcagtaagcttataaactagggggsagtgaagcaacctgagtatgaagtagtgggttcctrgggattagaaacacaagtaccttttgatttttatttttggccgtgctgttcagcttgcgggatcttagttccccagccagggcccaaacctgtatcctctgcaatagaagtctggagtcctaaccactggactgacagggaaytccccaaaacacgtgtagattttgaattccctcccccagcattgcctctatactccagccacacgatacccattcagccttaatgtctgctcctctcagagtctccygttattttctctgcctggaagctctctcatctactcttcatacttagactttaaaaaaaagaaaaccatttatttatttaggcgtgctgggcctttgctgctgcaccggctttctctagttgcagtgagtggactactctcgggttgctggctcttcactgtggtggcttctcactgcagagcacaggctcta

SEQ ID NO: 2746 - DNA, 600 bp, Bovine  MMBT22767
ccatccctctgcctctcctcgcactgggctcccgcccccagggagctccagacatcaccggaacttcctgggcattagcctgggcaggggcacggttttaaccagtgggaacagtcaagctagaagaatgcatgttcccaggcccagcttgcggtgctggggccgtagatgaggagggggactgttttttaaatcgcttgggaatatcctttcttttgggcgtagaacccagctcttgctttttgaggaaacttccttctctttcatcctgtagaaagtatttttcgattygacccattygtggattgtaaagtcaaggttgtggggtagagacagtattttgcaaaatgaaataggatagaaaattattagaaagtttcccacaataagaaaaaagtgaaagaaagtgaagtcgctcagtcgtgtcctcatggactgtagcccaccaggctcctcagtccatggaattttccaggcaagagtactggagtgggttgccatttccttctccaggggatcttcccaacccagggattgaacccaggtctcccgcactgcaggcagatgctttaccgtctgagccaccagggaagcccatca

SEQ ID NO: 2747 - DNA, 600 bp, Bovine  MMBT00134
ttgttcatcattatgaggaaaaagagtgttttggctagaaattaaaaatgcaaattaaaacaagctttaaggtatcattacaaactgatttatccagaaaggaaattaaacacgtaataggcaatggccggggtgggagagtccataaacgtctgcatacttggcaggtttataaatgggttcaatgtttttgaaactcagaacagctctgtgaataatgagttgaaaagctgttaatatctttgatcctataattatccccaaagaaatcctcccaaagggtgggaggagtcattgtaygtaaatgctcccagcagtgctcctcgtaaaggcaaaaactggaaacaactcagataccatataataaagctaaggctgagcaagccacagtgtggccaccctctggagtgtgggatggcatggaaatcatgttgaaactcagcagtaagcttataaactagggggsagtgaagcaacctgagtatgaagtagtgggttcctrgggattagaaacacaagtaccttttgatttttatttttggccgtgctgttcagcttgcgggatcttagttccccagccagggcccaaacctgtatcct

SEQ ID NO: 2748 - DNA, 600 bp, Bovine  MMBT00144
actgcctcagccagagaggcaaggaggaggaaagatcgacacccctcgtgtctggacctgccggacagycagsgcaagggtgctgctgtggtggcccacatgcaaacccaggcggggagagcaggcggcaagagtgagcttctgagatacaaagaggaygccatggttgtgctcaggacccaagcatggggcaccaaaagtcgtccccggcggaggagaaggaagatctgaaaataaactggaagatgagtatttgagtcaggaaagaaaaagaccacacagaaaagcgatgaaagaagygtgatgtgggcagcgcatctctttcactgtaccatgcacaccaccccagaaggtcctgggcagacggaactgctgaccttgcaggccaggcaactaaggctcccgaggcgaggctcccatgggtctcaggcctgttcccacatgtgccaatggctgcagggtctctgaggctgttcttcagcccggggatcacattggtttgaagcacgaggttcacttaaccaaggggttggtttataaacgcccagctcccgtggggcctcagtgggtccccagcaggcctgagcctcctcccccaca

SEQ ID NO: 2749 - DNA, 600 bp, Bovine  MMBT00150
gctccttgcccactgaagagtcggggtggtaaggagctaaaaattcaaaggcctgaaaatggtctcttcctgctttgctgatagtacactgattcacttcttctcaagccacctcttccatctatttctcttttgaattctttgcttctacaattgggacaccctggggytggagagctctcaccttyctccccactgaattctcgggggctagcacatggcatatacgcagtgagtacttgcttagtgaatcyaggaataaaggacttytgcgttttagcttcctttctgtagtcttayactcccttccctcatggtaaggactagaagaggctgtgcatgtgcagagagcggagactggaatcacgcgagggatacagaatgcttaactgcagccagcctcagctcaacaccctgttcaggccacctgactgagtcttcccagccgttctgtaaggtgttattaatatgattatgcttagtccactgcaggggaaactgaggcagagggagaccatacagcaaggaagagggactgctgagaaaagaatccagtagtttaactatacagactgctttgtatactcaagtatactgctg

SEQ ID NO: 2750 - DNA, 600 bp, Bovine  MMBT00424
acaaagtacacttgcaattcttcaattatcacactcattgtggctattaaataattatgcatgtgctcccttccctagactataagctccatgagggtagctaccatgtccatcatatccaggattaaatcctcaggacctagtgcaggggacggttgaattcattaattagcagatgctccaaaaataatttatcaaatgagtgattaatgaatgaacaagtgaacagaaaataagagaatatgtagataaagttaaaaaaaaaaaaagaggagaatccagagaatgagaaaaagtgaraattctacaaagcaagacacatattccattgccaagacaggtaaggagatgattactttggcagctgaagttgccatgtttccaggagccttctggattgggatgaaagcctacaacgcagccacagctgtaggagcccagggtgttggtgcagacagaatctgggccgcatcgtgagggatcctgaaggcactcgtcaatatctgcaaaaaactcaaagatatcaaacagtgcagaggagtaaggagattcttctttccaaggaggtccaacaaacttcctacacccctatgcagtccg

SEQ ID NO: 2751 - DNA, 600 bp, Bovine  MMBT00428
cagggctcaggaacgactggccacagccctgcagaagctggaggaggcagaaaaggctgcagatgagagtgagaggtaaggacgctttgaacctggtggcatgagcgtttacttctgggaaattgaggtcctgccatactgccaacctcccggagctggggtgagagtcagtgagatcccaaggacacacgtgtgtacacatacatataaatgggcaacaataccttgtaaaccatcatgctgtgtgtggaggcatttgacgtggcagttatgaaggaaaactaccaccagacagaggarggcaaaaaactgggcmgatataaggctgtagctgcgactgtcgtcagcagtctgtcckcagagcgctgtgtctcctgttgtctctgaaagtcactgtgcatgtggttgtcagcattctcaagacatcggtgtccagggtgatatgagaagacgggggatgaaaactggaaatgggctgtctgcatgaataactattagcagtgcttcaggccttgagtcactggacaactgtgtgtcagggacatgcacaaaaccactccaattaatgtatttgcaactgatagcacttcttacctccag

SEQ ID NO: 2752 - DNA, 601 bp, Bovine  MMBT03376
  misc_feature (1)..(1): n is any nucleotide
naaaatgagggctgtgctagtttgtagactgtgcctgtttctgcagtgtaggtacatgcactgtagcttctttttaagctgtcaatatgacatctctgaaaggcagagttggaaagagaggctaacagtaggctctctctagctggygtgggtacaagcccgcaccagcacagcaccgactcaagagaggatctgcctgggcttgagtctcagctctgccgcacgctagctgtggttgtggtttagaaactaactcccttaggcttcagcatcttcatctggaaagtgggattatggtagyacttgttgcagttacttgaacgttccttaaggtgagccacgtgaagaattaagacagtgtctggtgcacgaccccaagaggtrtgacctgcaattcctatgattgatcaaattcaaagaagatggagagatggcttccaggtgaaggattccaggatttaaggacgtaaatttttttttttcctggtgggtgtggtggggattgtggaagaggacagcatggcaaaaccaggtaggtaagaagagaccagttatatgctgaaaattccatggagttctgtttagttggaatattgtgttt

SEQ ID NO: 2753 - DNA, 600 bp, Bovine  MMBT12554
tgctttgagctgaatgaagcaacccatagatacacaatccccagacacatacacacttaattgatttatcttctttctcttacatcagttgtctatatgtgttgcttaactagtgtgcaccatgctgttgttcctaaattgtttacttttctacataaaagtgtttaatayagcatttcaaacatgaataagagtgctggttatgagaatccaaataatgaacaaaagagaaagccttaagtaatgagaatatttaaataacaaaacactttgaaagaaagagagaatcaagcctaaagraatcacattgttatatgaggcaaggctacaaaaataaatgaattagtaacaatgaaaaagctctacacatcacagttatcatctcctttaagtggaattgagaagcatttgcagtggattgaaattaacaactataaaactgagtataggagaataccattttgtagcatctgttctcacttggcactatatgagcaatttctgtatctaaggaggtaattgtccaaacaacaaatgctagatttctattttaagccaatgarttaaaaaaaaaaagaaaaaggaaactaagacaatgaa

SEQ ID NO: 2754 - DNA, 600 bp, Bovine  MMBT07591
aaatacaagcttatttgaaatattcactaccaaatcaagctgtatcttaagaaatatgttgccaatatakagtgatactctctttaaagaatactgatttaattgtcccttataagaatttatagccttctcattttatttacttatgccttttacrttctgtgacattctgccagtatttcaatctcttcatagatttgggaatcacgaaatctcaatagtgaactttttcaaaagtaaagagtcacttagaagacttcattataacaatggcaacaaaaaaaacattcttacttttcrtagaggactttattctacttttaggctggtggttaataaacatttgtccttaacaagcattctaactataccagagtatatcccagtgaacacattcttgaaatttcagctgccagtgcttattaaaaaacatttgagaaaaatatttttagtctttagcagcaaatattaccattgtagcactcatgtcatgtcttagtccttaatactattcctacttaaagaagtagttgattccaagactggggcagggatgagtacagatgatagtacaggtgacgtgtgtgatgatagacagca

SEQ ID NO: 2755 - DNA, 600 bp, Bovine  MMBT07812
tctcaatgtttaaatcagtgtacacagtagcatttgttaactatttattgtaggagcgaatgaatagttcccaaattagttggggatggagacctgggatctaattctagttctgaatcacctgtataagcttaggcaagtctttatttttttgaggtctccttttagcacctgtaaaataaaagcactggatctctaacctaagttagcattctttctagctctaacatttcatgactgtgcacccttagtttttaaatgcttagtagatatagaacaatattttgttttattttcaartaaaattttatacagaatcttaatatctaagacagataagaatggagctgctctgaatgaattgggcttagggataggaacaggagaatgaggcctttcaacttggctgcctgctggcaggctggttcttcctgtgagctccacgggtttgtctaagaaacacaaggtctctctcagacacagtttgaaaattctttctctagattaagtcagaaatgggaagtggccatrtatctgcataaaattctgttygtgtgkagatatggatttgatggagatgttgaataatgaaaraaagat

SEQ ID NO: 2756 - DNA, 522 bp, Bovine  MMBT13180
ctttctctgcccagctggccaattgttccaatccagtaaatcacagattcggcaaacacacttagggaaaaggggcagatgagtaaccccaagctgtgctgataaggcgaccaggactaagtctttgaatgtgtgcacaatggaacaaacaccttttatccctccaacccaccaggcaagccacaccaggaaaatcattttccaattagtcagcaggtttcagcgtcattacctttgagatcagatttgctaccattcaaaaaggcatcagagacagtggaggaaragttaagcatcatwtctggcatctgaggtctgggaggaggtgcaattagattagctgcaggaaaatgggagggtttacattaccagaggggctctacctggctccaggcttcacagtgaacaacgctttcaccatatggcattacaatggattagtgatcaagtacgattaatcctaatagatcgtcttttcaacctcagtggcttgttaggtgagaaaaaaattgtctgtcccca

SEQ ID NO: 2757 - DNA, 600 bp, Bovine  MMBT16293
ggtgtcacaggatgcagccttctgtacctaatggggctggggtcccacatctccctagaggcgacaactctggcctcagaatgcaaagggccctgtaaacagagaaggggacaatccagtaggggacacaggctccttgtcatcagaacaggtggcacagctgggctgagctggagcctgtgtttctagattctcagccccgagtctaacattcccactctttgttgtcgttcttgttcagtctctaaatcatgtccagttctttttcaaccccacggaatatagcccaccaggctcctytgtccgtggatttcccrggcaagaatattggaatgggttgccacttccttctcaaagagatcttctcaatccaaggatcaaactcacatcccctgcattggcaggtggattctttaccgtgagccccctgggaagcccacgctcaccctttgggtaaacataagctgattcatcgggctcaactctaggccatttctacattctgaataatatttgtaaatgacctgttcccgtggattgttcagaaagctagcacttagattttgctgtatttctttgccatgaaaaaagcacttacgg

SEQ ID NO: 2758 - DNA, 600 bp, Bovine  MMBT03312
tagttatctattttataaatagttgtgtttgtatgtccactctaatctcccattccctcccacaacttagatgcccactgacaaatgaatggataaagaagatatggtacatgcatacaatggagtatcacttagccataaaaaggaacagcattgtgtcatttgtagagatgcggaaggacctagagtctgtcacacagactgaaataagtcagaaacagaaaaacaaatatcatatattaatgcatatatatggaatctagaaagayggaatagatacacaaacatagagaacaaatwtaaggacaccaagggggaaaagggaggtggggtgtggratgagaaagaatgactkgaacaaactcattcttcaggatttttgaattttcagcaycaaataaacctcttactttggagctcttaaagcattccagtattaacctaaaaaaattatatgtgtgcccatggttgcatcatccttctcagcccatcatcaagctcatttcctgtgcatgaagcacaggtttacttatgtgacataaaatgcttttgcctctgtgacatcctttttcatcgacatcctttttcatctctctctgt

SEQ ID NO: 2759 - DNA, 600 bp, Bovine  MMBT07054
gttggttctggagctaaactgatctgtttcttacagctacttcatccgttccagctccaaagacaacagaccctccttctgccctcccatctgtggcctccttgcccagcaccacctcctgcgctccgcttctgccccctgcatcccagcacactgccactctgccttccctgtcccagcctggggacctgtccagcagtcccctctctcagctcagcaggtacggggacaacagggacccagagtccgaggcaccaaggccaagtcctgaagcttctggacggctgtgtccagggacakagcccacacttgcccctgcctgtcgtcctggcctttcgcagtaatgctgtgtggcgggggtggggtctcaggcgcccggtgtgaaagtcttgccgcctgtaacgcctctgctgtcacacagccctgggtctttgggaatggggtggggccagagggtcgcttctgctcctctttagccctcaggaggggaccccgtgcctcagccctgccccacattctgggccccatcactgtgatgtggggtgaaagtgccgggggatttctgagcaggtctcttgtgtggcacttgctgtgggttca

SEQ ID NO: 2760 - DNA, 600 bp, Bovine  MMBT08595
cccagctgcggtcattgtgagaaaaccctgtgccttcaagacagttacaaagactgaatagtttctgcggggtttttggtttcagtgtcatttatttttgtattttcaaagaggaagtgtgcaagacatcattatgtcagcagtgggcaaaaggctggtagactcttaataagtggacatacatgtttacacttcccaaagtttctctttctgtcaaaaggtctaaccggctgttggtatctctaggttgggttatttcttcccttgatggtaagcttaataaaatacatttttaagttrtaggtggaattttgaaagcctgtttctgcaaacctcagatttggcaccttattttgcttgtcaagatttctacttaaaataaataagtaacatctaatcctggacacggattaacaagttaattcctttccttttcaaaatggaccaattagcaaaaccctatctctgcagatttctgataaagcctaaaaatcaaacaaaagttgtattcatcttgaaagggcatagccataagaataatcacatattaaataaagtattcagatcattgctatatttaatatttcccatatgatacat

SEQ ID NO: 2761 - DNA, 600 bp, Bovine  MMBT12893
atgagatgaactcagaaggaacatgataactatctcaattactggaggagttataaagtagaaggaaggaatgaagaaaggtattacatgagggaatactggtatgtcaggcacttccaaagggcatccatatttaattttctttaatgtgaaaatgttgcctgattttataaccccagaaagtaaaagagggacaaacagaaaagacatgagacagaaggggaagtacggatagaaggaggtcggtatggaagtgcagtagaggagaaagggaaccaaagacagaaytggtgacctccraagacaacagactggcagaccctggcaatgctctagtcctgactggatgactacttgccttggagcctgtctgaaagaatggggtacgagtttcacactcttcccaactgcaaaatcttrgtctatgaagtgaggaggtttacagggtgggtgagaaccactggcgccatctgtggtggaaatcggggcagtgggggctgtgtcgggtctctttaaccaaagacacctgcagcacctacacttacactgtgtctgccacgactcccctcctaagtgccagcctcgggagagaagaagggt

SEQ ID NO: 2762 - DNA, 600 bp, Bovine  MMBT15592
cgaggagcaaatgggaccctgagccagctggacccttgaacagacatccagcagaattccatctgggctcggctgggaacttcccttgcagcctgtgcaatgggggaatgttccctggcttcatcctcatctggttctttggcctgcacctctctgccctgacccacagcctgttccacgtttgacctgctcccttttcctgctctgactcttggatataagcccctgttgccatgactatcatcccttggtttttgactcagcctggcttctggtcagagcttttgcactcacacatarctagcgctcagttttagctttggattcagttgcagtcttatttgtacacttgattcaggcctctaatttaaccataactttcttggttttacacattgaaatacaaggtctagacccaaggttccaaatatgggcctgaaggagaaaactttagcttgattattggatgttatctggatccagtccatgtccttctttagtgaatggctttgaaacagcacttcattactcatccctagtagggaatacttccctaccgtaatctaatatctctcaaagccatgagtaaatcaatcctgc

SEQ ID NO: 2763 - DNA, 598 bp, Bovine  MMBT17029
  misc_feature (1)..(218): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctcttccttacctgctacaaggggatatagcagcatatgtattgctcatgtggttggtgttgatggtggacagcaccyggcctttcagattccaaatgaggacggtcgtgtcactggaagcagtcatgatgaacttccctggaggtgagggggcgtaacacgagctgaggtcaatgacctgatcaactgacttacgaaggcctctgctgcccttcacatcatgctcccctcccgcaccaagggtcgccacagataaggatatractgaagactggcgattacctgcctctcctagggacttgctgtggctcccaggaactccaggggagcccaaacaaggtcccttttgtcacaccagaactgagcatacctctca

SEQ ID NO: 2764 - DNA, 600 bp, Bovine  MMBT17505
ttcctagtcaacttacagtcatatacttccataaacttttgctgaatacataaaaaagaacagtctgagtcagctgaggggtcttaggctctgggacttgaatctacttttatatttcaccagctatgtgaccgcaagctactcacttctttgtctctgcacaattttatgttgataaggaataatatccctttgttataaggttgcataaagaaaacttgatagtatgtgtgtatatttgcctcatgttatttagttgctaagtcgtgtgtgactctttgtgaccccatggactgtaastcaccaggctcctctgtccatgggattctccaggcaagaatactggagtgggttgccatttctttctccatatttgccktaatatagggatttaatatttattccttcagtctttgatagaaacaatatcttaaagcttttctttattgtattcttcatagccaaagaaattattttctctttttaagaacacacaggaaatccactgtctttgaccgtcatggtttgtttttcactggtttgtcgattttcagcactgattctgaagcttttgtgctaatgctcatcttacaatgcaag

SEQ ID NO: 2765 - DNA, 600 bp, Bovine  MMBT02203
agtgtacctacccatagtgtaattggaataccaaaagcagaagagaaacaggaacagaagaaatatctgaagcaatcatgactgagaatttccccaaattaatgtcagacatcaaaccacagatccagggagttaacaagatggatggccaaaaaaaaaaaaaaaagaagaaggaatgatagaattctttaaaagaatggtaaacaaaaagtccatatctgatatatttgttttaaaaagttttatatcctgaagcaaaatccacttatttcaaaagtgatagtctctttttctgtcaaratgtaaaattgcacaaacaagggaaaaaagcatcttacttcttttcggctcaatcagggaaagacatacaaagtccagtcttaatcaaagtaacagtcttactatatttatattttgtggtcaatacaagaaacataatggggactctgaaccagaaccaggggtgtgagtgattcacttgttcctaccaagaatgcagtgcattgatcagactgatggtgactatgggtggcaggcagcaagtgtgcctgaggcagggcacagaggaggcagaggtcccccaggcactgagaaaaccag

SEQ ID NO: 2766 - DNA, 598 bp, Bovine  MMBT03080
  misc_feature (1)..(115): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttctgaaatgatgccttatattctctgaataaaagataactgccttcagggtaaataatatgcctgcacttgcagctctcttcctaccttaaaccatcactataatggcccaaggctctgcttctcatcactacacaggaagagagaacaaggtgtggcttacaaagctggtagccctaggyacatgtcactttacttttttgccttctcttttttcttccatttagagtcwtctgtgccaactctcagattggtaaacagagggtggggctaaaggtcgaaaggtgacagatctcaatctgaactcactagcttaatcagctgcatttcttcattttaatcaggaaatcctggagtgaccsagtcagcaagagcacttgtggggcgacaaagaagggagggaggggaaggagaagagggaggagtcctgtatcgaggaagggaggggcgcctctctcttttctgggctcaaaatggatc

SEQ ID NO: 2767 - DNA, 598 bp, Bovine  MMBT05683
  misc_feature (1)..(104): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagttctaattctaagatagttaaagacaaattcaaagttgttttaggcaatctaggtagcataagtttactacaattctccagtcatctagtaacctttttatattaaattaacaaagatttgggtaagcattctcaagaatgagtgttttatatgtactggaaaaaaggaaagtggtcatcccttagactgytgaatggctaataaattcaaagaattattcttgtctattaacacttgcagaattrtgttatgaaatattgagaaagaaatatggagtttactattcaatcacaaacacagcttatttcattattcttagcattatttmaagaaataattcatggaatgtctcatatacaaaaggataattcatttctagtatctttcaagtatatttttggttcatcattaaatatgtgcaattccttcagtcaaacacattaaccctctttataaaacagtttgacagaaaatagacaaatctaaaa

SEQ ID NO: 2768 - DNA, 600 bp, Bovine  MMBT05881
tcttcctttcaaaaatccaatcaaatcaggccacataaattcaacttgacacattgataaagatttttgggaaaaaatattgagaagggcagtgggagctttcctcagctcaggttaaaccagcttcatctcataagaatagtggcaatcaaatttgttctcgcctttcttaaaaatgtaattagaatgcagagagaagtatatgaaaagggatggggattatttataaaagttttagaataaatctttctgggtcaggagatttgcccaggggcaagaatttaatacataagcataacyctttagagagttgctgctccagggaattttttttttttccccaaccagggggaacttgaggaaatgaaaaatttcaaagaaatgttagaagtggatgggcgaaacccaatttgatctccactgtaatggtattattccattttgcattaaagaataatatccataatgtgaagattatgccaagtactctacaaaagcctgcaaaccttgaggcagtcaccgcagacttgcttccaattgtgcttggaatgacacacacagatatgctgagaagtgtagtgtcagcagagctttggggct

SEQ ID NO: 2769 - DNA, 600 bp, Bovine  MMBT07192
gttattcatatatctatttgttagagtagttttattttattttttaattcacctgaaagaccaaatttgaatagcagacagataccccacacacagggaaaaccatttttcacctataatgagcacattttacaagaaaaatgccacacaattcagtgtccctaaagcatatttaagatctagtcactggttacttctgcaaaggtcagtgctatattttcagccaattttcagtttaattgttatgagcctgggatccttgttacaagttcacaaaaataaatagttgagaaaacttayttatacatttattgtaaatgagtgaaatcatattaaaatataaaaatcatataaaatatatattccatacctaatttttctcagtaaattcagtgaccaaataacatgcaatagtcaagggattctgtttgtttcctactaaaaataattggctttcaattgtgatggtatacaaaggacatattgtaatgtgaaatttaatttaataaagaccttattatgttttggctttgttcagagacagtcaaaagaatatatctttattcccattgtgtaaaacatagagcacgtctaaccaaa

SEQ ID NO: 2770 - DNA, 600 bp, Bovine  MMBT10120
caaattgctaacttttattcacaaaaattagtctaattactccagttctacgaattgtcttgttttccttatcatatcagaggtactatatctttttttttttttccagcaggagacaaatgtggagagtttttattcattatgtcagtgttactttaaacctaagcagtccgtacccagaccaactaacacttcctcagatataagaaaatgttgaggtatcagttaaatggctgtaaatcttgctaataagcttctctggttatttaaatcatagttttgtctgtcttccagaattgrgaaaagaaacagcttgttgatgggtttgtctttccaaggagagcgctgtcttttgctgtgggccacgccacgcagtgcagtgtggccggrccgttgtctggtgytggtgccgcactaggtgcctgagtgctgttatctgatgaacactggtgtaggtgactgcagctcgtatgctttgtgaattacaggtagagtaaggagtgtcgtygttaccttgggggatattgccctataaataaagcctttttagagatggcttcctcaactcactgtccccttccccagggcaggggtggcagt

SEQ ID NO: 2771 - DNA, 601 bp, Bovine  MMBT11881
  misc_feature (1)..(1): n is any nucleotide
nggggaggggaccataatgtatgcctatggctgattgatgttgatgtttagcagaaacaacacaattctgtagagcaattatccttcaataaaaaaataatttaaaaaattaaaaaaaaattttaaagtttaaaactatttggaaatgcttatatrgattcattgctaattttcatatctaaaagtatttaggttttccatcacacaaacatgagaaaatgtgaaatggatatgatttatctatgataaatatatttctataaataaagcttatttcctctgttctattttttctcctttycccaaagacctcacagtgtttcaatttttgaaatctttcctctaaccaggaaaaattaagcagctgctacagataaaatgagcatyaccagcagatattaaaactgtcacctgatggaaaccggggctcaacattaggccttcaagcaataaccagcagtataattttgtaactcatatatcaattaactttatattactgtcacacatgacactaacagctaacaatattgcttcatgctgctatcttaattgcaaagtatgggtgctgaacgtgaatatcttaagatgaaaatatgtc

SEQ ID NO: 2772 - DNA, 600 bp, Bovine  MMBT15581
ggagagtgacctgcctggacagagttcagtgctggtgcactgttttattttgaggaaagattcctgctatctgcagattggtaatcatgcatccagggtctagaaatggttgtctctcctggtttattaaatctaaagtcagaacaggagcatcaccttccagatgccatctgcctgtcggctgagcagggtgcacttcagctgtgctcaggggccgtctgatgaacatctgatctgtgactctgcagaggagaaccatttcctgagatcacagggtagcactgtctatgttgtttatcyaatcatatttaaaaacccggaaaggcagacacgagcactgactttactgataaggagtgcagggttcattgtacagcatgtctgggtaaaagtgtctggtgtgactcaggaatcaatctttactcagagttgcccacttttagctttaagtcttgtgtacttttaattgtgaaggaaaatggagagtgtgtatgaaaagctggagatgtaatttttcatagcaatgcctaaaaggcaaattctaacgaagaatttcggaatggttcgcatctttcaggcaatgaaaccccagccccaact

SEQ ID NO: 2773 - DNA, 490 bp, Bovine  MMBT18403
ttttatttttttggactgagaaatgtyggaaaatttacactgccagtttagacactgcaatgttaggaggatcatttgagaagcggcaacctcaaagtaattttatactccttgagttacttttcactttgatccttactctggcacttgaaggcagctcatggagttgggcaggtggcaggcacagagccatggacctctggtgtttgagacaactcaaaaatccatcctgtgctaagtcagtgagaatggaagatcttcttgattagtgagttttaccactggcaccattatattctkgtacccttggtccatgttctaaagtaattaggtcttattcctggagatccaccttccctcactactccattatctactgtcaaatgtccctcatgttctccaggttctatccagcttcactcatacttattttgtggggtttctagcagtttttctgggcaactatagttcatccctaatctcaggtcat

SEQ ID NO: 2774 - DNA, 600 bp, Bovine  MMBT18408
cactgaagtgrgttgccatttccttctccaatgtggctatcctaaactcccaggkgttatataaaatactgagtgggatccttaggggaggaaartaggtcctctctgggatctttctatagcagccccacactaggtaacctgagttactttagttcttagtacactacccatgggtctcacttctgraaatgctaaaagcccatctacatatgtgtttgcatcctgctgcccctcagcacgtggggctggtgatgcctccaagactgcagcagtgactgcctcccttcacgggcagcrgcctcccacccccttctgctgcctggtccttcacttggactggagcagacctgctccttctctttcttctgaattaacttccttacctgaaaaatcttctggatccccttccatccccacaccagatggggtctctagtctcctcccgcttagctcttccatgtcactgtcctgctggctttcctccccacacacctcaaaacggggcaggagttgtctctagtcttggatccctcaaacatcaggaaacatttggtcacatcaccctccrcacagggctcatttcagcatataggggca

SEQ ID NO: 2775 - DNA, 600 bp, Bovine  MMBT18965
tgaggtacagaagaaactgagagtgtgtagtgttacaaaggctaagggaaagagtagctcaagaaggacagagtggccacctgtgtaaagcactccaagaagtcaaggggataatgaaaaaaattgtcagttgaattccacttcctgtctattagggcaggtgggaagggatgagacccagaggacatggaaaaggattagctttggtcaggagaaaagattcctcctcctttgcaacagaagaatgggtacagayataggtaggtttgtaaattmattgcaaatacattgtgaatttcycacatyagaggcaaaataatctgctaaaactgagaagagaagccaargagtctagaagctttgaagtggtaaccatggagagcaggtggatcagtcaagggaaacttggcaggatgtatgagcagtgttgagctcccagttgaggctggcgatcatgaaactgtagtgataatcatcagcatgttatgtgatatttcccctgcacttctcagctgcctgatgcaatcacagaaaagacagatcgctagatgagccagcatgaggttttggtaggagcagaggttcttcatcagagtttgt

SEQ ID NO: 2776 - DNA, 600 bp, Bovine  MMBT20089
tatcaaagtaatgtacatgcatttaaaaataggaaaaaaacaaacagaaaagaataaaagtcatccataatcccagaatctagagataacctcttgttaacattttagattttttcttcttttctatatatccatagaagtatatacatttcttttgtattcctgagatcatagttttattttataatctctctttatttaataaaatatcatcaacattgtctttcatcattaaatattttttaatggtatgattttttttcaccagttttattgagatataattgacatatagcattrtagtagttttaggtgtacaacatagtgatttggtatgttgcaaaatgatcaccacaataagtttaggtcttacattcaagtctttaacccattttgatttggggggatgtggtgktaggatagaggtccagtttcattctgttttcatgtggctgtccagttttcccaacaccacttattgaagagactgttctttctacatcatatattcttggctcctaattaattgaccatatatgcatgagtttacttctgggctttttactctgttccattggtctctatgtctgtttttatgct

SEQ ID NO: 2777 - DNA, 600 bp, Bovine  MMBT20445
ctcacacctccgcggcgagcggagagggagctggcgggtctcgagggctttaccctgccggctggcagaggggggcggtgctgggaccattaggaaaagacgcgggtggggggtggggagcgagggtcgcttcggaggagcacatgttatctttctccctcaactaaatcgagaagccggaaaaaaagggccggaaagagtcccactgaactttttctgtgttaaggccttaagttgctcaccattgtgttgccttagaagtgggacatcagtaggggtctttgttccctacttatcagytgagatgtcacttgtcacctcccatcctcatttcattcaactgtaaagtgggggcaaataggtccgtcttaaagtgtggctgtcaagtttaaaggtgagaaagtgcctggcttcgcagaagtgctgggtaaacgtcccccttgcgttcgtttgtatcttcctttcagccctattctgcgggagacttgctcrattgggtctcttaatgcgggtcaattcgccttaattccgaggtgacggagacgccaccgccttggtgcgcagcttcctcctaaaggggttgcaaacggctggcttacc

SEQ ID NO: 2778 - DNA, 600 bp, Bovine  MMBT20731
tactgaagacagctctaatctaaacaaatggccatagccttgagagcttccaaagctgatatgcaaagatggctgggattcaaggcaatgcaaaatgtgctacaggaagctttcaaagcacaaattaacccatttattatgtctgtggtaaagtagcatgttttgccttgtataacatttctcatgtttccataaaccatagtttaatatccttttggaagattaaaactagaagtcatttctagtgctaacaaatactttgattgagaggtataactgttctattgggtctcacaactyggcagctggtttcttcaattacactttttaagtagaacaaaactctgaaagcaagcaaacccttgactctgagtcctgcagtgggattggacatgctgtgctatctccccaaggcacatttccttaagcaaaagtgtgtctttgtagatggttacgtctgkttacttacaacatcatraacaattacattctcttttctggttcctataggccagctatctaaaattaagttaaaatatacacatttttgtaaagaaaacagacttgatttaaatagatcacgacaagtaatcattcttt

SEQ ID NO: 2779 - DNA, 601 bp, Bovine  MMBT21016
  misc_feature (1)..(1): n is any nucleotide
ngagcgatttcataaaaaagagagtcatttctgtcaacttggagttaactgatttttataaataatcgaattgcattgatactccaaacaagagtttcttctagataaagaatgacaagcaaatgccctacagaatgacaaatgttgcaggtggatctgatagggaccatctttacaaggagaccaagttagctgaatactttcggcttatactgtgaataaggatcctcagaaacaagtccatttttctgatcctcatatgtaatcttyataaataaatatttctttgctttacatctgygtggaaaatttgcctcctacacaagccccaccttccagccaggtccaaatctctcactacyaatgttatcattatccttkggagtccagctgctttgggttatgaggattttttgcaaatacgaaccraagggagcaaaacataaagcacttccatttttttccttcccatttccccaagttaaataacagtttattctgcaggctttcaaatcactcccacaaaattggcaatccaagacaatcgacacattcatgctaatccacccagaagtaaatacactgtggtaaaactgtgaca

SEQ ID NO: 2780 - DNA, 600 bp, Bovine  MMBT21052
ctgatcttaaatatttgttgcatgtctttctgtgcagttagtgaaggtggctgttttcaaggatgattctttgaagggaactgcctttcactgtgggttgtgtaatttctttgctccatctgtctcatctctgattatgatagcctgaatgttggcatttcctagtggtcaacggctatgctgaattactaaatctcttaagtctgtcgttatactgttacrgatcatggctgtccctttctgctttacacattgtagttctttggcagtgatatcatttcagtttaacctgagaaagcyttttattttgttttcttttaacctagaagttttaagagagtaatgtaaycttaagagaggttacattgcctgacacggagacaagtcccagtyctttaattgggatccttatgaactggctgagtcttaccttgccagatccactcagcacaaatactccactgtacttaaaccarcgtctcatayatccatactaaatgtttatgcggtttttgtagtggaattttagtcttaatcactcctctatcttctaaggtccattttatgtgagagactgggacctgtgactcctctttgaac

SEQ ID NO: 2781 - DNA, 569 bp, Bovine  MMBT22206
ttcccatctcgatctcttagagggacagtgggacattctttatcattttgatgtataggatgtatgaccaaatagaggaaaatgtgaaattggaacttctatcattgtcctcctgggctgccacacccacactgtgaataatattcgccttactcatactaagacrtgtgcaagccaagatgagcctactcaaaaaacaaagcatgtgctttaagccttcctggagctgctggaattgtcttgtgtttctcttcaacaaaatgcaacgattgctgagacactgcattacctgctgagcarttctgagctagacagcgtgagaaccctttcctgaatgccaaacaggtattgtcttctgtggctgggttgttttaaagagatgcaccccaggtctgaaataaactttgcaaaggcagtattctgtcaagagggctatgattatggttttggcccctctgctccagaatcttgactccaagaaacatactagatatagatggatagatatatacatacatacatacatgcatgcatacatacataggtcgatctctgcatgtccttagtaa

SEQ ID NO: 2782 - DNA, 600 bp, Bovine  MMBT22509
agtcggacaggacggagcgacttagcaggcacagcacacgaaccttctctgtaaattcaagtcaaggtcgtacacgaattctccaggaacatcactgattctgtaacatgttacactcgctcccctttctagggtgtgattttaaggtcttgattgtccccactgctcaaggcaaacgcractgtgtttaatgttacactgaaagtttgaaaaagaactgtttgtgtaaatacttactayatagaagcaaaatgaccaaaggccgctatttttcctcctcttacgaaaaataaatgctaycacgtacatcagggagacaagtgaagccgcataaccaagcgtcaggacaacctgaaaacaatacaaagacacaccaaagtcaagaaaatgaaacattaactgagggagaggttacaagcgttgctgaagcttctcgtcacacatgctctctgcgtggtttctgtttgggtgtgtgacagaccaagaatggaaacggcactactgtacgaaactgcatcagtgtgaaagtttaccaggaattgctgtgtaaagatactctctgtgccattgttacttaccaaagcaaatacaattcggctt

SEQ ID NO: 2783 - DNA, 600 bp, Bovine  MMBT03629
ccgtgaagttaaattccttaagggcatgaggtcagaggcagggtgggctatcacctgggtgcttgggcctggttcccaggccacctggggcagagggaagctgtgtggtggagactcacggagggacgcagacggaagtgcgcaggtggccaaggaggggggcgcatgtgaagcaagggggtcggtcagtgtggagggtgcgctgtgtgtgaggcatgctctggctgtctgcctaggacaagcctgagctccagcgtttctgggctgattcactacttcctctctccccaaaggaatccyctttatagctctccaggccggacccctggatccctgggaatgctgtctgacagctgtgtgagtgcaaccgtggctcctgaaccgggtgccagctgggcgtgctctgggagccaccgcttgggatgtcagaggagagctgctgcagccgcccttccgtcagcaggaagcccagccgcatacacttggacaggaagccccggtgctggccagctgagcaagctctggtttctcctgagtctgaggctttggcccagcatggagggaggcgagccaggtgctgtggctgggcggcactgacag

SEQ ID NO: 2784 - DNA, 600 bp, Bovine  MMBT04487
ggaacaaagttcaatgtgaactggagatttagccactgatgggttgtatgatcagcatggtttaaaccaatttatacaactctggccaaaagttccttttgggatcagaatgaatttgttgcctactttgaccaaattgactagaaattgactggctctgttcattactatgtagatacataaagcaactggggaacaggtgtcactctggtggcaagtagcagaaggtgactctgccagagaagctgtttactgaaaggatcttgggagctgtcagatttgttaggagaaagggagagycaggcttgaagctaagcttctargagcagtgaaaacatcacttygtagacctggactgagagggaccgctgcccctgctgtggtggaagcaccaccaagacctcaaggaaaccacactgaccctcttccagaatgccaaccttgtaaacattgtcatcccaaaactcaggcttcttgccaccattctgccagcaaaatggatctcctggaaatctctttccttaagttcctctctttggaatcaaagtttaaaggagtgtatctgattggcagaacccgagacatgtctttattcatgtt

SEQ ID NO: 2785 - DNA, 600 bp, Bovine  MMBT08688
aaaataatatgaagttcaaaaaataaaagtgcaggaaagaacattttaaaacatgccttagctgtggaaatactctcttcacttgtatgttaaagaagaagtactatttcgagagattgtcttaagattaaattatccactttgcagtttgcaaggtttttagtgtttatttcagtattattttatgtatttatttttcttttaaaccttggcaaaatgttaagttcaacagagcaagaattgcttgggacaatcaaatcacatatggttaacatgctggtagatgttactggtatcacwtttgaatgactttcataatgctaataggaagtttctaattgaataataatgttaaaatgtctctttctgtgcaatacagagactgttctttgggtttctaataacatgaatatatgttactcttaaccttatttatttggagaataatgcatatgattcattgacaatctagaggttactagaatgctgaaaagaatacaacagatacactaaaagaagataaattctttgaaaatgtatattctaagtattgatattgagcttgmaaataggcttatttcagtaaagagratacttttg

SEQ ID NO: 2786 - DNA, 600 bp, Bovine  MMBT08691
gtttgcaactgactttacttcttgaagttgtttaattatattatacatcattaattaataactttaaatcttgcactatcattttaattatgttaatgctatcaatccaattacatgaatgctctatatataacagagagaagaaatgtcagaaacwaacttttagtactttaatgtcttctctgatagatttttgtccctaatataattttcttaacattttactagaagaggatttcagcactgagtctcaatttcagtgtttaacaatgataagcctcttgactgttacaatattasacttgcaaatgccccattacctcaattataacacttttttcagattgagaccatttctcatttatatttcctttcccagttacatataactctcagtaaattttaaatcaataaaagtacaaatgaatgagtggaatatgcattccagttatggaattaaatagttctcttgcatctaactactttcaatgagtttattagaccaatagaccaagaaagaactattaaatataatgtacatgcttccaaaattacttggattccagaatgtgtaaagattcatggtgagacaattcagac

SEQ ID NO: 2787 - DNA, 598 bp, Bovine  MMBT09321
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnntaagagaagggtgggtatgggtcatctatatgaacacaaggtggttcctattttaaggggcccagaaagaactagggcagaggacccagagatcctcgagagagacaagatcactgcagcagcttccaggctggctgtgcacagcatggcaaccccacacgttactgcctggccttctcggcaaacctgacccgcaacgcactcactcagcaaaaagcaagcactsggaggatgcaggttaggatggaagtcagcttagctcgcagtgctggtcaaggaccacagtgagggaaggtgaccccatgctgaggctcccatcccctctcatcaaccaagaccaggcccaccttcaaccctgaccctcgggtgcatcagtggaagcctggctcatagccagcatggcacagctctcgtcttgggccggccctgagtggtggctgcccagacctctcagatggcccagaggagggtacagaccagcccactcaccttcttggtgaacttggtggtcttgatctccacaa

SEQ ID NO: 2788 - DNA, 600 bp, Bovine  MMBT09402
tggtcgcagggtctctgctccagagttctgtggttcctggctcggccgctccctttgacttccaagctgcatacrgactgagcaatgagatggtaagtatctttcctggacacactgctttttttgttgacttgagaaaaccaatggctctgggccagtcctgacccacctcaggcgcacgaccatagacgactaggtgtctggggtccctgcgctcactgctgtcttcccacaggccctggccatcagtgaccattacccggtggaggtgacgctgacataagtcccttctggggtccrgaacctctgccccacgctgggagctgaagacaacaactgacccgtcacagttaagagcggagggcggagcttaaggaacccagtgccgttcgtccccgtgtgccctcaacyaccccacagcagctggaatttgaggagagggatggaaggtaggcttttcctcacctggcccacttccattgtaagtgtggcggtcgtgtcaccagagcaccccactttctcagtctggaaagaaagtctaaaactaagaaatgccttttaatttaaataaagctcaaaagggggtgttgtcattcacgc

SEQ ID NO: 2789 - DNA, 598 bp, Bovine  MMBT10175
  misc_feature (1)..(43): n is any nucleotide
nnnnnnnnnnnnnnnnnnnnnnnnnnnnnnnnnnnnnnnnnnncttcctgatgccctggcctcatgggacactgatggagatgagcctgtgatgtttcaggacccagtaaccttcgaggaagtgtcagtggacttctcccaggaggagtgggcccagctggcccccgctcaaaaaattctgtaccaagacgtgatgctggagaactacaggaacctgacttctgtgggtgagtgtggttggccacctctcttcgttagtagattttgtttttcagagctatcagtggtagcttacacgtstgggagtttacatgtctgaagtaaggtcctggagcaacaccccccaacatgtacacaatgggcaggatgtcattcatatttttttttttttttaagcagatttattatttttaaaaattatttatttattttatttttttggctgcactgggtctttgttgctacgtgtgggttttctctagtttcagcgagtgggggctactcttcattgcagttcacaggcttctcattgtggtggcrtctcttgttgcagagcacaggctctagggtgcaaggaytcagtagttgtagcgcacag

SEQ ID NO: 2790 - DNA, 600 bp, Bovine  MMBT11287
tgtaatcatttgagtctcctccacaaggcagcaaccggtttgattttgttcacctcagctgctcagggctggcmccagccctgggacccccgagctactcaaacatttaaactaatgaatgaattttgagactttctaaatactttgcaatcttttctatgatgcttttttgcccacggagatgtgtgagagcttgatcactttttgacaagaaaaccagaggccagagggaagactggggacaacagcagtgactgtagactggggtggtgtgggaggcagcgctgagctcctgagggygctgcgagtgttctttgtaaaaccttgacraaaaatgtaaaaatgccaaaaagaatgctaggatcagttgcatttaaaaaccatgtaggaaaactcttcaaaatgatacccacctaaagcaagtcaaggtcccagtctgatcttcaagacctcatatagtcacaagaagtctgaggaggtctcgaatatacaccctgagttttaactaagcaacccaagaaaccaaactttgagtgtggttttcagaaacatcagcagtgcgattttctaggagagttgtagacagtagatgctttgatt

SEQ ID NO: 2791 - DNA, 600 bp, Bovine  MMBT13187
tgtgtctgaatataggaggggatggggaaggaggcaaaaataatttaaaaaatgatcataagggaaaatagaatgaatagttggtttgggggtaaaatgattcattctccattgccttcactattctgactgctcatgtaatttctaygtaggacagtgacccaattccacctaaagtctcccacatcaggggtcatgatgggaagaagagaagatgagatgaagaaggggtcaccatgaactcatgtggtataagtagaagaaagactcgcacatcatcctctcatagctcgtgtccartgacactagaatgctccctgtcatgacaaatttatagaaagaaatagtatgcagtatataacatgaagccttttgaaccattttttaatgacatggaaaatgttcaaatgcaatgtcaactgaaaaaatccagtacaaaatagaatagacaatgtaatccacaatacaaagaaaactcatgtatatattgtctatataatcatttttgtaaagtctatatatatgtgtatgtatgtgcgtacaaatatattagaaaaggactgaaagcagttgttagttcctggtgtttagattaagggt

SEQ ID NO: 2792 - DNA, 600 bp, Bovine  MMBT13261
ggccatttctcaaaactcatttgcaaaccaaaacggccaagccyggtctgctttctctgatttcactttggggaaattccttggaagatatttgtggacgccccagagctgtctgctaggtgacattccaattgagtttacacaaggccaacagcttccttctggatccccatagtaatcagtttagccacgttacttgtaagccaaaagcactgctttatcggccacaaccagagcctcccaagtcccatgcatgacgcggctccgtgggacgaaggaggcaactgtcctcgtggaggrgracaggcacgcctggtccgcagtacactgctgggaagaggctgggggcctgtggcaggcacccccttgcccacacctctgactcaggacaagcatgtcatctctctgagcctgcttcttgactgcagaaggaaggaagtcatacctggacggctgcaaagtttaaatgaggttaaaaatgtaaagccccaggtataaactaagtcctcagtaaccatcaacagccctgcactagatggaaaagccatctaagatagacctttctttctctctgcttttacataaaaacacaactgcatc

SEQ ID NO: 2793 - DNA, 600 bp, Bovine  MMBT13265
gggaggactgtgaaatgagacaagagcaagcggcaaaccagcggctctatcaggactgacttgattttaggaaaaaaaggcaaatgctaacaatgcatgtgggcaaatccagccctcctcactcacgtctctggagacggggatcacaggagactctagcttccacaaggcattaaaatcaaaacaaaacaaacaaaaaaacacgtaacgggcatgcaacttggctggtaattacaaaaacaaaacaaagcaaaacaaacaaacaaaaaacatcggagataccatttcytctaaaatccrggctgggaaaggcaaggcctaccttaacaaaagccacggygggaggtgaaggcayggagaataaaggaccccagcctgggattccaggacctggctccagccccacacccctgccttccgacccgatgagttgcttccttcctctgagccccagtttccatgtctataaacagcaagggtggggaggtgggtgggggtggatcaaggccactgcctgagcttccacaaatgaccaaagaaatcattgattaggtttgttttacaaattattaagcagcttatacccacacccactatgct

SEQ ID NO: 2794 - DNA, 600 bp, Bovine  MMBT16215
ttttttcaggctctgcatttcacacttcaccataactagctctgtctggcaagagaggttaagactagtatccaggtctcagactgatttttcccaaagttaaacagctagttaaatgattgctattaattttctaaatgttttcatttctaaatatgcatatattattagaaatctccaccagaagacttaaagccatgtaataaatcacccagatcatgccttctctcacagtaatctcttacacatcctaccatatccattcattaatttgtgaggcaaatgaaacattcaaatcaycctaaatattttyatgctttttwattacttgtgcattttttcctgtgatccagactacttctatcttggcccagtgcaaaataatattaacayaagagcagtattaaaatcacataaaatattaggggaaatgattaatttttttacttatgtcaggtggcactggtggtaaagagcccacctgccaatgtaggagacataagggacgcaggtttgatccctaggtcaggaagatcccctggaagagggcatggcaacccactccagtattcttacctagagaatcycatgcacaaagca

SEQ ID NO: 2795 - DNA, 600 bp, Bovine  MMBT16774
tggtggccacaaaagtgttgaaaagataaaaaaatatatatatatatagagagatatactaccaggaaagtggtttgccaaaatgttaagtagctacagaaattgaaaggcttgaaatgagtcaaaatgcattgtttctgggaaatccctagaaatagaaagctgcctaacataaacttttaggttgacaaacatgattttagaatcaagcatttaatcacactggttagtttgaatttgcatgtttagagtgtaatgaatctcacagtatgtaatggacacaaattttacattttattrgcatttacttgatgtattttgaaacagtaattgatactttataaacttataacaagtttttttctcatgaatttaagttgaaatatgatttatgcaagaactgaagttgttactgctaaatatcacatatgagaggaaattagattgtagaataacagataaggaggaggctctagatgctgatagaattataattccatttctaggtgggataaatgggaaattttatgtcattagttttgtagttataaaaaacaaacaaacaaaaaccaaatcatgccaactaagttgatgactttt

SEQ ID NO: 2796 - DNA, 600 bp, Bovine  MMBT19820
agcaggctgatttcactcttcgttagtggtggcacagactgtaaaatatttatgttcatattctaaatatgtattcctggagtaaataaataatttactgttcaggttataaattatttacttagttattctaaatatatgtatatactatttgcattttgctggaagcaaaacggtagactgatgrtctttaaggggtcctaaaagaaaaaataaataaatcaagacttaagctacaagaggaagtgttctattaaagagawagagagagcagaagatagccccaaatacattgccttyctygtagaaaatatcgattttatctgataaccccagtgcccaacatgaattttgtggattttgtttgaaatttttaagttgggcttctggattagaaaattcgatattacaaaaaacttttttaaaaattactttaattccttaaggcttgctgtgacttcaaagcaataggtaagatattgtcctgttcgggttgggggcaccatctaacgggctttggggccggttcattcattggaatcactctgtcaaagatttcagatccccagaaatgactcggagaaaagcttcttcttgaat

SEQ ID NO: 2797 - DNA, 600 bp, Bovine  MMBT20226
ctgctgagtaagcagcagaggaagcagagaaaggagagagatctcccaaacttgtgtggtccttagattcyagggccctgctgcagctgcaatccagaggtgaaacaaattaatttaagcttcaacccactccctgccagctgctagttttaaaaagccaaagaaatcagcctttcatcctcagaacacaggaaactgcgggttgggctaaaggtcaaatctccataatttcatttaaatctagaagtaaatggactaaaactgctgctcagatccagctcagtctgactcaatgaaatrtgaatgatcagccaaataccccagctgcctgagagaggaaagaatatgccccatctgggaaaaataaaggaaaaatattatctaggttacttcttttataaaaaaggtccagtatgaaacaaactctaaaacatgcaaagaagtaaataagcataattcataattaagaaaaagagccaaaagaaagacccatgtataagaactttaaaataattatwaaaatgttaaaagaattcagaggagaagatgaacagaatgagtraagagatggaggattccagcaaagaaacagaaattcta

SEQ ID NO: 2798 - DNA, 520 bp, Bovine  MMBT22699
cgccacctgcccggcccctcgggaatgaaacagagcgtggccaaccaggcctgaagcgctccgtcagccgagagcgctacgtggagaccttggtggtggctgacaagatgatggtggcctaccacggacgccgggatgtggaacagtacgtgctggccatcatgaacattgtaagtgcctccscctccctggacatggacccccaaaaatgtggagcccacctccagagtcaggaaaagggctgtcaccatcccccccatcactgatcaaatgccagtgaaacagaatgggaaggggacrgggtgcctcagaaagaaagcctgttagtgaaagtagcctagcacagtggttaggagcatgaactcaggagctagccaacctggccttaaatctcagctttgccaatctttgactgtgtgcccttgggcaagctactttgcctctctgccttggattacccacctgtaaaatgggtttaatcatagtaccaacttcataaggctacgtggatacagggaat

SEQ ID NO: 2799 - DNA, 508 bp, Bovine  MMBT00804
gttgcttttgcctgtatcaggttttttgtgggtgtctttctacctgactatatcttgatgagccagttcagtttagtctgaggaaaaaaatgttactggtggtgtaaattaaacaaccatatgaaagaaaaaacaaacaaacaaactgatataggatccagtagaacttacgaagacaaagcctgaaaccatttcagggccagactttatactatagcccgagaggggaaaatatgtgcattttgaagaactgtagacatttaaaacaacttttaaatggtaaaagttctagatttcagmacaatcagccaaagcatagaggataagtaagcaagctctgacatcctgcactaaagcgaataatatccccaaagacaggatctcagatagcgagcgagtctttcaaagataaagctggttgggagtctttgtaacagatatatctgagaaatatatctgggtcacctaaagaaaaacaaatgatcctctgataggggaaattgcttat

SEQ ID NO: 2800 - DNA, 600 bp, Bovine  MMBT02374
ttctttgtggcccacatttccttatctcaccagttcttctaaatgaaatctaaccacttgggagaaaccactttctcccagaacctgttaatcagcttacggacagtagacacatttatcgctggtgctgactgtgtccctagcccctgcctgttttgagtgccccacagacttagggattccgagaaagtatcctgggagagtttctctcatctcagtctttatattacagcaccgggagcagtgactcctacatgacctccttcccagaggagggaatagaaaggcaaggagctccakggcccaataccgagttctctgctatttcttgtctcttgaaggagcttattggcatctcagccaatcccatagcgatctacacagacaggctgtggcagcctctgttgtgggaaattcacatactgtaagtcagacgagaacgaatgcaacaccgcattgtttctgctacttaccttgtgtgactcctctgaccttcagtctccttattgttaaataacaatgatacctgccttctagggttgtgaggattcaaaagggaaatatatgcaaaggccccacacaccagacatccaataaaag

SEQ ID NO: 2801 - DNA, 600 bp, Bovine  MMBT03945
caaagagtcggacacaactgagctactgaactgaagtatgtacaatttctagatttgttaagtttacttaatttttataagttaaagttaagcactgaaagttaagcactgaagacagcatcatttcaatttttatttttaaaaagtgggctcaattttatttttaaatagtttatatataactagcagcatgtggggaagggagagttttggtgatatttatctgaatgcctcttagtgagctaaggggtcatacagagcagacttgggatagaaagaacattccaagtaactaatttyctcactttatacaggaaagtagcagttgaagaatcaaagagtgctctttctccacgtggaaaagtacatgacttttcccccaggcaaaagcctgcttarggttcttttcagcaaagggcaaggatgacttgagtagagtcattttctaaaaggccaggaaatagctgctcattttccccctactaccttgctctagttactctatatttgaaaaggtgaaataaaagttggygcatttatgtgagggccatgccaaagtgcttctggccttattgctctcctgcttccctgagccatttt

SEQ ID NO: 2802 - DNA, 598 bp, Bovine  MMBT05695
  misc_feature (1)..(30): n is any nucleotide
nnnnnnnnnnnnnnnnnnnnnnnnnnnnnntgctgggagggattgggggcaggaggggaaggggacgacagaggatgagatgactggatggcatcactgacttgatggacgtgagtctcagtgaactccgggaattggtgatggacagggaggcctggcgtgctgcgattcatggggtcgcaaagagtmggacacgactgagcgactgatctgatctgwtctgataggtaycacaataataatgaatgttattctaagtatttagccctttgcttgtaatactaatccagtagatggttytccatacgaaaggattacattttataagatcgcaagctttcagaattcaagaaagaaatgcaagtataatytgaagaaatttttttcaaaactgcgattcttaactcatgtattacacggaggttatggtgctttcatatttcattaaaatgtttaaaaaagtttatatgatgtagaccaattctgcaagactatagaaatgaatatgaatggttaatcatgaatttaaaaatcatttagtgtctatatatcatcccattttttttgccattaaaatattccctgtttctcatcagga

SEQ ID NO: 2803 - DNA, 600 bp, Bovine  MMBT07522
tatttaacttaaaatactcaattcagatttcaattatccagtcaacagataagtatttttaaaagactgcatacagatttaccttgttgtcagccaaaatctgtgaagttttctcataaactgctgactacagaataaatttcattatatataacttttatttaaacagaattaaataacagaatgatgagtgatattaaaactagttttgagatagataaaagcatataaaatatagacattatcatagttaacttttgtatcattctcaaaatataatcttatttctttcagaaattygtacttatactaacagcaaaattttaatcagtatagactaatgatcagttagacaatgtaataaaattcacataccaaatttcaggtatggaaagattgcattaaatacattaaaataaagagaaaataagaatattctgaataagtattcagtagtttaatatatgagtgtccagtgcatgcctttcaataacagtgttttttctcataataaatttatggttagttaaattttgtcayttctactaatcctcagtttatttggggttgttcatcatacagttttatagaaatacttgt

SEQ ID NO: 2804 - DNA, 600 bp, Bovine  MMBT07618
agccaacaactgacaatatgatacttatctaaaaagtaaacctaattcccatcacaatagttttttctttccttataggattcctggtacttaaaaatttatctgaataattaccaacctgttaagaaacaatcttctttacttttaaacttcctatttaaagttataggtgccaggcacaaggtatgcaaatgaataaaaaatagatactgttctataacactgataggaaaaaaagaagtacagtacaataatgaaacagaatactggaatacaagagagtacagtctttggagtcarattgtttgggttcatgtcttagttctaccacttgggattcccttgtggctcagagggtaaagagtctgcccacaatgcagaagacctgagttcgatccctgggtcaggaagatcccaaggagaagaaaatggcagcctactctagtattcttgcctggaaaatcctatggatggagaagcctggagggctacagtccatagcatcacaaaaagttggacatgactgagtgacttcattttcttttctttatttctatcacttgtactcgatgtggctgtttggagcagcctcaagggcct

SEQ ID NO: 2805 - DNA, 604 bp, Bovine  MMBT08146
  misc_feature (1)..(4): n is any nucleotide
nnnncccagggacagagggaagacacaacacggtaattccttgggaccttaagggttgctgcccagaattccagcaggtcaaatgggctgtgctaagtgttattgcaggaacactcagtttactaacggataayaataacctgtagctactgtaagaattcccaggacacctggtttagaaactataatatgcaaatttacaatcatgtgacattatgtgtgtttatccaggcaaaccatgctggtttttcattgttttttaaatgagggggaaaaaaaaactgctttaggaaaacaaatagtrtgaaatgcttcactaggatcacaatttatcaaatactattgagaaaaaaaaagaactgaagacaggcagcagcttagaaccactgatgtagttttctggtgctaacgaaggtcacagacttccacctaagaagtttctttaattgtaacttcraaacccctctgcagtgggataagcctgttcactgaagtgtgtggagcaaccaggagaagagcatggttcagcctggatctaatgggtctgacattttgtaatgactattaaatgcttattcctttttgggggttataatttgttaaa

SEQ ID NO: 2806 - DNA, 565 bp, Bovine  MMBT09471
aggttgttctaaaggagaaaaatcaccatttcagagatggaggggcaagtctgaggcaacagactgagaataaatagagcaattatacatgtgtgtgtgtgtgtgtgtacacacagaaattcttttccattagttcattacaagatatagaagtatacaactgagtcgctctgctgtacaccagaaactgaacattgcaaatcaactatatttcaattaaagagagagagagagcaagcaaaatctatcagcgaaaggcatttgtgagctaaaagccagtttgcaagggcacaagattakttgcattttctgctgaataccttcctcaccctgggtccatggctgatttcctattgctggttcattccattggcttgggcggtgtgttttctctcgttgggaagataatttttaagtagtttcacaataagcagcattgattcacatgtagaggaagatcctttgtcagttctctttccatctttctgattacttcaagaataaagtctcagtctcataaaaatctgagtcctttgtgtgtgtgtgtgtgtgtttaataaaggga

SEQ ID NO: 2807 - DNA, 600 bp, Bovine  MMBT11523
tagcaaccatgacaaaaaagactgggaatgtcatattcagaatcttgtaatttctctcctatacctgtattttttttgtcacttcctgatttagtaccaatttaattcattcttgttgaacataagttctctagggcagagatacattagcaagaatctcagggtagaagaactctcacatttggatactatgtagtgaagttcttccatctagaaactgaagtgaagagtatctgtcctttagctgaaaccatgtgtcagcttctgaagtgacctggtttaagacttcagcatgtcacytgccattgtttagctgttacagcttctcactgtttaactgtaggactgtggcaacttgaagcactagatattttttaaagtaagcagagtaaaaagctattttatatttgattaagtgttttattttgctattccccttcaaatgaactttgcacagtctatttcatgaggagtgtggtttgctttggcgtgtaatcccctaaagccaagttccttttattgttattgcttaagtcatatatttttatacaaaacatcttattaccttagttttattttaaatcaaagcaaagtttgcaa

SEQ ID NO: 2808 - DNA, 600 bp, Bovine  MMBT12299
ggaaaggtcaagccatcctggttaaagttaaaaattagttacctttccccatgatacgactgaataagcacattaacagtttgtaaaagaggttgtgaaacttcctaagggggaaaaaatattatgtaatcagtttaggagagaggcttgcctgaccccacctctcagtagggggttgaactgactgggaggttcattcctatttcaaaactattattatttctctggaagagcttatcttttattgctaataacacttcactctcaactactctgctctctcctctcaatctacgtcaycaatcataccctgaaccaawataaacatctacccaacattggagcactaatctttattaagtaaaagcrgtgctgtcttttcttttttttttttttaattttattttatttttaaactttacataattgtattagttttgccaaacacggttataaactgaaatgtcataaggccaagctttcctggactttgtggttagaggacttgaatatctagccgaacccaatctgacaaaatgcacacagaygtcaattacaacaatgattcccaaacgtatattgaaaagccacaagaagtct

SEQ ID NO: 2809 - DNA, 600 bp, Bovine  MMBT13990
gaaagagacagcccttggggccactcctgggaaggtttcctggagtcacaagtgtgtggggccagcaccagactccacccccaggtgccccctcctcagggcaggccttgagcacaaggagccaagggtcgatggtgaggaccccgtagtgggaggcgggaggccaaggtcccccctcatctgtgtgtgtcccttctggccactcgggggaggcagactaacaaggggccctcctggacaccccctgccacctggttcagtgaaggtccaagttcaggagaagaatgaactcccagaaaycccagcacaggacacagacaccgtcaacatgtcttccaccggtttattgaggctgcgtaggagcaaggttggcagggaggccagtgtgaggctgggggctcagttggcggccagggtctgctgcacccagttgacgagagcagtgacgcgggcgtacacgccaggggtggacgtggagcacgtgctgctgccccaggacacgatgcccaccagggtccaggctccattcttcttgcagaccagggggccgccagagtcrccctgcaggacagggagcggggggcttggagctggcagccc

SEQ ID NO: 2810 - DNA, 600 bp, Bovine  MMBT14928
cttttagaaggccaattggcttatattccttccttaaagcctatttactagctcaggattcaaggccatctacaatcttgctatatctcactttagatctattttgcttactacccacgattcccaaaggaatctctatattattgggttggccaaaaagtttttctggcttttttgtaacrcagaaactccaaactaatttttggccaacccaatataatattcattcatagtttttcatttcacgtaattcctacttcaaatatttcccatgcatttctacctctgttgcaatcactrtgcccttgaatcagtggcatgtgcttccttcttttacataagaaaagggtaagttgggttttacaattctttgtcttcttcacattgcctgaactggtgccatattgtagacagtaggttatctgtaaatgtttcttggttaattagataatttatatacagaatccccttcatggatcactgccttgttttggtgaaggggcttgcataactcaatgaagctatgagtcatgccttgtagggccatgcaagatggatgggtcatggtggagagttctcacaaaatatgatccactggag

SEQ ID NO: 2811 - DNA, 515 bp, Bovine  MMBT18649
tggggtcagctccctggccsgccagggagggtaggaactgatgtgagcgaagyacaaactccacacttcacatatgaagacatttgatcatcaccatctcccaggartttgactcacgcccttaatgtagggctcaatgtagatagggaaaataaagctcagaaaggttcttattagtttatgtcctgcctggttccaaaaaggataggaggcagcttacaaaaggcaaacgttaaaataaaataaacctatgaggaaatggaaataaaaggagaatgagagaacccagggatggagtcygcacattacagatgattatcacttatacagttggggatgctgggacacctgtagctgtgaacttcctagtggtcatagcatagagcgaaacaccatcaacaacataagataaaaataaagtcattgcttggagattgagacttatttgttgtggtctggctcccacagtgttcaggtgtctgctgacaatgtgtcaggtaccaaagatatctttt

SEQ ID NO: 2812 - DNA, 600 bp, Bovine  MMBT19431
tgaaatagcctatttgtggcccatcaaacatacattgtacatctgctctaatcgttaaggaaaagggcacattgacctgaagtaaagaatgttcaagttgaaaataaaaattaaatgcctcccttcctgggaygcatgttggccctcctttgatgataagacttcccaggtgccatgttgacttgctgtgttcctgctggtctggttttatttgaaaccttgaagaaatgcatccctgccttgcttaatgttctttgttctgacaagataaaactgtactgaagaccaggcttctctggrgcaatttctcagagtaatctaggaaactgacttctgggctrtattctaccaactatagaaagctattttctattcttattataggtggtttattgatgatttttgttgacattacgaaaggaaaacaaaagygttgccttgcctttttgggaactattgcttttcccacttctttaagtacaagagactattccttctctctcttgcctggatttttctgggctttcttacttcatcttgacatgttattttctttgggtttatcaccggggctcctccccctgctaactattttatggg

SEQ ID NO: 2813 - DNA, 603 bp, Bovine  MMBT19712
  misc_feature (1)..(3): n is any nucleotide
nnnttgtcttttaagtctgttaacaagtgcgttgctacatgcatgctcagtgtgtccagctctttgtgaccctgtgactatagcccaccagacttctctgtccatgacattttccaggcaaaagtactggagtgggttaccatttcctcctccagaggatctgcccgacacaggttcaaacccgtgcctcctacgtctcctgcattggcggaaagtttcttcaccactggtgccacctgagaagcccctgggaacatayacttttttttttttttggtaacatatacttaacgtaaaacttamcattttggccattctaggtgtaccgttcagttgtgtggagcacattcacgttgccctgcagccatcaccaccatccctctgcagaagtcttttcatacttccaactgaaatgtcattagacaacaaggccccagccccctgcccagtccctgatgaccaccgtcctagtttctgtctctgtgcattttgactgtcctagggccttcaagaaagtggatgataccatatttgtcttttgtgaatcgtttatttcacttagtgtggtatctccgaggttcacctgggttgtagactgtgtca

SEQ ID NO: 2814 - DNA, 600 bp, Bovine  MMBT19773
atggtgctgttggacatcacagtggtggcaacaatacttgtggcttcggtgggagtaaagagtgtaaaccagctctgcatgatgctgtccagggcataaacacctgccaagaacacagagaagccgcattactgactggctgcccaggggtcttgccktacttccactctttaatcaatgcttacactgttwactagcacagaacatgagcccggccagaaaatcctgcaaggtaatgtgcctgggagcaaccttttacaataaggttatgatagactgttattcagtgaaatgcytaakgaacatgaacttcctgtaataaagagcraatcctctcggtagctggtatttgcgctgtgctgctgcctgcctgccgtttcagacaacggcttcttgctaatgagttccagttcactggggcctcctgtcagttaccgactrcagaatgggagtcagaaaaagtacaaccctcaccagaatagggagtctttatgtgatgtgtgtggtgtatgtgcccaagtttaaagtacacacaatacaaaatgattaaacacacaaagaagcaaggaaatgtgacctgtaatcagagagaaaaaagtc

SEQ ID NO: 2815 - DNA, 600 bp, Bovine  MMBT19826
tctctgttgcaacaagggtttgtcatgagacacagtaaggagacaaagtggaaacctattgagaagatttctgaaaaacaakacactttctgcctctccttcactttagacctgccagaggaacagcatccttaaaaccacagatacgaaaattcatgtgagtagagatgctccagtcctgggctgccaagttcgaagcttcttaccatgtataagaaataactccctaactattcaagccactgttaattgcattttctgttacatacacactttccacctgatacattatttaattcytattatatctctatggagcattagggtgaatcacatagaattttgacccacaaaaatggyaattttattcaatcacttttcataattcatttaaatactgaatatctactatgtgcaaaacactgacactagaacactgccccttattttcaaatgtactaccaaaatactttcacccaaaattcataaaactaaattatagataatttaaaactaaaaggataactacttgaatatgagtcagatatgataggatgaaaattacacaggtacattattttaagccaaacagatgcttaa

SEQ ID NO: 2816 - DNA, 600 bp, Bovine  MMBT21298
ttaaagacaagtgaacagaggaaataaagcctgaaatattagattcatgtatagcttggttttgttttcgaattacgcttctaaccactttaggccctgaaccttgtcaatttgacgtttatttcagagagaaatcatataggtgcaagtcataatgttagaagactaaatagaaatcctccctattccatcttatcctaacgaaatgtctttcacagattaactccttcagttcctgagtagaaaatatccaacagctgcactttccaaaatggtaattgtagctacccgcagctactsaacacttgaaatatagccaggttaaactgagctgtagttgtaggtgtgaaatgcataccagattttgaagacttagtatcacaaaaaaagagaatggaaaaattttcaacaattttrttttattaattgcatgttgacatgataataccttgaaaaccctgggttaaataaaatagattatgcaaatatttaacattgcacatgtagctcaccttattttttgcctgatagcgctgttctggaatcctatatgtaacatttattttcagacccatttttgaggttaatgggggaagaatt

SEQ ID NO: 2817 - DNA, 600 bp, Bovine  MMBT00696
cagacagctctacacagtgaagaattatctgacctaaaatatcaatagtttgaaggctgagaagctctgatattaatgggatgaatatatttgtttatgagttaaagttagcgaatgtggtgaggtgtgcattcatggattcatcaaactggtcagtgctaggctacagatgaagctgtacctgaaaggaatttcttcctggatgcaaaaaggttctttgcttttcaggaagatgttgtgggaaaggcctaagttataaaatggttctcttcggctacggttattacctggaaggcgtcyctgttgcctcagatggtaaagaatccgtcagcaatgtaggagactcgggttcaatccctcggttgggaagatctcctggagaagagaatggcaatccgctcgagtattcttgtctggagaatccaatggacagaggagcctggtgggctatggtccatgaggtcacaaagagagacatgactgagctacttaacacacacatacacattacctagaggcagccgaagtcctagaaagctcaagtttgtgtctcagtttccatggaatccacgagaracttcctttgttcattcaagcatt

SEQ ID NO: 2818 - DNA, 600 bp, Bovine  MMBT00901
tcccttgtacccaattggatagtctgagacatttagcactgaaaatcaagtaatcatatttgaggaaactgtttcrtcgcattctcctggcattatgtagtactattctgctctcatcgtattagaagaaacagaaagggcaaaatcagataatctgagtgctcttcatctcttcttccttttaaaaagtgttttaagctatatatattgttttagttttcaaagtcatagctacggtattttttaattaactggaaatatttggttaatgaatttttcttttctaagaaacccttcaarcagggatcttaatacagttgtcttggattatgaaaagcaatgaagcattaaatatctagtctgatgacatttttttctcaaatttatggatgtacaaatagaatatagaaagatcttttaaactgtagttaatattttagtcagtactaggaattgctttcttgatctgaaaattttctcatccactctcaggcttagaagctgtttagtttttatgatcccacctactttcctttttgtttcagattatcccctttatttgccctacttgttggagtagagaatccagttcttgtttga

SEQ ID NO: 2819 - DNA, 600 bp, Bovine  MMBT01073
ctttctgtttctgagtagcattccatggtatagatacatcactgtagatttttgcaaagattaaaagggaagacatttgtaaagtggtcagttcagcttctgacacacggcaagggcctggtaaattgccattaatgccgtaactattacaactactgtcaacaaaaccaagaaaaaggaaatttgcccctcactgagaaatgacttcctgtgagaaacagaagtcacagctcccgataggcccatcttaacatcttgagttcttggcttaaaaattccactgctttctagtttgagttycctgtacttacatattaagcacctctagaacctttcagaagacggttgtgctggggctcagagcagcccaccccaagatataccacaatggcatattgactgttttaagttagttatttaagaaacagccagcgggaaaaaaattgatgttgaaaaacactctgaactccttctttacccctgaaagtgggaaataaatcttccatgtcaaagtaccctacccaaaccaagaggagagaaagcaacctcaccaccagaggtagggaattcaaggctaagaaatttgtataaacaaatttt

SEQ ID NO: 2820 - DNA, 394 bp, Bovine  MMBT01268
attcatactgttagagaaggatgctaaatcacagaggtctgtcagagcatgctggcacagcatagaaattttccatgatcatcttttttctgacttcaaatttatattaatggtcatcattcctcagaaagcttccctaagaagtgctggccaccaagaatgaaagcaaaataagccatatattgcctcaagcaggaaatgactgctgttaaattgcatgaatgccaatttaagacatttcactcaagctgcctatgacaaggcatatcccatttcataaactaagcacatatgtcttawccagcttaccctgtatggacaggaaggtattagctatcctaccacaaagatagaaattcagaaatagaacaacttcatatagacaaaccatttc

SEQ ID NO: 2821 - DNA, 600 bp, Bovine  MMBT01818
gttggaggctcagcgtggattactcattttgactactcatatatagtatgattgtgtagaacagaattcttaatactaacttaatactactgacaatatattactatgagtaataataatactcatacttaataaactataaagctgtcatctattataaagtgtttgcgtatagttttcccyggagaatttcttattatagtttgtattcaacattagggtccagatggtccccctggtccagctggaactactgggcaaagaggaatcgtcggcatgccggggcagcgtggggagagrgggatgcccggccttccaggcccagcagtaagtagctgcactggtcaatacttcatctgattatgtgcaatatcatttgtgaagggagaatgtatctttatttttcttaataaatttaaaatcttttaaaggcactaatacagagtatcttataaaccttttgactttaaatgtcaaattcttaagtacatttgaaaaatatatttatttaaccctgggactagaaacttagacaaataaggatatggatttttggtgactctaaatctttcttcaaagattaaaaatatccgtggagct

SEQ ID NO: 2822 - DNA, 600 bp, Bovine  MMBT01821
gtgattcaagggataatacagaagtgtgaatgtgtaggagatgagtgtcaatgaaaagttcctaggacactggcctactgtcttgagtaaaacatgttcttagtaaaggtttattgaattaaattgaaggaacattttggtcacttagtgtgctaggcacttcacagaatgcttaaggtaataaaaccatttcttgctttcaagtagtttacaatctactacttgtaagccaagccagcaagaaaggctgaagtgtagcaactaacaatgccttgaggtataatgtaatagttggtgaawaaagattacaggtgaagtcctgaaagaaatcagggcaaagaataaattcagcttggaggacagaaagaaratggcttcttggaggaaatggttgayactttagatatcgaaaaggcttttgaaactgagtggagaaattaaatttaaaggaaaaagcaggagtcatagcaacaagatgtgaaagcaaatggcatttttgggggagtcagtacattgtagctataacttaatgaattttttcatgttaaagtaattacttaagtttctaaaaataagagaaattttatttttcaaccaaac

SEQ ID NO: 2823 - DNA, 600 bp, Bovine  MMBT02628
acacagcagtcagaacccccaccccttgctgggtgggtggagggcggggtgggcaggagcctgcgctcactctggttacacgctcactctgattacacgctcacgtgaggaagagacatatgagctctcttgatacaactttcattcaacatgagcacacaggtgaaatgacggcctgtataatgtggatgtagtgtaatgtatggtgattatcactaaagcacagtaaatagaatacggtatattacatatgatatgtaagtgtaatggaatacttaccataacagaccaccacgccgyactcctctccaaagcacacacgcacactcagtgcagcaaagcgctcttgccccgagaggtgtggactggtccaggctgagggccactcggatgcatgggatggatggaagccctgtgcctgtcccggagcgtggaggtcctcccctccccctcttccctgcccgcagtgttctgctgggagcttcggcaggcaggcaaggaaaggatctcgaagtctgcagcatgcagcccggagcagcgtggggcgatggagtcgggggtgggggggtcctccagagtacacgggggaccccaggctgc

SEQ ID NO: 2824 - DNA, 600 bp, Bovine  MMBT02695
aagctattttctattcttattataggtggtttattgatgatttttgttgacattacgaaaggaaaacaaaagygttgccttgcctttttgggaactattgcttttcccacttctttaagtacaagagactattccttctctctcttgcctggatttttctgggctttcttacttcatcttgacatgttattttctttgggtttatcaccggggctcctccccctgctaactattttatgggaggcaggcaaagtcagcacaaaggaaacagaagccagtggtctgtgagaggccttctgstgctggccacccacyggaggcactgaggctgagaccagtgacacttcctttgaaacagagctatgtgcctgctatccaaatcaaaggtgcttataaaaagaattccctcttttgggtctagggttttttcttcctcccagcttcaggtcctgctgtcttcctgctgtcacaaaggaaggacccacagtctcgttcctgctttgaatggcaaaaactttaaatggtagtacctgttcctgctcatcttgctaaagccaattttgtgtgtggctacaaaatctggcctggagctgttaccta

SEQ ID NO: 2825 - DNA, 600 bp, Bovine  MMBT02829
gtggtaaagaagccacctgccaatgcaggagacttaagagactcagggttcaatccctgagttggtaagttcccctggaggagtgcacaaccaaccccactctggtattactgctatggatggaggagcctggtgggctacagcccatagcgacacacagagttggacatgactraagcaayttagtaagcacatggaagatacagactaagggaaaatagcttcctatttatctcaaaatttccaatctaatactgaacttggctgaagatggaaacaaatttagaggtattgttagcstcttttcctctgtattcytagatggatcttatattcaaggagctaaaatagaaattaaaatagagatgtgataggtctttgatatttaattgcagattaaagtggagttctgaatctctgaactggttaattttcatttctgtactccaattttaactttaagtggaggaaaggtgacacataatatggcttgaactatgtgtyctcttctgggcttttctccagaaaatgaaaaacagcaaatagctcatctgatcttacattgtgatagagatgatacacactgccttgtagtctaaa

SEQ ID NO: 2826 - DNA, 600 bp, Bovine  MMBT03536
cttttcatctttttttttttttggtcaagattcacactacccaggtgctgtgaaacagcagaattaaccccagtttataaagggaaaacaaaggcaccatagtgagatctcaccagggccagagtgagaccacatttactttctgatttatgtccacagccagattctctttctggacgacattaatttgttcaatgatggaagtaagtgatgtgggatttattgtgggagaactagttctggctctgtaggtaaaaagttcacagggtggacaaggtagagaggacaatttcagtgtgwaacrggttaatgagaagaaagttaaaaccggagtacagactctattcagacagagatcacttttcagacatataaatagcaaaacaaggatagggaaaaataatagctatagagtttctcatttctaaaccaaggggcttttacaaaatcactttaaaagtaggagctttcttgaagacaacccttaagcatcttattctccccgcgttccataaaactcctgtaaggtggagactactaattttttactagggatgaaagtgagaagtaatgaagttaagaggctaagaatgaattctc

SEQ ID NO: 2827 - DNA, 600 bp, Bovine  MMBT04617
ctggtgggctgcagtccatggggtcgctaagagtgggacacgactgagagacttgagtttcacttttcactttcctgcattggagaaggaaatggcaccccactccagtgctcttgcctggagaatcccagggacgggggagcctggtgggctgccgtctrtggggtcgcacagagtcggacaygactgaagcgacttagcagcagcagcagcatagagaaagtagtccattgtgactttttattgtttgcagagagctcacataaaagccaactgcccagccttaccctaagaaaaagyttgacagtcttcaatttcctgtcacttcaagtctattttctatttaatgttaggctcgtgatctttgaaatcccttggatctgggtttctcttatagaggagaaactccccatgagtatttctgcatctttggtctagttagaagtttaaaccagcaacccagaagacttggctcttttattaacctgaaaatattcccaaagtagtatttatttgttttatgaatttgctgtgggaaatttataaaactgtatagacaatatggagttttttaaaaattctgaaaacctaaagaaaaag

SEQ ID NO: 2828 - DNA, 598 bp, Bovine  MMBT06172
  misc_feature (1)..(75): n is any nucleotide
nnnnnnnnnnnnnnnnnnnnnnnnnnnnnnnnnnnnnnnnnnnnnnnnnnnnnnnnnnnnnnnnnnnnnnnnnnnattcacataaaagcataacattggccacctcctgctaataatacacatgtttcacaaggggcaagtagcatattatccaaacagattaaaaattatcatccagatagataattcctagaggagtggggagcactttggcttctcattgtgtgaattatctggattattgctccaattccgttttttgccctgggagtaagggtttagactcagaagcctctaagrctacagcagctctacctttagacccagaaaccatggtaactgatagctacagcraaggcaactttcttagcagctgtgtattttcyagacctttacagctgagacatgaaacattgcttacaaccagccaatcccacagaatccacagtgagctcattgccctttattgatatgactggcaccattagcttctggatgaatgtgcacatcaggcaacattgtagaaagaagagattaattgtgtgctgttcttttttgctatcatcattatgtggcaaactatggtagctctctctat

SEQ ID NO: 2829 - DNA, 600 bp, Bovine  MMBT07620
cccttttttttgtaattatctttattaccaccttgcttcctgttagttccctgaccaggaattgaaccgggtccccggcagtgaaagtgcaaagtcctaaccactggaccaccagagaattccctggtatcttaaagttccagactcaacttactttccttctcagtgacagtgtcactgagatagtgctttcttctccaagaactgagcaccatgtggagcctctgcagcttttggaaaatgactcctcatggtagtgggtctatgagcacacagtaaagacaatgatcagaatttcaratattgttctccatatcaagaacttagcatcaaataaattacacatgcgacaatgttatgcacacctctcacctctttgttataacctccgttaatgatagagtggaattacacttggcagagaaaaagccctgggtgtgccagaagattaataagtacataatacaactccattagaaatytgacttcaaaataatgtgcttgctctaatgagcattactagttgcttatactttatgagaacagggaagggggtggtgatttagatgattgcctttggattcaattttcctatcataa

SEQ ID NO: 2830 - DNA, 600 bp, Bovine  MMBT08143
atatttgagccatagcaatggccctgagtcatcaagaaaatatgaactcacatcaagaatattctgtttagtaaggaaaataagtttgcaatacatttgagaaatattctcatcccaataactacatatccacgtgcataatatttaaattattatgttttagttaccggaaamaattcatgtatagagagcattttgccattgaaaatgctgactgtaaagatctttgatttctataaggttatttcttctgagggtgggtgctgggatgtcccttgattatacactcacttgtaagaygttaattccttggtctaagatgaaatgtccctgagtctccctaggtyatgtgagtggggctgaactggaataacaggtaaatagaaggggagtgaacaaaacagggaaaaaaatatacagtggaaattttagaatgtatgttatggaaagagaacgaaacagcttatctagttgctaattgcttactcagtttttccattcttccctgcctcttttctgcttcctttcctcatttgagtgatcatgttcctttccaaaatcaccaggaytccatagacaattgctctggtgaacggataa

SEQ ID NO: 2831 - DNA, 600 bp, Bovine  MMBT08575
taaatctggctctccccatgtgagctagtataactttctaaaatcaaaaatgaaccaaaaataagagtaaacagccagggtgagaaggttgacattgtggggtcacagcttcgcagctgcacaccccgtggcccccaccctcatccccggcacagccagtgacagagccgctgcagacgcgcccagcagccaggcctgcgcccacgccccagggctcacgctttccccacaaagctgacatggaagaggcttcaggacagttgaggatctaagactagcgtattgtgtcatctcaaatayagaaaaaagtggcactaaaagagagctgagacacaagaagtcagagagcaatgaaataatttcctaatgtggtgaaggagagaacggtcattttccaaagggtcaacaaacgtagagaacatgagacactccaaacaggaagggccctttgagatcacacatcactccagcctccagtgttattgtatctgaggagtacctatagatggagtttaacgggtcattaggaaatgcagataataagctcagaggtcatgcccactggcccactggctctgacatcagtggagaattgaggtg

SEQ ID NO: 2832 - DNA, 600 bp, Bovine  MMBT08591
acagtccctcgtgtagctgtgtgttttataaagagtcatgacgtgtgcaagattggaaagtttggggttcttctcttccaaacaaaccttttaygagaagaaagtcaactagtgatacaatagcctgatgaatraggaagaaatgttagcaattttgctctaagccccagcagcctggaaaactgatcgatacatttttgggggcagcygcagaatacttagccatttaattttcaccaattttttcccacttattttctcaataatgaaatgaccatgtgaatcagccrcccagaaacrtgaattactagtgatatcagttagtaycttcaggtttatgaaacgttatcaccccgagcctggtaaccgctgttcaacatcgggtcttggatctgcctgagggtgaagccttaaggcctacctgagcgattctctcagctacatccttacagaactggttggggttttcaaaatgctgtatcagctggggcagaagacacaagacattcagtggaaaccctggattagagaagatacaaacggagatacgtgaatatggtgcatttgagccattaacagcatgaaggcctattacagatt

SEQ ID NO: 2833 - DNA, 600 bp, Bovine  MMBT08931
ccaagacctgaaggactgaactttcaggatctcaagaaccaactccaacacatggtccgtagcctcaatcaagctagccgtggattttctaagcaacagggagcacatctattccaccgtggatgacgatcattttaaatccacagatgcagaataactggatctaattgggtatctgagatattttccagttggaccttttttttgcagcctcttgtctccagctgtgcatacaattggcgagttgacttctaggaagtagatttcatctaaaaatctcaactgacatccttttgaaayttactactactcttctgtgtttttgatggacttccctggtagttcagacggtaaagcgtctgcctacaatacgggagacccaggttcgatccctgggtcaggaagatcccctggagaaggaaatggcaacccactccagtattcatgcctggaaaatcccacggaccgaggagcctggtgggctacaatccatggggtcgcaaagagtcagacatgactgagcgacttctgtgtgtgtctgtgttaaaaagttttttaaaaaataaagtaaagctagcctatgttgtttgaagtcaggtt

SEQ ID NO: 2834 - DNA, 598 bp, Bovine  MMBT09040
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagctcttcacacatttttaatgatgttactatacttctaaagagtgaacttaaaaatacaatgtacaccctgtacttggtctttgagaaaaggaataatatacacaagtgcaaaacttttaaataagaacagaaatttgtagcttggatgttttgaacatctggatrcttgatgtacatcaaacagctgaaaggattaactgagactttttgtttgtgaatatgttagttttggagtcatgtggacacaactaatgattcatttgagaggaacacattagctattccaagtttattaagaagctatatctttcctctcacccgtggagtcaggccctgttattttataagccctattcaaamgcatctgcaaacagatctctatacacagcaagcatcaagcatgctgaatgcaaagactactacattcagcagaataagttctcatttattttgcttatgttta

SEQ ID NO: 2835 - DNA, 601 bp, Bovine  MMBT09052
  misc_feature (1)..(1): n is any nucleotide
ntggatggaacatatgagttctcagagcatttacatcaacgttaataataatgacatagttgagtactgagtgcttacatatgctgtcaacttccatggctaaacttcctttggcctcattttcagagataacctagggctagggggattgatttgagtcttctgtgtgtttctcaagttagtcctgacagtctgaactgatgccatttttgtcttccagattactattaaaataagtgtcttgggacatggcacatgtgtctgtgtktttgtttttttttttttaatgaaatctaaaackggcgaacattattttgatttgacttyttttttttcctacaaaaccctaaatgggactcatgagaagtgtcaggtgaactyggcccaagttttcaggagaacgcactccttccccaaggatataaagacaagatttatgactccaggtgaaaagtataagaaagctggtgactgtagaacactttagctttgggtttctggttcattgggagtctaaaatgaaacttggtgattgcaggggcaagtctctataaataagcctttgcacaatctgtgmaaaatggacttcagtctatggcag

SEQ ID NO: 2836 - DNA, 600 bp, Bovine  MMBT09488
tttatttaaggaaggacactgcatctgttttatggataatcaagtgctactgtgctgtgcttaggccctcagtcatgttcaactcttgccatgtcctcctccagggaatgttcctaaacaagggatcaaatctgggtcttctgcattgaggaggattctttaccatctgagccaccaaggaagccttaatcatgtgatacagagagtccaaaagcttgatgacattgttttaagttacacaaaaaggtatccaaagacgcatacccgttcttgtctcaattttgatcctaaacaaaaatycaatttcaaaatcagttaggaattattttaatctaggaaattgtggaattgttgcaaatgtgcaacccttgtttctgagattcaggttcctgtaggcccttttctaatcctctcactacaggtccaacccataaatgccattggctgcagagtctatgagccctaaggttatcactgggataacactgcaatttggtggattctgctaataatagttttgttgtaaatgtgccttgaccagagggcaagaggtggaccgtgcagagacaagttgaaataacagggctgaaacttctgtcc

SEQ ID NO: 2837 - DNA, 600 bp, Bovine  MMBT10249
gtggggtgccataccctcctccaagggatcttcccaacccagtgatcgaacccttgtgtcctgcattggcaggcagattcctttacccctgtgccacctaggaagcccctttttatttattattatcaccgttgtcacatcagctctccatggcacacattctcaccagcacggggttagcggctggggcagcatcttgcctttggtcccattgctccctcgctctctcttctccctcccaccctcctacaaggcaccctgctcgcattcagtacctggtctgcctccttggaactgctstcctctgtgtctctggaccccttgactgaaggagccartgcccacctgccagtccctagaagcctggatagggttctcgccacctcttggttccgagggcatgaagtccggccagaagccatgatcttctctcccgagggcctcccagggcctggccacactggccgggagacgctggacacccagggcagcctgatcwtcagaaacgtgacgactctagatgcgggcagctacatggtggtactggaaaccagcaggggacgcaggagtgcgacggagcagataccgatcaagggtaat

SEQ ID NO: 2838 - DNA, 600 bp, Bovine  MMBT11380
taaagttattttaaagttgtaattaataaacttggttttcctatagattagaatatacctaaaaataatatacttgtctgaagtaaatattaggtagaaacatctaccctaagatattaaatagaaatcttcaagtagaaagttgtagtttgaaataagtaaaaatatgctaaaaagattaataacgacataagcggcagaaataatatgtagccttttgtgactacttttgaagtccatcattacaagtaattctagtgattttcttttagggtgaatggttccagtatttctgacccmaaatttcaccttttcatttttcattgctagcctttaagtatttattaaactacctgattagtggacattataacagatacttggtaatttattgcagctagcagtatgtagtggttatcttgaaagaaatgaactttgaggataaacatttaggaagatttgcagaaaattattttctccccaaacacaaattaattgtttgaattatggttgctgtatctagaaatctgagtgatcacttttcttattttttaagatatcttttctaagttttaagttatggatttcaaagagaaagaa

SEQ ID NO: 2839 - DNA, 600 bp, Bovine  MMBT11699
tgcctcacacatatggaaacgcttttattcaaagctcaaagttaaaacaattcagacaaaatttctgcatgtattccagccytactcagctaatgggactctatcagggtggaaaaacacatacagatgcccagcagacacatgaaaagatgctcagcatcattaatcatcagggaaatgcaaaacacaaagtcaatgagatcccacactatagttagaaagacaataaataacaagcattagcagtgctgtagagaaaagggtactcttgggccttggtgctggtattgtaaattggtrcatcatttatgcaaaacagtatgaaagaktctcagaaattaaaaaacaaaaaacctattatgtgagccaggtttcgcacttctggccatttactagcagaacagaaaaacactaatttgagaagatataggcactcttaatattcactgtagcattatttccaatagccaagatatggaagcaacctaaatatccattaatagatgaaaaattagaggatatgtgtacaaggcgcacacacacacacacatacacacaggaatattagccataaataaagaagtctagccatttgcaaca

SEQ ID NO: 2840 - DNA, 598 bp, Bovine  MMBT12139
  misc_feature (1)..(190): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaaggagaaaagacacgttattttgaaggctcactctactttctatttaagcttttctaggtgcagattccgctcctctgacagcaccacrgcactcattatgtacygcaagtcatcaagctgaggttaggagagacaaagcctgttccctgaagcaatttctttcagcagtgctgctggagcatagttcagaattatctttaatatgaatgagaagctagagccacttgaataggcagatggagttttgttttttccccctagaccaggaacttgtctgcttctttttyccaagtacattcatcatcttggttgctattttgtctaaccttgttctgccattctttccaattactcagtttagtttattcattccaggttagctaattggctttgcttagccct

SEQ ID NO: 2841 - DNA, 600 bp, Bovine  MMBT12161
aatgccttcaatraaaaggcctcttgacagtttctttcatttagtatttaactagtcaataatcataatagccataatattaatcttcatagactacatcatgccctcatcatcagggttaggcaaattaaccctgaattctcagaagctttaaacaaagtttacttcttgctcacacaatgttctctgtagatccaaaagtcctctactaaatggtgactcaggcatccagtctagtatcaccttgtgatatcatcaactcaacacrtgggtctctacaatccatatggcaaagtgctytggctcataaatgacacctgtcacctccacttataatctactatttagaataaataagcrggcccaatgtaaatgccaggaaggcaagaaaaagcagccttggcctggctctaaaaaggaaaataaaacaggaccaggtaaccatgtaccactgtctctgtcaccaagaggcacttattctatgcctaattaactaccatgcatctgaagtcttcatatgtattagtatctttaatatccacaaccacttctagataggtattattatcattatgccattttacaaacaaggaaattgag

SEQ ID NO: 2842 - DNA, 598 bp, Bovine  MMBT12210
  misc_feature (1)..(119): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttaaaaccagcaagcaaactttgagtaaaatttccaaaacagcagaaattatttaaaaaataataaagataattattttctcctgattaaacttctaaacattcagagycaataaaagtttatacttaccaaatgtgtcatagttttcaaacacgttgttacccacattaatttccayagctcctcaatattatccgggagaggtgtgtaaacataatatgccccaaggacccccacgatcagaagcaaaatcgtctttcttcccatcatgttttccaactgcacattctacttggcagcaaagcaaatacacttctgaaatatttgaatgttgaaatttcataacagtttttggatttatcaaaaagtgttatcttacttcttagacacaaattccattggtccarttgtcattctgcaagctgctgggaaataattaactcagaaaaagtacaaagaactctgtgaaatccata

SEQ ID NO: 2843 - DNA, 600 bp, Bovine  MMBT12681
ggggcgctgggtctcgctctggaaggtacccgggctcccctttctggcctgcggaggtgacagccctcttgagaggcagcccctcggggcacccactgcagtctctcctcgtccgggatatcgactcacccccggcctcagggartggcagaaccccgaactcytcaaccgaaccgctccccgwctcacgctctcacttcagtattgatgaacccggaagtaaatagagaatgctggggaaagacggcaccggaagctgtcatctgacgcacgccgggaaatgtagttctaacatggtcratgtgtggtgttctgctaaaaagaccagacgcggaaggatttaaggcaagatggagaaaccgagatgggaaaagaaactgcacggttgcttgggtcttgacctcggagtgcccgtctttcatcacttgggcataagttgcctcactggggtccttggtcccgcccctcaktggggagcgcgccctcattaaagatggcgcctgggaggcttcgacctggaacggcgctgattggatgagtctcggaggacttccgggagttttccatccgactgtggaactgtggagaggagtttgcacg

SEQ ID NO: 2844 - DNA, 600 bp, Bovine  MMBT13393
tttctttctcaatttaggaarattttggctacaagtatgagaaacaccttctctaactgccttaaaggttatagaaatgaatttttaaatatactaagtcctgtatcagagcaggattcagctatgtcaattccactgctcagtagcattattagaggtcagtttccttgttctgccagtaacagcattggcttaatcctcaggctggttgcacttatcaaaagatgacttcttataataactcagtctatctgtttcttctttcacatcaatcagccaaatataagaaatgaaaaactktcttttttttcataattatagagtaaatgatcttcccttcagccctcttggaccaagttaaatgcccagtactagattaaacacggtttttagagtgtcacctctccctgccaatcagccctacctttggaactctgaatgagagtatcttcctctaggcacaaaggctacctagagggctttgtttaggaaagaaaaatggagctgtgatactacctagactattcacacctaatacacatccctttcttcctctaaaaatgacctgtctcatcaaagagccttcatgatccagtgagc

SEQ ID NO: 2845 - DNA, 600 bp, Bovine  MMBT13941
cagctcccggcagggaggacaagccattggagggatgaggaggaaaggtcacaggccacagggtcaggatggagagcccgcgggtgagatgaacaaaaaaccatgccagaggccagttagcagggggagaaacagaaaacaaaaacgcatgaaaatacatcgtgtaaacatgacggcraaaaagtaaggtttcacgcatgatactaaaacaaagaacattggtgcaaattaaacatgtgtggatcgcaccgcacggcagattccaggctgtgctgaccaggtgtcccgcccccctgctcrggaccagctgctggggccctgaggggcacagctccagaaaaggccagttctaactccaggcccagccccagccgttgggaccctgagagaacagcctctgactcaggtcacactgacttctggaaaatgccgtattcccaccagggagagccaggaaagctggacgggaaggggggcgggacggggggcagccgttcaaatggaatgcaaaacaagaacacgaggcctagcacggctcttctcagatttggcgaaagcagctgaggtgaagagcgtgtccccggttggcagtgggctggg

SEQ ID NO: 2846 - DNA, 494 bp, Bovine  MMBT14110
aacttccatccatcattctccacacactatggtgtgcacaccagccaagagaactttaaaataagaaataaaactcagtgaactcacattcaattaatattagtcatattattaatccttgctggtgcagggcttatcgggagataattgaccttgtcagtgtttcaagcctgctgcattgctgtaggacctctcactcctctcacgcttaattagaatgcaataaaaccaaaaagattttctttttcctgcttaaccgtaaagtgtccatttttctcctcctttcttctatccaagaaygggaaagagaaaatgtggatatcgtaggtatataatcttctcaattaataaagtgaaagcaccgtcattgctccccagggcttgacaaatgcacctgtcggcagatccagacgactgatgttccttacgtgcccagacgcttccttcttttttctgtgttcaaagaaaacgtgattttaattggactgtgaaag

SEQ ID NO: 2847 - DNA, 600 bp, Bovine  MMBT14652
catcactgaatcagaaacactgaagcaatcggtgtcacacacatggccagttttctatacaacagtccggataacctttctaaaacatcattctatatatgctgttcccttgctccaaaaaacctttartagctctgaataatgcagtcagcagtatcaaatctaaactacacaaaataacattcaaattcactaaatgctaattaccattaaaggctaacactccatgcaactactttgtccgttctactggcctctgtgccctcctcccgttacaagggtaatggtccatgctgactrcccacctctgcccccaggcccgccacagaccacacctgctgaaatcacagcagctggaggcaaggtaagactgggctcccttcaccagccccaccgcccccacaactacaacccacacgaacatctttattagactggtcttcagtattcattagcaatattttagtatccctactatggttaattatctttatgctttgctctcctcaaacagactgtaaagccccttattggaagacccaacaagaagacattcacccaatcctccaattcatggagcacttacttagggcaagcaca

SEQ ID NO: 2848 - DNA, 600 bp, Bovine  MMBT15692
ctgtggttcgtgtgtctctggataccatcaacagcggctgcagctagctcatttcagccctgacaccctcccccgcagaatcaccatggagcgcaaacagcccgggacacaggaggcgggaagccgcatttatccgagctctatgtgaccagctgcgtgagaagtttgcctcttctcgggcaggtcaccctggattctcattttttcctctgtaaattgagagacggaaacgagttcgatccaggagacccgtggattactcacagatgtggtctattaactcactcaagagggacgcaygtgattttttttttttaatgttttaaattagttgccaacatttaaaaatttggagaaattgcttgaaaatccagatttcggttagctttgaaaaaattagaaaatttgacaccagcacacaggacagccgtaaaaccgggcaccctattagatgctacagaccatgctgctccctgttgccttggcaatacagaggccagtgtcagttttccctccatacgtgtcccagctcgttcagttatatccccttgccaggttgctaagctggatgaggtccccaggcccagttgtctttaaagc

SEQ ID NO: 2849 - DNA, 522 bp, Bovine  MMBT16093
ctctgaccccactttcctctctgctcccacaacctaaagaatgttagatctagaaggaagctgggagacagacttttaaccaccattttacagaagaaacagaggcccagagggaaagtgaatttctcarggtccctcaagtgagagccaggactagtcctctaaagtttcagggtgagtttttggaggcctttctaggacaacatgaggaaaataaaatggaaggaacaggcaaaaagcaagggaactagaggggaggctggtgcaatcatccaggctttgaaatgaagaggagggaaygggcaaggctcaagtcaatgagaggtatggaagatcctgtgatgggcagacccagaacccagaagactgggtcccagagaggggtctgtccccactttacacagccctgcccttcagggaactgggccatcccagaaggggcagcagggtcatgctgctaggatcttaccccggcacagagcttccagggccagtgcccacagtgatcagccccatacctcc

SEQ ID NO: 2850 - DNA, 600 bp, Bovine  MMBT16463
acctcacatcttaacctaaaccttcacatttctttctgccaaatttgacttagggcaaagcaataaaaaactgccagcgttcacttaaatggacagagcgatgtaataagttattcagaagagcagatcactcaaagatcacctctatttgggtttataataacaattttcagctgatttactttcttaattatatttctcttaggttattaaatttgcaactcttcagaatatactaactgggtggcagaggcctggaaaaaaatcagctcttctgaaggagccaactcaggtcacatratacactggggggaatttccaaagagaataayccaaaacagagtgcatcaagtgtgtgctccagccttctagaactgctttcccttttggtgacagtctaaggaaatatcacggggctttctcctttaggttgggcctctaaagaaaatcctgattcacaaaaattgtcatgcagtgttattcaaaatrgtaaaaaattggagacaacttaatatccaacagtaaaggactagttaaacaaattataatacatcawtaagatgggttcttgtactattaaaatagcatttatggagaatt

SEQ ID NO: 2851 - DNA, 600 bp, Bovine  MMBT16635
tggtctggatataatgcaatattatgaacaattataaatagggtgcttctatatattactttttttcagtcagtgctgatgaacttttgactccatgataaatttgcagaaacataagtcttctgcctggtgtgcttactattaaataaacaacatatactgtaaatgacaagaggaaatttatctccttggtctaggcaattgatttggcatttgattatccttcacctatttgttctgttctacaattcaataatttaatttggccaaaggggaaaattgagtcctgaacaaaagtcwgtttaagctggagtgagctaaggagtgggtcttttctaaaaacattatttttcattacagcttattgcaagatatcaaatatagttccctgtgcttatatagtaggaccttattgtttatctgttttatacacatagcttgcatctgccaatcccagactcccgatctgtccttcgcctcccctccccattgatagccatagtttgttttcaatgtctgtcagtctctttctgctttgtaaatacattcatttgtttctttattagattccacatgtaagtgatattatatggtatttga

SEQ ID NO: 2852 - DNA, 600 bp, Bovine  MMBT16658
cagtcccaaaggcgactcccctagaaatgggatcagmccgccctttcctgattccccctctatcaaagcygggtcttagggaccctgatgcaactcagtttctcccaggatttcctcttcaggaattccccaactcggccacaaacccaagagctttccaactatcctgccataattttctctggccccaagttccagctttaggggcactttgctttcagcagagttgatgtgatcagctgatgagaacaatggtgtgaccgggtcactagatgataacagtggctttcaggcttcctkaccaatacctgaccttggttcccagtacagctgtgcctgcagccygctccctcactggatcgccctatgggagtcgggagagacccaccctaaagtcagctggtaatttcagtctaagggaatccaagttattcataaaccaggtcattaaaatgaagatattgggggcaggtgaccgacgtggagttgcagtgatgaaacctgacaaagtcagacaagccagccccctgccgggtggaccagacacagtacctgaaccaaactcagagctcctttcactctttcctgagagactgaaac

SEQ ID NO: 2853 - DNA, 600 bp, Bovine  MMBT16841
tgcctctgtgtgtgatgcgccggtccagaggcctctccagagactggaagtctgtacctctgctaggtagaggaggagcgttctcatcctgcttgctggggaggggttgatctgggtatctgcttcttaaacagttactcgaccatcctgccttgttttttttccagtcttcgttcgcacttccagaagtccctgcacctaaaaccctgtgggcatggttggtgtaaatggaatgccctctgtgctttctcttgctaccagtttagtatttggctccagcttctaaattttgttctgtcrtctctttctctccctatctttgtaaaattccccttcctgtgattttaacataatttttgaaaaaggtagagctcaatatgttgattccacaatctcagtcagaagtccactcggccctttttccccttggtcatgggtgagttgggtcacttgttggagggtgtcagatgtatattttgtttacagagaaattaattttctttaagtaaccataggagaacttaacccttcacgtttttgtatgtaaaagtcagagtcatgactagaaaacggtcgtttttaccttatgaggtttttctg

SEQ ID NO: 2854 - DNA, 598 bp, Bovine  MMBT16928
  misc_feature (1)..(78): n is any nucleotide
nnnnnnnnnnnnnnnnnnnnnnnnnnnnnnnnnnnnnnnnnnnnnnnnnnnnnnnnnnnnnnnnnnnnnnnnnnnnnngaagtgctgaaactccccagtggtccgtgtataccaaacaacagaaacacctggaaaggctgctttcttggttttaaattcagttaagatttctatcaggtgctaggcatgttaattatgtggtatgtcacttcattttcataacaagctgtgaggtattaagttggtaacagagagaaggggctggagctgaaaccacaaagggtctaaatgtgcctgccktaagtgaattattcatgggagcagtaagtcaagagaggtggcaatcagacttcagaggctgagtgagggatgcaagaaaaggaggcagcttaggaaagaagctaacacgctttgagtattttgagtcttgagatgcctttgaaacatccaaaaaacatgaggagctcagaagtctgaattgaagatggactttggagtcatcagtatatgaacaatagtaaaagcagaggataagaatggccacattcggggagagcatggacttcagcaaatacaaggagcaagactcccctggtgg

SEQ ID NO: 2855 - DNA, 598 bp, Bovine  MMBT17239
  misc_feature (1)..(185): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagtgcagagagtggtaacttgctccaagtttgcactggagaagagagactgggactaactaccaaaagtgtgatggactcaggaggaagagggggagatttataaaacatctygtctctgcctgtacaacctcgagaaagttagtcagttctaatcagtgtttattgaacatccatgatgcaccagaaatctaccagacttcttaacggagggtccctgacatccccgtctataaaatgagggtgctggctacactgaattccttggctctttgtgaggcattagtgaaacagcatatacagaagcacttttttaaactaaaaaagtggttttaaagtatgcatcattgttgttaagtcttctgctctgggaattgattaagcagaaaaagatgacttccagatggtgcaa

SEQ ID NO: 2856 - DNA, 600 bp, Bovine  MMBT17440
ctaacacacacaacacttggaaatggtactgactcagtattcacctgggctatgcttagaaataatctagtctagtagttcttgtcctctttttggtcagggacccttttgagaatctagtagagaatctaaacagaggagatcagtgaatgacttcaaaaggttcatggacctaggggctctgtgaaatctattttcaaaaatctataattcagatcaaaacctcttttttgattaagaaaaatctatggcttataaaagataagcaatttaatgtcaaacaagtagttaaaatggaaragcaatgttagcctaattccmaaaacctacatatttccttttcagccacattgtctctctgagaaggaacaaagacattgtctctcataattctcttatttttctcctcaagttttactyaaatatagaaatacartagaatagttagtgaagagggaaaatggaatttaataactgatttccacttcttggagatttacaaagaacctcaacatattaaaggttctgaggagtccagctgcaagttaagacttagactgaaatccctgaatgtcatttctactatattctatcagtcaa

SEQ ID NO: 2857 - DNA, 600 bp, Bovine  MMBT17698
ttagaataatactatacttcagttttctgaaagtggtttgggaagatccctgtaatgcttcccaggtattaagcctgctccaatgtcagttctctgattgtttcacaccagttagaaatttcaagggcttataatttcagactgtatcagcattctccttcctgttttgaatcaatggccattaactcattaatttatcagctttgatcacatttttgcctgtgctcttaagactagcataaaactcagaaaacaataaaaattttagatcattttaactcatttctgaatctatttgtrtcctccagcttagcccacattctgatcttgaacatggttaagattcacagtgacctttccccatgacataagtagtgggtcaactcttgacattgattcctcctgatcttcccacaacctagtggtgacaatatattttatttcaacttacacaaataaatcctaaaataactaccttgtcaggctgggtgaaaaaacgagctggcagtaccgggtctttaggagattccaaactatatgtggtgctttttgacatgatgatattcatggcaacatcacatacagtatacagtttctgca

SEQ ID NO: 2858 - DNA, 600 bp, Bovine  MMBT18048
agtccatggaattctccaggccagaacactggagtgggtagcctttcccttctccaggggatctttccaacccagggatcgaacccaggtctcccgcattgcaggcagattctttaccagctgagccacaagggaagcccaatcaaggatgcagggatgatttttaaaaagacatcacacagagaacaggctcgtggctgccaagggcaagggggcgtcagggagggatgcagtgagagtttgggcttagcagatgcaaactatgatatctagagcaaataaacaaagttctactgtacrgagcagagaaccatacgaaataccctgtgatgagctacagtggaaaagaagatgaggaagaagcatcttattcttgatccaggaagatcccacatgaagcagagcaacaaagcctgtgtgccccaactactgagcctgtgctctagagtcggggagctgcagctacagaagccatgccctgcaagtgaagagtgtccccccaccccactgcccctaggaaaaaagcccctgaaagcaacgaagacccagcacagccaaaaacaaaataaattaaaaaaaaaaattttttttttaaaagac

SEQ ID NO: 2859 - DNA, 600 bp, Bovine  MMBT18167
cagacaagcaacacggtggcctcttctcctatactaaatgggtcaaggtcgttaatactgactctaaagagacacccatatggaaattaagactcgtctaaaaggcatcagagagcatgtgagaatgatgcttgatctttggtatatcacctggacaatcagagaggacaaaaccttcttttggcctgattatgcctgatgacctgagcaaagacacctctgtggctgtatcagtgaggttgctccagaagacgacaccagtggtgacagatccyggagctagaagagacttagcccacrctccccattttacagataaggagtacagacagatggatttaattgtccgtgtttacacaggagagttggagtaggaaatggcaaccgactccagtattcttgcctggagaattctatggtcagaggagtctggtgggctacagtgcatagggggttactgagagttggagtaggaaatggcaaccgactccagtattcttgcctggaaaattctatggtcagaggagtctggtgggctacagtgcatgggggttaccgagagttggacatgactgagcatgcatccacccacacatacaa

SEQ ID NO: 2860 - DNA, 600 bp, Bovine  MMBT18567
ctcacaggacagagttttcacacttacatgtcagaagctaattgcttaaccatgaccttgcattatagaaagaacagtattcaaactctggtcctataacttattgatgacataaatttgggcaaactcttggacttgtgttttctcatttataaggtgggatgccatcacctcgtcaggaagtgtattttagttgctgttttgttttgagcttaagcggtgttcgttcctttccttccccgtgttgttcgctcctttaggatgggcatctcatactgttaggtatctgcctcagccttrctcaggcacccacaggcttaattaatcctgggaactaaaaggactgtttctgtgcagattatgtatatggatatatctctgtggatgtgtgtatgtataaattgcccagaacttgtagtgattcataggagatacacaataaagggtagtctacctttctttcatccacctctttgcttcatggaaacgaactctgtgctagatggcaatctgaaatgtgtcattttcttgtttttaattttgggggcaaaattacattcttttgggaaaattatgttcttatttttcgtatgaacattt

SEQ ID NO: 2861 - DNA, 591 bp, Bovine  MMBT18624
tccttctgttgctttctttgttgatgaaatttccttcataagcttgggaatttccctgtcaaattattagaaagttctttaaatttctaaagtttaattcacaaaagtatcttaagattaaaaaatgtactattagtactctgtaattagtatttaaatatggaacaaaaattaaacaggttcacatactctaatacaactgcaatatggcgatgccgaattttgacccagaggtcatcatcttcttcaaggattgcctccttttccttcccatctgtcttatatctacaagagaagtaygaaacttttggattatttygtgccagataaagtaaaagaaaagtttttataaataacaattttaagacacagctcaagaaactgaagatttttaggaggataatgaatacctatccaaaactaaggcatattgctatccatacaacaaaaatcaagygccatgcccaccatgacctttttactttcaatgttattttttgctgtcattattacagacttttatctcagtatcttagaaacaaaaattcagtgttccacagtcaactttaacaagaggaatttattaacaat

SEQ ID NO: 2862 - DNA, 572 bp, Bovine  MMBT18625
gttgatgaaatttccttcataagcttgggaatttccctgtcaaattattagaaagttctttaaatttctaaagtttaattcacaaaagtatcttaagattaaaaaatgtactattagtactctgtaattagtatttaaatatggaacaaaaattaaacaggttcacatactctaatacaactgcaatatggcgatgccgaattttgacccagaggtcatcatcttcttcaaggattgcctccttttccttcccatctgtcttatatctacaagagaagtaygaaacttttggattatttygtgccagataaagtaaaagaaaagtttttataaataacaattttaagacacagctcaagaaactgaagatttttaggaggataatgaatacctatccaaaactaaggcatattgctatccatacaacaaaaatcaagygccatgcccaccatgacctttttactttcaatgttattttttgctgtcattattacagacttttatctcagtatcttagaaacaaaaattcagtgttccacagtcaactttaacaagaggaatttattaacaat

SEQ ID NO: 2863 - DNA, 600 bp, Bovine  MMBT19400
aggagctacaggagacagaggttccatcctcagaaagattccctggagaaagaaatggcaacccactccagtattcttgcctggagaatcccatgaacctggtgggctgcagttcatagggttgcaaaggatcggacatgactgaagcaacttagcatgcaagtatgttaataataatattaatgtaaatattaaatctgacatgagyatcatcctgaagtagttcaccagagcatattaagatcatggatgttgagagctgargtgaagtgtaacctgkgttaaattgttctgtaagcstcaatttcttcacccataaaatatgttaagaatagctactatcttacagcrttgagaaaattaaatggtatcataaagccatacactcagttcagtggtgatattaagctctcaaagtrtttagttattattaatattaccatcaataattatttctgccaattctctctttgactgaaaaactatcaggcatatcctctaaaaggagatggacagaaatcatctgttggaagagttaacaatagaaaacctataattgttggcagggactctattttaatctggctcctgaactcttgt

SEQ ID NO: 2864 - DNA, 600 bp, Bovine  MMBT19583
atgcaggagactgaggttcagtccctgggtcgggaagatcccttgggaagacactggctactcactccagtatccttgcctggagaattctgatgacagaggatcctggtgggttaaagtccatggggtcacaaaagakttggatataactaagcgacttcctgctctgcctctaktttatattatgaactatttataataatcctatgaacacagataatattattttctttcaattttcaaagaacaaaatttgaacttacagagtaagtaacttgcctagarctaagcagcttgcaygtggtggagctgagattcagagtacagtggctcaaagtgactgtaacatgtaatcctgaaaagtttgcaagtgccttggggtgtgaagctgagatactttctaataatgcgttgcttggcaattactctggcacccaaagtgttttccacaatacattcttatttactttactgttatataaacactatatgttatatcagttttkatattttcctttggtatttttggaaaatataagaagcaaattataagataaggtcgtttttctccatatttatctctgctatggtatgatcatt

SEQ ID NO: 2865 - DNA, 600 bp, Bovine  MMBT20259
acagcagttctcctttctgtgtgaactctgtgcctcctctgtgtgcataaatggccttgcctctcagtctgcaccagctgtgtcgggtcctgagccagggcttcctcagcctccgtgtttcctgagcctctctgggaggtgctccatccctttacagtccgtgacttctctgaagagtcttcttcacatttgggtccactggacccagttcaaagcctggtacccagtaggtactcaataaatttcagctctgtctccgtctctcctggcasacgcacgcagacacacatacaaacacamgttcatttactctataaatatgtaagttaatgaaagttcccttatacttgccttgggggctttagtttctgcttccaggtgagagaaataaaaaatgtgaactgctttacatttcttgggtataagtactatataaatttgggattattattattatggtagattattgcaatactttgctttacgactttcattttaattaggggaggttgacttcagacggcttaatatctggtctttggtcctgaagggagcaatatgacattggcaggggccaggcctggatgacctaagagtaat

SEQ ID NO: 2866 - DNA, 600 bp, Bovine  MMBT20441
tctgagtgcgccttgactcccgacgagatcccttaggtgtagctgatcgctcacagttgaactgcgagagtttgccgctagaggacacagcacctttgcaactcgtttgcctgggaggacaggaagctcgcacttttcagaaatgccgctctcctgagaaagctatggatctgcgcctccacgctacgcccagagcaaacagcgacctgactgagtggaccgaacgcactctggaagcgcaagggactctactgcgaagattcgcttgaaaaccgacgcggagkgggagagggtgcgcgsaacctcattacacaaacccggatcccgggattggggtggttgatggtgtgggtagggggaccataaagcttgtgaaatccccacctctggtttttgtcgactgtggcacctccaccccagggctctggattggtgtccttggacgagaagggcaggggtgaagggcgattgggcataaaaatatggaactatggaacgggactgttgtaaaagccaagtaagatgtccaaagaagaaaggagggtgggcggaaaattttgtaggatgaaacttacttcttgtttcagctgttttatgcag

SEQ ID NO: 2867 - DNA, 600 bp, Bovine  MMBT21026
taccactgagccacctgggaagctctgaatgggattagtgcccctttaaaagaggtccataagagcccttgccacttaagctatgtgaagtttcagagagaagatggcaatctgtggaccaggaggcaggccctcaccagacatggaatctgaacacctcttgatcatagagttcccagcctccagaaccgtgagaaataaatttctgttgtttataagccaccaatctatcattttctgttagagtagcccacrtggacgaagacagaacattttcttaaaaaaaaaaaaaagtatacrtcagaatatacctaaagcaaacacaaacatagcaaaacgtttattattgtatcctttaaacagtactgacttgatattcaaagcacagccataaatgcatgcaaagtagagcakcaagtattaaggtgaaaatttggttcagagacttttatagttactctaaaacatctttgctttattgtgagaaattataagaagtttgggaatatatatatgacataaattttacactgtagctctggtgccacatgttccttcatggaatttgttccaaatgaaaagctagaaaactgatttctc

SEQ ID NO: 2868 - DNA, 529 bp, Bovine  MMBT21094
cctctcacctctttgttataacctccgttaatgatagagtggaattacacttggcagagaaaaagccctgggtgtgccagaagattaataagtacataatacaactccattagaaatytgacttcaaaataatgtgcttgctctaatgagcattactagttgcttatactttatgagaacagggaagggggtggtgatttagatgattgcctttggattcaattttcctatcataagcagaaattcatagtcagtcagttgacctctttccctaaatttggggaaggttctctttaacartcattgaaagaatagccattggtgcatagatgtatatatggtaatatatgtcccatgttattaactttacaaatagtgtctccaagagcacttgggaaaaaagaagggcctttctgtatatgctcataagaaaacaagtttagtatttttattgctttctgagcaacataatatttcatgttatttgttctaaatattcacctctaaactttcaagagttaccccctaa

SEQ ID NO: 2869 - DNA, 601 bp, Bovine  MMBT21106
  misc_feature (1)..(1): n is any nucleotide
ncataaaacaaaaggtatttgtcttttaaatttttaaaggcttcttttaagagtttttttttaaacatctgctttaagatctattcaagactgaaatgtattttgtttaaaggtataatctctgtgaaacttaggacagtaacttctaatcaggctacagttctctgaaagggtcagtaaaakcatcatctatgcaactgatgaatctcacaggattccttcacagttttcctgattctttgactaatagtttcaacagtttagcctatagaatcatattctatatttgttattttcattygtgttctgtacatttctaaatcaagcatagccattttttcagaaagtgatagttatatatggaggaaaataggaggcaagccaacccccacckccaaggaaaaaagtatttctaaataacaggtaacttatatctaattggattaatttttcattttaggacttgaatgctgttgcttttaggtttaaagataaagagagaccacggggctatacctctaagattgcaggaatattacatgtaagtttattgttattttactctatactttggcacatagagtgtttcagtgatcctgta

SEQ ID NO: 2870 - DNA, 600 bp, Bovine  MMBT21141
gtcatttgtaatcacactttactgtctgatgtgtccttctaggtctcatttgtgtactttcacaactaagcatgcatttgtatatagttaagatcacacagctattgtttttaatttaaggaagaaattctgaaatctaaccttcagagttgctttacgagggccgagtccactgacataccctcgctgacaacatgccccaggagggtctgkgagtacagctctaattttaaaatcgtctctttattttaaacatttctgcagggtttcactatattctagtctattcatgcctgtttkgctatccactgagcatctctgccccacacttctttagacagagagctgacattccaggatgatggtatattgtgcacacgctgcaaagccctgtgacgtgtgccatcagccgcctgtccccaccacccactcccctttcaaaggcatggctgtccgaggcagcacaagcacagggcctggtgcttggtaaggcttccgtgatattgcttgaaaacaacctctggaattcaggctgaagagatcagcaggtaaagggctctttggagagcgcccgtttgcccttctcctgcccggggacct

SEQ ID NO: 2871 - DNA, 598 bp, Bovine  MMBT21156
  misc_feature (1)..(26): n is any nucleotide
nnnnnnnnnnnnnnnnnnnnnnnnnnctgcggtcttctgagaacacagctgttgccaactatttgttccgggcttctgagatcaggccacccctgccccctctttggtctgagaggcaagtctgtattggaatgtgtagctgtaatcagcagcggctgtaagcgggggtggggacagacacacacccttctgctgcctgttyctgggtgagaaaaagccacagatgtgatcaaaccagagtcttacaaaagaaatatatatgcttctagggactgctgtttaacctcatgcttagaacargactagagtgtcccttgggtggcctgaaattcttctaaaagtaagcttttctgaaaagctccacatgttctattactgcttttgttactgttcagagttcctttgatgcagasacaggcagagagagtggggaccctattggagcacttcctctgtccctcaggaagggctgtccttttgacttgtgggcagagtaagccctggcgaggattttgagcagtgttggaaataggaagcatctcatgctatgtcagcaggtggggaatgctgctgctgctgctgctgctaagtcgcttta

SEQ ID NO: 2872 - DNA, 600 bp, Bovine  MMBT21768
tgcctcctctttatgtgggtcaaaatgcaaggcaaagccattgtgtcaaacggccttcattaaattcattgatttgacctgtattttaaagaccaaaagtcaaatggaatgggaagttaaagttcccatacaaaaatcttctcctgggcacttgtcggcttccttgaactctctggtgtggaggcaaaggacattggcgaggctctttggagtctagctcgcagctacacaagttttttggcgaaaagttggagtttgtgttgcattttatgtaagaacaaaacaaacgctaaggttgarggaagctattgtcttgaacttgattttcttcccaaagaggtactgatagtttgtctgccttatacagcatccttgcgagggtctgttctgtgttgctctgcacagaggtctctgttcctgctcagaactctctgaatgaattgtcattcttttcatcaatatgcactttttggacttaaaatgaggttaaattttctggacgttttgaggcacgtcagcattcaaagccctatcttttycttgtgtgtrtttttatggctaaaatggccacaaacagtgctcgttgaaaacagggggtgg

SEQ ID NO: 2873 - DNA, 600 bp, Bovine  MMBT22029
cattatgaggtttttaaatcatgaccatgtgccaggtttatcctgtgattgtttcttcatccactgtctcctagagacgtcctcgggtttcccttcaccttgcccgccctctcccctaaggtgcagtcctccgtggccgtgggcaccccggactacatctccccagagatcctgcaagcgatggaggacggcatgggcaagtacggccccgagtgcgactggtggtctctgggcgtctgcatgtacgagatgctgtatggagagaccccgttctacgccgagtccctcgtggagacctaygggaagatcatgaaccatgaagtaagccgtcgcacttccaccccgtgtgtgttcgagtccctggggaagagggatgggtggagcaggctgggcggccagacgggtgtccgagtgggctgctgacccgggagacgagagcggagggggmcgctcccgttccctggtggagggtggtgggtccrttgggccagaacccctgcaggagatgtgggcttcgggagctagacmcaggtccgtgcggggccaggtgggygggaactgcccaagggggctctcgggcccctgccgcctgtgtgcccg

SEQ ID NO: 2874 - DNA, 600 bp, Bovine  MMBT22139
tgcatggtctgctcctgtaaacgtatgcttttggttttttcctgtcaaaaaatcatgctaaaatcattattttaaccagtgttcaaacagcaagctcatgtcaactcttggctggaggcttctgcttagaggaaaccaaagacaccagaacatccatttgcctcaccctgtcatgtgtggaaaattttaatttgcctagttaatcgtgtgggacatgggagacagacaggcagaaggrcatgacagcaaagagcacrgttcagaagcagcctccgccgttcaaatcctatatccgcagtyagtactcgggtgaccagtcctagaccaggagcacctgaaacctcctgttcaccttgaggctttcatgccagyacctgtggctttctgcgggctccaaggtgaagcacaagatcygcccccctacctttcaagacctccacatgcatcccttccccctctccagtccactttgtcttctcagaaaaaacctccatctgtgtggtctcttgtggcaacccactcagtattctcgcctggagaatcccatggacagaggagcctggcaggctacagtccatggggtcgcagagagtcagacac

SEQ ID NO: 2875 - DNA, 600 bp, Bovine  MMBT22140
gtcattctctgacagccccctgaagggtcctacctgtccaractgcatggtctgctcctgtaaacgtatgcttttggttttttcctgtcaaaaaatcatgctaaaatcattattttaaccagtgttcaaacagcaagctcatgtcaactcttggctggaggcttctgcttagaggaaaccaaagacaccagaacatccatttgcctcaccctgtcatgtgtggaaaattttaatttgcctagttaatcgtgtgggacatgggagacagacaggcagaaggrcatgacagcaaagagcacrgttcagaagcagcctccgccgttcaaatcctatatccgcagtyagtactcgggtgaccagtcctagaccaggagcacctgaaacctcctgttcaccttgaggctttcatgccagyacctgtggctttctgcgggctccaaggtgaagcacaagatcygcccccctacctttcaagacctccacatgcatcccttccccctctccagtccactttgtcttctcagaaaaaacctccatctgtgtggtctcttgtggcaacccactcagtattctcgcctggagaatcccatggacagagga

SEQ ID NO: 2876 - DNA, 600 bp, Bovine  MMBT22280
acctttaaaagcataagggttctgtatggggcaactgcaggtccagcagcatagggctatgcattgccagtgatgggagccacggtgggatggcaaagactgaccagactcaggtatctcacatcagggaaggaagttgcagtggaaggtccacagggcctccagtaactaatgcacatgcttctaatgggaagtcaatgtgttgactcctgcatgcagagaatctgaccatcagtgttagatgcaggaacagtagcaatgaacagtaatgctttgcaaatccacccgctaaataaagtracattttggccttttttccttcctgttcttggccacagcatactgaatttactcccaaatgaaagagggaagagtaaggaaatagcttgcaaccaggtatgcagttgcawgttttaacaaccaacagtggctggaaagttatgaaatctgcccaaaatatcactaagaaaatgagggattggacataacacagttgaaagccaaaataaaacagttgcctcattatatgccacttagttgagacttatcaataaataggaaatatgtcatcacgctttgtctctaaaattctaaaagttg

SEQ ID NO: 2877 - DNA, 600 bp, Bovine  MMBT22709
ggtttataaatgggttcaatgtttttgaaactcagaacagctctgtgaataatgagttgaaaagctgttaatatctttgatcctataattatccccaaagaaatcctcccaaagggtgggaggagtcattgtaygtaaatgctcccagcagtgctcctcgtaaaggcaaaaactggaaacaactcagataccatataataaagctaaggctgagcaagccacagtgtggccaccctctggagtgtgggatggcatggaaatcatgttgaaactcagcagtaagcttataaactagggggsagtgaagcaacctgagtatgaagtagtgggttcctrgggattagaaacacaagtaccttttgatttttatttttggccgtgctgttcagcttgcgggatcttagttccccagccagggcccaaacctgtatcctctgcaatagaagtctggagtcctaaccactggactgacagggaaytccccaaaacacgtgtagattttgaattccctcccccagcattgcctctatactccagccacacgatacccattcagccttaatgtctgctcctctcagagtctccygttattttctctgc

SEQ ID NO: 2878 - DNA, 600 bp, Bovine  MMBT22808
ctgtctttaattattactttgatacccataagaaactctgttaaacagacaggaataacagcactttcacatagttgaagaaatggatgctcagaggggtaaacacaattcatccagtcatccacgtttcacaagtgaggccatgacatgatatcaggaaccctgattgcaagtctgaggctaatttcatcttctaggatatcttcctcaaaaatctgaggatctaaatctcaagaagtactgtaaaagaacctagtcacatgaaaaggatacaaagaatcacagaaatttataagacaygatctcaatactgacccataagagtgcgtttttcaggtcatgagaactaggatgtcagacttggcacaggccttgccagaacctatatgacaccaaatctctgtgaaacaaatggcgtaacattctcccttatctcagaccacactcacaaaacatagcacgtgcctattgctgtgtagagtgactattacaaactcattccttctttggtgtttctagtagtccgaaaatcagaatgttattgtcacatgctactcacgtgcaaaaaagtgacatatgcagtggcctagtttcctatat

SEQ ID NO: 2879 - DNA, 600 bp, Bovine  MMBT22920
tctctaaatatcttttgcaccttgatgaatatttattcttgtcttttgtgataagctttactgccttcaattttactaagacaaagatggggagggacacctccaaaagagtactaaagaycatggttgtggaatgggtgtttctgtactaaaaaatatttaattaagatcatttctgattttgaatctccctctgtgctgatgaaraggagagttataaggaagaagcagggctcctgccagctataaacagggtagaaaaaatacaccccaactccaamacaaggaaacgtggacccstctactgactagcaatgggaggaagttatctcccacaggcttcagagatgactcccagaaagtaatatggtatgagaacyataggcacttagggaaggtagaggaaatggagctaaaccactcactatggtttagttccactgttgtatcatgacacagtcagatttttgaaaacaaatggctcagactttatatttcagaaatcatggctgtaatatttctaaaggggtgcggaggatgttccctaatactctattttagcagcagaatgatgtatcaatagactgcttttgtgcatca

SEQ ID NO: 2880 - DNA, 598 bp, Bovine  MMBT22946
  misc_feature (1)..(239): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctatatatactgaaacaagctgaacaaaatctttacttataagccatagattgtgctrtgaagtaagctaacagaagaaggtgggggggagggagtggaatgtaaggacaggatccagtaacaaaaagtgagttttttcccaacacttcagctgtttaaatccctaaaccggccctggtggtastcaccaccattartttgggaaaatgtccccatcctcttgctaagagcgagtgctggggagatttctgttattccattgcactgttgccaagccaacctgaaagtgtgtgggttctcagagaaacatctcagtatgcagtgttaagtttcatagcattcttgacacagtattc

SEQ ID NO: 2881 - DNA, 598 bp, Bovine  MMBT00037
  misc_feature (1)..(212): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctgtcctaggccccctgtaatctactcatccctgactcatctccaaggaagaggaggagtatttgcttcgacaggtgatctcarcactgttctggtctgttcttctcctcttcccagatccctctccaacccccagctctcatgtgagagcccacaaggccacagtgaagatcctggcagaaaggagagtgccacccagcacccatccctcaccttccatattcctttctcaacacctgctagggcctggcaaaagagcttttcccagaagacttaggggaaaccaaactgatattttttttttggccaagtcatacatcttgcaggatctcattccccaaccagggactgaatccaggccacaacaataaaagcgctgaat

SEQ ID NO: 2882 - DNA, 600 bp, Bovine  MMBT00203
tctcctttgataaactgtggtaataactggggttgcatgaggaataaatattcagtgtctgcacacagcactagctcaactagtctgtcctctcctctcttccctctaccactatttcacctggaaagtcacttaatttctctggacaaatccccaccaccaccccacccattttcttttacacaaaactgagatgatatcttgcctccacatatagttactcttcaaacagttggggggactgtcattttgcttaaacacacctggtctctgcctgattccacagttgttactggtttygaggagtttttggcaggagtctcaacctacctggatggttttagtgagcttcagagcaggggtcactgtcccaatgggtgggctcatgaaggcagcaggggaattccgcttcaagctgattttctcccgggcatcagcaacctggtggggcttctggggcactgtgctctgctgcttgcgcgagttcagcatctctctggcatcctgcactttccctttgatccggaaccgagcatctttctgcaaaagcttttcccgggcatccttgactcccagcttgaggcgggcatctgagaggcc

SEQ ID NO: 2883 - DNA, 600 bp, Bovine  MMBT00454
tgtgtagttcacggaggaggtgaaagagagcaaggctcctgaagaggagtctggctgagttcattgactccctccctccattcatccatccatccatccctccattcagctctctatccacccacccatccttccatttctccgtccattcattcctccccccmctccctccatcccgagagttcgctcacaaggatgtgactttctgagggtcttggtgagtgggaaccaggggccaaaggacagccaagactgtttttcacttttgttactcctctccagccaggagagcggacgtgyrtggtctgagggttgcgctgtgtggcaggcaccccgtccatctcttcagctgccaggagagagtagctctcacacctcagctgaccgatgagcttgggccataggaaaaacaagaaccccaaatccgagcgggctggatgggyagagcagggagtggacgttcccagttagtcctcactcagctcattctcctgacggctcaggcgggtgtgttcctgagactgtggacagagggcagacatttattaggcactgcctctgtgtcagatgctgaaaatacagtggtgagcgagtaaggcc

SEQ ID NO: 2884 - DNA, 600 bp, Bovine  MMBT01177
attgaggtcatagtataccatataaaaaacatggagttttggcttgtaaatacctctctcagtgacttcctacttactgttttcaatacttcaaagatatccttagtgtctagaaaacttaagtctgtgtagttgattttaatattatgcatgtagattaataggggcaacattgttggtaaaatgatagaaaactttctttaaaagttaaaagggatttgagcttcttgaggtctacaagccaattacgaggcttctggctcttgcattctcatctacctttccatggtaacctcttcyttgttttcttcctaaatcatcacatttctttcctttagtaggcaggattttaaagytgcratttctcaggaagctttagctatttcaggaaggccttrtatcttgattagcagctcttgcattacatcttgttcatcttgttcagaagcctcagaaattaatttttatgtttgaaacaatgattgaaatatgagcaagtctgcttgactgaaatagggcgcatggtccaactctacttacctagggaactgaaaaagcaggactgagttttcttcttatacaagttttctttggtaatat

SEQ ID NO: 2885 - DNA, 600 bp, Bovine  MMBT01667
gtaaccagatttctttaagaataccattgattcctctttttgcctgagtttgccatcatttcatcttgctaagagttatattgatatactatatcaatataaattgtattgatatattatattgacataatagatgtaatattagttatattgatataatactaaytgacaaactctattagtcctgaattttaaaatttaagttctcaagtttcctcagctttccttctaagaagcaatatttctgttattctggaatgaacataaatcctcaagatttctttagatgtcatctatctytgttcctccttacatctcttttcatctgaagaacagagtaagtatgggactcttaastccttcgatagcytttggtggagtggaaakamgccyctctctacatgagccaggagacccagattcaataccagggtaaggaagatcccctggaggaggatgacaacccactccagtactcttgcctggagaatcctatggacagaggagcctggtgggctacagtccatggggtcagcaaaagtcagacacgacttagagactaaaccatcaccaccaccacatgagccagaacagccagta

SEQ ID NO: 2886 - DNA, 600 bp, Bovine  MMBT01905
atcttctgtgagaccagggcagagtggatggttgctgcacaggcctgcttcatgtataattttcagcgtacgtgggcttccttaccttcttgaagcatggacctggtgttgtgggagagatgatacttactatttatgataagtatttcctcccrggataaaattctgatgttaattttaacctttgttacaatttaagacatactggtttgttcagttgtggaacaaattacccgtgtagtaagaggacttgaacctattctgaggggactttgtgggtctggggaactaaatctacasctgtgggtcattgctctgctaccccttctcagaattgtcctttaaagttagtgtcatcttgttaggccatttttacagttgacagctggcctctaaagcacttccaacactcaaacctagctgctagttaaacgatagagactttttatgttgtataaatataagacgacttgtggaagttgtgatgcctgtgaggtcgtctgagaagtttcgttcagaggttatggtgtcagttgtggtattaaacatggacattgttttatacttcagatgaaatggaaaggatactttttatcatca

SEQ ID NO: 2887 - DNA, 600 bp, Bovine  MMBT02494
tcatggtctctctagaaatccatttctgaaatctgtttttggaattggtccttgtcctcttcctcccctctaggccagccctggactctagggcagacaggaacgcmatggctgcatgtaccatcacaccctggtgaacttgctgctgctctcctctttttgcactgaaatgtctgcataatctytttgatttgctaagctcttactttttacctgatgattactggtccagataagaagactaaaataggaaattttgaaaaggaaaagagtgactttctttgttctcttgtaagccawcgttataaataggaaggccatatttgtggcattaactctattactgctcatactatttttacagttcatacttctacaaaacaagcctaagagtaaaaaaaggtgaagggaagggtattccgtaattgccagtcttaggatcaaaacaaatcaattttcactctcccgtaaaactctcccaacaatgcagcattgaacgagcgttcttcctctcactcagaagctgcatcatgcctgattggcccagcatgccaagctgcgggtctcactgatgagctctaccgtctcactaggaggaca

SEQ ID NO: 2888 - DNA, 600 bp, Bovine  MMBT02573
cagaattgctctgcctcactccatcaaagcacagagttccagctcattcttgggatttctatcataatcccttctctaactratctattctctgcatgaacccaagtatctcaaaatcaaacatgtctgtaatggaactcagaactttccactccatatgtggtccccttcctgggttccatgaatggcaccattaacctctcacttgcccaagtcacaaacctgggaaacatccttgatacttctctttcatttccaaccctcagtcaccaagtcctgcctcttcttcatcctaaatayctgtctcatccttctccgctcaatttgggtgtaacaatctctagcctcaatggtgcaatagctccctaattaggctcccagcttccactttccctgyactacattttattgtccaccctgcaaccacagagctcatcctataatagaaacatcacatttctctgcttaaaacccttcagtgattccccaaggctcttagataaagaccaagtttttttattattcccatttttagaagagaaaattatgaattaacaaggttaagtaactagctcaagatcagtaagctaggaagggaag

SEQ ID NO: 2889 - DNA, 600 bp, Bovine  MMBT02710
gattttagcagaaaaaacaattagaaacagttagtaaaactgtctaaagttcccctttagatrtccctgtttggatgaggaatttcttgagaactcagtgcatggttcttgattgttagaatatggttgctttacatgggtataatttctatgactaattttaattagaggtatcagttgtgaaagagattgaaacctctaaggaaatgttaattgttgtgttttcctattggcttctctatgattttatatcactctgtgcctcagtcattacatttcagccatcccggctttttctgmttttkaaacattccacagtttcccacctcagagttttgtgcttgctatccttttgcttggaatgttggttggctccttttcactcatgtcttgattcaaacattaggtttcctagacaccttccctgcccttccaaatcatttagactttatcctgctctcattttctcatggcatttactactcttttatgttattctatttgtttttttttttttaatgaatattgactgtctttcttcactagaatattaggtacatgagaataggagacactgtcttaatctcaccatatacctag

SEQ ID NO: 2890 - DNA, 600 bp, Bovine  MMBT03375
atttattttttattgtacagtatttgtaaagtttgcattattttaaaaaacagagtagagcatgatcaaggaggaatraaaaaattatggattaattacctcctaaactattgaattttaataatttttattgaggttttaaactctttcatggaatatttagctaaaaagcagatccactaaaaataggtgcaattgctcagttgtaagaatatgagttcacaccttaggcaactcttaggttatgacatcagtttatttgagtgcaggctcagacaaaacatcttctgaagtatcacygttggtagagtctrtttggatatttaatcaaaacacaatgtcagtraatacagccctagtctagagtttatagtcttcggtgagtagcttacaagatggtcaccatttgtttttctgtttccttaagcagctatcttgatatccaaaatgtcctgtttataaactgtcatcccgggggccagggagcaaagtgagccctgtgatggatcaccctcagcaggctgactccgcctgtcgttcttgctgctctaattaaaagacggtgaagtcaggggtctaaggcagggatgacaatagggc

SEQ ID NO: 2891 - DNA, 561 bp, Bovine  MMBT03672
cgccgccgtggtggctgcaatgtctccatggccccggacaagggacatatgccactagggaaggggccctgcgatgacaggagatggcaggagtactaagctagggatcccccacccacgcctccgcgggtagggcttcccgtggcttcggggaacgtctgtctaaccaatcaggccccaacagcagtccctgcgaacagacccgccggttcccagaagggggcgctcaagttcccccagggaccccgcccccacggatcgagatctggtattccgacgttcccagggacccacagaaastactttccaggccggaaaggggcgggcccgttcttttcgccttcacgccacccctctctacacctggatccggcaccctctcctcacacctcgaagtttcgccacctcagctaccgtacgcacctggagctaagacccgcctcccgggctgcgcagggtcacagtacgcaggcgcaccgagatggcgcgggaggctccgctttagtctaagctactttgaagaggaaagcgagggaaggcttgcacatgcgcaggtaggcg

SEQ ID NO: 2892 - DNA, 600 bp, Bovine  MMBT03982
ttgtgttatcaataaccccagaaagaacaaggatgcagtggttcttggctcccgacctcctggggctctagagatacacctgcaatctgtttgtgctataactggctgagtgagaagagccttctcttgttttaaccagctcttaaataagagtggcaatggagaatcaaaataatcctgtcccttcattactaaaagtatcataaaaatacatagtcaagcatcaaatttatttaatatctcagttcatgtagaaatatttacatagatgtcaatattgcttcctgtatccaaactggraaactcatggacatgacaatcaaaatataccacttaatctccacatcttctcttcagataaggaattaagaaagaataatcctgtgattccctctggtaaccaactcagaatatatcgaatggtcaacacatttgattcttgagtcaataaagaatgaatgcaatcaagccatttaattagttatcctaatcctgaaatgaacaatgtgttgctcacgattcaggttgctgatacagtgagaatatattcaatatgtccttactgcagccaaaactaaattgaatgggaagaaactgtca

SEQ ID NO: 2893 - DNA, 600 bp, Bovine  MMBT04260
ggtttgggggttttgtttttgttgttgttctttgaaggttcggagtttttctgtttgtttttcccttgtctttattttagaaatgcgccttggagaggcctacatcagagatcgctgatctgatctatttacatcctcagacaaccacttgagcacacctagagtttagacaaatgagctccttcctttttaacacgttttaagtgctgacttcagtatcttaattaagtgctgttctaccagtatctggtttgctgtgtgagaagtccatttccttagctacacagagctcttagcttkttgggcttatctccacttggagtgaacaagaataagccctttactgtttgacatattgtcaccttcgccctggctagactcaaagcagctctctcacctcaagtcttaccattaaaggattcatacagccgtgatatttcttagcaaccttatgttttaagtcttccagaagatacaaataaaatgcatgatctgatgccatgataagtaagatttacatcttcattgcagcctgtttataacagagaaaacccggaaacagcataaatgtctagcaatgaggaattagttaaataaacg

SEQ ID NO: 2894 - DNA, 600 bp, Bovine  MMBT04283
attttccaaatgcaataggttcatagaggaatgtaacatcaaagcatgaaaatgtatcagctcatttctgacatttcatgaggtaacttggcatgatcctaccagacatagcagcttaaaccaaaaaactgctttgagctgaatgaagcaacccatagatacacaatccccagacacatacacacttaattgatttatcttctttctcttacatcagttgtctatatgtgttgcttaactagtgtgcaccatgctgttgttcctaaattgtttacttttctacataaaagtgtttaatayagcatttcaaacatgaataagagtgctggttatgagaatccaaataatgaacaaaagagaaagccttaagtaatgagaatatttaaataacaaaacactttgaaagaaagagagaatcaagcctaaagraatcacattgttatatgaggcaaggctacaaaaataaatgaattagtaacaatgaaaaagctctacacatcacagttatcatctcctttaagtggaattgagaagcatttgcagtggattgaaattaacaactataaaactgagtataggagaataccattttgtagcatc

SEQ ID NO: 2895 - DNA, 600 bp, Bovine  MMBT04365
aaagtttagttaatgtgcaacttgggasatattgagggacagtgtcagtgacattttataatcgtttctttaaagtagatcagatgtyatctcagagcaagaaagctggaagaatactactaactcaacctggggctgtgtgaagattttaggaaatagaattggtattaatttgagtgttttattactgaatttttaaaaagttcaattcaaataactcacctttgtttcctaagaaaatacatagggttacttgattagagttagagaataacttattttgactgtttgattgaaagwataggcaagaggtttgaaagtcctgaagtgtgtttaagcttaggcttatttctggaagtgctgtaattctgtttcccattcataaaatctggattaatattgccttactatcacttcctataacttcatggatgttaggaaaataagttggcctttagcaaaaaatttttttaaattttattttatttttaaactttamaatattgtattagttttgccaaatatcgaaatgaatccgccacaggtatacctgtgttccccatcctgaaccctcctccctcatccctccccataccctcc

SEQ ID NO: 2896 - DNA, 600 bp, Bovine  MMBT05044
cataaaaatttagcttttatttttcttaaatgctattttaactggaatctacattcaactcaggcatttttcattaacctggacaattagcacctggctcattcttaactcgatcccaggtatattcagggatacttataaattctactaataaaccctctcttgtctacagttaccttcttctctgtgaccaatcttaagtttgtttcaagctctggcctcttttctcttggaatgcatttccaaatgcttcatgaaattttttcccgttatggctcactatgcaaaatcaaaacacaycatttccccaagtctcttaaattcttctaatggtactatttatattgacaacaaccccattctcctcgggaataacatttgacatgagtcgcatttttggttyttccctttcactttaactgtatgtctctgatgggatgacaagtcctgcattattctaatatttctatcttcttctttccattaccgatcaagttccacggccctatgttcaggcctttatcaccattcatctataattcccaagagaccgccccaccttcactctgtcattgttcgatcacaactcaaattttacaa

SEQ ID NO: 2897 - DNA, 600 bp, Bovine  MMBT05539
cagcatcagggtctttccccatttgggagaggcctatgtgattggataagtggcttagcctctgagtctcagctttcttacctgatggaggattagaaatggggataaaaaccccccccccacctacctcaaagagtccttgtggggctgagatgacctcacagagtccttgtggggctgagatgtgttggaattggaaatactcaggaaactgtgaaaacattataaagggagatgaattgaaaaaagcataatgagggaccatatcctctgacttgagacagttagagtatagaggtrttcatctcaggtgrcttaaagtaagaaagttgagtgaaagggctatttaaggaggtgtgggcaaggytaaaastacagacaagataaaatgaggcacctggagattacccacagtgggaggctgttacatccccaagactcaggtgcaaaggaacaaractgttactggagctcaatgagagtcagcaggaaggaccagtagccctagaagcaggcagttcttactaggtgactgggtgctgcagcagggtggacaggaggacctggacttcccactytctcatcttgtgctgcttacct

SEQ ID NO: 2898 - DNA, 600 bp, Bovine  MMBT05696
ctaaaagttaaatagatcctttattaaaaatgaattcctggattatccttgcaggaaacaagatggtcataagccacaaagtcagttttgaagtaaaatgctatagaaattgaggttgtttcttacaccttctgataaggaatgctgcaaattataagaacagactatttactgaaatgagcataaaaatagccagacaggtattcctttgcttttatagacttcaagactccaaaccacttttagaagtcaaaaataaaactgtaacatttctgtcaaatcttaatattcaagtaatgmtcacagcaacacagaatatagaatttgataatgaggaagaagatacaatatttctaagggagtraagtttaaatgcagaatgcatatctgaaataaagttattattttgatagattcagtactttactgttgactgaaatcagtaggccggccgcgattagcagacatttggtaccgtccaaaaccttcataagacatttggtccttgccaaaatgtccttgaaatttggttctttccaaaacttccatgagcatgtttggtctatgccaaattgttttggacaggatcaaataccaagt

SEQ ID NO: 2899 - DNA, 600 bp, Bovine  MMBT05753
gccctcatttttattcatgtttataggagaacatctgtttggttgacatttgaaaggtgtctgtactgaaataaggctaacaaatgttatttgacacctcatgtaactaaaggtcataaatctaaaactgttcaacaagatgaggtgatatttacatcatttaacaaaactgtagaagtgctacaaacacaatttacttttaaacacctttatgagatgaggaaatactttcagccaatcacagtgcttagattttaaaatgaaacattcttaacgtacatagaaaaaattaactctgtraggaagcagagattatgatatgcagtaagattcagactcaaggaataaaggttaatagtatacagagaaaaataaatgctttaatttccaactttctataaacagaagcaatttaaatacaataaaaagcaatgtactatatattttcaatgtatgcttgcctatatatacatatagaaacttcttacaataacacacacttgttatgagctttattcttgtcaatacattttcacatgtatcagttctaatctcgcagacacactctaaaatggacagcagactttctgatccccattt

SEQ ID NO: 2900 - DNA, 600 bp, Bovine  MMBT06008
tattgatcttatacttttgactttctwttccacctaaaatgaatatgcctctcacattatgcyaatgttgaaagaacgactaacatttcaatttctatcacatacagctagacaaaatatcctagaatggggaggcctcttactaatcctaaatcacactgaattgttgaacacctattgggcttctaaaataatctgtaatcacacttcttatattttacagaaaataatatttatgttatgatgtattcctgttttttgaagtggaagtatttactaacccacccttaacaaggacckattaacagaaatcgctggaaaatataacacattttcattttgttccaactcctcccatgccatgagtgtctttccaaaagggaaaaaatgacaactttcagtaaaaatgtactttgacttgcataagaccactctgtagtccaccacaatgattaaagcgaagttatatggaagggatcaacacagtataagaaagagcaaagtgtgaaaaatgcagttacttactctgctgccacatacatctggatgagaaagtaccaaaacctaaaattctacatgattcttgaaagtatcacagct

SEQ ID NO: 2901 - DNA, 600 bp, Bovine  MMBT06033
actttagatgcaattataaataaaaattcttacaccaaacctgaattttagcaaagacaagaatccacagagtatgatgtagtcatagaaaatgaaaaacacatcttgcccagagataacgtagatcctcgctgccttctacataaaccaatgataactgataagagatttagcatttcctcagactsaggtacatatagaggtacatctcctcacagaartgctatcaagcccagggttcggatcagcttggaaccacctcaatcataccatgttcctgtacgtgctcctggcttgtgygtcatgggtcttggaaagccattctgccccgatgaagataatcagtgggtctacccaggacaatcacacrgcagtctgtgctgagattgagaaagaactcatggctgacaacgttacatacaaggtaagtctgggtcttcatcaaatatcactttactctcagtggccctctgtgtttctaaccaacttttcctgcttccagggctccttcgaaaggcctcagaacaccagtgaggtaaggagcagtcaacccatggtcatttctgaccccacttgaaagggaaatcccagggcagagac

SEQ ID NO: 2902 - DNA, 600 bp, Bovine  MMBT06272
cccttccagctggtgtggggactggtagctgcctacccctcgaagctcctgccaccactctgctttttagggcagttgatcgggctccttcattaactacagcaggccgtttccattgcaaataaaaaactgccttcctaaatgcctttcatcctgaggtcaaaggctctgccattgttctgtccaggcacctaaccctgctctgtgctccggctggagctccacaagtgccccccctctccctgaacctccgctcccttggaacccactcagcgacagcttggcgggaagtccctggamattgaaacagcatctactgcctagatgttcaaatgttgctaactaagatayagtactatacagtatctaaataatagttaataattattgacataaattattcttttatattatacattatattttatatattatatatataatatatatgttaagttaattaacattaacttaatactgaaataatatctaacaaggtcayactcttacctgaaacaggataatagttataacttctgtcataactgttagaagtaatgacactaaagcaaagatgagtagagtctatcatagtcacgg

SEQ ID NO: 2903 - DNA, 600 bp, Bovine  MMBT07512
agtggactcatctccagcagagagagagagtggaatttagataacagagcaggcagacaataagttaccagctgtcaccccaagaccaaccacagtgatagccggaggttgtygcacagacctccctttctcagtcccttaggacctggtgagctaccctagcttctcctcttccccattcagcagctggattcttaaagcaattcatgctacttgcctacttaaaatcatccaagtttcacgtcgatcacaaaataaaaatccagacttcttccccttcatctgaccaggcacacctcyyaccgatgttatccagaagcagccacacagatctcctttttgtttttcaaatgcaccagcctctttcctgcctcaagaccttgccctttcccattccttcagcctaaaaaagcactctagttctcttagaatctttttttcaaatgtcagctctcctgagaactctttactggccaatccatctgaagaagcaccctttccaatggacctgccccatcatatccctcaaatagagcaacgattagcacagtctcattacttgccttgtttactgtgttattatctctctccctgagtaga

SEQ ID NO: 2904 - DNA, 600 bp, Bovine  MMBT07635
actttggccacctgatgcaaagcgccaactcattggaaaagaccttgatgctaggaaagaatgaaggcagaagaagaagggggtgacagaggacgagacgattgggtggcatcaccgactcaatggacatgaatttgagcaaactccaggagatagtgaagggcagggaagcctggtgtgttgcagtccaggggtcacaaagagttggacatgacttagcgactgaacaacagcaaccaggatcactaaacacacttttgttttttgagaagtatagaaaattcacctaaaatggagcawattttctgctttcagaaccctttgaatgatttttttaaaatctagtaaaacaaaaaccaagcacagaaataatacttaaaaggaaactgataaaactccacagaatagacactaaagccactaactttggtgacttcttagccccacgttccccctctgaaaattagggtttttctatatcttctgtgtatctgtatcatttccatactctgtttttatatctatcctggcaataagcaagacgacaagtccaaaaagattataaatttctttgtttaaatctaacattgatggattcct

SEQ ID NO: 2905 - DNA, 600 bp, Bovine  MMBT09848
aactaaataaggcagaaccgatgttgtgagagagaagcatttccccacacccactgcctgctgctggaaaaatgcgtaagtgattgaaaattcagatctttttaaaaagtatgtgtaatttagtgaatgcatggatgtctgaagttatgcctgagggaaaagaaaacaaggatccaatttcatttttatacagtattcgtacaatttacgagcatcacttttataactgaggtaaaagggggcgatgctgacatgaggccagtgacctgttaatctcctaaaagccccaccgatgctccygggagcccactcgggtcctgccgtggtcaacacacctgctctccagtttcaacaacaaaacctgcaggtctgaaaggggtcagctttattatccaggattttttgtctgtagaaaatgatcattttttaaataacatatacccacttcctcttgtacattatttaggacatttaataaatacttttcctcatgagtttccataggtctccgcccaagtacattaccaaaaatgagagcagaaagaaatcacattagcccagaatcacaaggttacatccttaaactccacgttcaaagac

SEQ ID NO: 2906 - DNA, 600 bp, Bovine  MMBT10250
ctggaatgatctctctgaatcccagttctttctgtgtttctgtctctgcagccctacctctctgtatggcacattgttttattgtgctccgcagataccgcattttttttttttttaataaattacaggtttgtggcaacgctgtgtctattggtgccattttcccgacagcctttgctcgctttgtatgtttgtgtcacatttggtaattcttgcagtatttcaaggtttttcattgttcttctatttgttatggtcactgatgagtgacctttgatgtgaccactatgactcactgamggctcagacgatggttaccatttttaacaagaaagtgttttgtttttgaaagtgtttcttaagttaagctacgtacttttttttttttttttcaggcagaacgctattgcatacttgctacagtacagtgtaaacgtaatatatgcactgcgaaactgaaaaatttgtgtgacttgctttattgtgatcttcgctttattgctgtggtctggaattgcacagtaaatagtccaggacatgtctctatttgtctgtctttgcttctctctccccacatctctgtctgactcagtggctctc

SEQ ID NO: 2907 - DNA, 600 bp, Bovine  MMBT10259
aaaaaaagargaagaagaagcgacctcgataagtttgatgtaaatagtaaatcttttactatcagggtgtgcgcatgcgcccaaccagagcctcaacctaaggactgcgcctgcgcaagctcgccccttcactgtcttgttccgcgaggtcgagcgcgggcgagcccaacttgggcgccgcttttcctgtcgccacggtcgaagacggccacgtagctacccaagaagacatcaccgaggatccagaagggccctgagggcggaggcacgtccagagccatgaagccggacaaacagacmctgaagccactccgagtaatctacagggcgataagaccagtcacaggtgtcacgctcaccggcctgccttcctcctaggagccagagcttcgccctgcccacccctagacgtgtttctgtgccgcttgcttggacctagtgacgtctcactcccagccccacccttccaaacgcgccactctgacgtcattatgacggccacctacctggatgacgtagtcctgggccgtgaggttaaaccagacccccccaagaaggaaggagactggggggagcgttgggattttcgagcattcgatg

SEQ ID NO: 2908 - DNA, 600 bp, Bovine  MMBT10285
gcctctgctccagttaccctccgggtgctctgtgagtgtcacatccttgacatcttccccccgcctcagtctccccacatctcacatgcctgtttcaggtcttcctcctcttctgtctgcaaaatccaaggacttcacagcaatggagtcctgggtcagagaattcccactgactgatgtgtgatcttatgcctccctgccttggtttccttatctataaaatgtcagtctcctctccttgtgaagagtgcaggaggtagagcatgcagaatgcctggtgcacagtaagccctcatcaaycctagccccttattttactcttcacaagggcccacactgtattagtcagctattgctgtgtaacaagccagcccaaaacctagtgcttaaagcgacagctgctttttatttgctcacaagtctgcaggtcagaaatttgggctgggctagtgcttctgctggccttacatcatgtggctgcaatttcaccttcttggctggcaaatggcgtgggctgtcggttgggcctcgtgtgtccagcacgctggcctgggcttccacttggttgttttccaaggagagcagaagctgcaaggccca

SEQ ID NO: 2909 - DNA, 598 bp, Bovine  MMBT10437
  misc_feature (1)..(218): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgggcttgaccttctttcagcctcacccctgatacttccactttaggcttttgctgtagttataacagactttgaactytrcctgagctttgcccagaactttgctcttgaccagcttattacccctttcaagtcattattcactatttcaccttttcaaagagacctactctgacctttaccaaatattttaattccctatatcctgccccagccttcagacttcaccatcacttatcttcttatctactaaatatggccttattatttgttacttttatggtttatctttcaccattagactataagctccatgagatccatgagacctttgatttgttcactgttgtatctcarycacctagaccattaccagg

SEQ ID NO: 2910 - DNA, 600 bp, Bovine  MMBT10559
aagtcccaaacctaggaaatttagactggagaaggacgaatagtgtggaaacttaaaagcgcctttaaggagaaggaggaaaaaaagagggttggagatttcattgtgtgaattaacagtgctgaaactggatagatcaaaggaaatgtcaaacaattaagcaggtagcaagccctgcaggcctagaggaagagcattccaggaaggagaacagcagttgcaaattctttggattgggaggaaatggaatttgcttgaggaaaaagcaaggccagtgtttcaaaatgctgggaagagatmatcatcaagcgttttgcttctctcttagaactgagttagctagagtcagtttctgtgcctgcaagtaaaagatagttaatagcgagttgcgttctttcaggagytctgtttttctattgataacctctgtgttttttgaggcaatgtcactttgttttgttaacaggtacgttgattatctgttaagattactgttttgttattgccctttgtgagtttcctttgtctgttttgcttgttctttcagataaaatttactgttttattaatgttgccaaaaattgtcagtaaaattagcaa

SEQ ID NO: 2911 - DNA, 545 bp, Bovine  MMBT10928
gcttacagttgctattttcatggtgtatcttttttcatccttttgctttcaagctgtttgtatctttgaatctaaaatgcctcctgtacacagcaaatagtcagatcatgttactttttcaacctaatctgataatctgcctttcagttggactgtgtgatgatccatattttagtatcatccataaaccatattactaatatggttgaatttacatctgacagtttgcttttggttttatgtctcaaatctctctgttcttctgtttctcttttactgcgttcatttgtatttaatggrtatttcctaggtggaggactagaggccctattctttctgaataaaggtcctgcaacacaggacttttgaagaaagatgaaaaatgctggcagcctgcccctcacatggtgattctgaagatatagctggctcaaacgtcaaagactctcactgttcttactaagatttactaaatttacttgaatgaatattgctctaattgctgtttgcccttaggaaagttatcagagactatatacaatttt

SEQ ID NO: 2912 - DNA, 600 bp, Bovine  MMBT11259
ggcaggaaagcactttgtctgtaatctgtgtgaygrtgattggcttaagagcatcttgctgatgatcactgcagaaactccctccccaaaacacagtgcagaagccacacaagcgagtagtaaaaggtacttaataagtaataagggcaaacactgagcacttactatatcgtatcactgctctagttactgcacrcatagtgaccaattgataccttacaacagtcctacagggaagcgtttgttattttcatcctcattttgcagagtgggaaactgaagcacagagaggtcaagtarctggcccaaggtcaccctgcacgaagtggcagaactggatttgaacccaggcagctgggcttgagcatcagtcccttyaycacgactctggtgcatctttacatttacaacagacaaaccagaygttgttgttgttcagtcgcaaagtcatgtccaactctttgtgaccccaccaactgtagctcaccaggctcctctgtccataggatttctcaggcaagaatttccttctcctggggatcctctggacccagggattgaacccgtgtctcctgcattggcaggctgagtctttaccac

SEQ ID NO: 2913 - DNA, 600 bp, Bovine  MMBT11595
catgataaaaaggtattgtggraaaaaaaaaaaggtaytgtgaaatgtaaagctaatattggtgggactgttctgaaatcagaatccaggaagggctgtggctttgttcaacagcaataaatctattagtaactaaggctatttagcagcaactctttactcaagactaaccaagtcttgaaagtagtcattagcctagaatcaacaattatgccaggccaactaaaagaaactgattttatctgttctatttattgcccaaaattttaagtgtttgcaacctccagcaaatataaagayacttccttgctttatttggagaataagagagtatgctttaagttgaccccacttgctatttttggaatttactagcctctcaaccagggacccactttctagaacactttattagcactctaccgtatctgggtttccttccagcagtacattgatggctctgttgacatctccattgcagtcatgcaaagcaatgacacattcatcctggttcttgcctgtgatatcaatcagctgaaagagaaagatcaacaaccattatgaacaagcttgcactccccacaaaaggaaaacagatga

SEQ ID NO: 2914 - DNA, 600 bp, Bovine  MMBT11720
ccagagatgccctaaaatagttcagttcaaacggggaataaggaagaggctcaaggtgataagaagaactaagttatcatgatggtgattagcatgccctcacccctacttgtttcctagggagatctaaagcattattttctagctggaggtcagtcccacaaaacaaaaagaaatggagctacactaaggagcaagaaggaggaagtctgagttgctgaagctcagctgtctaaataacaagctagacagctggtgggagaggaagtcagggaaagtcaaagaataatacatactgcraaaatccgatgtgtgtatagagccacagtctggagaagtttccaaccttcactgtgctcattctaatcacctggtttgacagagaaaacctttgcccyrgtggattctataaaaagattcagggaatgaatgttctacagaggctgtgtaatgayttttagtctggaagcaatggttgggaaacaaagtctaccctagaatcaagtctatttccagggataaaattgggtgcactccaaaagcctccaagtgcttttcagggggcaggggggaaatagagttggaggtattgttcatcag

SEQ ID NO: 2915 - DNA, 601 bp, Bovine  MMBT11922
  misc_feature (1)..(1): n is any nucleotide
natatgacatctctgaaaggcagagttggaaagagaggctaacagtaggctctctctagctggygtgggtacaagcccgcaccagcacagcaccgactcaagagaggatctgcctgggcttgagtctcagctctgccgcacgctagctgtggttgtggtttagaaactaactcccttaggcttcagcatcttcatctggaaagtgggattatggtagyacttgttgcagttacttgaacgttccttaaggtgagccacgtgaagaattaagacagtgtctggtgcacgaccccaagaggtrtgacctgcaattcctatgattgatcaaattcaaagaagatggagagatggcttccaggtgaaggattccaggatttaaggacgtaaatttttttttttcctggtgggtgtggtggggattgtggaagaggacagcatggcaaaaccaggtaggtaagaagagaccagttatatgctgaaaattccatggagttctgtttagttggaatattgtgtttacctataaaggggcaggaagtttccawgcttaggggttaggctgggctgtgttgtgaggctcttgaatgccaggagatcagac

SEQ ID NO: 2916 - DNA, 600 bp, Bovine  MMBT12123
tgctaattcctcagcagaatgtgctgcttgtccttcagacagacagctccttgttgtctgctccttaatttgtgatcatacttccttgttactttctccttcttcccagatcccatcttagttcctgtcttatgtaaactccatgggtaagcrttggtgagttgttaatttgggaaacaaggcctgcaatctgtggagcaacaagaacagctggtgctgctgctgttcagtttttcttggcagatggatgtagagggaattacgaatggggaaatttgcctcagccttggctgctatttygtacagcaatrtaacattgccagctctctctctctcctatgccaccactcctgcaccacagcctgatactttaatgtgttcccctaacttcatgatccaggtcttcctgggtagcctttgttatatgcttcatgcccartatacctttttgaccacaacaagaggcattttcagttttacttaagcagttttaagtgtacattaaggaaatgttattccacatccccagtaatttgaggtcaagacctaacttgtttgtccacttatttattaattttaaartaaacttcaatgaatgtc

SEQ ID NO: 2917 - DNA, 600 bp, Bovine  MMBT12927
gctcccttcactctgaaccctgtcaggggaggaagccatgggcataggctgaccagtgctcccctgtgggaacaactccccagtgcccagctagctgatgctgttctcctygtggtcggaagcactgtggggaaagcagggcaaaggtggggggtgaggcacagaatggtgatcagacaggccgaggaggccctgggggaccagcgtgccctggctcgggccagcacccctttctccatgttctcgcttccccagcttcctgccacgttctgggcacttaggatgaatcatttcacctayagacttacacacgcccaactgccgtcaagcactttagttagctgtggtgtcatgtttggataccagtgttttatatttatacatagagaattttctaatatagcctattatctatctatctatatatatgcacacacacatatccacacacagccattctcccctcccagacagctcttccacaygggaatgggatgaacccctatcggggccttgactgcagagccggagctccaggggctgggggagggagccacatgtcccgatcaccccagggcctgagctttttcaggaaaaggc

SEQ ID NO: 2918 - DNA, 600 bp, Bovine  MMBT13225
aacaaccaggcttgtgatgggaaggccaagggcagagttgttaccaaagcaagtataagaaaccagtggcatgacatgggggcccattctgctaaaattaaaaaatacaaacctacacacaccaagaataatcccttccatgataagtcacaaagagaaatggaaaaaaatctctgagatcaaagaaatctattcttttaccaccactgagtagaaggcacagacagacccttgggaagaggtcttaggaaaatgtttccacttttcgtttttcaagagytatggcaaatatgatatagktttaatcagcttgatttatggagtaaatgataaaagtggagtgctacctctctttcataaactggttttcctttttagaatagttaacactattatgactgaagatttactgtattcttacagtgagcaagaacacacagaatgatgaccccactccatcagtcagggtccgggaaggaaaacacaaaccattgtaggtcttaataaacagaggtaatttaatttaggggattggtcctagaagtaatagaagtactgagaagccaaacagcagatagcgatgcaacccagagattagcc

SEQ ID NO: 2919 - DNA, 598 bp, Bovine  MMBT13692
  misc_feature (1)..(127): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgggtgttacgttagttcgtttaggacagtatagaggaagcagatctaatcagaaaacgaagacagagatgctgaaactgccaacacacactctgtgattcttcaacaggtgcggactgcctgatgggtgtgtatctgttcttcattggcctttgcgatctaaagtaccgmgggcagtatcagaagtacgcgctgctgtggatggagagcttgcagtgccgcctcctgggcttcctggccatgctgtccactgaggtctctgtcctcttgctcacatacttgaccctggagaagttcctggccgttgtctttcccttcagtaacattcgtcctggaaaatggcagaccctggccgtcctcatctgcatctggattgtggggttcttaatagctgtgactccattgtggaaagaggattattttggaaacttttatggaaaaaatggagtatgtttcccactttattatg

SEQ ID NO: 2920 - DNA, 600 bp, Bovine  MMBT14506
ttctctctgacgttatgtctttttccttcctccagctctctctgctccagctcagagatccttccattcgctgcttcctcctccctcaaatgcacgtggttcactatctccaagtctctgctctcatgttttctatccttgagctctttcaggagcactccactgaagcacagagcaaccataccagtgcttcgcatccttctgtttattttccccactgcacgtaccaacacccgacacgctatttcttaccttgttcgtacattttctgtatcccayccccaacccttgccccaccartgagttccattagggcagggacttttcgctgttttgcttactgctatattcccagtacctggaatagttcctgacataataggtgatctaaaaaatactttttgagtgaatgactaggttttcacaaaggcatgaagtggcagtatattcaattaaacatcccattaactttaaagaatgaggatgcaacttcagtagaaaaaaactttaggtattcccaatactaaacattaaccatttaaaaaactgtattcttaacatttctctagtaaagcatttcccaacataaaactagttatg

SEQ ID NO: 2921 - DNA, 600 bp, Bovine  MMBT15303
ggtagaagatctaacagattagaagatgaccatgtgctttggcacaggtttgtaaataagagtcctatcactggtccataaaatgaacatgatgttaccttttctcattttaaattctctggaaattatgcattacacttctgcccactgcttcctcatagtgtgaaataacttaactggaaaagagaatctattaataatcaagcacctggaggtctgcagctaagcagtaaagatgatgtgaaatctgttgatagtgactctgsgttcctgagctgtgaagttaagtttttaataatmtttctaatcaaatggcaacagagttatcactttttcaggctttgtttcatctgaaaacaacagtgaagatttccattcaatcaaataatttccatttgttcaaaaaggtatttactgtgtatactttagtggtggatatcaaaaataaaaacaaatattaattcaagatattatcttacaggcaacatattaagaaattttcatgcataattataggtaaagaagctactctttagaaaggttaagtaacttgcctaagtaatagagctgagaggtgacagaaccaggatttgaacatag

SEQ ID NO: 2922 - DNA, 600 bp, Bovine  MMBT15629
ctacaatccatggggtcgcaaagagtcagacatgactgagcgacttctgtgtgtgtctgtgttaaaaagttttttaaaaaataaagtaaagctagcctatgttgtttgaagtcaggttaatggttactctgggggcatagagactgggagggaacaagagaaaggatgtgaggggctagcgatgctccaagttttgatctaaggactggtaaccgtacagtctgatttctgcacttgtatgtatcacacttcaataaaaatttacctamaaaaatgactgatggtagagaaagaaggtarcaacatgacttcaagtggaagtgtctatgagagcgtggaggaatggcaagcacctggtataacaaacgataaaaggatagagagccctggatggcggtcgatttatgacagggaaagacagagctagctacaggaaaacgggatgtttagagaaggatttaaggtcaggagaaggtaggaggagggtaacagttcatcactgtctagctttctaggtcttgctaaatttggttgtgcaagagtgagcaaagtgccccagggagaggttatcaacaagcagtactgtcatcatcaccctga

SEQ ID NO: 2923 - DNA, 600 bp, Bovine  MMBT15827
tctgtggggtcgcagagtcggacacgacttagtggctaaacaacaactcagtctcatccataaaggagagtttgacttgggtaccccacggtttcagtgcctggcatttaatacatgtggtatagacaaaaatgtttgcctatcaaaatttaacgtaacagattagaaaattgggcaacttaaatgggagatttgtgggacggacataaccaatcaaacgcacagggcgatgatggagcaccctgattcttgaattttctagaaggacagaaacagatgtatccacaagtggaagcaggrtttgttcatcattatgaggaaaaagagtgttttggctagaaattaaaaatgcaaattaaaacaagctttaaggtatcattacaaactgatttatccagaaaggaaattaaacacgtaataggcaatggccggggtgggagagtccataaacgtctgcatacttggcaggtttataaatgggttcaatgtttttgaaactcagaacagctctgtgaataatgagttgaaaagctgttaatatctttgatcctataattatccccaaagaaatcctcccaaagggtgggaggagtcattgta

SEQ ID NO: 2924 - DNA, 600 bp, Bovine  MMBT16616
ctctgatcagtgttataccgtaatattagaaaaatgacaagtagaatattgagaaaaggatgaaactggtaataaaaaatgatttctgtcagaatcaagtaagagcgtgtatggctattaatcagctaaggattcaacgttcatagtaaattgagtgcatcacctaaaaagaaggtttacttaaactctgtttagcagctacagctgggattgtaggtcctgctacagatcaccatagcaaataccacagatctgctaaagaccaccaagaaagtctttggccttctcttctgagaagcrctgacccatgcagatcatgtgtgagtcaggccagattggctagcaaaacaaaactggacatcaggagaaaaaataatactgctcaaaaaatcctcaaagtctccttagtaatgttctaccgctaatatgtgaagaacaaagattctctttgtgraaagctagccaactgggatttaccaatctttcatctcttctctgaagaactctttctcaaaaacagacgcactccatccatcacagaatactacacataatttaccataaaatagtgtattaattcataggaattcaagatatcac

SEQ ID NO: 2925 - DNA, 600 bp, Bovine  MMBT17358
ttggcattctgatattgataaaggaaagttctatttcactaatgtacatatagcctttatcagatctttctcaatttatctctgaagtatgtttagagcttaaaaatttttaaaagaggaagttcagtgattagaatgagattgactcattttgaagatgattttcacaactccagtgattgctcctgatacactaatgcctattacaggaaagaaggctctaaataattcaagaaaaatataaaagtattgtgaaagctgcttcaggctgaatgtactttgtgatggggtatcacctgyctctgcttccaaatgtgtgattgacatgggttttgaacctaggrcctaagctacaataacaaccggataggaggaaatgaaccagctagtccagggtggaaggctgtcaccattaatgattttctaaggctaagtttttagtctggaagaacttcttaacaatcgtgcgtgtgttcatggataaaaaacaaacatgaactcttctcatcaaggaggagataaaagttcaagtgattttctagtctaataaagtcacgagacgatcattttcattgcctccctttattaaagacccaagct

SEQ ID NO: 2926 - DNA, 600 bp, Bovine  MMBT18400
tctttctattccttatatttacctattatcaagtccttcaaaatttaccaatttatttctaggagtggaaatctcttctcacctagagagataaatcctagattgttaccttgattaggcctatctcatttttttataggaactacaggaatctcataatacctcttccttttccaaatttatttcctgtaattacgtggtccacatactttcatgtatacccaaattatcactgtcatggaaagctaaccacataatttccattctttaaatatttccttggctccccaatgcccacartttaaaagtaatttagagcatgaacagtattccatcatctgacccttgtccagtcttgattctcatttcctgtcacttatggctcatctctaattgtccagtttctccaaactgtatttgtctcttgaacataagactgtatcatgtctctgcctttatgcttctcaattcctgaaatgcctttattaccaatttcttaatctctactcccactttctgcttgcacatggcaaattcttgtgcatcttctaattcttcttttgatctcacttttttcaagaagtctttgctgggattaag

SEQ ID NO: 2927 - DNA, 598 bp, Bovine  MMBT18643
  misc_feature (1)..(32): n is any nucleotide
nnnnnnnnnnnnnnnnnnnnnnnnnnnnnnnncgacagcttgataatagtctgccctggtggaattttctcccccaggacattccttcaactgagtttcaaaacacgagccagcagtgcccagaaactgagacagccttccggtctcattagtgtgctgtttccctgttgttctgctttgctattgtggtttctatgtgtgaatgtgatcacttgttagagtggtctatttatacagttcttctcttttgtttattcccattactcagcaccctagaaatcaagagaagtcagtgcatcrcgcttatgattcctggggcccttggttgctaggtgtgtgtgtgaagacctggagcttgaggaggtgctcagygtctgaaccagcgtcaagctgtttcctccaacccatcctcaggygcacgcaccagtgacactcgttatggctgacgagcgtgtgcatcagaaagaggctcctggagaatgccagagtgttgaggttgaatgggaaccgcacgcacacgtgcacaattgtagtgcttcagaaaggcctggcagggaggagaggcctagaatattaatgaagtgtgggaccgtcaagg

SEQ ID NO: 2928 - DNA, 600 bp, Bovine  MMBT18704
tctgccctcataccacgactagaaatcacaattttccaggagatagtaaccttgatagtagccgatgttaactgacttaattgcgtctcttcgattctcacgragcccttggtttttgctgtgttccggctaaccgtatgccttcacgaacgtcttgttcgagcttttggccgctgcttccagggggtgttgctcttgatccatgtggtagagccccctgggcctcaccgggtggcgagtgtgcttgcagtatactggtggcctgaacctgggcaagcgctttcctgtcccccagggacyttaattctgcgcgctccaacctctcagcgtcttccttcaggatccctgccttcggtgcaatgctataaaggcttttcccacaacagagttgcgggagcatccatgcctggcttctgctaattgttgcgtgattcactttccacaccgcgcctttcctctgaagttgactgtgtgtcttcgtagccgacttcaaatttcctttgaaatgaaagtgattaattgatctattagttcattcatagcrtgctggggaggatacgggagagagggggtgactcacagatcgaggtccaggagaga

SEQ ID NO: 2929 - DNA, 600 bp, Bovine  MMBT18787
gtttctaaagatagcttatgctctcttacgtgaatcaaaataatttgagttgcttccagcttcattcattgagaactccacaaatggaatcttaggggtactttagaaactgcttaatgaatgaaatagatatgcaatagaaaattactgaggaatcctcaaagaggtttgacaccttaataacaaggttctatgaatacattaaagatgctctatacccttatcagctgacttaaagcatgccagtcgggtaatttgttggtgattcttttgtttcactctggatttctccgttgcctyccttaactacatttctaacacagatgacctgatgtgtagccatcaatcgtttttttaaaaaagagtgcactgcatttctaaccatttgttggattattttcaggtgaacaacatatttccttttgttctcaattacatttaagatttggaatattctcattcaccagcaaccttcaagctcactatatctaatgcaataattgcagaactttttatagaaaataagactctcaaaaagagttcatttttatgaaacattgctcataaaaggcaacgtgttaacaaataagctaaatttac

SEQ ID NO: 2930 - DNA, 600 bp, Bovine  MMBT19102
tcattggagtttgagtcrttgagtatgtgctgggtgctgtgtgctgagctcagactacatgggattacaaagctgaataagacatagcttggctccaagaaacttagaccatcatgagtacatccatgtttatctaatgcagaaatggaaataatatggcagactttaaaattaaagccaatattttcttttggagtataattgttttaaaatgttgtgttagtctctggtatacaataaattgaatcagctatatggatacatgtatctcctcactcttggacctcyctcctacccctstatcccaaacatctaggtcaatcatgattcaaaaggacacacatatcccaatgttcattgcagcacwattaacagtagttaatggaagcaacctaaatgtccaatggtagatgaatggataaagaagatgtggtacatatgtacaattactcaaccataaacaggaatgaaattgggtcattggtagagatgtggatagacctagagtctgtcatacagcatgtcataagtcagaaagagaaaagccagcgtttttgttgttgtaaaatggttttatgtttagaatcaattttactatta

SEQ ID NO: 2931 - DNA, 600 bp, Bovine  MMBT19230
attgtttaaaaattaatacttagcaaaattacttcaggataagaataattttttcttatggctgaaataagactttaactggggaaacacttattttcacatgaagataaaagtgagaaagaaacaacattacaatatattgctggattagatcaccgtttcagccttatgtcaaagtatctagagttgagactattttcaaaagttctattctccctccaatagttgatttatttgcaatctccaaagtaatttcatctttaatatctccctatactatcacatcccttgttccttttmcccttacttcctcaataagtggtacttktccagtaattccatttactagtagctccttctttaaatccatatactctgtcttcagccatcactttttctctatgcctgtgtctttaaaaataataaattatccaccttctaaaattatctatggcatctggaattgctgactatccgttcctttaaatgcttagaatcttggtggtggtggtggtttagtcgctaagttgtgtctgactcttgcaaacccacggactgtagcctgccaaactcctctaaccaggctccaagaatactgga

SEQ ID NO: 2932 - DNA, 600 bp, Bovine  MMBT19434
tctgctctaatcgttaaggaaaagggcacattgacctgaagtaaagaatgttcaagttgaaaataaaaattaaatgcctcccttcctgggaygcatgttggccctcctttgatgataagacttcccaggtgccatgttgacttgctgtgttcctgctggtctggttttatttgaaaccttgaagaaatgcatccctgccttgcttaatgttctttgttctgacaagataaaactgtactgaagaccaggcttctctggrgcaatttctcagagtaatctaggaaactgacttctgggctrtattctaccaactatagaaagctattttctattcttattataggtggtttattgatgatttttgttgacattacgaaaggaaaacaaaagygttgccttgcctttttgggaactattgcttttcccacttctttaagtacaagagactattccttctctctcttgcctggatttttctgggctttcttacttcatcttgacatgttattttctttgggtttatcaccggggctcctccccctgctaactattttatgggaggcaggcaaagtcagcacaaaggaaacagaagccagtggt

SEQ ID NO: 2933 - DNA, 600 bp, Bovine  MMBT19815
cttgctctgaagcacagctgggcctctatccatgtggcctgaacgctgagttcatttcctcaggactgcaattcccaagcttgctctgttctagcgtataccacttgcccagtctccttatgaccatcatgcactggcatgaaatgtttagctgggtttcgagggatcatgggtaactctctcggggtacaggttgtctagaggagagcrcaactaaacggrtgcactaaccgcctgaactaactacggataactacgttagcttgtgttacaaaaggacagtagcagcatctacccagkaaagcaagaacatgttcagtactcaatacaagagccaaaatgrtcatacagtgttctaggaataagtgtttacaccaaaatgcttagaatcaagtggaagagaccaggataatatctgtaagacaaagaagaacatgtaatgcatatgctcaattggcatgcagagagattctaataatactggccacagttctttttaaaaaatgagagaggtcaggggttggtgtaaatgaaggaagtttcccaaaggcggtacaacctgaaggccctgagagaggctraaactttctcaaatgtaag

SEQ ID NO: 2934 - DNA, 600 bp, Bovine  MMBT19863
aaaataaaattaaaaaatatacaattaagagtcctgcatgataagttccatcttacatcaccattgcctctctgacttcatctcttaccactctgcactagtcacttagagctccttgctattccttgaatgcaccaaacactctttcatttaaagacctttgcaatgactattctacttggaaagctatgtcccaatatatccctacggctaattctatcacatgaatcaaagctttaataaaaattcatctcaatcaagacaccaactatcttaaactgcacacagtccttgtccatktcttccaattcctttatcctgatctttttaaaatttgcaattatcagctaacatattatgtagcatacttgtttcctatatttatctgtccatctccctccctcttcagttagaatattaataaaaactccagcagggtaggcctgtttagttcactgatacaccctagtgcacaaaataatgccttgaactggtaagctttcgctgaatatatttattacagatgcttaacagtccactaaaaagaataaggaacttatgaaagcagaaatgaccctgtgagaatttcatcaaattatt

SEQ ID NO: 2935 - DNA, 600 bp, Bovine  MMBT20172
ggaggtcagaagcatttctctgtacggtttccctcacctttgtttgtgtgggtgacttagtggcggggaagcagagagattaacttgttatccccatgcagtttggtcagtagctctataggaaggccaataargmggagacagtcccaatcatctgctgagctctatttgcagcataaaggagtaatgagtagaactcttgctattgcacttattccagcaattatgtgtataagaaggatgaggagctgtgggcctaagagagaagggagggggccatggaaatcacacagtgtctcyggggctccccagctgtgtcaggactgaaatatgaatgtcatgcaggttggtgacttccttgtggcatgtacacattatcccacccrtgccacaattaagtcacattcagtagcacttcattattttaattaagcttattgcaagagtaatcatcattgccgtcagtatcaatcatcagtaatttttccgattatggccataagtggtgacagtccatgttgacagtaaatgataatgcctctggcttgaactgacacttcattggactttgcaaggttgctctgaacactcctgggcttg

SEQ ID NO: 2936 - DNA, 600 bp, Bovine  MMBT20878
cggaatcaccttcatgcagaaggccctgcagagtgggaggacggtggggctccatggcctcccctcctccccagctcggcctttcccagtcactcagttaataagggtctgctgtgaggctcccagggaagcggagagagccartgaacccacagacaggccctcagcagacggggacgcgtctcacccaggcccctgcccgccgccatgtgagggtgcaaacgtgcataccccctcacccagggagtgccttctcacaccagagaggtgaaaggtgcacaakgcgctggcattacagasccacgatatatttttttttttttttgcagtataaaaatgtataaaaagttccgaaagtcaaaagctttctcatcaatataggcgccaaaattcctgtggcagcaaaaactgacatgaactgatgtgagtctgtttacatcttaatttatctcacttagtgtgaacagtcaaacgtcttgctacacaacatttggttacagggtactgcccccaaccctgctggagaacttggtggtatacgaaccatactacctttcaataacccagaacattccaaacccagaacacggacgcggaagc

SEQ ID NO: 2937 - DNA, 600 bp, Bovine  MMBT20884
gcatgtttgaaggtcagaacactccaggctttgaagcagccgagatgcttaatttagaactacgcatacacaatcctgacaatggtggaaacatccctgaaccagatgacagcaagttaagtggagaatgaaatgataattaccagaagggaggggaaaacacatacacacacaacacgggaacaaaagccacgcagggccgtttctgagagcttgtgggggagaaacgccccagcggctgctggcaagaggtcacgacactactgatgagccccagccctggaggagcaacaggtgccytatgtcacaaggagccctgccaacgaaaaggggtgccttctgacaaacttcacccagtattcctcttagtccaaaatgattctgcagtgacatacttctcagcctggggataactgctctgtgggtccaagggccaggccgggctgagtgcagtcctggacgcacacccgaagctggcaacgtcaggaacatggtgttcgcctttgctccaaggtccaaggagctgccgacgctaaaaaattcagaggccgagccacaagaccttgtaggttgggatttttttttgtaaaagtatgcccg

SEQ ID NO: 2938 - DNA, 600 bp, Bovine  MMBT21019
gggtacaaagcgctccaaggctaggagtgatgtctagtgccaaccacagtgagaacagtgattgtgtaatgacataagcattcgatggtgatgcttactgacctcagagaggaagagtaggcaactaaaatcatattggcagagtcaagaccgactaggacacatgacaaaagcatgtctctaaataagggcttgctatcgagtcaaacagaagccttatctcrtaggtatttaaagttaggttgataagactaaccggctasagcaaggctaagaaggaaattgatgacttaaatgtgraaacttagataatgtaggaaacagaaatatactaaattttaagagctagaatggcacacaaaggaaraacaaagaaaatgccagagcggtggaatcaagcactgactaaaaaaaagaaaaagaaaaacgaagctggcagctggtaaaaaaaaaacaaaactgcatgaatccagatagaacctacacccacctaatgcatatagttaaaccatgttaagggagagactacaatgaaaaagactccaaaatggcatatacagatacactgtttccaaaagaaactgtgtgtattttaagaat

SEQ ID NO: 2939 - DNA, 601 bp, Bovine  MMBT21137
  misc_feature (1)..(1): n is any nucleotide
nccggaagagtcttcagaccattggaagagccttcagaccattggaattcatctcagggaacaggctgaggtggggtggaggggccagaggcggggagggtaacagggaaatcctacccagagacacatttagttcacgtcaagtttccagcagagggatttaccaggtttaaagcagttttctgtgaatctttgtcaagggagtgtatgtacaaacaaacagggagggttttttttttagtgaaaagttaatcggcttaaagtgtgcaactaaataagcaaagcttacatgaaagtgacycacggagaaaggacctgatggaaagaaagttctaggaaatacaatatggcctctatgttcttttgtagttccacgccataaatattcatggggtggtgttaatggggtccgcagctctatrcaaccacaatagtttttttgtttattctcaggaccatgaactttgaaaccatgaacctaaatttcaggactctgcattcaggcatgtttgcagagcaggagggagaggttcaggctggcagaggacagaggggaggaaaccagaggacctgtgaatcatgcctcctggatcttttggtt

SEQ ID NO: 2940 - DNA, 600 bp, Bovine  MMBT22755
tattgagagtctgggcaggtcgggctgcccttgggcgcaggggttgggagaaggttagactgagtttggaggtgcaaggggaaattggattttgtgcttacattccagtgtgtttactgaccctgtactccacccatcttgcagggaaagaggtccaaaatcctcrtcgctccatccccctgggcatcgtgatcactatctttatcggctttttggcgtattttggtgtctcagcagcactcaccctcatggtgccctactaccagattcaaccccagagccccttgctgcaggctttcytccatgtcgggtggaaccctgcccgatatgtygtggctgttggcaccctctgtgctcttacatccaggtcagtgycacaggtttttaatccacccactgtgggattatcaggggtcgtagtccttgggttgagagacaacaggaaaagacttgtgaccccaggaagacagggaacagaagccctggtctctcctgcttctccacatcctcacatgtttccatttcctgtcccagcctcctgggtaccatgttcaccatgcctcggttgatctacgtaatggcagaggatgggctcctttt

SEQ ID NO: 2941 - DNA, 600 bp, Bovine  MMBT22802
gcaagcttgcctttcttgtagactcaaggctgagacagtgcacccatggacgctgttaacagagccttctagaaaggggagcgcttgctaaccagcccattagcatgagagagaatgaagctgttgttcaatcagtcctgagaaaaatctcagtgggatctcctttaacaaacacctgtaatctggggttacaccaacacacagttaattctttatacagacctttgtcgtgcttttggaagcatcctgtgggggttacatagaaagaaaaattcagctttttattacttaatcacatcrctcagtattagaggttttcattgtctcataaattgctttccaggggtaaggaaagggggtttggaagaaagtttgttattgacttgcctcatttccaattttgtgagctttcaaacaaaaattcttgtgttctctttttatttgttgatttaaaaaaatatgacttttgggcaggcaggattggttcatttccatggccattttgtcctgatatcagtatgctttaagaattatttttcttaagtgtaaatggcatagagagctataaattatccacatgcatttgactatgacagtaat

SEQ ID NO: 2942 - DNA, 601 bp, Bovine  MMBT22815
  misc_feature (1)..(1): n is any nucleotide
naacttgaagggacatgatgctatttaagtagaatctaatcagaaagaagaaaagcttgaaagtaaaaagacggaatgtttcatgtcgttatttgcaaagcaacygaacaaaaggtgagcaagataattaagtgccttgstgctgagtagaatttttcaaagtgggttgattagaggtctttcttaaaaaaaaaaaawttaaacatctaagtctaggaaatctagttgaaacagctaactcagttataaaggtggagaccagtttgggagaaaatcgacagtattgtgtgtatggtggcakatgttcacaatgatgagtttaattgtcagcaaaatcctgatcagttctgaatarttttagcattaatgatattttcctgtgttttaggtttttgaaaaatgggaatccaagcagacttaacatgtgatggcactaaatagattattttccagtgccttggttcctccatttttcagttgatctggataaataggacttgattcttttattttcccttttgcctgaaaaaataccaaaagcgagtattatcagtcttattataaaatgttatttgtaactgccaggcgaaaatgggatgtc

SEQ ID NO: 2943 - DNA, 600 bp, Bovine  MMBT00840
tagtttcgcataacctctttgagctgtctctctagtctcctctagttggtttacctaaacagattgaacgaaaaatttgaattccctgaacaggatatagcagagtggaagacagaatccaccaatgctaatcagagatgaaaaatctgcattgcataatttgtagagcagatacacagttgaaataattgagactgaatgtaaaagctcttgagttaaggcagatcactcactcaccatcctatatccaggtcttcttttctaataatttatcaattaatcatgataacccagatagayattttccataaaaatatcatagattagcaggtctgatcaatgctacatacatacttggccccctgataatctgtgtttcaactggttagctgtgaaaacatggatgaattccttgacttttctgggtctcatttttgttatatatatataaaggaatattatcatttagctcagaaagttgttatgagaatgagtataggaaaagcacttaaaagcatgtagtatgtgtgacatccatgttttggttttacattcacccaatatggatcacattgtcttctgtggaattctgaccaaagc

SEQ ID NO: 2944 - DNA, 600 bp, Bovine  MMBT00905
gagcaattaagccctcgagccacaactactgagccctaacgctgcaactactaaagcctgtgtgcctagagcccgtgctctgcaacaagagaagccaccacagtgagaagcctgcacagctcaatgaaaaacagcccctctccacaactagagaaagcctgagaacagtaacaaagacccagagcagccaaaaattcatgaaaaaaataaattattttttaaaaagatttctttctctgctacttcaacaaaaacaagttcacatgataaaaaggtattgtggraaaaaaaaaaaggtaytgtgaaatgtaaagctaatattggtgggactgttctgaaatcagaatccaggaagggctgtggctttgttcaacagcaataaatctattagtaactaaggctatttagcagcaactctttactcaagactaaccaagtcttgaaagtagtcattagcctagaatcaacaattatgccaggccaactaaaagaaactgattttatctgttctatttattgcccaaaattttaagtgtttgcaacctccagcaaatataaagayacttccttgctttatttggagaataagagagtatgctt

SEQ ID NO: 2945 - DNA, 600 bp, Bovine  MMBT00914
tctttgtgatcccatggcctgtaaccagccaggctcctctgtccatggaattttccaggcaagtatactggagtaggttgccatttcctactccagggtatcttcctgacccagggctgaaaactgggtcttctgcactgtaggcatattctttaccatctgagccaccagggacttttgggaaaataaattcatttggtaaaagtgggggaaggtgttgagctatcttaggggcctagttgagtgagggctgaatgaggactgaagcccacagacagatggttctttgagaagggaaayaagatgaccattaggttgatggtgtaggaaacagggagatccatgaaaatctctgaaaggagttggcatgacaaggatctgggtcarggatgggtcactarcaggaatccagaacttaccaatgacagagaggttaatggtctcactgctctgagggccaaagccattgtcagctgtgcagtagtagttcccagaatgctctgcagycacagagaagctataggaccttgttctccatgaagtagcttctatccttgtgagcaacacatcttcatgaaaaaactggtaccagatgggcga

SEQ ID NO: 2946 - DNA, 598 bp, Bovine  MMBT00919
  misc_feature (1)..(93): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctaaccactggatgaccagcaaagttctgccttattctttcaagtaattaattaattaggctgcaccaagtcatagttatggcaagcaaaacccctcccatcctcattacggcgtgcagatctagttccctaactaggagtgcagtctgggccccctgcattaggagctcagagtcttaaccattagaccacaagggagattccrtgttattgccttattgtttttacacctggttctgtactttattactacctgttgattcaatggatggatgaacaaatgaatgtatacttcaaggatagaagtgtttgggatcagaatcaaactcttacagagagacacaatttaattcagctcaagtcaattttgagtggtgaaaatgtccctggcacttcaccagatgttataggagatccaaaacatatgtcatagtctcttaaaaattttttggacaggcgaagacttatcttcctgaagaaattatacccaagggagaaaaacg

SEQ ID NO: 2947 - DNA, 600 bp, Bovine  MMBT01094
aagaatcaatataaatgtcttgcattaagatttgtgtttgttcatttctggtgtgtacaaaagaaataaaacagtattcccaacagttaatattttaattgctttgttcttttcagtgtattttagaaataaatcactctggtcttatccattaataaaaagttattatgacttcaaatcctcttttggctagattgtgcatacaaataaatatagaatcctttgaaaatctactacatacaagtcatttaaaacagaactgttttcaagacctttctactaagctgtggagaccttttkgttaatttacgaagcctttcctactacagggaaagcagatgaaatagtgacaatcatggttgaactggtggtgaaaggcccagagcctgccaggaactactcccggaatctcaaggtctctctcaagggtcacctccaagtattcaggctactgtgtagcacagtaaaaaggctatagcctgacaggcaaagtgtaatttcaaccctagttcttcttgggtaccaaggagagggggtcaccttaacagcatcaagccaaattgtactgactcttcttgccacatgtttaatgaggacatt

SEQ ID NO: 2948 - DNA, 600 bp, Bovine  MMBT01613
catcaaccacagtgaccaaaatttggtcttggaattacaaagacattagagtgaaatttatgagataggaaatagatatgctgygttgttctactagggtagaaatatgtctcagtataaaatggaggcttggaggagggcattctcatttcttccttgcttgggcaagasagaattcctatgaggacaaattttacctaattcaaaaagcaagcatctttgtttacatcatgtaaagctcatttctggtgatgattgtctctcaccttaccaatgagtaagtaaaagtccaactgcttygctgcttgcactggttgatttactatcaaagaaaatgtaaaatcctcacttttaaaaatgtcaggagaaataccctaggacttttaraagatagaaacacattttattatcacattcttcacttggccattctcatgaacagtactatcaaataaaaagagttcagtcagcaaatagatttcaaaatatatttttaagcataaggagagttcacatctctttaactattttgaacacagcttagtaagtgaatacattattttcacactctcaaagtatataattatgcactgaagacca

SEQ ID NO: 2949 - DNA, 601 bp, Bovine  MMBT01672
  misc_feature (1)..(1): n is any nucleotide
nggagagagaaatatggaaacttacattactgtatgtaaaatagatagccaatgggaggttgcaatacgactcagggaactcaaacatgggctatgtaacaaactagaggtgtgggatggggtagaaggtgggagggggattctatggggaggggaccataatgtatgcctatggctgattgatgttgatgtttagcagaaacaacacaattctgtagagcaattatccttcaataaaaaaataatttaaaaaattaaaaaaaaattttaaagtttaaaactatttggaaatgcttatatrgattcattgctaattttcatatctaaaagtatttaggttttccatcacacaaacatgagaaaatgtgaaatggatatgatttatctatgataaatatatttctataaataaagcttatttcctctgttctattttttctcctttycccaaagacctcacagtgtttcaatttttgaaatctttcctctaaccaggaaaaattaagcagctgctacagataaaatgagcatyaccagcagatattaaaactgtcacctgatggaaaccggggctcaacattaggccttcaagcaataacca

SEQ ID NO: 2950 - DNA, 600 bp, Bovine  MMBT01673
tgatactaggaaagattgaaggcaggaggagaaggggacgacagaggatgagatggctggatggcatcaccaactcaatggacatgtgtttgagtaaaccctgggaattggtgatggagagggaggcctcgcatgctgcagtctatggggaggcaaagagttgtacacgactgatcgactgaactgagctgaactgatgaatgatagaaaaatgaacaaagaarttgaggtttttatrtaagtgcttgtaaatgggatgatgagttcaacctcttaatgtcagatcagcacaatactttytatatagtttgtgttaaatgcatatttgtagatgagattgaaggataaagacgcattatcacaaacatagtagtagaggaaatatggataaaaacaaaagaaggattttactatcattgtatccaaaggtacgtatcgcttggccactctgaaaatgaggaccagtggactagmcaaagattcagtttattcctagaatagaaagaattgagaatgaagatgttcttgtatgtgctttgggtgaaggtcagagagttagatcacagaaccaaagaatattcaggtaaaaagaggtttaaa

SEQ ID NO: 2951 - DNA, 600 bp, Bovine  MMBT01786
tccaatatgactattttgttgagtgagagaaactttttaagagatttaataatacaaagcatttgtaaatggcacatagctaaaagtagataaatcttagctatttttcattgagactaccagaatattttatagtactttaccaaatatagatttggtattgtattgctagctgttttcaaccatagtcattgtaactctttgttaccttcttttcctttgtaaatactgaaactgtgttttctccctttcctgactctcttatatcagttttcccttttgtctgcctagttttagatwtagaaataatatgaagccaagtctcttttrtggaatgctggatatggtgttccttttagttatagaccttaccttwcagtagcrtatgagtgacgttaaaagtgtgctttagttagttttcgctgggtaaatgcaygctcagaggaaacrgtctcaaatctttgttcaaaaagttaaagactaaggtagtctaataaatgttaagcatttatctggaagaaaaatacatttttgagttgaaagtgaagtgaaagtcgcatagtcgtatcctactctttgtgatgccatggactgtatcct

SEQ ID NO: 2952 - DNA, 600 bp, Bovine  MMBT01854
gtgtgtttcactatttactggcgactaccaaaataattatttcctgtgtgggtcactgggagtgaggtaatcccgaagaaaatgttccattgtgcttactgggctgggcagtgcagcagctccagacatttccttaaaggaacagtaattgtgctgaatgatgaatctgatgcatgtaccccttggagggagatccatttcctacttgatactttcaggatcttatgagaggcataaaatgtgactgtacacatgcacagtaacatctgtgggtgcccttatcatgttggttcattaaayagttttatagatgttttagaaggagaatttttacaagacctgagataatgctgtctgcccctatccatgtaaaagcagaaacttacttgtacaagttgaattgatttgcctgtctgtcttgagccactggagggcacgcttcattggcctttgtcttctcagcccacactaatgggcccatcactgaatgcaatgctccctaaccatctgtgggtgaaaggatagcttgccaaggaagtgaattccagggaaaggataactaccccgaaactgatttccttggtaccatgacactgagat

SEQ ID NO: 2953 - DNA, 600 bp, Bovine  MMBT01865
aagtcttgaaaaatacataccaacatggtcatatgtttatctaaaagcagtaggattatgaatgattttctctttctttttaatacctttgtgttttaccatattctttcataataagtatgcataatttctatactcaaaaaatactaaagctacttaaamawtttttttaatttatatgcaaaaaaaagccaactgatttaaaaaattaaaacccatatctatatggatcttatctcgttcatcctcaaacagaagggagacgtttcattattgctgtgtgtagcagggtttctcaaycttggcactattgacatttttggctggataattccttgtcatgggagattatcgggtgccttgtaagatgtttggcagcatcactgacctctactcttgtaatacacatcactccyttcccaccaarttatccaaaaatgtctccagatgtcaactaaaggctagactgccctggttgaaagtcactgctctaaggaaacaggagatctggaattaaaccccatgtttgacacttactagttgggtgatccaacctctctgggcttccatttcctcaagactacattwtcttcaagatag

SEQ ID NO: 2954 - DNA, 552 bp, Bovine  MMBT02249
atgcaacttccaagtttagttgcttttgattgttttgttttcacatgtttgtgttctcttgaggacacagagatactctttgcatatattggaaagtgtttagtggtgatagaaagggtgatgaatacccacttaagccagataaactatcctgaacaatatattattctccttcaaacatttttcattcctatccatgaaagacccagattgaagtatcaggacctagaacgagcaccaatggacatgagagactctgattttctacacacttattacttagaaaggttgattaagtakgttttactcaattaaccacagatgagcccttgtgcaccactagtttgtaatcgccctaattgattctgaggcgagatctctggtcagagtcaagccagctgtaggctttgttagtgattttgatggaatgaccccaggaagcttcctttttacagctttgatatgaaaaatgcccaagaagcttgcccaagcctctctgcttacttaattatatttttgataatttattttaccaatgacttctagccaggc

SEQ ID NO: 2955 - DNA, 600 bp, Bovine  MMBT03109
cagagtaaaatgaacaggaaaaatatatataaactgtatgcatacatgattagggggagacaaaaacaaagaagagaaaatgagctagaaggacagaacatgatggttactaggggaatggttcccagtcaaaaaatcttacaaacagctaacaaggtaatttcatgctaaactggtggctgttgctaaaaaaatctgtatgtaagaaatgccaagatctcagaacagatgatcgtaaaaaaaatcaaaaagataatggttaccaggtttagcctcacaaggccctgacatccctcaagyctagacattactaacccacagctggttttgttaaagccccatgcatacactctcgtccacggctggcacctcttccccgtcttggtggcccaccacgtcgccgactatagtctctgtcccggtctcgattttctttgccttcctcgttggattccgtttggccaccatccttttgtcctgagactcccttcttcttcccgaccatctcccaggaatgctaaagaagaaaagaacattcgtgtcaaatcagtataggttgctaccaggaaatgagagataaaactgttgggacaactgtta

SEQ ID NO: 2956 - DNA, 600 bp, Bovine  MMBT03379
aatgtccattggcagaggaatggatgaagaagatgtgttacatatatcaacagaatgactcagccatagtaaagaaagaaataatgccatttgaagcaatatagatgggcctacagattataatattgagtgaagacagtcagacagtgtaagacaaatatcatatcactcatatatggaacctaatttttaaaatgatacaaatgaacttatttacaaaacaaaatcagactcacagactgtgtcaacaaacttatggttgctaaaagagaaagacggagttggggagggataaattargagtttgggattaacctagaaatactactatatatgaaatagaatatcaatgaggatctattgtatagcacagggaactctactcaatattctgtaataaccctatgggcatagaatctaaacaagaatggatatatgtatatttatagytgaatcactttgctgtatacctgaaactaaaacaacattgtaaatcaactatcctccaatataagacaaaaattaaattaaaaactcaagtaaatccttaagtctccaccagatggtaaagaatccaccttctaagcaggagacaggaga

SEQ ID NO: 2957 - DNA, 600 bp, Bovine  MMBT03516
attggaaaagaccctgatgctgggaaagatagaaggcaagaagagaaggggacgacagaggatgaggtggttggatggcatcatctattcagtggacatgattttgagcaagctctgggagatggtgaaggacagggaaccctgacattatgcagtccatggggtcgcaaagagttggacatgactgagtgactgaacaacaaatataaattcatcggacagtttctctccctcaaggtatctctaagttctaatgtttaaggttagatagagactattgaatgggtgagtctgtcattyctaagtgaaatgaataattattcatctagttcctatctaattgaaaacatcttcaattataatctgctaggttgaaggcacaatgtcctttaaatagatatgatatagtgcctcccctcaagacacttccagtctgaaaacaactgtaaagaaatacttctgaattccttaaaacgtatgaacatctcgtacttctggaagatgcacacagactaaggaggtgctgggaaacctctgaggttttcgattttctctagcacctctgtcaaagcgagcattctgttactgaaagcgtgactg

SEQ ID NO: 2958 - DNA, 600 bp, Bovine  MMBT04286
ttggcagattatgaataatgttttaggttgaacagatgtaagcaatttataatttttcccctttctgaaccagctttgtttggataagtcaactggaaattaaaatttaaagtagaacttcattttttaaaaggaatagtgttttcccacattagactatgtagtcagctcctaaatatggacaagagacagtcaacagggaaactggtcagagtgtgtgactaaaatctggaagatcaccacttagcmttgcatcgcagttccagtttctttcgtctatagaaccacatgtaaaaaatmgttttaggtcattccaaactaaccacacttctattatatcttgaaaagayggtttttagctagtgtaaaaattgcctgtttttctctttggttaaaatactcttcaaagaactagagttctggacatgcagaaagtgctgatgaaatgttaagagaaaaggaagtgaactatccttctggcaaggatttgatttattgtgccaaattatattttaagtaaactatacaaattaaaattatattttgaccttaatatagtcaacttaaattgagacttactggcaatccagtttcaggaaa

SEQ ID NO: 2959 - DNA, 600 bp, Bovine  MMBT04300
agtaatggaggctgtacaaaatgtaattaagggaaagaaaaaggtgcagagaagcataagagaaggcaatggttggagacaaaaattaaaatcaattcattttgatgaattgtgcaataaagaagttgcatatctatatatmtatatatatataatttatagagagtaaggcttgtctttgtcagctcaaccctccttattgatggcatgtcatttattttataaatgaaatcatcttcagcatggtgagaaaagcattttacagatttttccagtcaaaatgttgatttatgttaaggrttacatttttgaaactcattcgaagttaaaaatattgaacttttaaagtaaagcaaatgtataattaagcatttattacctggagtaaattaatgcttttaagctataagaactgcccacacatggatattctgccagctagaccagcaggctcacatattcacactgagctggttcctaccaccttttccccttttccttttttttccagtagaacttagcattggaccatttgtctttctaactgcctcatgcaaatgttcagcctgtattctatccgcaaatccctatttttttctt

SEQ ID NO: 2960 - DNA, 600 bp, Bovine  MMBT04306
tttatttcctttgcatttggctggataatctctattaaagagagagaagaagaaaaatgagtcttctttcaagttcttcctttttcttttttacgggctccccgtaacaactttttcttctaccgtgaacattttatgtctaacaagacatctttccacatgtttgctagatgcaagagctaagctctatccttttcttattcctttacagtattattaatagtaagtattttagttactcttctacctcagaggataattgaatatgtagaaacataaatgacagtttttgtgtctgtrtcttttgtamcttattgtacttgttgatttaatgcaacctaaattagaatcaaccwaggataggattttatgtaggtgaagaaatgatgttttactgtacttgacttttgaatattttaagcattctttttgtactaacctgcaatcacttgatttctaatgctgtttagactgcatataattttaacataaaattaaacttataaaactttgagtgtagagatgactttttggaaatatttatttcactttctctcttataaaagaggatacataaagccataactataaaagctttgc

SEQ ID NO: 2961 - DNA, 598 bp, Bovine  MMBT05000
  misc_feature (1)..(105): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgaaagtgaaaatgctgtagttggggttgtattgggtaaaaattagcttgaaaatagaattgtttcattacagattctgaataataaaagaaaaatagaatgtttaagatactgaagttgaaatcacttaatgataaacctactaagtttataaacagtttcctgcccattgataatgcatggctaagccrtgaaatagctratggatacagtgtttgaacttgcacactttaacagttttgttagtatcttacaatctgtgatgcttggcaaagaaaaaaacatcatrctgattaattacctgtcttgaccttttttaatgtcagcatataattccactgaaggttcttaataaatttcttcaatcgatyacctctacagaacatactttcccttcttccagaacaaatgaacaatgcatgctctaacttgcgtgagaaatgtactgtgcagaatggaggttgcagatctttcttcataagttcccct

SEQ ID NO: 2962 - DNA, 598 bp, Bovine  MMBT05342
  misc_feature (1)..(160): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaatccaaatgaagggaaaagctagacatgtatatgtgacaaatgtcgtatctgcaagggctactgcaccccccaccccacccccaccaaaagtatgcctcctgactacagggtaatgagtagctatctgatcaaayaactaaattattaattcaccttatagtacacgaattggatgctctatcatacaaatattaaaaactgtgcaaattataccaacgtgggaaaatgtttcaagtaaatttaacaataaaacaggcatataaaaatcacacctctgagtaccataaacgatgttcacatatgaataaggacagggaaaaaacatgagtcaagggacaaagatgatgtgttgaggtggcgggatgatagaggatttacacaaggtttaaatcttaaatttaaggtcctcccttcagacaaacacagaacaca

SEQ ID NO: 2963 - DNA, 600 bp, Bovine  MMBT06173
aggtagtgaaagaattagttgtataacagcatgtagagtttcccaaggaaaatggaataccaattgtgattaagatgacaaaacatctaccatgtttcttaatttttggaacagttggtatgcgtggtgtataccatttaaattctagtaaagccgtaaacatgggcaacatatctagtaaaaagaaatactcctttgactcacagtggtattttgattatttttattattatttaatattcaccaagcaaccatgctgagcaaagctctaatataatgtttatcaagtgctgttaagtmctgagataaagaggaccaatctaggattaatgtattttgaaattcagactatctattcatcaaaatgttcggtgaacacatatttctttttttattcttcttttaaaagtttgattattatgagtatatgtttttacagtcagctttttctttagtcaaataagaacctgagtaactgttgcattatattgatgaccatgaacttatgataaacaaagccaaagttggggagctattaaacttgatttggggcttataaagacccttttgaggtcatccaatcttttctcctgtctttag

SEQ ID NO: 2964 - DNA, 600 bp, Bovine  MMBT06531
gatgaaacctcgggttgagcgatcaaccccatccgtttccatcttctctggaaacatttcttcaatcttgtcaaaacacactccctgagtttagagctggggaattcttggcacaatactgagccaaggaagaaaataagaagcagcttaggataagtgacccagaggatggctgggataccatccatgccgggtaggagtggggaaatgctggagatttaggctagacagtgagcaaggtcacagcagtgaaaacaggctgactggggcactcataaagcaagctgaggctaccgtccrgaaaatcaggtcccggcatcagctttcaggatgtctctggtgtctggtcggatgttagcatttttcagtcaaggactgtaagttcgaaggagtgggtggagaacaggagatctctttgatggctggttcctctgaaaacaataaatagcttctggagagaagggcaggcatctgggtgttggcttggccgaagtcagcagcggtttatccacccacagacgacacaaaggtagrgtggaccgaggaagcggaytgtgggctcccggccagtctaatcctgctcccagcagcctggaggag

SEQ ID NO: 2965 - DNA, 600 bp, Bovine  MMBT06623
aaaaaaaaaagaaccagacaagacaacatggcctgagaggctgtgatgcccatcacagtccccagcaatgtgaacaatggagagagcacgtcagcccctgggatcacagagacacagagcggccaccagctgtgtcagagggtctgttctctggggtagcctgcactgttctggagagggtaaatgagcaatggaaggtctcattttttaagaaattcaagtaaggaaaaagcatacagaaattccaggaaagcaacagacccctcagcaaagttcatacaaaaccagagaagagggagyactctggagwgcatgcctgtgtccccctaaacccacgtatgcaagccctaaccccacgctgtggctatatttggagacagacctccaagacagtaattaaggttgaaagaggtcatgggaggggctgatgtgacaggattagtgagggtccttgggcgaacagagccacagcttcctgtatctctttgccaagcagagaggaaaggccctgtgagcacatgcccagatggcccgccgtctccaagccacgaagacagctctctctagaaactgaccacggtggcacctcaatcctgaact

SEQ ID NO: 2966 - DNA, 600 bp, Bovine  MMBT07016
catgcacattgattatatttactgtataacttggggtagaagatctaacagattagaagatgaccatgtgctttggcacaggtttgtaaataagagtcctatcactggtccataaaatgaacatgatgttaccttttctcattttaaattctctggaaattatgcattacacttctgcccactgcttcctcatagtgtgaaataacttaactggaaaagagaatctattaataatcaagcacctggaggtctgcagctaagcagtaaagatgatgtgaaatctgttgatagtgactctgsgttcctgagctgtgaagttaagtttttaataatmtttctaatcaaatggcaacagagttatcactttttcaggctttgtttcatctgaaaacaacagtgaagatttccattcaatcaaataatttccatttgttcaaaaaggtatttactgtgtatactttagtggtggatatcaaaaataaaaacaaatattaattcaagatattatcttacaggcaacatattaagaaattttcatgcataattataggtaaagaagctactctttagaaaggttaagtaacttgcctaagtaataga

SEQ ID NO: 2967 - DNA, 600 bp, Bovine  MMBT07200
gatgagagtgagctggtatcttcagaaagtagcaagaagaaggagctaatccagcaggtgcgggggtctgggaagccttcattctctcacatcctccctctcatgacatcaatgctcccaccgcaacccttgaaaggttgctcgttaagactcccaagaaggtgccaccaaacagacccactgtagtcatttcagaggttgatgctggtctgcaggtggaggttttggaaaaggatcactggctcacgttaaagatttataaacaggcccccagtgtcagtcaaaggcagagtattaagraaagggaaatgctagaatctttgactcctcaaagagagtcggtagcttttctagctctccctcctttctgtctcagcatctgtcctggtaacaaggagagtttggaaattgttttttagcaaatgcattagagggaaggttgaagggaagtgacacattgacaagtgactgagggagcaaacctggagaaggatgcttaaaaaaaaaaggctgctgaaaaggagggctccccagatcccttcaaggtgtgattgcaggtgtgcagttgacccacgtaaactggaagctcaaaggatgcgg

SEQ ID NO: 2968 - DNA, 600 bp, Bovine  MMBT07278
ggaagcaagaatgagcccctgctgccctcctaactggcccagctgacaccatgaggagagcagagggaaaacaactgcagagaagtcaagccagagcctcaagagcatcatgaacctctggatcaaaccatacctgaatcaaaaccatgctgcatttttctattacatgggcccatagtttctattttgattgggttttctgcctgctataactgagagtctaaacagatatcggagttcaccaaatgtgggcagtaactgtttctagggggacaaatatgaaggaacttccattcttcratgtatgtgttttattttatttattatttttatttactctgattaggtgaaactgaaacatactgtcagatgacctcacagcaagaagaagcaaggagcctgatccaagctgcccggtcgtgtgcgactctttgacatctcrtggattgcagcttccaggcaagagtactggagtgggttgccatttccttctccagcggatcttcccgacccagggatcgaacccgggtctccctcactgcaggcagatgctttaccctctgagccgccagggaagccccaatgtatgtgtttcatact

SEQ ID NO: 2969 - DNA, 601 bp, Bovine  MMBT07627
  misc_feature (1)..(1): n is any nucleotide
ngacacatttagttcacgtcaagtttccagcagagggatttaccaggtttaaagcagttttctgtgaatctttgtcaagggagtgtatgtacaaacaaacagggagggttttttttttagtgaaaagttaatcggcttaaagtgtgcaactaaataagcaaagcttacatgaaagtgacycacggagaaaggacctgatggaaagaaagttctaggaaatacaatatggcctctatgttcttttgtagttccacgccataaatattcatggggtggtgttaatggggtccgcagctctatrcaaccacaatagtttttttgtttattctcaggaccatgaactttgaaaccatgaacctaaatttcaggactctgcattcaggcatgtttgcagagcaggagggagaggttcaggctggcagaggacagaggggaggaaaccagaggacctgtgaatcatgcctcctggatcttttggttgagattaaaagagaatctgtttagtatgggaggcctcttgtctccagggtctccagctgctccagcctggggaaatagccttcataggcatggagaacttagttactcaagcatatggtag

SEQ ID NO: 2970 - DNA, 600 bp, Bovine  MMBT08088
aagaacaagtcataatgtgcactacrgaatacgactctgccaggacagacatgaacaagtgtcatttgcaatgatatggatcagtctagagataatcacagcaactgaagtaaatyggaacaagaaaagtaatatcctatcatatccatcgtgtgtggaaatgagcaattgttctcaatgaactcactcacatatgaaatgatcatattgtccaagtaaacaaagttataataaccaaaaagaaaaggcaggttgaaggataaaattagaagactgtaataaaattataccaatgattartgtaaaacatattatcagcataggctgacattactacgagagttgtactaaacactctgtaataacctagttgtaaaaaaaaaaaaacatgagaagatacacgcctggctataaggaaacaagattctgtaccactagagcaaacacagcgttggaagtcaactttactccaatcaaaaacacattatttaggaaaagaagaaataatcagacccgagctttggtggctaataatctcacattccattctaatttgtgatcaggaagcaggactatccctaaaactctggttaccgtagc

SEQ ID NO: 2971 - DNA, 600 bp, Bovine  MMBT08661
gcttttttcatatttatgtatatatggatctttcaaacatttagcatttaactatagatattacrtgagttagaaatgtttctaatcctttactgtaaaaactaagtattcatgtagttagatgaaaagtatgaattgtaattctaatttatttatgaataaaatagcctcaaagtttcttctcatttttatcctgaaaaaaaagcatgttcaaaagcttcatgtccttggtgagcattcatttttatttcaaaataaagtgagaatgtaaagttatatcattaaatttcaatttccccratggaaagaactttggagaaaaaaaaaatcccaatttaaaaactcttaccaccctttactttccacatatctcttttcctaagaagcaactcagcttaaaaggactagtgatagaaatttgcttttgtaaaaatggacagaagatataatacaaataaratgaatgctgaacatttgaatatatttcayaaawcctttatataagccctttccaaaggtttataatggatataattaagaattatttcattctcctagagttctaaggaaggaagctggggtttgagatctggttaccag

SEQ ID NO: 2972 - DNA, 600 bp, Bovine  MMBT08723
caattcatactgaatagaaatgaaatcctcatgaaaatgcttatttacttaaattaacatcattttaaaaaatattgattcttctgtaatccatgaactcctaaaaaggaaggcagatggtcttcaatgcaatttattgattatttgacaaaatatttaaatatttcaaattctagtctaggagctgcagagatagagttgaataagcagagatcatttttctctatatagattacaatctatctacccaaagaaaaaaatgagtaattaattacactaaaatgtgaagttcagtgaggmgataactacatccaacaaccttcatgtagacaaaaataaacctggaagtttaatctcttaaaggttgctcctagtattaataacttttgtatgacataaatattagattgattttctacactggtggaatcattagatagatcaataatatacatgcctcgtgaaggtaatgaatagtccctgaattatggggtaagcatagtgctagttttatagatatataattttatgatgcatttgttagccctctatgctaaagttactttatgtttttgaaacttaaataatttaacttagaag

SEQ ID NO: 2973 - DNA, 600 bp, Bovine  MMBT08727
aagatgaacaaatggactaattcagtgttccatcaattgatatatacaggtttaaatgatcatgaatgctrtctcccatccattatgttcttatatcaccatgaaatccctcagttgcatatataaacatgagtgtctcaccttactgacgtaacacgcacacatacacacctggaaatgcaggtataaatcctgtaaatatttttctgcaggcccttttacggttctatttcaaaactacctttaacacctattacttcaaaatacactaacattaacaattcttwttgggtatagaayatggttcratttttttttcttacagttattaatctcctgatagtttaactccaaatttcaaatgtttaaagaaatcttgctttatactgtcatcagtttttccttttgtatggaaatatataggttttatttctaagagcagcrataacatagtagttggaaacattgcataatgtatattattaagcctgcatttaaatcacttttcagaggcattgaactctcttctctctgatcatcacctccagtagctatgcaagggcaagtagagaaggttatctgaagagatctatgttgatt

SEQ ID NO: 2974 - DNA, 600 bp, Bovine  MMBT08984
ctggccttccagtcaagttgccattttccagtgaatgaccaatcacttaaactcatttggtctcagaatatatattctttcatgatctttaaattgtttttaagtttaggtatatttggtattaagtataagtttcagatatacaacacagtgattcacaatttttaaagattatacttcatttataatattttcaatattggctatattccctgtctgtacagtatatrcttgtagcttatttattttatacatagtagtatatgttttattattttgtacatagtagtttgtacctcrtaatccttttcccctgcctttcctcttcccctcttccatcttcccactggtaaccactagtttgctctctacatctgtgggtttgtttcttttatgttatattcactggttttatttttttagcttccacatatttgcaacaacatggatacacttgaagggtattacgtttagtgatctttccatttccaaaattaaattttggaaagatttttttgagaaatgttagtagtttctttttatcaggaaaaatcagaaaatagggtctcaattaatagtttaatattgtaatccttgtat

SEQ ID NO: 2975 - DNA, 600 bp, Bovine  MMBT09086
catggtttcgataccatgcaaagcaagaacggcttgtatttaaatgtgagaaggtgtagtaccggaggagctgaggatataaactgctcctgaagtgagcttgaacagtattgaatcatttcaaatttacttatgtgataaacacatttagtgtattgactgtacaactggggattgtctgagttaacttccattcaacaaatgtttattaaaggataaacaatataaatgtgctaatttgaagctcccgtagataacactgaaactcagcagtaatcacagcaattgtttagaacttasagtgagaaaaggtgtttttgttttattctgttttttgtggtgagagaagtagtttgtcactgacattgcttcaactcactgactcatagggatattaaaaagtagactcaattttagttagttttattgttttactttcagtagatttgcttaccttagtgcctgtgcctgaatgggccattcctgccaccctggtgttggcacatcactgaaaatatcctgagaagcacaatggagtgaagcgtcatcagaagacagtaaaaactgaaaagcattttgtagaggaactgatggagaggg

SEQ ID NO: 2976 - DNA, 506 bp, Bovine  MMBT09475
actacttagggttgttttgagggtgctgtttgtttctgtttgtcaggcatgtgaataacgcctggcatgcagtaagcacatggtgagtctgtagaagtgaaacaaaccagccgctgccttgttcctgctagtctgagacagcagggagggtcccttcccattccctgaatcctctgatgaagaaatccctgttggaggacgtttcacaactttccatgaattttccagtattgcagttgacactcatgcaaatagcatggaatcaataaatgtttctttaatgaataggtggttgggccrgatcattgtttcccatgggaggaatatgagacggtttcaggcgggaacagagatagatgttttaaatgttaatagttaggtatttgttacagtgtgtgttagaaggaaatattaggtagcacctcagagctgagtactaagaaaattgagtttatttaaagacatattactttggggagagggtgtgggggagggaaggattaaga

SEQ ID NO: 2977 - DNA, 600 bp, Bovine  MMBT10227
ttccctcatggtaaggactagaagaggctgtgcatgtgcagagagcggagactggaatcacgcgagggatacagaatgcttaactgcagccagcctcagctcaacaccctgttcaggccacctgactgagtcttcccagccgttctgtaaggtgttattaatatgattatgcttagtccactgcaggggaaactgaggcagagggagaccatacagcaaggaagagggactgctgagaaaagaatccagtagtttaactatacagactgctttgtatactcaagtatactgctgtttgawgatggatgaatattcrgcagtttgatgagcagtgtcatctaatggttaggagcacagacccatgttagacggcctgggttcgaatctagctcggccgtctgggcagcttgcaagccctctgtgatatggagagaacccccggggatgctgygcagaggactctagtgagacctcaatgcacagtgggcactgtgtaagcagtgggtatttgtgatttcttctggaggctaaaggtgctgggaaggggctgagatgctggataaggaagtggggcaggcctaccctgggtggacggtcctg

SEQ ID NO: 2978 - DNA, 598 bp, Bovine  MMBT10229
  misc_feature (1)..(163): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaatttgcatttcccgtaagacttccccggcgatccagtgctgaagacttcgcctcccaaagcagggaatgtggattccatccctggctggggacttaagatcccacgtgcctcacatccaaaaagaaactgaaygtagacagcagaagcaatattgttaacaaagtcagtaaagactttaaaaatggtcctcatcaaaagagaaatctttaaaacaaatgtgcatttcccygacagctagtgaggccagccatctttggatgtgtcatttcctgtgtggtctctggagagctgcctctttatgttcacggtggtctcttgacttgtttattctcttttcatggatgttctgtgtctcttcagatcctcagtgcctgctgaccaacggcaagctgccgctctgggcgaagcggctggtgagtctgccggggga

SEQ ID NO: 2979 - DNA, 600 bp, Bovine  MMBT10371
gggtgcctgttggtagcctgctaagagaagaatgcttctggcctttgctctagctttgcaccagaatgaatgcattaatgtactttaaaaaaaattttattcagcagcaattattttataaagcttgtacattatgtgaggcttagaaatatctgacttcccgacactccaagctattcaatgcttttcaccaagagtaaaggcatttcctctggaggatctctgtacaagtttatcctgaagactaaatgcttaatscaagtctccacatgcctattagcagcatctgaaatatgaaaygcacagggtcatctatgaagttccccattctaagaagctaaagaataaaagggctcaatatttggagaratctggactcccatatactctgctgatgggaatgtaaaatgtttcagccacttgaaaaagtcaggtagttctgcaaaaagttaaaagcagagttaccatgtgacccaagaattctgttccaagcatatatactcttgaatgtatgcccaagagaaaagaaaacatatgcctacactaaaacttgtatatgaatgcccatagcagcactgttcataacagctaaaaaagtga

SEQ ID NO: 2980 - DNA, 600 bp, Bovine  MMBT11201
aactgattctggaaaagagtaagtattaaagaatgcaattctaggttcttacctttggtggcttaaatggataatcggatgaaaatgtgatatccagaaaaaacacaccaccttcatatacagaacctggtggaccaagtatagtcgatctccattcataaatgttatctcctttaggcccagcactattcaaaagaaattaaaaatcaatgtgtgtatctgtgatctatgaatattagcatcttaaaccagttaagtatcaaaggtaaattagcaacctagaacagtacgagataaatrtaaaagaaataagcctcaaccaacttgtgcagggatgtgtgaataaacacatttgcaaatagttctaacttacagaaaaatcacaagaacraagaaactttatccagaattccactttgctcatttgctttagtcaactccttttctctttctccacccccttctaaattacacgcacacacatgcacacacacacaagggcttttttttctaagccatctgagagaaggtcaatgtatcagtcctttcagaatatttattctcaaataaatatttcagtatcatttcctaaaacaatgt

SEQ ID NO: 2981 - DNA, 598 bp, Bovine  MMBT11311
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnntcagggattgaaaccagttgtcccacttgcaggtggattctttaccaacggagccaccagggaagccccaggatacaagagtgggttcccttctccaggagtctcttgtgttgcaagctgattctttaccagctgagctaccaaggaagccctgttaccaacatatacaagtgtaagtttcatcttccatataatgggaatattaatatttattatatrggattgctatgaagagtaaatgagatagagcagatgcctaggccaatgcccagcccatggtaaacgcccaaagaatgggagcactggtgttagtgttatcatgtccccatgggcatcmtatgtctctagccctttagttttcaccagccatggagacatagtcagtacatcaaaaaatggcatttartagagaacagatataataaaataatgaggcaaagtcaaatttaataaagtctacatagtttaaagtaataaaatgttcctcagggtataataaaataataaaattatagag

SEQ ID NO: 2982 - DNA, 600 bp, Bovine  MMBT11361
cagtatctgaagaactgatccaattaaaagaaagaaaagtactgtagtacaaatgaacacagataaatcctagaattatttttaaaaacacatttggcatgccaaattttttttttttttttggttgttacaactctttttttttttttttctttaatagaaaattatttaattagtatacatgtgttattttaaacagtaatcactaactgaaattaatgttagtttctccaaattatgaggcagtttctctatcctacaatgacattaaaatcaagaatacctggaaaaataaaaatrgaaccttgattgaagacaaagatgcttcagcaataattttcacacaaagcctaattctatgttgtgccccaacctattcttacctgtttctcacaaaagatgttatataaaataatgtaacaatgcacagaaaaaatatgtatctttgtcatattctatgctcacattttagcaatctcaaaaaattaaaaaaacatattccaaattaaatcaagagaaatacttattttacccaagtggtactgtaaagtctagagagtttgttactgacttcaaggaaacagaaaacaactacaaagc

SEQ ID NO: 2983 - DNA, 598 bp, Bovine  MMBT11570
  misc_feature (1)..(121): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatatacttgtctatttccccaacaaaaataggagctcttggaagaaagaatgttgtgtctctttctgaatggagcaacacttgacacactgaagatgcttcgcatttcacagcctcttgatcagaaatgagagaacttggctggaagaggctcatctcatacagttttgatgatrttaattggaggtgaagaaggacttaagcaaatacattagggaaaattacagcttatcagtgaagtgtgcatagtgagagtgggcttgtagggagagacagaaaaaaaaaatgactaattacctaattttcacttcctgtgcaatattccctggttgtttgaccaccaacttctgggaacatcctgtaattagtatatttattctctacccttaatttgtgtctccaagttttccttggctctctcatccctggcttgttgccctaaaatatcccgttgcctgatggaacactgcttag

SEQ ID NO: 2984 - DNA, 600 bp, Bovine  MMBT11591
tgagcgcggggaggaaaatgagtgagtgcttagccgctcccttgtgttatgtaatcccgcctatagtacatccgaagccttagtgcgctgcagttagtttacaaagtctcctcccctggctctaaaatttcttcgggatggcgccgtgatttataaaatgggatggggcggaaaaagcttattttcgtatggttatatcctgccgcggtgggcgccatgtttatcccagggactattttctcyagattcttagcaccttctgaaaaggagggatattgttgatccacctgctttttctgytttcgcaagttgtcctgctttctytcccgtcagacgcgggattccttcaaactgttaataatactgagcgtttctttgcttgtctaggacattttcagctcagaaaaaggtagagctggaaggagtcttgttagacatttagtccaaatttctttttcgagatggaaactgagatacaggtgttctgtctcggaatagccgtcattctattgcagactgtggcccagccctctgcactcctttagacacctcccacctccgcgcaaaaccccacagacgtgcagtttgactttcaaagga

SEQ ID NO: 2985 - DNA, 600 bp, Bovine  MMBT11688
atattattcatgggacttgaagattttacctataattatcatgttgtattgctatatagtatatttacatatatacacatatatgtacacacacacatactgcgtggacaaagaatgaagcctgccatttaattaaacaaaggatgctgtcrccatcagcccagcaaccactgcagccacccaaacrgtgtacctgaggggattcaggatggagaaaagcaggatccaggccctgagagttaaggtgcgtatcaaaggaatgatttcagggagcccagactcttgcatcttcccatatayagaaaygcacaaaattcactaacttcagatgtctggttttctttmattgtaatcttttgatgttctgactacttatttatttattgcaaaaacctgcatatcctggctcctcccttaccttttagaacagttgcccagagctgagaggctgctcctgggattaagtcctaagtaagtccaccaaataaaacacaacttccaacttttagatggtgcaatattttttttttcagttgacaacacacacacacattacagtgaagtttttaaatgcttttttcctttttgtaaggcttctaa

SEQ ID NO: 2986 - DNA, 596 bp, Bovine  MMBT11925
cacagggactgcgggcccgagtcactccgcccgggcgtcccagctgagcggatctccccccggacgcgagcgaggactcaccggcagtccttgagccatatcgcgatcttctcgttgggcacgtttcctgcaggacagagcgaggggacagctcgttaccgaccccaagggaactctgtccacgggggtcaccctggatacccctagggagaatcttactggggacaaaatgcagcctaagccacacgtagcagtgaccacctgaagggaaatgatggcaccggggtgtctgtgttgacrctggagacgccttgccaagcgcgcgcgtttaaaggtcgaaagtgtcccctctcccccctgcctggagcccaggaggtcttccagaactcagagcagtcgcccaaggcgcacgagactttcctccgccagcccgcactcccccgagctccccgcccgccgctgcccggccgggcgcacggacctctccctgcggccgccggcagcttcgttccggagaggtcgtcctcgtcctcgtcctcgtcctcgtcctgcgtcgtcgcttctgtggacaggtcctctgtctccgacgcctgcca

SEQ ID NO: 2987 - DNA, 598 bp, Bovine  MMBT11954
  misc_feature (1)..(26): n is any nucleotide
nnnnnnnnnnnnnnnnnnnnnnnnnncccctcccactkcgaggctcawctccccaggttaacagcacccgtgggaactcagctgctgctggtagggtcacctagagcaaacatggataccaagtcccacagcccagctgcccccagccccaccggaggcccttggggggacagcagcagtcagtgattctgtccacccaagaccgggtcctgctgaatctgggaaggtggttaacttctgtgtcacagcactctgacactcaaggtttacaaacccattctggcagagctgacatgaacrgtctctgtgatttggcttaaggaaagtccagttcctaaaccgagttcaaatcagcaaagccaaaaccaaaggggacaagcagagccccactaagcctctcggagctgcacccctctctcctgctctcctgagcccctaacactcatcacccctcagcgacccgacatcaaggggtaagtttcagatgaagggttggacttgatatgtgagttagcatttgcaaacaactctaaaaatcaatgtatgctcttaacataattttaatttttcatggccacatagtatactgagcaattcc

SEQ ID NO: 2988 - DNA, 600 bp, Bovine  MMBT12008
tttccagtctcactttccttggctcccaggctgtcctgatcttgttcactttgcaacaaagagattctgtttttctattcttgggttccctgacactgcayagaacaaattataattaggaaaccacctgaagggaaggtgacaattcggttgtcagttgtcatggataaaccccacttctatccatgcaagcaaggcaagcctctcaccttcaaaacagatacagtgyggatgctgtygttagctggttcactgccccgagaaggaagcagtcacaaagatgacagcaagtacaacagsggaaaacrtgaacaaacagaggactccctcgccgtgagtaattttactgccggtctgactctaatatggtgtggagtgacgtgaaagccactgcagcaagtggcccttatgaggctaactcggagctgtcatgtcagcgcgctggacacagagataaatgagagctaccgttcaaaagacacaaaacaagcaagcgggtagcttgtggtgggaacacgttaccgctcagctgcagtatgagattttagctcagaatggattaaggagacgttatagctttcttatctttagtcatttgga

SEQ ID NO: 2989 - DNA, 600 bp, Bovine  MMBT12368
ttcttgctgctgttgttgttcaatcactaagttgtgtctgactctgcagcctcatagaccgcagcacatcaggcctccctgtccctcactatctcctggagtttacccaagttcataatttcttaagccatccttactctgcactggtctgagaatagactttggctctcctcatttcatgaattttcagttgatgttagttacagccactgttgggcagtctccaaatagccccttactttgattgtatttttctttacattgaaaratatatatgtttagtggaagaggttgttaaayagaacttttctttatattatgaattaaaatcttagaaccactcccttacttggaatatatgctayagwctccagacagcaaattaagaagcttccaaaatatcctcatccatgctaayttaacyagcagctatgactgaagatgaactgagagtggaatttaatttttggcaggagtatcccaaagcagccacgctatctgccgcatccaacagtcttggcatgggatcaaggtaattctttctgagggcaagtctttaagatcacagtctcttaaaacgagtactctcaaacatcattg

SEQ ID NO: 2990 - DNA, 602 bp, Bovine  MMBT12387
  misc_feature (1)..(2): n is any nucleotide
nnacctttacaaaatgaactctactttttctttcttataaattctgaagttcaacacacgcaatttttatattctatcaatgtccaaatctaatttaattagcacagaaatacttgttcacaccaaagtattataatagacactctgagaaattaggttctgttggctcctattcatttaaaatgatcaacaaggcttttagaaggattaagagaaatgatgtatgtaaatcatctagcactgtgtctggcacaggctggtgttcagtaaacacaatacgcctaccccctttaaaagaaagraagaaagaaaatgatcaacatgggtgtgtatgtgagtgtagggaacatcttctattataaagaaaagcaatactgagcctttacattttactctgatggaaacatatcagtgtatcatgattcatggagaaaacagttccagaaagtagagagagagaggtggatcctkagtaacagctctgatttatttcaaggaaaccttggacttactctgggcatctttctctccaaattcaactgattaataggtgtggttaatgctacctcttaaatctctcttgaaactgtcacttgtattcc

SEQ ID NO: 2991 - DNA, 520 bp, Bovine  MMBT12803
ggtagtccctttgttctggtcaacaccaatctcctgatgtccctcctcagttcccaggtgcccctgccctcccggagagctgccctgagcaaatgaccactgtcaccttcctgctacacaccagccatccacgggcgagtcctgtcaatctcagcatccacgggcgagtcctgtcaatctcagctccggggagcatctgtacccaccccattctccactaccccacctccatccccttggtccaggccacacatcccctccagcctcctaactctctccggccttcagccctgtgtactyggcctgttctacccacagcaaccacaccagttttctccaaattccaatctaccttcaaacatttagaaacagaacttaccatttaagagtgcattggatatttgggagaacggcattgaaacatgtaaaatatcatgtatgaaatgagatgccagtccaggttcaatgcacgatactggatgcttggggctagtgcactgggacgacccagagggatggt

SEQ ID NO: 2992 - DNA, 600 bp, Bovine  MMBT13234
gaccttgattaaacctaagcaagtgttcaaggtaagataactaatatgtaaatacatttatgtctctaatggaaatggttggttactaggtcttcaaagtcagtgttagtccaagtagcctctgtactggaagagcttcttatttacaatcgtgtctatgcaaatcctgcccaactttctcaaacatttttcacaaattttctgcaaatcacacagcaagaaataatcactgctttatgtaatcaagtacttcatgattatcacttacagtcttgtattctattgggatcaatcttgaartacatcagtattctaaaatctcactttctaaagagcagttcctaaatgttttttcatgcctaacatttctttcaaaggatatgaaagggatctaaatacatatttcaagataacccatatatacatatatttccttttcagttcctaattacatattctcttaaactagtctattgcatctctttctaagctctgaaatatgtcattttccatcctttctctgccttcctctaccatatgtttattctctcattttctcccttcttttaattatgagtgaacccagttcagccactcaat

SEQ ID NO: 2993 - DNA, 600 bp, Bovine  MMBT13808
taattgcaagttcaaatgttattgtctttcttcactttaggtcttagtacccacagtgtccatggttggaaagcatttgggagcaagaaaggatcatccaggcttgaaggctaaagagaatgatgaaaactgtggccccaccactacagtttttgttggcaacatttctgagaaagcctcagacatgcttataagacagctccttgctgtaagttaaactgtttatttttcattaaaaaacttttttgttgttaatttcaggcttaagaaaaatcagagaagactgaattattgtctckyttatattttgaaaagtttcaatcctgcaaaaaagttgaatagtgaacacctttgcaacacattttgccacatttgttttctttctctctctccacacacacgcctctcagtttttttctgaatagtttgggaataagttgtggctttacatttcacctctgaatacttcttatatctcctatgaccaagatacttgcctgcatttttcacacttaggaaatttaaggctgattcagtattgttaattaaaatacatacagctcatatttttaccaacagtttctataataggtgtttttt

SEQ ID NO: 2994 - DNA, 600 bp, Bovine  MMBT14203
ccagtgatcgaacccttgtgtcctgcattggcaggcagattcctttacccctgtgccacctaggaagcccctttttatttattattatcaccgttgtcacatcagctctccatggcacacattctcaccagcacggggttagcggctggggcagcatcttgcctttggtcccattgctccctcgctctctcttctccctcccaccctcctacaaggcaccctgctcgcattcagtacctggtctgcctccttggaactgctstcctctgtgtctctggaccccttgactgaaggagccartgcccacctgccagtccctagaagcctggatagggttctcgccacctcttggttccgagggcatgaagtccggccagaagccatgatcttctctcccgagggcctcccagggcctggccacactggccgggagacgctggacacccagggcagcctgatcwtcagaaacgtgacgactctagatgcgggcagctacatggtggtactggaaaccagcaggggacgcaggagtgcgacggagcagataccgatcaagggtaatttcacgcccccacccctccctccatggcagggcgggag

SEQ ID NO: 2995 - DNA, 598 bp, Bovine  MMBT14212
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnncctaaataattaaataaaacccatatcagactctgtccttctcttgtcaaatactttctcggcgctctaggatccatgggagaaagtattcattcctcagtctgattacccaagctctttttgatctgaaaacctgccaaccactcctgcctcactcaagtccctgtttcttatttcagttctaaaagacattctccctacagagagtcaggagcmgggttgatgagaagggaacaaatgtttctcaagagaaggagctttttgttattgcttttgctcttgtttttgtttttagtgattgaaagttatctaaacacaatgtcagaagctgttcttgtcattctttctccttcctgggcattttatggcgactctggttctctaaaaataaccttcttttctcttttttctcctccccttttctctctctcccatccctcgccctttctctgtaatacagtcttctctccccccactccactacatctgcttcagaattcttagagcacagaag

SEQ ID NO: 2996 - DNA, 598 bp, Bovine  MMBT14605
  misc_feature (1)..(23): n is any nucleotide
nnnnnnnnnnnnnnnnnnnnnnntaaaatgaggataacaatccttatgcttgatacaggtttgtgaagatgaactatggttatagtttaccaaacacttcttcatatgttaaattaggaaaatattagaaatccacaagaattaagagacttctgggctcacataaactctcttgtggatgaagaaggagttaacctgcctggcagtgcacaggggtctgatgggtctggtcagccaatataagcagatggctgtgatgtcattcttgtaacatgattccttgctggggtgcaccggtgsggcatattggagcctcacagaggagcccctctctagcctgcccacatagttcaatttactctcaataaaaatgcaataaaaggctcacttgccttcagactgttgaatgcttgtgactccagattatttggaatagaaatcctgactgacaggatttgggagaagaagatggatgaaatatccttaaagcaaaaaagcaggaaatgaaggaaataaagtggttgtattttaccaaactggatggtagttcaaagaccctgcaagattttggaagtgtataagccaggrctaaaataat

SEQ ID NO: 2997 - DNA, 600 bp, Bovine  MMBT14985
caacagcatctgtttgtatgaccataagattggtttatgaaacacttactagatatcggacactatacttagttcttgatgttcatcattttgtgtaatgtttacagcaatctagtgaaataaatatgctcttgttaactgatagtgttcaaatgtactagtttttctaggattgcactgctagtacaaattggaatttgaactcatcaggctacctccagacaaccattttatacgacttccccatcatcttccgactgtatgatcaactgcatattttactgttttatgcaaaaatgrmaagaaatctgttaaaagtttgtctgtgttgctaatcacagataaaatgatctggtttcacagggctctcatgacaaataacctggatagactccttacctctttagtttgagagactatcaatggcatcccactgcagtagggctaaatcccataaaaaggcaacacagaggcctgttttatgtctcctttaaggaytccacgatatgagactatctccatgagagaaatgataaaagtaasgcaatattaccaagtaaactgccaggacacccttcatcacaaaacaaagactaaggc

SEQ ID NO: 2998 - DNA, 600 bp, Bovine  MMBT15976
aagaagacaattacaaacctttgtaatctgatgctgtttggtgattattgctcatatgttagaaactcaaaattcttacgctgtattagtctattactcccttacttctcctgtttataatacataacattttttgagaaaaggaaagtttggttttttaaataggttgatggggaaattactcaaaggaaacctaaagttaaaacaaaaattactcaaagatttctttttcccaacctcaaggtttaaacatttttctcctcttagaaaaataatgtttgaattaatttaaaactgtcyaaaatggtttatgtattagtccagtttcctattgtactaggatgatttttaacatccttcctaagttacaccactgatgttcatctttaagatastaataaactagtgtcaactagaaaggacttccctgtagctcaaacagtaaagaatctgcctgtgaagcaggagaccagggtttgatccctgggttgggaactgcaatctgctccagtattcttgcctggagaattccatggacagagaagcctggcaggttacagtccgtggagtcgcaaagagtcgcacacgactgagtgactg

SEQ ID NO: 2999 - DNA, 600 bp, Bovine  MMBT16486
tgggaaaaatggcagcattactgtacactgaagctctcaartctggctttggtatccaaataaagaaaaaatgagcttttcctcttttctctggttaggatgaggcaatatttagtactagaagttttgcatgtcttaattacragaaaatggcaaaacaaggccattgtgtgaacataattgacactaataatttatcggtttagcaggaatttatttaataaataccactttcttgttgattaagtttcattgcatgcattacaaaggatctcagatttcagagtatttataactgcyaccacctttctgatgatagtagcaatagttgataattactggatatttactctctaccagccatagcattacccctccatgtgcaacacacatttaatcctcaragccatcttatgagaaagatactatcgttaactccatttaacaaggcaataaacttgagagagatgtaasgtgacttattcaaggtcacatgggtaggatcttctggtagggcatgataccagaattttaaacattgttattactccccttcccgtacaagtgatggtacaaacaagaggcaggaaatttgggctt

SEQ ID NO: 3000 - DNA, 600 bp, Bovine  MMBT16657
gtagtgggagtagagcagagtcaaaataatgtttacttttaaaagcaaggagctgaggctatctgaaggctgaaggcaaaaagtccaggaaagtgctggatttcctaaataaaggggatacactttgccagctaaaccaagtttgtaagaacagcagggtaaggctaatcagacaagcttaagaatatgcaggaagccccaagaacctgctcatttaataaaccaactctgtgatgtgacatcagatggccccaagaccatacttgaaggaaatccaatttataagagaggcacactacygtcttgcaaaaaaatacctgtagaagtttggtttctttcttattgagcacccatcgactatccttgatctagattcttgacccacaaagcctaaaatatttagtatttgtccctttacagaatcagtctgttgattcctgccttagcatcttgatgaagaagtaacttttattgcccagaccagagagccacaggcagattcacagaaaatggtgtgttcgggtacatcgagatttggcatctgacttcttaacaatgtgattgctgcaagatggtccaatgctttttattttgaacagg

SEQ ID NO: 3001 - DNA, 600 bp, Bovine  MMBT17262
gccattgccttctctgaaaccactcattaggaagcagataaaaatgttcaagtggagaagagtttgagaaaaggagtgaaggatgtatgaagggttataaattgttgcaactggacatcaaacagttgcaactggcacatcaaacatcaactggcacaccaaccaggcgcctacctcctgagggccttttggggggcaatgagagcatcctgatcttgggcaggttataaaacctggtctcaaggtctcctctgcaaaaggcaagttgtaaaaggaaatttccaaagtcttcctgctttyaaaaatgctaggattttctaaagggtgaaataaatgctgtattaaaaatagatgttcatggtttccaaatttggtcttatatctttaaaagagtacatagtaagctgtggagggttttctaaaaagagaagagagacaacaaagctattaatatgatgaagakcaaaagacaggcaccatrgaacacatcaccaccttcctttaaccttagttttaggagagggatctgagactcactggtcttattgtacagtccaaggaggactgtgcatggctggtctttaaaaatggagaggaggg

SEQ ID NO: 3002 - DNA, 600 bp, Bovine  MMBT17409
cttcatggagtcaaaggacttggttttagttaagaaggggtacaaagcgctccaaggctaggagtgatgtctagtgccaaccacagtgagaacagtgattgtgtaatgacataagcattcgatggtgatgcttactgacctcagagaggaagagtaggcaactaaaatcatattggcagagtcaagaccgactaggacacatgacaaaagcatgtctctaaataagggcttgctatcgagtcaaacagaagccttatctcrtaggtatttaaagttaggttgataagactaaccggctasagcaaggctaagaaggaaattgatgacttaaatgtgraaacttagataatgtaggaaacagaaatatactaaattttaagagctagaatggcacacaaaggaaraacaaagaaaatgccagagcggtggaatcaagcactgactaaaaaaaagaaaaagaaaaacgaagctggcagctggtaaaaaaaaaacaaaactgcatgaatccagatagaacctacacccacctaatgcatatagttaaaccatgttaagggagagactacaatgaaaaagactccaaaatggcatatacagata

SEQ ID NO: 3003 - DNA, 600 bp, Bovine  MMBT18398
ttaaattttaagaatgtcagaactcctcaaaagtaaaaggtaatgtgtaaatccatatatcatattcatttcaaccaccatttgatagcatgtgttaggctcwacagaatccagaaagaaaaagacargtacattgatcttaaagagctaggggagctaataatgtaagcacatgaatattaaarggattgttttatttaagaataagagtatgtataaaatatagctattgcacagaaaagtgctaattctcataggaagctaaggaaagtgcttcacagaaataaattctcctgtgcrcttttgaaagatgaatttgaatatttgtcagaaaaggaatagaaaggaaagtaaaagaaataccaggcagagagagcacataaaagcttttaaagatacagagacttactcaattaaaatccataacttttcgctaaagaacattttgaaattagattacatatgtgccaaaacaggaaaatatcataattctartaagtctcatttcaccagattgcttaatttatttgcacattggtattatggagtccctttgaaaaatatttacacagaggcattgtaattggccagcagtaagaa

SEQ ID NO: 3004 - DNA, 600 bp, Bovine  MMBT18621
caaaagtgaaaccctttgagtctcagcatttgtgcattctaccaactcagagatctaaattatctcagctggccccagtgatcagacacagataagtagctgatgccaagagcccagagaaaatcaaaatacacacacaccaaatgaaatctcctatgcagtatcaataaaacactttgcatctgttgaaaagacaggatgaatcagttgacagcatcatcagtatctcagcctgtcccattccttctctcaaatagtgtggagagtggggttgaaaaggggcccattttgagggctcaytgtgtctgggtgttctgggaggaccctctaagagacagcagagctagatttcatccatttaaaggccacttattattttaaaaattacttcgtgtatatggccaaatagttcttctcacagcttcctagtcagcactgaaggtgtcttaacaataagtaagaataaagcatggcataataattttaaaaaacctattttataagcacagatttttatggctcagtcataaatctctatcacatattttmattgctttatttatacttccttttctgtggaatgaacaaaataataaataa

SEQ ID NO: 3005 - DNA, 598 bp, Bovine  MMBT19101
  misc_feature (1)..(44): n is any nucleotide
nnnnnnnnnnnnnnnnnnnnnnnnnnnnnnnnnnnnnnnnnnnntttattttgattttccttggttgtggtattttcttttatttttgttgaaatgaggaagtttcttttacagactacagaggaagtcttccctctgtaatttgaaaggtctgctacacttcttggttgactaagtcactgtcatattcaaagcatcttaattgaatatctatttattattgtaaataataaatcataatttaataatgaaatgataaaatcataataaaatcaataatgacaataggcttgcttgacrtgtttatcccccaccccctgcagtgacatgggaacttcacgatgttctcttttcactcttatattttctgtttagtgcacccttgmcccttacatggggcttcccaggtggcattagtggtaaagaatccgcctgaaagtgcaggagacacaggagacttgagttcgatccctggaccagtaaggttcccctggaggaggacatggcaacccactccaatattcttgcctggagaaccccatggacagagaagcctggcaggctacagtccataggctcacaaagagtcagacatgac

SEQ ID NO: 3006 - DNA, 600 bp, Bovine  MMBT19401
aaagaatccacctgcaatgcaggagctacaggagacagaggttccatcctcagaaagattccctggagaaagaaatggcaacccactccagtattcttgcctggagaatcccatgaacctggtgggctgcagttcatagggttgcaaaggatcggacatgactgaagcaacttagcatgcaagtatgttaataataatattaatgtaaatattaaatctgacatgagyatcatcctgaagtagttcaccagagcatattaagatcatggatgttgagagctgargtgaagtgtaacctgkgttaaattgttctgtaagcstcaatttcttcacccataaaatatgttaagaatagctactatcttacagcrttgagaaaattaaatggtatcataaagccatacactcagttcagtggtgatattaagctctcaaagtrtttagttattattaatattaccatcaataattatttctgccaattctctctttgactgaaaaactatcaggcatatcctctaaaaggagatggacagaaatcatctgttggaagagttaacaatagaaaacctataattgttggcagggactctattttaa

SEQ ID NO: 3007 - DNA, 600 bp, Bovine  MMBT19437
ggggtgtagtatgtctggtacaaaagggaatgaaaaatgtcaagaaaaatacctaatgaggaagctgcaggatttctgtgacagtttggttgaagcattggagggaaaaaatgtcaaaggcttctagcttgagaggctaaaaaaaataataataaaataaagtgacagtctgaagggttcattttagagaaaaaggcaggtttgatttccaggttcagctgcgctaagtctgtacagttggcagactgggcacacggatgaaggcaggtctgtgggtagggggctggggtgggactcttrcagagagtttctgagctcccccaggagtgagctggtagaaggtgaggcctgagcataaagagatgcccacaggactcagagaaagtggagcaaagagcaggcataaaatagtttggagggcagtcaggccagcagttartggcagcaccagacatgagggcggggtgtgctgaggccacagctggcccccctgtaggcccagatctttgggccgccatgaccacagctcaggctccacagcccacccccattccctggcccttgctgtccccctcctgctcctcctcaccccacttgggt

SEQ ID NO: 3008 - DNA, 600 bp, Bovine  MMBT19441
aaaaaaataataataaaataaagtgacagtctgaagggttcattttagagaaaaaggcaggtttgatttccaggttcagctgcgctaagtctgtacagttggcagactgggcacacggatgaaggcaggtctgtgggtagggggctggggtgggactcttrcagagagtttctgagctcccccaggagtgagctggtagaaggtgaggcctgagcataaagagatgcccacaggactcagagaaagtggagcaaagagcaggcataaaatagtttggagggcagtcaggccagcagttartggcagcaccagacatgagggcggggtgtgctgaggccacagctggcccccctgtaggcccagatctttgggccgccatgaccacagctcaggctccacagcccacccccattccctggcccttgctgtccccctcctgctcctcctcaccccacttgggtccatctactgctctttctcctctgctgaccaatcaatgccctttgtaccacttggtctttcctgggcrtggcctcctacccacagtgccttccccaggccccttctccccaaaccagagcctagaagttctgctacccc

SEQ ID NO: 3009 - DNA, 548 bp, Bovine  MMBT19539
gagtagttttttccctatttcatcaaataggcactgaacactcctgataatatactgtgctcattaaggtttatttgggggcttgctgagtttgccgttggttaactgcactgtttggcttaactgtcaggctgtggagcaaggggtcatccctttaatctctcccctgttgctcttcttagcaatatgctacctgtaatggtactgggctccatgtgccttgytctggtccaagagttagttctagttagcattctttttcttgcaaagaccagaaatgtattcaaaccagtkcaagtrttaaaaggcttcatgagagaatataatgacttctcttggacataaaatataggaagtacgaatcatctcagaagaaccagaaaattgtcatttagttactcctattgtcccygtgaaggtgtcatatctttgtgaatggaggtgtaatctgttctgcttttcctgtaggctctttctgtgtgtacttagaatgcacatatgcacgctcagtcacttcagtcatgtccaactctttgcaaccgtatgga

SEQ ID NO: 3010 - DNA, 600 bp, Bovine  MMBT19819
aggctgatttcactcttcgttagtggtggcacagactgtaaaatatttatgttcatattctaaatatgtattcctggagtaaataaataatttactgttcaggttataaattatttacttagttattctaaatatatgtatatactatttgcattttgctggaagcaaaacggtagactgatgrtctttaaggggtcctaaaagaaaaaataaataaatcaagacttaagctacaagaggaagtgttctattaaagagawagagagagcagaagatagccccaaatacattgccttyctygtagaaaatatcgattttatctgataaccccagtgcccaacatgaattttgtggattttgtttgaaatttttaagttgggcttctggattagaaaattcgatattacaaaaaacttttttaaaaattactttaattccttaaggcttgctgtgacttcaaagcaataggtaagatattgtcctgttcgggttgggggcaccatctaacgggctttggggccggttcattcattggaatcactctgtcaaagatttcagatccccagaaatgactcggagaaaagcttcttcttgaataac

SEQ ID NO: 3011 - DNA, 571 bp, Bovine  MMBT19824
ccttcaggggatcttcccaacccaaggatcgaacccaggtctcccgcatttcaggcggatttatcatccgggccaccagggaagtccaaaaatacaggagtgggtagcctatcccttcttcccgaccccagactcaagctagggtctcctgtattgcaggcagattctttaccagctgagccaccagggaagcccacaaataaacatcarttcttgaacaggctattgagagccataattcccaccatgtaacatcattccatgtaacagaataattwaaaaagtcaattcctcaagtcyaaacccgagttagttggtcccttggccacaatacggagatgaggactcaagagcaattcctttgactacgagtagggggcgagcgagtgctgtcccaagccagaagaatgggtgtcccaggctggcccttctggcatcattagggttatttgttaggccaataagtgtttgcaaagtaacttaatgtccaataggtaaacaacaactcttacccataactctctgtctttggtagagagggcaaatgtcgcacatttaggaaatcaagaaa

SEQ ID NO: 3012 - DNA, 600 bp, Bovine  MMBT19827
ttaatctccagttcacaggaaaggaaactgaagcgtggagacccagcaggaagaggtggcacagaacctcagaccttttgctttcaacagatctttttgaaagagaaagggaagggggaaagcaaagctgactgacttgtgaagcagaggtgttaagaaacctgggtgccaaccccaaggctcccccggaactgcggtgatgagctgctgacggcagaaagcccctttctgagaggcaggaatagggcccaaagcaggggggcccaggaagcccacctattatcctcctcctccaaggaytgcatcctcccttaaggaaggtaaccgtcctgtgtacatttcaaggaggaaagaaaaaraaaaaaaaacaaaactgtttcctttggaaactaaacactggctctgccaatccaacttcactgaggtcatttgagaactgaggagttcaaaggttctctacagcttcgatttactttggcataagatttaacagaaaaagaactaaaggagaatttatatggcccaggctgttttccaaatcgcaaactgctaaagttatttagaatttactttaacttgcaatcacatgtaaagtggctc

SEQ ID NO: 3013 - DNA, 600 bp, Bovine  MMBT19841
atggactgtagcccatcaggctcctctgtccatgaaattctctaggtaagaatactggagtgggttactgagccattcccttctccaggggatcttatcaacccagagattgaacttgagtctcctgcattgcaggcaaattctatgtctaccatctgagccaccagggaagcccacyggaaaatgagtcatgatcatatatgcagtcgtcactcaaccccccctcctcttcaattacctgctgactctggacttagctccatgaaaactgtgaagtcagtcaatttttttaatgtgttmttccactccccttttcaaccaccattgyccctaytctyattcttttctcatatcaggataccttgtgagtctctaggtattcagtttcatctccatctcccatcttgtgcttccttcactktattctccctgctgttgcatgtgaaagatattattaggtgataygtaaatatcagaaattgttatcctttctaaggaaaaaaaaaaactctactggtggacttacatttatataaagtagactagcagatgataattttggcagcaagcaatattacacgtgtctcttatccaaacaga

SEQ ID NO: 3014 - DNA, 600 bp, Bovine  MMBT19855
ggagggggagctcctgcctgggttttttctacaccctacttgcttgctctgctcaagccaccaactgtagacagcaccagtcctgggcaaagaccaggcagaaagggtcatgactttagatgcaattataaataaaaattcttacaccaaacctgaattttagcaaagacaagaatccacagagtatgatgtagtcatagaaaatgaaaaacacatcttgcccagagataacgtagatcctcgctgccttctacataaaccaatgataactgataagagatttagcatttcctcagactsaggtacatatagaggtacatctcctcacagaartgctatcaagcccagggttcggatcagcttggaaccacctcaatcataccatgttcctgtacgtgctcctggcttgtgygtcatgggtcttggaaagccattctgccccgatgaagataatcagtgggtctacccaggacaatcacacrgcagtctgtgctgagattgagaaagaactcatggctgacaacgttacatacaaggtaagtctgggtcttcatcaaatatcactttactctcagtggccctctgtgtttctaaccaact

SEQ ID NO: 3015 - DNA, 600 bp, Bovine  MMBT19856
agcaaagtgaagaactcaaaaggataagttgacaattccccccaaagcaacaaattccatcagacctatgtttggtgccttccaacccataggacaattgtgacagtgaaagcattccttggccctgtggccatccacactctgaagatatgtcaagagcctaactgggcaagtgcaccctgagccagatctctgcaccagggttcttcagcacgggagtttctagagcagtgctggttgtatgtgctgctttggacgtgctactgccatcatcatttctgtgcacagcagacctactckgagcacgctccaatgttacctgtaaccagattttggccaaactttaaagagaacaaccaataagaaaaataacaccatttatattcaagtcaatatagtcagagatgggaaacagcagtaaaaagctattcaatgtttccactcacatatgaattggtgaggtaacacatggcttctagggttggggatatgggatctttcttctgcagtgcctctaaatgtgatggaactacaagctgggtaggaattactacaattcaaacaagctaataaagttttacatacaactcttttcagcaa

SEQ ID NO: 3016 - DNA, 600 bp, Bovine  MMBT20734
tttgccttgtataacatttctcatgtttccataaaccatagtttaatatccttttggaagattaaaactagaagtcatttctagtgctaacaaatactttgattgagaggtataactgttctattgggtctcacaactyggcagctggtttcttcaattacactttttaagtagaacaaaactctgaaagcaagcaaacccttgactctgagtcctgcagtgggattggacatgctgtgctatctccccaaggcacatttccttaagcaaaagtgtgtctttgtagatggttacgtctgkttacttacaacatcatraacaattacattctcttttctggttcctataggccagctatctaaaattaagttaaaatatacacatttttgtaaagaaaacagacttgatttaaatagatcacgacaagtaatcattctttctgaaaaacatgctgcagtcggcatagtttcagtgaaacctcagcaagggtgtttcaagtgtcatgattttagttttactgaatttgaattgaatttatatatatatatatatatatatatatatatatatataaatgaatatatatatatatgaatatat

SEQ ID NO: 3017 - DNA, 600 bp, Bovine  MMBT20750
taataattgaaatctttttctcttattcttattcaattgagctctgtgtttgttatctgcagcatactaaaggtaggatctttctaattatgaggccagtatttctgtactattttcctcattgtttttccaastgtgccatgatagaaagtgttgacagaagatggagcaaagcmgagtccagtttatggctcagtggaattgcattatagcagtaatttctcatattggaatgtaaaagcaaagtatgactcagaatggactgagaagcagctgtctagcacagggaactcagcttgrtgctctgtgatgacctagagggttgggattggtggggagggagggaggctcaagagagaattgatgtatgtatacatatagcttattcatgatgttgtacagcagaaactaacacaacattgtaaagcaattattctccaattaaaaaaattaaaaaagaatattccaatagaaaaatgagctgagtaactttaatactgcatgtcagtatatattgtccttgtgactgtagacatcagtgggcaggtggtaggtaagaacacagtctctggagtgggcctgcctgactttgcatctggc

SEQ ID NO: 3018 - DNA, 600 bp, Bovine  MMBT21107
ggcagacgatggagtactcgaaaccccagccctgggacatcagcaaagagcgctgagaagcccaacaccttgagtataagcaacaccaagaaaaagaagaaaatccttatgagggtagagtgttacttgtttattaagcatccaacccagtcatctgggaccactgtataatctacataaccataaactattttaggtcatttggattggggacagggtgagatgtaaaacaaataaaatacaagagcttaccaagtgcccactggatgccaagcccagtactaggaactgagtcatcaycagcaaaaagtcagggtccacagagggacacagagatgctaacaaacagtgagatctgagtaagagtcattgtcacgctgtctgcaaagtgctgtgggagtagagagagggaaaatagaagactgggagttaggcagggatggctccacagagaaggtgagaggtgggtcttaaaggacatataggattcaccaggcagacagtgcaggggaacgtctstctggcacagggggccctgagttcaggcttcaggttggagcaygggctctgtggtgggcaaagaaaggatagtaaggaaca

SEQ ID NO: 3019 - DNA, 600 bp, Bovine  MMBT21143
gtttgtgtgcygcttgcacagcaagaccaaagaaaccaaaatgttggggtttggagcagagaaaggtttattgtaagggccaaggcaaggagaacaggcatctcaggctcagaaaacctgaactcccttcktggttttcagggaagagttttgaaaagcaatatttggaatgagggctacggggtgtatgcctttcttctgattggttggtggtcaggtaacaggctgctattaccggaatcgcaatcgtcagtctcctggttttgaccagtctgggcactcagcttgtagttaccatcrtcctgggtgggggttcttagtgcctgcagaagaactcaaaggtgtgaatcaggttgttaggtattccccttaagggggaactgggagtctgttttgtttgaggcactattgtttcttgactgcttgggctttgcttctgcatcccccactcccttaattagtaactgcttgaatctgccctttggaactcagggaaggtctaagaggctgaaacctttttttctacaaaaaaaaaaatcgacacagacacagaaatgcttttgtaccctggagagcccctgcagggccctgcttggtttc

SEQ ID NO: 3020 - DNA, 598 bp, Bovine  MMBT21864
  misc_feature (1)..(107): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttactaaaatatatatgcaattttaaacaaataataaaaacattaaaagcctcggagagaatcttgggctaaacatatttacattaaatgtgaggctcacagcaattcagaaacraaaagaaaagagaaacaaaaagaaaagcagcaatgtgatttataaattacttattatctaataaaaggaaatgcygggcttttaggaaaaaacctttccctcagcactgaactccaaggagaatttattgcttggagcattgtaacaaaagtcaaagtacagtcaaagttacagaggcagtacaraattagggaaacgggcactgaacggaagtcaagctagattctaatccacaaactgtgggacactcagcaagctattagactttttattctgtttcatcatcaataaaatggctagtttgtctccagcatcactgacgacacaggattatttcggtgtttataataaatcatacctggaacatagtaag

SEQ ID NO: 3021 - DNA, 600 bp, Bovine  MMBT22333
atcttattcactgtgatattctaatagtgaaaaagtaaaaatgaaaaaccaggaaactggtaaatccattacagctttccatatcatgaaatatttggttgtttagtcactaagttgtgtctggttcttctgtaatcgcatgtaccatatagcccaccaggcttctctgttcatgggatttcccagagaagaacactggagtgggttgctatttccttctccaggggatcttcctgacccctggaacaaacccatgcctcckacattggcaggtggactttttaccactgatccatcagsgaartccctagcagaccttaaaatgaaggttaattaacaagtctagatacatgcaccaaactgagcctttaatttcatgtcattatatgtacctgcaactctattttcaatgagcaggcatttttataattataaaaaaaaaaaaatcataaaaagtaatcataaccatattttgttggtggttattcatttatggccagtcacattaaaaawtttttttccattttattcagttactgggaaaaaagtctgaattttttttttttcagctacacaaatttgaatgtaggccaatcatct

SEQ ID NO: 3022 - DNA, 600 bp, Bovine  MMBT22786
ctgcttctaggtgagtggctgcctccctccagacctctgaaccttagcttctctgtccctgatcctcctcgatcctcaagaaaaaggtgggagcacaagaaggtgattctaggaaaagccaaaatgcaggaagaggcaccagtgagacacctgtgcccgaggtttgaggacacacacagcaccctgcctccagcttttgggccccgcrgagccatggcytcccaaatctcaccttggtaactttgccccagggactttctttttcctattgcctgccctcccacctgttacccttctccyaggcccagccctccaccttcagtattgcaacttcacactgattccttgccctgcatcctcaatgtctccatgccatgcatctgctrttccaaccacctggactatccctccccaacttggggcatcatggagggagggggtcactttagcaggtggtgtagggtagggagaatggagaaggtgaaggagatcttggagctgagatgtgctgttttgaggggtgctcctgctggagggaaacaggtacgcaaagaacagaaatggcagcaagaccacaggagacactaggagctgatgtgt

SEQ ID NO: 3023 - DNA, 598 bp, Bovine  MMBT22921
  misc_feature (1)..(216): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgggcttgaccttctttcagcctcacccctgatacttccactttaggcttttgctgtagttataacagactttgaactytrcctgagctttgcccagaactttgctcttgaccagcttattacccctttcaagtcattattcactatttcaccttttcaaagagacctactctgacctttaccaaatattttaattccctatatcctgccccagccttcagacttcaccatcacttatcttcttatctactaaatatggccttattatttgttacttttatggtttatctttcaccattagactataagctccatgagatccatgagacctttgatttgttcactgttgtatctcarycacctagaccattaccaggca

SEQ ID NO: 3024 - DNA, 600 bp, Bovine  MMBT22923
gttataacagactttgaactytrcctgagctttgcccagaactttgctcttgaccagcttattacccctttcaagtcattattcactatttcaccttttcaaagagacctactctgacctttaccaaatattttaattccctatatcctgccccagccttcagacttcaccatcacttatcttcttatctactaaatatggccttattatttgttacttttatggtttatctttcaccattagactataagctccatgagatccatgagacctttgatttgttcactgttgtatctcarycacctagaccattaccaggcacacagtaggtgctcagcaaatattcattgcactaaattgtgaacaatttgatttgccattttaactctcaaaatatggatgagattaacaaaggattaataataagtaaaaatgctgaacagttttactactggataaagaaaaacactctagcttcaaagtccttgttttccctcaaaacaagaacctgatagggcatattaagaaatggacacatgatttattcattaccatttgtagcaycttgactgagaaaattaaattgttttgtagatcctt

SEQ ID NO: 3025 - DNA, 413 bp, Bovine  MMBT09237
  misc_feature (1)..(4): n is any nucleotide
nnnntcctttaaaaawaaaagattttcaggattcttagttcagtatatagatgtagatatccrtggggtggcrtaagyagctttgtccattccaacagctcagcaggaaacactcatgatgctttatctcaaaactcatatagactgctctgctctagtactgaaaaatcacaccttcattctctttggaatgtaaggggtctctgggcctcaattcccacatggagtaacagtagctctgagtctggaaggatagagagaagcaaatttactcccatcagcctcatctgagctgtggccctgytcctccacctttgaggtggttcagtccccaggaaaattagctggtaggaggctcatagctgggccggctatgcagtaactactgtagtatttgactcatcacacaattt

SEQ ID NO: 3026 - DNA, 600 bp, Bovine  MMBT12459
ccttccaagaagtccgtgggcttccgtgggctacatgaccgccatggatgacaccagcagagagtgtaggggagggagttgtggaaccaggggagctggagggatggggctgggaactaggaagcgtcctcagagactgtgccagatgctgggagaacgtccttgggagctcagaggaggggacagggggaggagaggacttggcggagaggaagggggtcaagggaggcagaggatgcccaggtgagagaggagtcagcagaagcggggggtccgggggtcggctggaggctgttccasctgagagttggagcctggaccaggactcaygaggaacggctggacrtggatcccatacatggaccaccgacagctggactcagtgcagcttgggtgccacgctgcccactccccgctcactgctctcgccctggggtcttctccctggccaggccaaccttccaggtaagcagccctgggctctcccatctgctgatgagtccaccgaaggctcaggctccccagacgtggagagcagggtgaagggggatgggcgcccaggtcgggggaggcagaggcccctggtggctgcttctagga

SEQ ID NO: 3027 - DNA, 600 bp, Bovine  MMBT13309
aaaggctatggaaaaatagaactcttttgaagacttctttttggaatacttctcaaacactattaagaactgtgtttaactcatccccctctttttaaaatttgaaagatatttttccttctgtcttttttcttgatgtaatctctctcaagaaatgttcaacatctgtagccttttttctcaacaaatcttctttataaactgtgtccaatcctgtagtcatttttatcttaacatggaaataaaccactttgtcccctgaaaagtttacaagattgtacttgagggcttattatgamrgtatcgttatgtaagacagttctaattccctcataaatctaaatgtatagctatgctttttaaagactacattttctttcttttttataatcaataattttaaattatgccactcttgatctctggctcagctcagctcagctcagygcattcgctcggtcgtgtccaattctttgcgaccccatgaatcgcaggcctccctgtccatcatcaactccyggagttcactcaaactcatgtccattgagtcagtgatgccatccagccatctcatcctctgtcgtccccttcttctcctgc

SEQ ID NO: 3028 - DNA, 598 bp, Bovine  MMBT14256
  misc_feature (1)..(138): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacctaaaagcagcttgcctaggggtcagggtataataattatcctttatttgtacccctggcttttttttttttctgagcacccttgatgatgctagttcatgatcattgaatcaaattgaactgtaattttaaatgtcacactcaacctaatttaatgyagtaattaaaatgacatatagcttcatcatttttcactgttcaatttagataccctccctcattctcacttttactgaatgccttacacttgccactatgcttagcagacaggaggacactattgagaagttatcatgtgagattcttttcctcgggacatttacaatgttaatggggagagaagaaatgtatgcttaagatttttcaaaccactctcaaatttctgtacaagaataaagtctagagaattayatttttggtgtagatgagtttagtttagacagtgtcagttaaatg

SEQ ID NO: 3029 - DNA, 600 bp, Bovine  MMBT16775
aagtcaaattaagacacataaaaacacattcttcaagtgtgattcacaatccttaggaaacgactataattgatttacaacaaaccagctgtactgagaactcagcagccccaggtgattctgacagttgtgcttgagtaaatctgtgtgcaaaacacactattctggaattgtttactgccagattgttaaatccaaagatgaaacacgtggttaatggggaacgtttagcaaaaaggactggagaatgatgttgcttargtaaacattcatttaaacacattagtaaaaatgtcaggygcattaaaaacttatataaagaatttataaagctactgtgtgtttctaaaatgaatcttttccctctcctttggtaggtcctgctttgtttaagctttcttgtttttataaaatcctggcatacacagtgtactgtatctgaaaatgataaagtgtgcctctttggtacgcccttgtcaattacatgtgccttgtttcattagctacagctaattattagccctagtgttcgaggctatgaatttaaattgaggaaaatgagtggtcattttttatgatttccttctagtcatttcagat

SEQ ID NO: 3030 - DNA, 598 bp, Bovine  MMBT19821
  misc_feature (1)..(106): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaaatgatgaaaatttaaatggaaacaaagggaagaatcacagacacccacttgtagatctcagaaaggacagctccttcatggtcttttgttctttgctccagctgtaagggaatcccaggtcaggtccgtaccacatgatgctgacagtggttcagtggccctgaattccctgagtcttctcagggatcrctgtgaaaactgcaacctttttgactttacggttttatttagtctcactccaaggagtggatccctttttctcactgacctgaaacaacccctctgcagctgtggtcttgagaaaaatcctccgtaaagtttctgacaaagacagaaatggaatcataaaagaatctgagatgttcccttgtctgaratcccaaagtctcctcagatggttgagtgagagccaagagtggagaatgaggggtcagtgtttgttctcagatctgagccaccctgcagccccacccaatggctttactcc

SEQ ID NO: 3031 - DNA, 600 bp, Bovine  MMBT08099
tgcactagacatcacagattctcctaacgagttcactcctttcaggagtttagagtctcagaatctgtagaatgtatttcaagaaaaaatttgtggtgagtttttggtatatatgcatttctgtgcatcagtattctttaaaatgtcataaaatgaatggcaccacacgtgaaaattctgtttccaaatggaatattcatttttaatgttaagttttgaaagttaactccaatgtccttctgctaatctctcagtttggttcgttattagacttcaaatcactgtcactgggcaagcagygaacatggaataattatttcatatttttctttctccctctctatcatctttaaatccacaatatctcaatccaactgatgtccgtaaatccaggctgtcgcaacttttctctaaaactcttaaaactatttgaatgaggtgttgagcagctgtcagttatggatttgaaaataaaaagagcctgaaaattgtacgttcagtataaaaagattaggtgaagcaattcagaatgtttaagaactttaaatcaagttaaaagcagttactatggccagatctcatgaagctctgcttaagagc

SEQ ID NO: 3032 - DNA, 598 bp, Bovine  MMBT12581
  misc_feature (1)..(147): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagttttcaagattgaataccatgcttattccagtgaccacacactatagtcagtcaacaagttaagcactaagcttttctaggagtaacataggacatgcttgttacttcaaatgacggatttcagtgacttgaaaccaagaggaaaamatgaaagtcatggttcagaataactgtgctgaagttaggagcagaatcctggtgtacactamtagtgtggcagataaaatagttctaaggaacagctgtagggtaatggaaagggctatgatgaatataattctgttgsgatgaagctcaggtactgcaggaataaatgccaatatttttccatacaggattaattacatggtcaacagctggaatttacaaggaggtgtattaaataaaatagcaggcaagcttgaactgcattcccacaaaagccataaaatgggaataccaagag

SEQ ID NO: 3033 - DNA, 600 bp, Bovine  MMBT18387
agctttcactgcaagaggacatgggtttgatccctgatcagggaaccaagattccatgtgctgctgagtgtggtatcctcttccccaagaaaaaaacttgagccttactaacattaacagttgtaagttgtaaaaattatttgcatttcatctgttttctgttaacaggtaattactgttttcaaatattaatactataatcaaggcagagttcttaacttaggctaagccatcatcattcttatattaaatacaaccctgattcatgctaatctgctaacttgctaattgctcttcctrtgtgaacactggcttatgtttgatcttcggcaaatagatawgtctcattattactgctaaaaattaaatgttaggtaacttgacatgtagataatgttgccagcttattcaagtaaacatcagttttcycctcaataaagtcaagatctttcaaacccagtgtaaaagcagatttatatttataattatttatagattgtttccatactgtttcatttccctgagaagatgttgtagtataatactcaacacagcacagtattaaytgatccattttcagctggacaaacatcttttgtg

SEQ ID NO: 3034 - DNA, 600 bp, Bovine  MMBT19682
cacatctccagcatctgggaggatggtttactacacaggatgaaataataattcagctctgtattgacaagccaggcagtatatacttccttgccatgaaggggtgtgaatactgtgccgcattatttaaatagtaggtatctcagcagacgcacaaatctaaatgggcttagtccacgtccgtgtgacggacaagcacacggtccaggctgcgtggcctcaattgaccaaagaacaattgagtccgtgtttttgaatgtggatcaatggcacgccattgatggcgtcggctgagcagcrgttgagcctgtcacttgagtcgagggccagcatagctcagtttaaaatgacagtaagtgaccaccccgtgtcagccccgtgaagccctcctgaaaaatacaccatgaactgcagccctgtctgccctccgctttcagtgataatacaagacagcgcaagaaagaaatcagaaagcaatcaattagagctgaaactctggaaatgttcgggaaagatgaatacatgccgagggttcagaaacaggagaaagtgcgagagtgtgtgcgacagggcagcgaggccggggccggcccttgtctt

SEQ ID NO: 3035 - DNA, 600 bp, Bovine  MMBT21520
tagctggggcatgtggaatctactttcctgacctgggattgaacccaggccctctgcactggaagcacgggcttttagccactggaccaccagggaagccctagacctgtgtcctttatgttctaaaacatagtctaggatgagagccagctggagagagcctggaacrtgatgaattatggacccagacatggaaggcctattgggcatcccccagtgcaagttctggaaggccacaggcaaccaaccgtccaggggcccatcaggcaacaggcctccacccacatgaggggatgaaaygaacatgacatcccctagctgaaatgttcctccaccctgaagccaccccttctcactcagatccccatcccagcatcgcttcctcggtcccctgggcccggcgacccctgctagaaactgcgcacagtcatggtcattccctgctgcacaagcagacaagggacgcctgcgtctcacctggtagaagcctacaagccaaggaccacccctgcctcattcagagtgaccagcacacagtaggcgctcagtaatagttgctgaatgatgaaatgattctacaaggcttttcacaggcagccc

SEQ ID NO: 3036 - DNA, 600 bp, Bovine  MMBT21740
accatgcttacacgctatgaggaacaaaagtaagatatgaaatggagagacatttggcctcagaacaataactccatcgatcgagttaaatgtattgactcagagagagagacagccaccctgtgtgaaatcatcatggttcctggcagccaataggagctcatggacccactcagctagctggagagaggctggtaaaccagatgtctcgagctccccgtctgtgtgtttaaaacatcccagaattatttgtgggtattgacagattgaaattcataggtatctctagcacagagctaytgtgggatgtttccaaattccccaagttaatctataactgaagatagaatttccatcacttcctctgtatggttgaaaagcctgttcatgagtccatatgtgtttctgggggggcgttttgacgacatttgctgagcattacaaatacttccactaatgttttctcgccgcatctcaaatagcaccagtaggaggcatctgggatgaaagcgtcatgcatctgtcaaacaacactcacaccagtgcgatgggcccacgtccttcaaacacgattacataactccaggttgaatttcaatc

SEQ ID NO: 3037 - DNA, 598 bp, Bovine  MMBT01231
  misc_feature (1)..(5): n is any nucleotide
nnnnnttttgtgttctctctcaattagacaaagacaaaagtcaaggtgggtctctcactctccctgagcagctcggtgtcctcagcaccggactcagttcccgtaggtgagactcactccaccccaggcatctctgtcaaccagatctctgttttcatgtgccccatgctaatattcctgctgtgctggacttcatcttaaactttaagcctggactttttcttttggctattttagttctcaattcctagtaaactttaagcctggacttttttttttttgactattttagttctcaawtcctgaacaccgactttcagataagtcttgattccgggttctccgggtcaaggacaacccccgcccgccctattacagccccagctacgacacgagacaggactcccccagccagcccccacttgcgctcggggctctcagacaggctccccacgaggctctttattcagagatgccgtggcaacagtccaggatccctgtggaaagagtgcctcttccagctttccttctgttcgtcactgctattcaattcaatgagaaattgttgttaactgctagcagagatgagtaattctct

SEQ ID NO: 3038 - DNA, 600 bp, Bovine  MMBT03413
tgagaccattttgatttttcaaatgtccaaagttttcaaatgttaattaaatagattatgcattgaagaaaaccaggattaagtgtttagtaacctcttatgatctattccaattagttaatttagcaatgagcacagtctcaaagggctagataattaaattttatagagaaccctatttatcattacttaacacttgtcacagtgttagtactttactcaaagttctttaattgtctttattattctaataaggttttaagactgaaatggatactttgcattgtttacttttttccmcaccagtttttagtaacttgraaaaaaaaaaagtcttcattgtccctcctaagcatttgaaatcactacaatggcctctatgctggaaaaaatattcccatctacacttacataagtgctgtttttagtccctaagttatgttccactcttctgcgacctcatagactggagcccaccaggctcctagtctatgggatttcccaggcaagaatactggagtgggattccactggaatccctggaaaaagatcccttctccaagggatcttcctgacctcaagaaatgaacccacgtctct

SEQ ID NO: 3039 - DNA, 598 bp, Bovine  MMBT03504
  misc_feature (1)..(30): n is any nucleotide
nnnnnnnnnnnnnnnnnnnnnnnnnnnnnngaagccctaaatgttcatttaacctccgaccttagtgtcatggaaacttgtggtcctctttcacccataacatccttgaaactgaaagttcttcctggccaggagattttcaattactttattgatcaaatccatttacaagacaatgagctactcatttgggcagtaaaaaaaagagaaaaagaaactaatcagatgtcctttgcctatatctaatgatttcacggatatgacagtaaaagcaagttacaagttgcctgaattctatayatttatttcatttgatgcaaagaagtaacattatataaaatttaataaatagcttaatttctgttaatactgacccatttatctcactgaattttaaaaatcataatgtttagagaattagccttccatttttgacttataaataaaataaattccatgaagctttctacttgaataactatttgcacagttattgccagatatgtcagaattggtataatattacactttcatgctcgctctcatttaatttacttctgaaatgaaaaatttgaacaagaaaatcagtgaactaaac

SEQ ID NO: 3040 - DNA, 600 bp, Bovine  MMBT03599
cttagactatttcactgcatttgtgcagcttgtacaataaggttttgctgacaacacactaagtccatccccacaaggtgtgtatagatatacatacatagacgtgattcatgtcctaaaaatgtatagatcctaagtggaagtcagagtaaagaagtgaatttggaggctctgaattgctccaactggctttctaacagcctaaattcactctattagttgtgaactactcacatatttaaggagtttatrtagattacctaagatgctaaaatctacccatatgttaataacttcacyttacttaaagagcaaagccccatcatgtaatatttttatatgagattgagaagatgtattttccttccgtgaatagagtatactcaaatagaccagctgatctgattgaccaaaccttccctttccagcacagggctttaaagatctatgatgcattttttttatctttctctggccacagattccaaatctggcactcttggagaactgcttggctattgtcatcgttataatctggagtgtctgagccagaaggaattgctctagattctccacatcaaaatatgatccagctacaca

SEQ ID NO: 3041 - DNA, 600 bp, Bovine  MMBT03962
ttgtgaccctgtggactgtagcccacccagctcctctgttcatagggttttccaggcaagaataccagagtgggttgccatttccttctccaccaagctgataatgaggtaaaaagaaataaaagcattgctcaagaatctgggcttgtattaaaacttgaataaaagggaagggcttggtgctgttatgcctcatttgggcactgacttgtaccctaacttccaagaagtctgaaacttctagacaatgtcgctgagaagacccaggaacccaggagcacaggactcttctcccaacgygaggtctcctggcagacagaggagctgggctctcctccgtctccaggctcagtccttgctctcttcagaaaacctgcttctcctgattcctgcagctggrgctctccccaccgccctccgccaccgagcaggagaagcggtcctctgtgtggcctacagggaaccctgtgtgtgtgttgagggggtgctgggcggagctgccccttgcttcctgcagcccaggtgtctcaccagcccccacccgcctcccggggtcttgtccccagactccagcccacggggtgtccttccccagacata

SEQ ID NO: 3042 - DNA, 600 bp, Bovine  MMBT05845
gaaataagtatttgggtcaagattaaattcctctagggaagatgaagtataaatgccttctctaactttagcagttagttcattggtagtagataatgtttactataatgttttcagtagatttaactgtactattttgatgttttgttttggaaaactcttaaaataacagttgcagcattgtctatcatgaaaaaatagaaataatctcaatgttccaataatatgagaatgactaataatactataaccattccatatatcattcagtcttttaaaattgtaattatggagacagtsttgcaaaagaaaacaatccttttgacaaaatattatgtagagaacaggaatagaaaattatatacatgtgatggcaacagcaactcaaggtatttatgtacaagtagattttatgtaaaagtgaatagtttaataagagaagaatgggattaccctgattttcagatttcctataatgctatgttatcatgatgaaagattagaaatcagtgtagaagtcttaggaactgctctccttagggctctcatgtgtgtgtatgatgattgaccagcaagcattggtattttctttcagttgct

SEQ ID NO: 3043 - DNA, 600 bp, Bovine  MMBT08136
attgctgaaaaccaaacacagaacctcatactgtgtatctacaattagaaaagaataggacattataagttagaatgataaatgtagggatacagagcctctaaattctgaagagtctcctttgctggtgggagattcttcccatccccataataatttaatttgaccatacttaatttctttatacacactgctttgatagttgtggtaaataawaccaaatatgagacacgtatgcatatactgcccttaaagagctgaatcttcttgggaggataagaaatacatacttggaaaagkaataagaataaaaagcaaggtatgactatcagggcttaggatgtaaataagaatgattgggaataacatacttgaactgcccctttaaatagatttaaaatgaaaggattttagaactgaaagcaattaacataatatctaatgtaactccatttaataactgagaaaacaaacaaagagaaacttaacttgtccaaattatgatagcaacttactgggaacagaactctggtctcctgatttctgactctttgctgtttcctttgcaaccactgcctttgtgactgctaaaaaaaaaaa

SEQ ID NO: 3044 - DNA, 600 bp, Bovine  MMBT09344
tggggccaggcgtctattcaccctgggctcagggactccatagtcctggagtagaagggtaggatgggggctgctggaaggctgggggctgctggaaggctaggggctggctggagggctggctgggagccaggaaaagaagtgctaacagtaatcgaccctttctttagtgggcactggttctggaatctcgatgttttttcccgtgggttcaagctgaactctcagtctctcctgggcttttaggggctcagagtgcaaacaccttcctgtaggaccgggagggacactcgctggagygctcggtaggccctaggcatcggagtcggattcccaggctcgcaccaccgagctgagctctcagaggggttcctgggcactctctctcctcgggtcctgaggcaggagaggtgaggccactggggagcccgctctggcaccctgggagcctgaaagtcatgcctcagaccagagcatctctctctcatccttttcctagtgatctgagtgaagacctgtcatgctgaggagacgggccttcgaagggaacacggggcrccaggcgggcgcaggacagagctgatgtgcccttctgtgctt

SEQ ID NO: 3045 - DNA, 599 bp, Bovine  MMBT09720
  misc_feature (1)..(29): n is any nucleotide
nnnnnnnnnnnnnnnnnnnnnnnnnnnnnctccccttccaaaaatatcccagtcttattcagcttgctggtgacagcaaaaaggaggggaccagtgtctagaggaggctgagaaaggacaagtgggggacgctgacaagccctgcctgagctggcgaaggccctttacaaatgagccagggtgtcctagaaacagagtgcaggcaggggygggggcaggggcatgcgggtatgtgtgggaggggtgaggtcagggcagagtggagagaagcaggaattggataagaggaggctggtaacaygcaggccagggaggcaggcgaggacctgcagggatgtgcacacagcccaagtgggaggaactgagcatctctcatggcrggtgggctggggtcacagaggggaggagagggtgcagggaacagagtctatggctatggagtagaggactagcccttgcaaatgggytcagaggaccaacttgagggttttagtaacactgaaggatttgycaagcagacctgccagcattatctccctgcctcccttctgcttgaccgtggccaggcatccrctttcaggcagaaaccctgcctatct

SEQ ID NO: 3046 - DNA, 600 bp, Bovine  MMBT10519
ttattttgcctgaacaggtggcctcctctcttcaaaataaaataaaaaacctaaaggaatcccaagaacttatgaatcatcattttattgtttctatcatttttaaaatcttaactatttattctccaccatggatctaaccatccaggtatcaaatagtagaaatagatcacaagctgaaaaatgtcaacaaatgtaaatgctacctcgaagcttatctgctttaaacaatttctgataaacacacacgcagaagaattttcagagaaactaaatctcaccccacaatactgctcctcrttaaagatctgaggaggcagcggaatcccattctgaggtttcttctctccgggaacattttctctcatccacttcctgttgtcttcatctccagcaatatcgaactccttaaaatcgattttattagcttccaaaaagcccacaacttcttgctgtttcttcctaatctagtcatgagaagaaaaggattaccgttagactgttttgtaaaaacccattctccaactataccatacaataccaataactttgctaagtatttaaacaagaaaaatcataaaatcacacttcttcatttaa

SEQ ID NO: 3047 - DNA, 600 bp, Bovine  MMBT10776
aaaaagttaaacataaaattatcaaataagccagcaattccactcctaggtatatacttgagagaattgaaacatatgttcacagataagcacatatatcaatgttcatagctgaattatttataatagcaaaaaggggaataaatacaaatctcttctgctgcatagaccacatttatccatataatggaatactactcagtcataaaaagaaacaaagtagtgatacatgcaacatggatgaatcttgaaaacactgctatgaaagaatccaggcacaaaagggcaaatattgtatgrttccattggtatgaaatgtgcagaatcagtcaatccatagagacagaaagaaattaagagttttccagacatcggggagagaaggttgggaaggcctgctagtaggcatggggtttcatttggggatgatggaaatgatccagaatttattagtgaagagtcttcataccttgtaaatatactaaaacccactggacttaacattaaaatgttgaattttatatgaattcgtagtaaaaaattgcaaagaataaagtgaaggaattacacaggatagacattttccttacactgaaaaat

SEQ ID NO: 3048 - DNA, 600 bp, Bovine  MMBT11458
gctggggaaatgtgatggtcagcagaacctcacgagacagaggccagcttccggttggcttctccaggaagcagatgctgtctgcctttcccagccctgactctgcagtggcctggtctggagccaggagctgggagcctctgatgaaccagcagctcccaagtggctgcagggtcatatcaggggacaatcgctcacccctcagccccttccactcccctctccagtcctggacacacaggtaaggtaccccttgttcattcatgcatccaatacaacatgccaggctgtctaggctcrgggaacctagccatgaacaaggctcctgttctcaaggagcttgtattctactcyaagtcggggtgtgtggtggggagacagaagattaaccagtgaaagaataattgtgtgcattctcagtcacttcagtcrtgtctgactctgtgtgacccctgggactgtagcctgccaagctcctctgtccatgggattctctaggcaagaatactggggtgggttgccatatgcttctccaaaggatcttcccaaccctgggatagaacctgtgtctcttgtgtcccctgcattggcaggcaggct

SEQ ID NO: 3049 - DNA, 600 bp, Bovine  MMBT14736
gattatactgacaggaaacttgtgttgtctaaattctggaaaagatacatacaacttgaaagaaatattaattttcatccagtcaagtaattcctcagaaggaggaatagctagtctgtygggtcttgtgacttcagtggtgcctttgtaatctagactgtcaaggccaggagattactgtcattttgcattttgtgtattttgaggagttttaytccattttcattctcaattcctttccatttcataagccacaactaattatcttaaccatttccactagtaagaactgrttgtrgytgtggtgttacagatcttgcctgttttctttccaaatttcttatccacatgcttcacgatagtctctcgcctcttctttttgcccccattctctcgttttttgacttctgaggactccttgatgacgatggaaaacagagtctctgcctcacattgtgaaatgtgcatgacttagctactattccaacaaacatttctcagacagtgtgggccggaagtaatttttttttttttaaccaaccgaatctcctttaagctacctggaagttgggggcagcacaacatacgtgtcttgtggca

SEQ ID NO: 3050 - DNA, 600 bp, Bovine  MMBT15783
catcaggtactaacttgccctaacttactaacagggctctacaatgtaagctttttataagattcacattaatttcagccttgcagatctggcacacgagagttatagcagctgcccatgatatgcatggaatttcatctggaaccatcagactgcaaagcccctctataaattcatcacagtatgaactacctattcgtcccaacacccaggattgccccagtttttgaaaggcaaaatcccacatcccagtaaaccccacagcctgggcaaacagggaccagtgtctgttcctcaayrtttcaactgagcaactcagttcaccttaggaaaccaatgggcacacagccctccatctctaggccaaggccacaaggccaggtgagtgagcagagggccaggtgtaacacgatggggaaggggacagacagactggacagtaaatgaccctgcctaaggcattagaattaacaaacctgaccgaggttcctaatgctctcatcctctgagatctcatttatctttctcgtcacttttctctcatttctacattatgaacttttattctaaaatggattcgcttttgtaacttctatcaga

SEQ ID NO: 3051 - DNA, 601 bp, Bovine  MMBT16538
  misc_feature (1)..(1): n is any nucleotide
naaaaaaaaattcttwaattaaaaaamaatatgcattagtaatagtaataagactagatcaagcttcatcttcccctagttactactaatcctctcatcacctatggaaattgattacatttgattctagaacatctcttgaattattgtttgtaactaatacctatttttttatttatattttgttgctgttgttgtcattgacttaccatctcttagagttctgtttaacaggattgattttyaccacaaccaagaaagctaaaaagccttcaagaatccttgcccttcttctgtatcygtcacagcaagtaaagggttaccagggactgaagacttgctgaagcataaggcatctgaccttgtcaggaaccctcgggcttttgccagcacttctgctcrtctctgcacacagccctccatggaaaagtactgcccagactctatgaattattaatctcatcatgacatcaaatacccaatagataaaaggaaccagtggcctccacaacgagattctcagagaaagccaagagtctgtgatatccttttgaccacaatcaagattttttctgctcccccctggggaagaggacaacct

SEQ ID NO: 3052 - DNA, 600 bp, Bovine  MMBT17360
gacctaacagccactgctgtccccccttcactgctggaatgccgtgtccctattttcccagggccctttgttgctatggtgatcacaggacacagctctggccaatgagagggctctgggagtggcctccctcccagaaaaatggatgctggatgggggggtgccttcccagtctgcctttcctcctggagatgccagggctgctgagcagaacagagcagtgagaagatcccagtgcccccatgacaccactgagctccgaggcagcyttgcacagcctaacaccacatccttgtgagrtgaaaacaagcccttgtggtgccgctccttttgggcaggttttgagtgtggtccagggcatcctcactgatggagtcacatgggagaaccttcctccttttggagttgggaggaggtacagtcttgggaagaccttatccctgacactggcctggtcttcccacattcaaggtgtacatatcacagtattgattgtgagcctgtctcctccacgccttgagctctggacatcagggaccacatctcactcctccaagatctttagaggctgacccaaggctcgtacaaaggagtggacac

SEQ ID NO: 3053 - DNA, 600 bp, Bovine  MMBT17394
aaaatgcaacaaaatttatgcagagaccaatgcagagctggcccaagaatgaatgacaactctcattcatattaagttagatataaatttaaaaatatataattaatacaatatatgccttataaatgacagaggctcaataactgacttgaatttaaaaactagagaaatcaggaattccctggcatttcagtggctagtactccacacttttactgccgagggcctcagttcaatatggttggggaactgagatcccagaagctacatgatatgccttaaaaaaaaaaaaaaagactraaaaaatcatcacttgmaaattttttcttccacttgtaggtaarccacctactgtcrtgatgagaatgaccacattacacagttttagaggttttactgcacaaataaccaatggggtatcagtcactacaaactaccgtcgtaacaaatttaaagtagctgaaaaaattagagcaggaaataaatacctaaggctttccagctgtcagcaaaatgctaacctgcttgaatattttctcggtgtctgttttaaaaacatgagggctgaggtactaaaatttgtgatccaaaactaaactt

SEQ ID NO: 3054 - DNA, 600 bp, Bovine  MMBT17905
gcgagcttcccaggactttaatttttgttacctttaacctgatttaaatgaagtcttcactttatgaacagtaatcatataaccagctcttctctgaatcctcttcctcctccccctccttttttggatacaactcctgtttttgctctgttgcaaacacttctcaaaaggraagcaacattgttctatatgcttttaaagtagctcaaagaccctaaattgaactctttcaaaactttagaaaacatccagagactatttaatttaggcaactgatattataaaaatcaggaataatcrttcaggcrttcaaacaaaagtttctccgtactaattaggcaaccattattctggggggcttgagtaactcgccagctgttgttaggctaaaacaggaaggaatttttgaacacttaggggtgtcttcttcttttaaaatgaacaagagaagagttggagtcaaaataataataataatgattgcttagtgctttgggcatagatttgtgtatccygttgccagggtgaaggcaataattgaatctatcccaaatctgagtgatggagtagtcagaaatgactctacgtgacagaagagcc

SEQ ID NO: 3055 - DNA, 600 bp, Bovine  MMBT18590
wgtacattttatactgtgtgttttatagtcaacagtggtaatgtaggaagtaatgtactgaagtatatcttcagtattgaatttattttttttctgtcttcttaattattctgcaaatgtcagtatgtttatgtggaggggtggtttatgtgtatatcatatgtgtagtctgggctgcacttaaagattcaggcacagaagaaattcccagaggggaaaaaaggtataattccacatctctcctttgatacctttccttgtcttgtagaacggttggtaatgacagttccagtgtgaaamcaatagctccgttacttttcttgactgactgaactcattctagtttcattgcagctctgcttttttttctttctcttctgctgaccttttcctcccccttacctcataactatatgtttaccttcatattccccagaaaaagataaactgtaggaagtctataattgaggggactcgtaaggaagatttttctaagttcattagagagtgctagatatgagaagagaattaccagtgttactgaaaacaaatgagcccagtaggctgccttggggagaaatagggcggsrggggtggggg

SEQ ID NO: 3056 - DNA, 600 bp, Bovine  MMBT19139
tggtctcataggaaaacgtcatcactgaaagccccttgtcacattcactgttcatttcctgggtgaagacgtgtctcttggctgcaacatgagacggaatgtagagcggctcactttgctttgttttgattctgttgactccgtggggcggtgccacactctgtgttgtgggcgtatctgaagcagaaggttctctgtaaatttctgttgaatgagtgctgatgtgtgctcacgttcctttcgtttattcgctgagaccagaaccttgcctggcttgcccttcctctctgtccgtcaatyctctctttatttccttccacatctccatctcctcgcagcaagggctttcagctctgggagcaatttggtgaagaggacctttctcaagaccaagagtgtaaggatgttgctctcgcctccccacctgtggggatctgctccctgttgcacccagacatcaggacaggggcacagccagaactgcccttgtcttcagagagcccaggacagaacacccatggagacacctcccaagtgccctctgaagtagggaccagcgctcctgcctggacaccagccttctgtcctgtgacacttcct

SEQ ID NO: 3057 - DNA, 601 bp, Bovine  MMBT19346
  misc_feature (1)..(1): n is any nucleotide
ntgatgctatattaaaaacatgttgtttaaaatgatttaacttgctaacatgtcatagaacctcatcaagctcataagaattatatagctcaaaatttaacctagtaattttctgatctgaaatcttccatcttttttaatgtttctcaaaaagatagaaaagctggaaaaaatttcatttgggtgggatgtcaggaagtaagattcaatcaaagactctagaatgttcaagataaaactgaagattaaactgttccaaaagctattttgagtaaaagataaacctttattttarcattgrtaatgggtagtttaaactgccttaaatgataacaaaacaagaggaaaacactttatacaagtctagaaggccatacttaaaactcattaaaatttgcttacagaatcttcatagatttttcaagctttaacaaaatgacaaggcacttctcgaataggccagatgactgaaaakgttattgagatagacctatctcataccttacaacataacactcatgatatatattattttattcttttagaaagtcaagacatacaaaatgattggcaggagttttttatcagaagaaaatctctt

SEQ ID NO: 3058 - DNA, 543 bp, Bovine  MMBT19700
  misc_feature (1)..(1): n is any nucleotide
ntgatgctatattaaaaacatgttgtttaaaatgatttaacttgctaacatgtcatagaacctcatcaagctcataagaattatatagctcaaaatttaacctagtaattttctgatctgaaatcttccatcttttttaatgtttctcaaaaagatagaaaagctggaaaaaatttcatttgggtgggatgtcaggaagtaagattcaatcaaagactctagaatgttcaagataaaactgaagattaaactgttccaaaagctattttgagtaaaagataaacctttattttarcattgycctgcctctgacgcgtgtgtttctgccggtgaagttttactgacggggccgcgtctgtgttggccccgggcacgctgcagtttccccgtcaatctggacgtgcctttcttcagctcaaatgataggaaataaagaaaaccagctccagatgtaagtgattttatgagcaaggggttaaggagttcaagaggatttcatattgttgggaagacagactcgcatggggtgaagcccatctgtgg

SEQ ID NO: 3059 - DNA, 600 bp, Bovine  MMBT23384
ttaggccrgcttatctacaaccagtgtgaggagatgaaatactgccagaaacaatgccgacgtctagggaaccgcgtccagagcctgctgcagcctctgcaaatgctccaggaccaaggagagaggaacctgcccccccagataactgccgcgctgagccgtttccaggatgccctagaggaagctaaggagcggatagacaagttcagcaataagtccaatatccagaagtttctaacagcagggcatgacagcataatctttggtggggtgaaccagaggctgagcgatgtctgggargagctctctctgctgctccaggtggatcagtggaggcatacttcaagcctcagcctaggagtgtcctggcaacaggaagatcaacaggatgcagaggaggacaggaaagctatccaaggactgagkggtgaggacttttttcaggtggggggatgcacatacaggtgtattcgtctcattttggaaaatcaggaaggttgaagtggttttgrcaggtatctgttgacragactcagaattycagacgtctgagtggagaggggtgcccaccatgaggctgcagccrgagtgtggatgtat

SEQ ID NO: 3060 - DNA, 600 bp, Bovine  MMBT01256
ggagggattgggggcaggaggagaaggggacgacagaggatgagatggctggatggcgtcactgactcgatgaacgtgagtctgagtgaactccgggagttggtgatggacagggaggcctggcgtgctgcgattcatggggtcgaaaagagctggacacgactgagcgactgaactgaactgactgactgataaaaggggaaacctggcccagagacagacacgcagagggaaggtgatgtgaagatacagggagaagatagccacctacaagccaagagacagtctaagctacggaarctaggcaagaggcctgtgaagagtttggtctctgctgagaaggaaagatggagaccctgggtactacagctggctccgatgatgtcatgacagccggtactgttcctgctgtcattacagcattttaacatttatttatttattttggttgcactgggtctttattgctgtatgtgggctttctctaggaagagtagttggggttattcttcctagtagcgcatgggattctcattgcgtggcttctctagttgcagagtagaggctctaggcaggcaggggtcagtaagtgtggcatgt

SEQ ID NO: 3061 - DNA, 600 bp, Bovine  MMBT02481
gcgaccccgtggactgcagcctaccaggctcctcagtccatgagattctccaggcaagaatacgggagtgggttgccatttccttctctaagggatcttcccgactcagggatcgaacctgggtctccctcrttgaaggcagatgctttaacctgtgagccaccagggttgatttgacctcaaagccctggaactccrtactcccatggatttatagagctattgattatrtttataaggaactgtctcctttaggtttctccaccattgttaatcatattgcagaaaatctgccttccyagtgttattgggtaaaatcatcatgtttagtgaaataatcttgaaatgaccaaccctatgttttattcttaaagcaataggaggtagatgtacagacctgacttagactaatgtagtcacaggttctgaattcacactcagttattttcctttctgataactggctcatccaactaattcataatgatggtgtctgcttcatgaactctacctaacacaatcacagcacaagcaaatgtaaaagaaatgtgagtttttaatgtaactgtccaccctcttttgtcagaaatgtcttcattt

SEQ ID NO: 3062 - DNA, 600 bp, Bovine  MMBT02659
ccccagtgttcttgcctggagaatcccagggayggggaagcctggtgggctgccatctatggggttgcacagagtcggacacaactgaagcgacttagcagcagcagcagcagcaaacccatattgatasttatgatgytaaacacagaatttctaayaaaaaagaaaggaaggagtagttactgaacatstactttatatctagaagctaaaacatgttatctcatgcactgacataaaagagaaattatttccctcatattacagatgagggaagaagggtcatagagtaaaagatgygtcagtggccccacagttagttggcaacagaacttcagcttgaatgcacgtctaaattcgtgtttttgtgtctagcatcttcgtgaaaaatacactctatcccagacygtggaattgatgtcagagttttcatcgttcttctacagacagtcagtgcagtaaytggctgctgctatgtgctatcattacagaagtcactaaatctaaaagcgtatttttggcacagaatccttttccacttttatcacaattcaccaattttctatggttcatgttactggtgcagtgctttgcaatgct

SEQ ID NO: 3063 - DNA, 558 bp, Bovine  MMBT02663
ccccagtgttcttgcctggagaatcccagggayggggaagcctggtgggctgccatctatggggttgcacagagtcggacacaactgaagcgacttagcagcagcagcagcagcaaacccatattgatasttatgatgytaaacacagaatttctaayaaaaaagaaaggaaggagtagttactgaacatstactttatatctagaagctaaaacatgttatctcatgcactgacataaaagagaaattatttccctcatattacagatgagggaagaagggtcatagagtaaaagatgmactagcgtatctaaagggatggtgggwtgatagatggcatyttacaggttttgatatgtatagaggtttcaccaaggaatgtgaaccaaatccatctaaagaactcagagcttgccctgaggccttgaaagaactttctcctgttttcaatacctcctgctttccctgggaccactgtcagaatggtgaaaagccagactgcatttggagaaggaaaaaaaaaaaaaattacagacagtgagagtataaggaagtcat

SEQ ID NO: 3064 - DNA, 600 bp, Bovine  MMBT03178
tgctcaggaacctcacagagcacccccgcccaaagtccgaagtagcctggggcaggctgaccccacctcccaccccagcctccttaatgatgcctcacactcagagagggtcctccaccctgggcccctaacaggcagaggttgaaggacaccagggttggaagacagggctgccacggccccagggactggacttgtgtcagggacatctcacgaagggctctatcagcctctaagccccagggtcacaccaagctagggccttctcagctcggggcctgagcctggactctgcccatmtacagccagccccagtggggaggcctggggccctagggggcagcctcttgagtcccacctgcccctgatggccacattctcctgccagcctggcctgtgtgattcaggccaactccctaaccctgttgggaccctcaaagtatgtgagaccccaatgtgggtagcaccccaaattcaggttctgctggccattgactgggaactcaggacaactggctgaaactgaccagactgtgcttgaggctctagaagctggagcctggtacatatggggcccgttcaggaaggcttcagaggagg

SEQ ID NO: 3065 - DNA, 600 bp, Bovine  MMBT05247
caaggaaaatcccatgggcagaggagcatggcaggctgcagtacatgggttctcaaagagtcgacatgactgagcatgcacgtgtgcagcagggctggggaatggacagtagaaggaaagtcactaagggggaaagctaagaatatgggattcttgctaaaccaagcaagcattgacaggattctggctaaaagcaggccagggtgatcacggttcaactggaggatgaggaatttgatcagatattaagaattctttctgaactaatttagcagaattcttattaaaactgggttctayaaggacagagacggaagcagagggctcaggggagcctgaccaaagtttggcaaggagagaatctttgtttcatgcattgtgatttaatattcacataaatcttcttaggtgagcttatcattatcatcactgtgcttaggaaaacaggcttaagagtgctcaagtgacttagtttagggtagacagggtgtaatgtggaggcaccagatcagctcaggtttatatgaatcaaggtccactgctgattatatatacttcactgtgttgcccagaaaactcaaatgcttctcaccaaggtga

SEQ ID NO: 3066 - DNA, 600 bp, Bovine  MMBT07547
ccaaaattagataacttagatcctgcgattaagatatatttacctgatctattagtttaaactttatatataccttttattttatawttgtaaatagcrtttccttttagagattccaaaggaacaagtctgagcagttaactcctccttctctaggacgtttggctaaatcatgattctgcaacacactgcagacatcttttctgtccgttttacttgctactaccattgctgcttggtctttcttatttttggttctggattatttgacttaacagtattcaataattacttttcttyactatacagatgaaataaatacctatctgtactttatacagacatatagttaaatgaagcaagttattcagctatattaggatatcactacttaaagaaaataataamaaattaaatataatccatatttactttcatatcactaccagtttgtccatacttgatatttttttctcttgagtaccattaaggaactcattgtactgcaaaatatttatatattttaactaaccataattattattgatgctctaattgttacagccatgtcaygctggttcatttttgtcctttttttcc

SEQ ID NO: 3067 - DNA, 598 bp, Bovine  MMBT09383
  misc_feature (1)..(22): n is any nucleotide
nnnnnnnnnnnnnnnnnnnnnnataattttttccattctgactaatatcacatcctgcaactgcaggcaagaggtgaacatctgccaataaacacagaaaaagtcaaaagctaactcatattctccagaactattaaaaagaaaacatctccaagtagstttccttcaaaaaattgcacttatgtmtcaatataactcataaactgcctattctgaaaggaaaactgtattgcaaacttccagatcttagtaactgtaagaaagtcaaggtttaaaataaatgcaaacccaaatactgtyggttgttttacattattactcattttatgaattcaaaacatgtaagtctctaaactatgcggtcagcatgaccagatgagaggcgtcaggcctttggaagaaaaaggccactctcgcaaatcacatctgcagaatcagaagtcagagtaaatgaatcttcgggaaaatcatgaaagtatcaccgtgacctgtattaacccttttctttgggtcccaaacgccatcattaactaaaatttcaggaccaaagtacaaaggtaaatttaaaagctaagagaaaaggtaatgagagagaact

SEQ ID NO: 3068 - DNA, 600 bp, Bovine  MMBT09743
gcagtggaccgtgggcaggacgtgttggcaggctttgctccagaattagatttttaaagaattactttcacagacattgcaactcaagtccagggaccttacaaaaccaattttattagaaacagcatttacaaagataactatttgatgcagtgttgtagctgatttaatgcactcagaaagaaagaacactttttccttattttgctgaagttagaagagcctacagtttcaagtcaagagggtggaattccatgtgcaaacacagacaggagaaagaaaaatttacaacttataatrtgggagaaggggagtagaataggactagtaataagtggaatattagtcatgtaatgttttaaatttccattagttgtacaaatattttgtggttattttttaaaccagaaacatttttcaaatgttttgtatagacagaaaaataagaaatgcattagcgttattaagtagcaggacttccctggtggcttagatggtgaagaatctgcctgcgatgtgggaggcctgggttcgatccctgggtcagaaagatcccctggagaagggaataggtacccactccagtattcttgcctggag

SEQ ID NO: 3069 - DNA, 600 bp, Bovine  MMBT10030
ctttacaaccagaatgaaatggcttcacattaatggatttgccatcaaaagaattgctcaaaatgtgcaaaaccaggtaaactggatccatgaaaaaatttgtaattatactctttcttatttttactacatattacacttggcactgtgagaaacattttaaaagtatgaaatgtgacccttttttgtctcagaaatttaaggaccagattcacatatgaaagaaatacactcttaaaaggtataatatatagcttataaaatatgaatatttttctccatgaatgcaactaagttttraataaatactggactttatgggcttcccagtggctcagtggtaaggaatccacctgcaatgcaggagacttggggatgcagatttgattcttagttctggaagatctcctggagtgtgaaatagcagtccaatccagtaatcgtgcctggaatattccatggaaagaaaaccctggtgggatacagtccatgrtatctcaaagaagtgaacatgactgaattgacyaaaaacaatggtgacatttacatttgtaaatatgtaggaaaaaagtgaactctatggatagcaaatcattaagg

SEQ ID NO: 3070 - DNA, 600 bp, Bovine  MMBT12285
aggagggcatggcaacccactccagtgtttttgtctggagtatcccatggacagagtagcctattaggctaagtccatagggtagcaaagaattggacatgactgaagtgacttagcaagcacacatcctgctgtatataacttcaataaagctctttcaaccatttcctcatcaaagagtccattacattttgggtctagccaatcttgcagattccccaggagacctaagtttcatcatggaaagagtcaataatgtgttccaaggttcagaacctcaatttttacccaaggtcccargaacaatttcttgtgactcctatgacttccatttacttgtgacttgggaatcagagaaccaagttcaaactctttctaaacttattctctcaaaatattttcyggacagatccagatgtgaagtccaaaatctttaagatatgtttttccttttaatgttaaatttcaagrcttgaaaaattatttcttaattagccatgttattagaaagatatamttaagagagtaatacaaaagagcagaaaactccaaaataattttatttttcttcatccctagcaacctatttttatgtttgaa

SEQ ID NO: 3071 - DNA, 600 bp, Bovine  MMBT13541
gaagaggagaaaaagaactcttggtctcagtcccatttctcaactccattcgccttccgacttccaaagccttgccctgcttccctcccacccagctctcatccactccagcctccaagcctgtctgcaccacaaccactgcccctggggtggctactcttcactgtgtgcggaccaaggcctcccyttcatgctcagctgcaagaaacacacaagggcctcaaatgcttgaaggagggaaattgccccaggtgggagccctgtgagcaagccaaggggcttggtttcctattaagtgcrgggaaggagtggcagttaaacaccgagcttcaaagagtctagcattttcaaaacttgcttttggggaatatgcagcttttattggaggtgtcagacattaatgagagttctggatgttcccagcctgaagagccctctccctctcttctcttcccccaccccttctaacaactagatagcccctccttgatgaatcaagagaggctcagcctttaaggggtattcctgtcccatggctcagcccacttccccacccccccccatcacctctgtaataaggggtggaagctgagaggatgc

SEQ ID NO: 3072 - DNA, 601 bp, Bovine  MMBT13773
  misc_feature (1)..(1): n is any nucleotide
naccctgagaatgccattcctcccaccaaggagaagtgtgattgcttgcatatgccatctgcttacaaaccccagtgagctgaaattctcccccaaaaggtttatgtaagccccctgtgaactcaaaccactatgctttgctcagctcaaataaacatcgaaraagtatctaagcatttgaacttataataacatatttatcccaacacatgaggctactcatcattggtgtgtgtgtaatatataattgcagcatgcagaaaacaaacagctctcgatcagagaagtctctggatcccayggggcactaatcatctaccaaaaatagagatggttggggaaaataacttataattgcattggcaatccactattaaagtataatttcatgttgttttcatttctagcaaataaataataaaaaactgatttgaaaaaattgcttattgcacttaccagcagactccaacatgaaatctagaaattgagtatgtatacatattttcataagtgtgcatttaaaaaatctaagaaaaaatatgcacacacatatatatgaacttgaactcttaatttataaataaaatttagtttatattca

SEQ ID NO: 3073 - DNA, 600 bp, Bovine  MMBT14221
tcttgcctggagaatgccatgggcagaggagcctggcggactgcagtccatagggtcgaattgcaaagggtcacaaacaccactgaagcgacttagcactcatgcagagctcccctcctttcaactaggtcctctacccatmggcaagcactgacctactcaaagggatctaaccagaagcctcacctgggactttcttaaaaatgcaaattcttgggtcttwtgccagcctaataaatctgaaattctcagaatggagctcagctatctgttttgtttctctttttgttaatcaaagtrtaactgattaatataacagttatattaatatacaatgttataaacaattaagataaacaatggtatgttaatttgagggcacatcatcgtgattcagtatttttacagtaatattttaactagcctcccaggtgattctgatgctggatgaagtttragtccccatttgcttagcatacaaatggacttagtccaaatattttagccactttgaacccaaacaagtttttatcaaattaattgacggcagcagkcaggtgaatctatggacctactgattcctgtggccttaccagaaat

SEQ ID NO: 3074 - DNA, 600 bp, Bovine  MMBT17043
tagttacctagtagcgtagtaagttctcacaatggtccggctgtggagacttgctcctcctcggcacgcatcgtcatagatgtccggatcacggagtttccacctggggaggtagttcatgttgcattccttgccagtccttcccgttcagctccctcttccagtcttggggaaacctagagaactatttggacgtttggtctctgtctctgctaccttctgaagagatgctgtwttcagtagttacagtgctggctctggagcgtaggacgcctggctctgaaactccacctttgtcastttttagttaagacgattgggggattattttcataccttaatctcctcatctttggaacagttagatagcggtagaacctacttcatagaatgattgtgagaattaaatggattcctcacttaagrctcacagaagagggattagtcataaaaaaagtgctcaataattgttaatatttgtaataattatcaacaagaagctcatgcttccatgctcctcacaaatgaacctacataacttgcaatgatatggctccttatctcctttcatcttttcagaactctgtgatactaactcag

SEQ ID NO: 3075 - DNA, 600 bp, Bovine  MMBT18543
agagaggagagggttgatgagtggaggagggatgagtgggagacggattggtctgagcaaaaggtgtggtcccgctatgtcaggatggtgtgtgtgtgtgtgtyggggggtggtcaggcatgacccaggtggggaagcagactcatcgtgggacctcttgggcaggggtacaggctttggaggagggcagggtaggagtggcctgaaggcatcctttttgtctgcagttttcagaatcacgcatgcaccttatgaagtctatgtgctcctgagaccttcagatgctgccctggggctgckctctggggctctggcagagtcctctcggacctgggctgtgccccctttaccttccctcagagcaactctcccttgcaacagaagcttatgatgtaggagagtgagtcctgcctcttggcgtcttttccccactggcaacatcaaaggtaactgtaccctctccttccagttaatgcattttggactgagaagatagactgtagcaaaacagcgatgaagacaataacatctcgacagtracagcaacaratgccattttaagtgcttgtttcccaccaggtgctggtcagcactttacag

SEQ ID NO: 3076 - DNA, 543 bp, Bovine  MMBT18744
cccccgcggctgaatcccgccgccgagccgcagggctgagcacgccgacagcggaagtgaaacrccggaaacgaccttcgcgcatcggggaaaacggtgcgggctccttctcccgaggctgcaaggtctcttatgacgtggctacacccgaccgccactcgccacacggaccctcacttctaatctgaccagagcgtacataagccctgggtccagaggggccacatgtctgactccaaactggccacctcctgtgggcagcattggcagacgggcatctctgagcttcatttcttttamctgcaaatcagagatgagytcagcttccaaaaagttcagctgtaactctggtatagggaccaccagcccagctaggccagggctcagtactgagctgggtctcctggaacagcctaagctttgccttcagggccccagccaggactaccccaccctgcatcggatgacatagaagaactcccagtatgacactgtgtgattcttggtttccagcagtcagattcaaatccaccttaaaatgtc

SEQ ID NO: 3077 - DNA, 600 bp, Bovine  MMBT19245
tttgctctttggaaagacaaatgcagaggttaataacacccgggttgcctgctcctgagagcatctgcatcactaggacagtttgataatgagattttgtataaaagaaatggacattttttgagagaagtcatgatgtaaagtgtattcttagtaagacatataagagaagctgaaataaaatccttgtaaatttcagtggtgagactatttccagaattagagctctctaattaatgattttttggaacttgttttaatygaagtcctcatatgtcaactcataattttactgggacytataatttgcaaagtgcttttaaaatttacyckcctccccccaaatcctatataataaacaactaatttcttctgagataatttattcttagctcaggctaagaatgctgcttaaagttttatgaaacatctacaaacataacagatcatgcycattttcttagcttttattcttactttgttcccttggcctcaaatccataatttcctgagggcatttcagtgcactttaccttagagaaaaactagttaactacgtcctaatctcacgtcatgagaaattcacaaaccccttccagt

SEQ ID NO: 3078 - DNA, 600 bp, Bovine  MMBT20842
cctcagtgtttgtttagtcttcatattatgattcctgtccaagagctatttggataaaaatgaaaaggtcccaaacaaggtccttgaactcagatcactcccagggagcatatgatgcattgaaggtatgattatatcagtacttaaaggcatatgccaaaggaatggccygacaagaacccaaaacatggcaattcagccacatctgttcttgaaagcgcctgcagaatgaactttttaagaggtatcayctgtcaagattcctcgactgtccctctggaagctgtctctctggaaacktattccaaaggcaagcccaaggacctcagcattccagtctttgataaataagcccctctctctgatagcctcagcaacagataaatctgtccacccaaggacattttccaagcgggacgggctgtttmaactccttaccagattgcagctggcacccgccacgttgatttttccctctccttataatcataatgggatctcagcaataaagatggatttgttaatttccatccccttctcactttctcttttaatcactgtcgagcataaattaatttcagcttaaagagctttcaacaa

SEQ ID NO: 3079 - DNA, 600 bp, Bovine  MMBT20921
taccgggctgacttgatgggcaggtccacacggaatccctgaaaaaggaagctcaggagtgagtcagggactgcacacagcacgaatctggacagtcacagaaggaaatctgcaaagacagtgctagcaaactcccttccacacagacacacagaaatagaaacccttctctacttcataaccatggatactttgcagctcagcgtctactgaacaatggamcttttgcctaactagattctgaaatgctgacttgttagctactaatattcaaatggcatactcctcctttaagagcasaataaaaatccacaccccacttacttcaacaaagatggtatacgtacctgaaaatatataacaacagcgaacacgaaaactgtggcaatgaggttcatgagattgggcaaattctgacgatagaaagcctccctcagggctcggactttgtctgtcctggtggccagtaaatgaaagagagctatgactgcgccctcaaactccgtacctgatgaatcaagatagaaatcagctgcagcctcatcacccaaagttgtcccaaagtcaacaagcaaccctaaagctccagtacagggcrga

SEQ ID NO: 3080 - DNA, 598 bp, Bovine  MMBT22007
  misc_feature (1)..(152): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagttttcatcaggttcattctaatttcaaaaaccagaaaactctggaatgagagaacccccaaatggcagtttaagatcttatttccaaaatcaggcttcaggataatccctcagctctattcatttgtgtgctggagaggggatygcttttggctgaggtcagtctagaaaactgtattcaaattgtgtggaagggaagcaaacatttygcaacaaatcaaatcaagcaatggccctctmagacaatcatgacgttaatgatgtatctgtcaattcacgtatatatataagtgtgtatatatatatactggttatgcatacatatatataaaatcaacagtattaaaatgtgtagtaacataataaaattaagatttcrccccaaacaaatggtagagtacaacatttctgcataaaattactaagaggaaaaaattcatact

SEQ ID NO: 3081 - DNA, 598 bp, Bovine  MMBT22645
  misc_feature (1)..(37): n is any nucleotide
nnnnnnnnnnnnnnnnnnnnnnnnnnnnnnnnnnnnnccgacccctccatgcccccatgccattcagtcacctgtcaggcagcatgagctaagcaggcgggggccagaaaccgctgcctcttttgcttctcccactttccagggttctgatatacccctcttccttccctctgtccctcccttctttccttcagataccttgctaaccctatggtacaggcatatattcactattgtaaggtatacmaaactacctttctcagacagatttagccccaccaccgtcttcccccatccatkggagcacacccctcacctgagtcttctactgcagtctttgaagttgccagtttcacaaaaagctgtgaggaccagaaaaaaaacaagaagaggaagtcaggaatgctgggccaggcttctaaaggcaaaacaggtttaaaagcaaagtctgtgaagagacaagttctaagtcatacttatgtttctcttgtaagttaatcactcaacttgctctttaatcttcctaaaacatatccctaccttctgattgctaacaatctttatccagatttcataaaattcaatttatwaaagaccc

SEQ ID NO: 3082 - DNA, 600 bp, Bovine  MMBT22738
atgatgacccctccctgtttgctcagtgcttagccgggcttaggcctgcaggggccacccccaggcgttggctaatgacctcacttccctcccaggtctccacaggacatctgtgtttgatcgcctcggcgctgagaccaaggcagacaccacaacggggaataaagtgagtggaaagtgggggagcccctggggcctctcaaagcttggtcttccctgagtgtcattcctggtgcttcctgcgtacacctcaccctgtctcacgtagctttccagtccagcgcccttgtctgtactccstgtctgtctgctaccctgatctctctcccgatttctagccccagggatctcgcagacccctggacagtgccctgggacccctcccaccagcatgtcccctaactggcctcgaatcttcctccaaagtacctcctcctcctgtatcgggggctccatgcccccgttccaggcaatcctgagtctgagggcaccatctgtctcctgtctgctgcctcgtcccattgggatgggcagtggccccctagctggtgtctgtgcagctccaggggaagccctccagccccttccccacagcagcag

SEQ ID NO: 3083 - DNA, 600 bp, Bovine  MMBT22976
gaaattcagacattggggttttgagataaatcatattaaatgacactctttagtatcaccagactgaactcacttgcattctaagggaacattttcaaagccagacataagtcagccaagccaggtttttctcccatttagttctactgaaaaaatacatcaagttctcttacaagtgctttcctggaagttaggtgggaaagaaaaatttttgtaataaattattgtgatattgcattgctracaggtaaatgatggaaactgggatggatttggtcctgtgtttgaaactaggtgatrggatctgcaatcatgcaaaaagcttgcaatcttgcagttgtgtggaacagcataataactaaggaggagagaaaatatctcaaagttcagcaccataaaacttaagtaaatgttaaaaggagtcaaacttttacttggccccattaccttggtgaaagaaagcttcatgcagccacctaattcaaatagaagagggatgggggaaggaggaaaaaatactttaacactcacaagaatagctcactgaagtagcaacatgactaagtgattgagatttatcaccagtgaaaatgttactta

SEQ ID NO: 3084 - DNA, 602 bp, Bovine  MMBT01288
  misc_feature (1)..(2): n is any nucleotide
nnctgcccaatgcaggaaatgtaagtgatgcggstttgatccctgggttggaaagatcccctggaagaagaaatggcaacccacttcagtattcttgcctggagaatccccacagacagagaagcctggtgggctatagtccatagggctgcmaagagtgggatggacatgactgagcacgaacacacacacactgcacaatccttcatctcagargtcacagtgtacacacagacctcacctggagtctcagatgtgcctggaccatgctatcctcatcctctatcctccatactctctayaccayacataggctcccaccygcctgtgaagtcttatgcctcagtttcttccactgcacccgacaaacatcccacccataggtcctcacaggacaacacacacggcccctttggagcatcaacagccagggactgtgtcattaagctgctgacaggtggtccctaccagcagctaccctccccccacccagttctgcatgcccagccttctgccagagccagacagtaaagcctgcctcctggcaggcctggccaaaattgtcaggaggttgatgatgtgtctgaaaaggggggaaaaaa

SEQ ID NO: 3085 - DNA, 600 bp, Bovine  MMBT01670
ctaacatatcattagtttatataaatctaacattgtctactttaaagtaatactccacaatgaaactacaaaagcaaaaagaaaattactttaacttttgaaaggttaaattaagaagtcactgctgtagtctaagttggaaatagagcttgggttctctttgaaggcagaaccaatttgtctgttttctcagcactcaatgattgtagagatattagtcaacaaaaaaataagtactaatagcttttggaaacattagcctgagaaccattttccatttagtctgtagttagttaatcragtgtatgttcatttgtccatataagctataaaatcctacaatgaagatgtaattataattaacattgctgaccagttaaaaggcataaacagtagtgtgcccatcaatatgcactctcaatttgccggcatttccagttatgccagatggtgaatttaatgatggtgccttgtggtgcttctaatgatttttgtgcctgatggtatttttatagggcctgttgtatcatagaatgctgaagggtgacttaataatgatcttcaagcatatgaaaggtcatgaagagtataaagtgacca

SEQ ID NO: 3086 - DNA, 600 bp, Bovine  MMBT02029
ttttttaagaaatagcttttgattgcatttcctyttcttttccatttgaggaaactctcggattaaaaaggatgaaagtcagaaaggacctacttagctatctttagtattatgtttttattagtgtaaattaattagggtaaaatcagataattcaaacagcttttaaagattttatatatgtgtttggtatgtatgtatgtagatggtaaacaagagcttctctattggatagttctctgagtggggggcagtttcccctactttcggaagcttgtgtgctaggcagtgtgtagttcyagagtgtcagactgggtcatgccaggagtgagaactttgaacagcgagggaagggacagtcacgttctggagaaatggagttagctggacttcagagttagcaacagctggcttttgagggacataagagcaaactgctgcatgaagggtgggcagtggagttgaagccagcagaacaaattggaattgcaagtgtagaattactcgtgtagagccagtaagtagcctaatccaaggtatgggcaggtaagttaaaaaccagcatgtctgttggttaaatgattcgaacagagatgcctg

SEQ ID NO: 3087 - DNA, 600 bp, Bovine  MMBT02126
atacttggggttgggatgcttggggaagggtgttttaaaaaggcagaaatgggacaatgctggtggtacagtgattaagaatctgcacttccattgcagagggtataggtttgatccctggtcagggaactaagatcccatatgccacacagcacagccaaaataaataaataaataataaagtttaaaaagaaaggcagaactttggctgaacctgaggataagcaagaactgttttctcaaaaggaatctggcacaaggttgatgtactgaaaataattgggtagtgacactatcccmtaacttcatgaaggcagggatttttgtccattttgttctttatcatattccaagcacagtcccaggcaaatagtaagcactcgaaatttctgttgctcttgaatgaacaaatgaaggaatgaaacaatcaagttgcctgaagtgatatcagccggaacattgaaatttcagggcaaaacatatggatacaatctgacaatcaatgggaaaaaagttctaaacagaagagtgaaatctacccttagcttcctttctattttctacattcttttttctaccttgctattctcctctcttgtt

SEQ ID NO: 3088 - DNA, 600 bp, Bovine  MMBT02369
ccgaactcgggcgccggggctactggggtctgcgcgtggcgcgggcggtgcgtgcgtccccggggatgctctccccgggtcggactgggagtttccatccgccgggtgagggggcgctcggagcagaaatgctacttaggaaacttaaacctgaaaaatcaggaaaagtagtttgggccgtaagctggagccccaccaaggctaatatggagggagagtggggagggggagtgaggacgagcagggccgattgggacagaggcggcgacacgagcaggagccgagttcaaaaaggcgctygagttctttccttcacttgagaggaatctgagaatagttggagccttctcccttccgagtctgtctcctgggggatggggggcggtccgaggagctcaagagattcttcttttagggcgggatatatatatatatttttttttttttttctcttttatagagtaagattatgattctctgatttttttttctttctttgtaaagtgccctgggactttgtgttactatcagagccaaataacggccttttaaaaatctcagtttttttcctaaactgggcattgcgcaagtatgagcaat

SEQ ID NO: 3089 - DNA, 600 bp, Bovine  MMBT04940
tcccaaacaaggagatagacatgatgtcttctgagacctcgcagccataatgggacctggatgatagaagaagccaactgtttgagcctccagtgttaatcattagggtttarttttttttttccctccctaatgttttcttcattttcctccctaatgtctacttcacttttcattcactttaagtcgtgtattctcagtggggcaaaaattggttcttggtgtaaaaaaaatcttaatgcagtggattatggttctccatatctttattctacacaataaaatcttattccttagtawttctctcattagggagaaatgtaatttaaagctaaatttattaattaaatatattttttcttctagggcaaggggcagtggtaatgaaaaaagaggttgaaaaaagttatttttaaaaggttttatagatgtattgcagtccaggattattgtgttctatgtgctatgtgtagtcatattaatagcggtttgttgcaagatgtttggacccagataatgtttacagtataaattcctggctactctttatgctgtaatttcactctgtccatcatggacagaatcagaaaacactggtca

SEQ ID NO: 3090 - DNA, 600 bp, Bovine  MMBT05960
gggaacttccttctctgtaagaattttgtgctaatcgattgaaaacatacacacacacacactcacacaacacgcatatatgttcctttgtcactaagagaacagtttaccaacctgtctctttgatggtcctcytgtctagcctaaggaaacaggagaggrggacactgaggatgctgtgtgtgggcataataaaaaattcctacgggggcacaagaacttcactatagacgtcattaaagctgttatccttagaggaactggcaagcggcagatgagttgtcacaacttgattctttsatttctgtaacaggaatgatcttggcacagtttacaggcagcaractgtgcttagaaaatggtggtgttttctcctatgtatcagaatagataaccatatgaaagatggtgtgatgaagagaaatgttatacctgttaccaagtgtatgttactttaaactctttccttaatcatattcccccaaactaaccaatagtacttttattaccttacatagatgagtattatttggcaaattatgaaacagtttgytacactttttaaaaagttaataacacagcatctgattctttttaata

SEQ ID NO: 3091 - DNA, 536 bp, Bovine  MMBT06986
acacgtcagcttcactttctctgcccagctggccaattgttccaatccagtaaatcacagattcggcaaacacacttagggaaaaggggcagatgagtaaccccaagctgtgctgataaggcgaccaggactaagtctttgaatgtgtgcacaatggaacaaacaccttttatccctccaacccaccaggcaagccacaccaggaaaatcattttccaattagtcagcaggtttcagcgtcattacctttgagatcagatttgctaccattcaaaaaggcatcagagacagtggaggaaragttaagcatcatwtctggcatctgaggtctgggaggaggtgcaattagattagctgcaggaaaatgggagggtttacattaccagaggggctctacctggctccaggcttcacagtgaacaacgctttcaccatatggcattacaatggattagtgatcaagtacgattaatcctaatagatcgtcttttcaacctcagtggcttgttaggtgagaaaaaaattgtctgtcccca

SEQ ID NO: 3092 - DNA, 600 bp, Bovine  MMBT07253
agatcggggtcccccgccacactctacgcctggcgccccgtgcgaggacacgagtgtggacagatgggctgactgggggaaggccccaggcacactgtgccacgtggacatcgtgattgcctagccccgggaggtgtgtcgaggtcttatgcctcatttacaagacgaggagacagaagtgcagagcagtcaagtaccacggctaggaaaggtccctgtagtgtctggctccgggcccacctttccagcaagcgcttaatttctctgggtctttgtttgctcatctgtaagatgctccayggtcagagacacctccccctgcagactggagctagccagccggggactggaaggtggcggccaccagaccccgctcctaccgcctgctgggtgaacgacctccttcagggtcaagtctgccaaggaatggccaccagtagggagttctaattggtgaggctggcggcacagagcccagcaaygcagccggtggctgatgctgttgcacaggaaagcgctgagcacagcaaatatagccgttgacccaattcagttctgttctgtcttcgagaaaataattgagtttaaatgaataggttt

SEQ ID NO: 3093 - DNA, 600 bp, Bovine  MMBT07336
caggcatgaaatagatgtaagctgttctgcccattgctttataatcccagcacactagtacagagaatgcccggtacagaacacaaataaagggtcagagatggaggggttcccttaggcagggctgaagacttcagtctctggaatttggagttgaggctgcagtcccrgtttttggatggaccactgggtgtgtggtacagtccatgcttttaaccagatttgaacagaacggccacttggcccgggtagaagtggatgaagtgttcggtgtcatgtgtcacataactcgttcctccmcatgatgcagcaccagatgggggtgtgcttcttgccacactccttcttgatatgggcckcgatgcccttctgcatattatatatctccagtgcctgagtagcaagtcctccgagtcctgtcgcatctcctctgacatgtcagcattcttgatcacggcctttgggtcaccaagaagcaggggctggccggctgcgacggtccctgcgggaggggttggtgaggctcccacccgcggagaggggccccagtatgctctttcgaccactgtgagttttgcctgctcctgagcttcgtgtaag

SEQ ID NO: 3094 - DNA, 600 bp, Bovine  MMBT07353
gtttgtctgctttcttcagcttttgctaaaggctcagagacgaggctgaaccaagaaactgaaatgaaactttttgattatctgtgtttttccaattaatcctgctccccactaarggatcatgagttggctgcatcactgtgtccctaagtgatgaatccccatttgccagctggccatgcatgaaccggatggcctggcatttcatttcttcctatccagtaaaatgagaaaactcaaaccagacactgaaatgtctttttcttttattaaaaacatttctcaattgtgtagctgggyactctgagagtgaacttcaatatttctgaacctctgaatgytggaaacagggaaaaaactaccattcaaagaagtgccagacaattacataatctgtctctgatctatggttctcaaccctggcaccccattaggaacaactggagagctgtaaataaaaagatacctgccaatctgcccccttcttacctgaatggggcagcaacatcggctttaaaaacaaaacaaatcaaatcaagccaagcaaaacaaaacaccttccatatgataatatgcggcaagaatcaagaagttcactgg

SEQ ID NO: 3095 - DNA, 600 bp, Bovine  MMBT08491
agctgtgtcaaagtggtagctctcccaaggggaggggagcctgggggctgcagggcagaggcagcagagaggatgtggcagctaacaggtgtcctcattacaagctggggctgctttcttgctctcgaacttggacctgtcctttgcctctctgagcctcagcttccccatctgtaaaatagggctaatcctgactccctcccattaactgggaggaatagatgagaaatgagagaggagtcctggtgcctactcagtaaatatttagcaaaacctccccactcccctgctgatttgctrggtcggttctacttagccttctggtcttagcataaacagcccctctttggagaagaccctgcccctcccctttcatatcacaacacactttagaatgtttgctgatttacagctggactgttacagctccacaaaggcatggcaggtctgtctcatttgtcaccagaagccagtgcttctcagagcatgttccctggaccagaggattcagcatctcctgggaatgtatttgaaaggctaatccttgggtcccgccccagacctgctgaaccagatactcaaatgcgggctgggtgctcg

SEQ ID NO: 3096 - DNA, 600 bp, Bovine  MMBT09056
tacaaggtcatcttatatctgaaaaaaaaaaaaactttaaatgaacttatttacaaatcagaaacagactcagacttagagaatgagctttcggttctgtaggacgtggtgcaggggagcgatagttagggagcgtgggactgacatgtacacrgtgccatattcaaaatggataaccaacacggacctaccgtatatcacagggaactctgctcagtgttctgtaacagcctaattggaaaagaatactgaatcgctttgttgtacagctgaaactgagaaaacatttttaatcaaccrcactccaaaacaaaataaaaaattaaataaaacattttattcttaattttttttcagggacattgaatggcctagtggaaaatcatcttctgagtgttccaggggcttttttaaaatagaatttacaaagatgttcagacatctgcacatttcttagccttggccatcagtcaaacatccaatgacaaattcctctctgtcttaaaacytctggagaatttctttcccatgttggatttatttgctttttttctttttgcttctgtaataggtattgctctgacttgggcttccctttag

SEQ ID NO: 3097 - DNA, 600 bp, Bovine  MMBT09579
attacctcagtccccctggggcctctggcctccagtcctaccaaatcctcagagggcaaggactctggggcagcagaaggagagaagcaagaagtgggtgatccggactgcttctcggagaaggcagagcccgccgaggaggaggcggaggaggaggaggaggaagaggaggcggaggaagaggaagaggaggaggaagatgaggaggaagaagaggaggaggagggctgcaaaggactctttccaagcgagctggacgacgagctggaggacaggccccctgaggagtctggggccgckgcaggtagtagcagcaaaaaggaccttgctctctcaaaccaaagcatttctaactcccccttaatgcctaatgtgctccagaccctgtcgaggggcgcagcttctactagttctaattccgcttcttcctttgttgtctttgatggtgcgaacaggaggaatcgtttaagctttaacagtgaaggcgtcagggccaacgtggcagagggcggcaggaggctggactttgctgatgaaagtgccaataaagacaatgccacagcaccagaaccaaatgaaagcacagagggggacgagggg

SEQ ID NO: 3098 - DNA, 598 bp, Bovine  MMBT09857
  misc_feature (1)..(12): n is any nucleotide
nnnnnnnnnnnntaaacctaactggaggtgattagcataactagagatgattcagcttccatggaaaaacacaaaagcaatgaatcaggttgagttttgaaagacagaaatggaaggttatgctttcaactgcaggctgcaaatggaaacacagaataaaaccatattacccctagttcacctaaaagccctaaattgactaggttggtaaggacacatagacttgaaattctggatcagattttaaaagtctctatggaacacccaagctattaaaggagaaccaaattataatatatraagatgctactagggctgggacttcccaggtggcgctggcggtaaagaacccgcctgccagcgcaggaggcgtaaaagagtgggttctatccctgggtcgggaaggtcccctggaggagggtggggcaacccacgccagtgttcttgcctggagaatccccatagacagaggagcctggcgggctacagtccatggggtcacagacagtcagatacaactgaagcaactcagcacagcacacactagggctggggttttgagagatgccatctgtatccctgcctttgaggaaggaat

SEQ ID NO: 3099 - DNA, 600 bp, Bovine  MMBT09867
cttggagcccttaaatctcactatggagcattgacgtctcgtctctcaccactgttcatgaagcagattctactcacaagtgtgtttgccttcttaatgtggcttcagcaaagtactcgagggggaggctttgagggaaaattattaataacttggctctaagctcactgggtctgacccctctgtacccctcggaggtggtttctgaagggccactagacccagatgcctttgctgcttcggaaacgccccccccgtatctgattcccaaagcaagtgggatttctgcagtttttctaytgctgtgcyggcaatccagccaagtggagtacattatttcacagtaaaataaaccttcccttctttttgttccacgggaaattactcagtgtggagtccaggcgcgtcaccttcacatttccaccggatttgcttccttcaccattgtggattctgctgcatttaagagtgatcaaaagtcacagaagcctagtttccattcctcctcttttgttacttcctaatctccaatttcatccacctccctctccygcctcaccattgtgcactaacggtagcgacttcgagtcaaacccatct

SEQ ID NO: 3100 - DNA, 600 bp, Bovine  MMBT11384
tagaaggaaattacaagacccttctctctgacgttatgtctttttccttcctccagctctctctgctccagctcagagatccttccattcgctgcttcctcctccctcaaatgcacgtggttcactatctccaagtctctgctctcatgttttctatccttgagctctttcaggagcactccactgaagcacagagcaaccataccagtgcttcgcatccttctgtttattttccccactgcacgtaccaacacccgacacgctatttcttaccttgttcgtacattttctgtatcccayccccaacccttgccccaccartgagttccattagggcagggacttttcgctgttttgcttactgctatattcccagtacctggaatagttcctgacataataggtgatctaaaaaatactttttgagtgaatgactaggttttcacaaaggcatgaagtggcagtatattcaattaaacatcccattaactttaaagaatgaggatgcaacttcagtagaaaaaaactttaggtattcccaatactaaacattaaccatttaaaaaactgtattcttaacatttctctagtaaagcattt

SEQ ID NO: 3101 - DNA, 600 bp, Bovine  MMBT12251
ctggcacctccatctgccttcgggcagctatttgtgtgaaggcaatagattactgcctttggtgctactcctgtgtgtcagccgctgccatttgcctcaattacaaagtcagatggttaaacgctgaattcatatttatattatttacaatgattattcattgcatccattgttaaggagggtctcaaactgtttctacagttagaaataaataaataattttgatcaactttagcaagcatattcaaacaccgatgcttatttttaaatgtagtaaataaaatgctctaacaaataatkcagtgaagttgaaagatcatagtgtttaagtttctgacttgggtttattgtgacttagttccctttctgtgccttaagtccctctgaaatatttaaatttttgaaagtatgttgtaaactgtaccaaagcataatttaaaaatacatgcatttaatcataaaatactgttgttaaatayagaacttctggaattcaaaagcagaaactatcaaggaattttcattttaaacwtcagaagtattaagtatttttcattagcatgagatcaataatatgatcataatgttaacaaatccaga

SEQ ID NO: 3102 - DNA, 600 bp, Bovine  MMBT12392
aagaagtcagggactggtcacctcaggcaattgctgtagtttcacatgtaagaaactgggtgtttttgaatggttcaaagtttgtcccrtctttatatggcattaaaatcctatgcaatgtcattcattcaaagttccaacatttgagatagcttataccactctgttggattatatttcatttttgaatcagctaggaagtgttatattcattttacaatacaacattgcaagagccaaaaattcataccccatctgttatgaactaccaagtattcctggagaagggctgagaatgarcatactatggtctggtcattatagaatgccaagtgatcaagtgaagtgtgtgtgtgtgtgtgtgtgtgtgtgtgtttaaaaggaagtttggttttttttttagcttttgattttgttatttacttgaagtagacaaaaatgtttaaatgaacacatcactatccaaaattttggaatctgtactatacatatacttaaaatagtatttgtaacctacagatgtaaagtggaaatgtaagccttatactccttgaaaataaaaggtaaaaatggttgaggatatgagactgaaaactacta

SEQ ID NO: 3103 - DNA, 598 bp, Bovine  MMBT12441
  misc_feature (1)..(32): n is any nucleotide
nnnnnnnnnnnnnnnnnnnnnnnnnnnnnnnncttcggggattgtagtaaaatagactgtgctctttctctgctgcttgtttactgtattagcaacactctggtttttgtgtttgtaaaaccacggtataaataacttgcccaaaggggggaaaaaagcaaaagacatttaactggtcatgatatatgagagccactggggatacatgatatgatcttctcagagtttatcacttatgcctatagtgttactgctttaattcatattcaagattagcatctatgttgattgtacagcttrgayataatagttttcactctcttttggaaatatataattcagaaaccttaaaatctcatggacttktaccctcaaatcctcaaaagtttaatactataagactttgtcattctttgttttcattgatgtcatatgagaagacaagatgaaaaaaaatttaatgcagtgactatttaataccatctcagtatgggttgtctgatttgaagatggagtaaatagatttattcaagttaacatggtatttggttttgctttataaatttggagttcagcacaacacattccattagaagtc

SEQ ID NO: 3104 - DNA, 598 bp, Bovine  MMBT12796
  misc_feature (1)..(198): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtacaaaagatctgtggtaagtctggctcccgtctgcagtgactgcactggtcttgaatggggaagagaagagaggaggtatgtacctgagtaactgccrttcccccatgaggtgatgctgaagctyttgccctgtaaccctctataaagctaagaaaatgtggcctcaaagcttatttataccttgtgagtctcactgccamtttgaacctctacttatgaccacgttgatacaatatcattcgaggctctcctttcatcaccccttctgccctgctttccaaccctgcagatgtggggaataccaacacaaaacacaaattaagaatgtgactcaaagactatgtattgaatgcccgctatgtgggaggagaaatgagattttcaacaaaatctct

SEQ ID NO: 3105 - DNA, 600 bp, Bovine  MMBT12804
cataagggattctataatcttcaccagtagcataccaccaaatgcgtgttttttttaaacttaacaaaccctccgactcaggataccctgttagaaaaggatttcctgtaattctctgggaacatgcaatagaggaaaattcactcaatctaaatttctgaaaaacatacaatttaactcwattacgcttcttcaaatttttaatcttggtaaaaaaaaattgttatccaatgtcttgattttccttctaatcctctcactgatgtttcaatcattcctccctcaatttaggtcttaatkctagaactttgcatttaccatttgtttcctatcatagtagattaagaatactgcaacttcaatcatctcttggattttaatcagtgcaaatatggagtccttcaagcaactgtctgactaggacacctctttgacagaaatgcaagttcttacaagacactaagctgaaggaggcaagtcgaccagatcagttttcagctgcttcctgacatcaccatgaatgactgacatcccatgacgattaacatctttagcagtttcctctccagaagaggccgcttctgactttaagttcgtaaa

SEQ ID NO: 3106 - DNA, 600 bp, Bovine  MMBT12875
ggcttggcaaattcaagttttgcttttttggaacgttccagaattttttttctgaatatttttgatccttggttgattgaatctgtggatgcagggcctgctgacaggaagggctgactggatacaatttcctgtaactgcatcacaactttctttgttatcattwcttggtcttttagttatcaccctggcttgctgtgtgataattcatcacgtgggtgggctgtgctttgcttcacttctcttcaattattgtcacttgaattgattcctagtgctgatgatgattagccatggagygtgggggcttttcatactttggtctaattttcttagaatgaattcccagcagttggaacatcaaagcaaaggggaattagtgtttcagtgctttgtgtttcttgctgtcatattctgattctgcttatccccttgtctgcaatgccctgcccattcacttcttgggatagtagttatctaagataaagaagctttattttctaggttctattctatccccctgcactgcctccatttcctctaggtttctgctttgcttgctgtggaggctgtgttcccacttaagggtgggtgctgtaa

SEQ ID NO: 3107 - DNA, 600 bp, Bovine  MMBT14066
tgcaaaaatgtcagcttaactttccatttcaagaacaggggtccagggttaacaaagaagcaaaatatataacatgcgatcgatcatgtggtcattgtgaagaatcatttacttcataattatttgtttaaggccataaggtaaaacagactaaaaaattagcttctaattatatattccatttcaaatgcattagactgtgtttttcataaatattctagattgacgtattcagggtaaagttaaatataagattcttttatgatatacggaaacttttccccaaagaaacgaagtgcygaaaacacccttttccactcttgtccttctttagttgctaggtcatgtttgacttttgtaacccacggactgtagccctccaggcttctctatccatggaattttccaggcaagaagactggagtgggttgccatgccctcctcccggggatcttccaggcccaggaatcgaacccgtcttcctgtgtctcctgcrctgcaggcrgatactttactggccaagccattggggaagcccaaccccttttaaaatgaaaaaagaagctttgtatgtgagcagccacaatatatgtattgtcc

SEQ ID NO: 3108 - DNA, 600 bp, Bovine  MMBT15718
actggatgaacattggcccggctgaagctggatcttggctccccgccaccccccaccccagatgtcatatgtaatatctgggtatatgccccagctcggagggacctgggagaagctttccctgcacttgcccgctgagtttggtgcccctcttccgcacgtcgtcccatctatagtttactctgtaatagcaggaaagcctcaggaagattgcatcagtagttccaaagtctcagaactcatgcatgacaaaaaagtcaggattcaaatctaagtatgtcagacatcaatatatacttrttccatcatggttagttgtctactgaatgaattaatggatcctcgatgcatagggaagagccaacaagttgaattcagcaaatagttaatgagtattttcaggataccaggccctggttcagcccagagggataaagagaagaattatacaagatttcagtgatcaaaaagtttatcatctattgaggaaaataggcatgagcagataaatacagaggcacatggtgagcaccatgttggggatatgaacataacaggcagtgggggcacaagagtagaaagtgcctgacattgagtggg

SEQ ID NO: 3109 - DNA, 534 bp, Bovine  MMBT19368
gtggcctttttctccccatctcccacccttctgcagtagctctgacaattgaattctcactggtgataataataaaattcataagacagagtacagctagttatgcctctagcaagatgtcaaatttcacttgcacaaaattaattgcacctaattaaactggggtcattggcattaccgtaaagtgaggctatttattagacaaagaaaatttcacaaatatcaatttgctgtcctttcaggtttgtaaaagagaagaattgcttacataattaaatttgttttgccattttaatagtrttagtcctyaaaagatcctcttcaaawtttcctttacttttaaaattgtgtaatattttagaatactggaggtaattcttggaggagggcataaaaaatagtaagagttttctgcagagtacccgatgacwtttcaaatagtatattaaaaaaaagaatttgtaaactatcatttgcaatggcatgtaccttggaattactcatatgaaggatattctatgcaaattaatagtg

SEQ ID NO: 3110 - DNA, 600 bp, Bovine  MMBT22459
accttgctttcacactcaaagttgtaatggatcccctgcaaatgcaggcagttaggaatgggagaaggaacctacttgcatgaggaggttggccataagttgaaagtgaggcttatatttgattcacaccagatgtgaaaagatcattgcacacttccaaagcctcagggtctaccaaatgtacaaaagtcatagtccctgccatctgatggttaatgacattctctaaaccagagtttctcaagctttttgtgattactaagcttagttccagcccctcctgaaagtgtagttgctackgtgccttcctaggtaggaatgggattaagagggtctctgaactagaaagtcttcgtctgtctggacttcactgtaaatgttagcattgcatcttggaacacagaaacttggtcaaatctggtagcaagatggtaaccaactagtacaaagtatgcctagaatctgacgatgtagagcaaggcaatgcccagacaaactcaggcctatcgtgaactgctctaaagcaaaccacaagagtacaaacctgttggttttgtttgtgcctccttagagtcagggaagttagtagaacagcaagca

SEQ ID NO: 3111 - DNA, 601 bp, Bovine  MMBT22881
  misc_feature (1)..(1): n is any nucleotide
ncargctgttctttattgggaaaggtcccagtgcctacattcagatgtctcaattttggacggatgccaatagactgccccagaacccactggaaatgtaggagtgagaagatagcgaaagtaccaggttttggggtgtattcatagaggtgatgataaggacctgatttactgaagagaaacgcagcaaggagactgagatagaagttggacattttcttctagagcatgtgaaatgcttccttttttttgatgctctcagttttccaagaattctaggctcagtggcttttcaagtgtyaacacacactctctccagcctgtgcctctgcctttaattactctactgactgcagacactacctggagccaggtcctggctgtcgcagcttcagagggagtttattgccaaccatgcattgtagggactaattgtgagccccgtgcacctgctggtgccccctgtggcagggacttcagggggaagggttattaatgagcttgttgctcattataataaaacaatggggaagttggcagagggactggaggtccaggtgtggtgtcagcaaaggttagttggcatttctggaaacaggac

SEQ ID NO: 3112 - DNA, 600 bp, Bovine  MMBT00074
ctttgagaatgtgctcgagcatctctcagctcacgcatgcaccccggcccagctgggagagagaatgcaggaggagtgggcagcttcccttgagagggcccagcagctcagtgggggcgggggcagacgcccaggggccaccattctagatgcctgcactctggaccccaaggcctggcacgagaatgttcccagcctgctctgtgcctcctcctctgcggccctctcactgccccccaacccagaggcatcccctgaggagtgggaacaccctgttacagctccccaggaggtggggcrcccrgcacaccgtgttccagaggccagggagagcgtgttcggcctcagggcggtggaccgtgtgtgcacacctgctccaaggcccagtggcttggcaagtccctgtcggggacagccacactcagccggacatccagctcagcaaacctkgagatggccagagataacaggaactcctgggagactccagcctgccccccttaccagaggccctgcaaatggtccaggagaccctgacagcccacctctctctctctctctctctctctcaccggggaaagagcaatagcagaagcagtg

SEQ ID NO: 3113 - DNA, 603 bp, Bovine  MMBT03601
  misc_feature (1)..(3): n is any nucleotide
nnntagttcagatttcctcatttttggctctgcagttaagctcaaaggcctctagactctgtcctgttggctgtggcttctgtctcaagccacactttccctagtcttcatttggtaagctgacctcagtaatgaagtctgacccctctgagagtagtaataatattcacccaaaagaaatatgtagcagttttttttaaaaaaaaaaaraaaaagaaaaatgtagcggtttaaaagaaaatgcactttaggaattatgtattatgaaaagtttcggtagattccaatttgaaaattaacccrcagcagcatctttgtgagaatgtagacctctcagataaatgggtgagattctgaccatagtagataccatggccacctccagacttgcccttcttcctgtgtgtcttccagagataaggacattaacagtctcgcctccaaagaggcagtatctatttgaacataattctccaaatttccgactttctgaaygcagatcaaagtaaggacccacactttcttcttctaaacatttgttacatccttgagttarcaaaagcagctcaaaggcttttctttcaaaggctgttgttaatcagt

SEQ ID NO: 3114 - DNA, 600 bp, Bovine  MMBT04178
agagggctgagtcacacaatccactgtctacactgctccaggagggggcgagctgatttatgagaaggggagttgggtgggagggactcatacagcagaacctgtctttagaracctaaaagacaaattgtagccctgcgacagttatacaatgatgtctactggggaagaaactcctctccccaattcatctatgctcagataaatgctgtatccactactctgatcctgtgcgactcgtgtgagtcaagatgaaaacagagtgtaaataaatggcttcaccytggcttccgtattacyattaatattattaaagataaacagatttggaagaaaggaagcttcctgggggctatgaatgaagatggttccatacctgtcaccaaaatgctacggccacattcagaatgtgaggtttgcatcaagactaataccttccttcaaacgacagcaagagtgtcctattaccaacagaacaaaaacaacatccccatgagagcagtgaaactcttggccaggaataccaagcccacmgcaggtcttcgaggactcagcttgagaagctgagggcaaggccttgggctgggtgcattttgatcg

SEQ ID NO: 3115 - DNA, 600 bp, Bovine  MMBT04489
ctagatgcctctatctgaagaccaaggagcataaatgattaattcctgctattccatttttaaggaaaagaacttctcaaaaaccctcattcaattttatcaagactaagaagcctaatattaagaagttgtaatcatttatgttttattaagtagtcatcaacagcaatatcctaaaagtcagtcacatttcacagctagagggaatcatggcccccggctgccatctctcccgggctgcccatgagcatcagttaagaggggcctctgctccactgctgcttccagaccacacacccygcccctctgccctgaaaccccagctcgcaatctctcatcatcagaatacaccatccattgccagttttgttgcaaatgcctgggtcagtccctcccctgcgtgaagaatttaactactagctcactgccattctctctaaaaccactccttctttctgtttattccttctaagaycccgctctcaaaattcccatagttctcttccaatgcgcttggcttccactacctgagtcactgactgctgtggtcatctcctggatgatatcactaccaacaacttcaaactgtctataatctga

SEQ ID NO: 3116 - DNA, 600 bp, Bovine  MMBT05839
gtcataaaggaggtcaaatggcagagctgatacccaaagattcttccagcagtctggctctagagcccacattcttaaccaaaatgctgcatacagtcctccatccaagtggtctgcagggaccacatcagcagctgggtgaatctagatacgtagtgcagactacactaggctattctatataaggggcttgagcatccgcatatttggggatccacggggatcccggaaccagtccccacggacaccaagggacaactgtactagtatctctcagtggagagaaaacaacacaaaaargaagggggtcatagatgtatttagaaacagacaggcctgggaaaaaaagactgatttggaagcatcctaagggaaatcagcctatcaagcagctgaagtcctaatggcctcaaaaccagttcccagagagtacagtcccagagctggggccaccagagagcagcacagaaggtctttgagaaggtcaccacccatcccttatctggtgatgaggctacttggaagttcactgtgaaagaacaggcacagtcacactctcagccttcagttcatcctggctgaacactttctccctctctc

SEQ ID NO: 3117 - DNA, 600 bp, Bovine  MMBT05853
tgtaggccatgacgtggagaaattggaacctccttgtacattacttgtaggaatgtaaaatggtccagccattgaggatgacagtttggcagttccccaaaaagctaaacctaggattgctgtatgacccagtgattgcactgctaggcatatacgtgaaagaactgaaaagaggagcctgaacagacagtacactcatggtcactagggcactattcacaatagccaaaaggtgaaaagaaccaacaatatggctatttacgtctcctgttctgttatcagtccccgtggaatatttartgattatgttattatgctggcctaaagttaggcctgttttattggcctcaagtttcaattcaaacatttaaaaagcaaacaaaggccagaaccctctcacaaatgtgaagtggtcagagaactggtcttgaagataatgatgacaagaaatcaccttggggttttctgcaaacttcttcttggccactttccgaagactttcctcaattccctttctagatttttccaggatgtcctctgtttggtccaccaacactactgtgtggccagttgctgcagcaacctagaacaaaacaaaaa

SEQ ID NO: 3118 - DNA, 520 bp, Bovine  MMBT07265
cgataaagtttttcattcacataaaagtctggggaaaactgattgaatctggggtgttgcagatcaaaatctgagtctcttattccctgacttttgcagaaacaagtggcagatggttaaaactggaacatcgggcccctgctcctcaattgggaggcaggccgctgtgacggcaccgtggagcccggggatgctgagccgcggcaacgtgttctcaggtaccactcactcagagcgcacggctggtcttctctgggatcggcagcgctgctgggtgaatgccgcacacagacacttacygcttagaagaacttgccacagggggcaagtgaaatctctgctctgactgacacaggatggacgagcagaggagaccatccatcagtgtcaggaaagatctgaagcacctggctagtcagttgaaataaaataaattatttactgatctcagaatccagctgctcacttgactgctcakaaagactgtgtgctgccctggacttcgcagttgattctgttt

SEQ ID NO: 3119 - DNA, 600 bp, Bovine  MMBT07355
cagattttgagagaaataaatgaaattgtatgtcaagatgcataaacttattattataagtagactcattattatagattttgtaataaagaataacatggtaccccaaaactaatatatgtcaattacactttaattttttttartttaaaaattattttcttttgattgatgaatatttttagtaaaattgctaagagagctagagataaatattactctggatttagatatgattttttattgtattgaagaaaggaagttatccaagatttattaatgggcactagtgctacatcygtcatctgtacttcctgtttctcagatttgtatgtcttcctttgcttccaagccccttagcctttcaaaaggaaaaacatgcttttagaccagaggttgctcaaccctggcttctcagtagcatcatctaggggcttttgaaaaacactgatgcccaggccttatcccagaataactaaggcagaatctggacattggtcattctaaaagctttccaggtgatccaatactgagaatcactagtagcaaatgaaacaccacctatgctatttaaaaatcacacacttgcaacaatacact

SEQ ID NO: 3120 - DNA, 600 bp, Bovine  MMBT08397
ggattctacacacttctcctatattgattgcattatcagtagtgctaatcacacatatcattaccagccaattacacaagcacatatctaaactaggtaacttattcaccaacattatctcttacaagtcttaattttgtaatgaagttgattatcctcttacccaattgagtatagctacatattttgatctagcaggctaaatgcaagtttattgaattatatagtagataattacttacctatgtttgtaacaacacaaaatgagggcaatttgagagtagtctgtttcttattctrtttaaagagtgcattagagaaggttaattgttttaaataaaacakacccaaagatatatttggrttaaaaaaaaaaagcaataaaagtgtacttcctgcacacaaaacagaattgggtatgagaactggtacttggggatgcartcattcagacacccaggtaggtttctcacatattcagttcagggtcactctgaaagattcattttagggagaaaggacatggaggactaatgaaggtgtgtatgggctgaccttgacagtgaggaacgctaatactctataggctaccgtttagtc

SEQ ID NO: 3121 - DNA, 600 bp, Bovine  MMBT09284
agtcacatgactgagaaattctactttgccacttcaatggaatacttattaaaccatatagtcaatatggatacagcaaaaactaaagataaaaataaaagggtatctgaaagcaggatggttcagtgtggtaacagctcaatcctattttgaataacctgcttaaaactgaatattttgaagctgaactttgcaaactggatctttctgactctaaaacaagggaacacaataccaacaaaagatcttttccctattacgtaccatgtaacatcaatggtgtatggtcatgcaggtgtrtaacttacaggctgctatcgagtaaaacattacaagtagactcttaagttctcctgtcatttacaatgctaacacaaatgacacattcaaacttttacatagaccagcttgtggtacaattcaatcatgctatgtatctggaaaggagacctttggtttcaatttttaagacagtactagtttaggtcaaaaaatttctttctgggatsaatcttagggagacaggaaagattgctcccataggtactgttttaagatggagacaatctgacatctagatatacattatcattatcagaa

SEQ ID NO: 3122 - DNA, 600 bp, Bovine  MMBT09935
cttaatcatacccattggcacatgcgtgtgattagtctatcttccatcattgttggtgacggaggcaataatgacatataattagttactcccttctaccccatcattaaaatctgcactggtgttccaggctctagatttttaaagactgaggaaactgcagggattcttctgcaaaattcgagaaactcggtgcacaggacaaatgtgttaggaagagtgtgctattcaaaaccttggctgacagagaagcagcatctgataacttgagagatggagtatttcctgccgtatcagtamacaaggatgtcacaggcatcagwgattgcagccttccagtgtgagcctcagggcatccaggaaagagaacaatacctkcsatctagcagtcwtcaggcttcagccactccctacggtaagccccaaaggagctcaggatgtgaaaacacaggatactgacgcagaatagctaaaatgcctataaaaggaatgacttcagccagcccagactcttgcatcttcccatacatagaaaagtgctaaattccttaacttgggatgtctagttttccttaattcataatactcttttgatgttca

SEQ ID NO: 3123 - DNA, 600 bp, Bovine  MMBT10516
taagaaggcttaatgtgcttcagacttctcaaatacaattgagactttaaaattgaatttgcactcccgtgggggaaaagagtgtggagctacccgcagggcatccagtggacgtgcagtaggtctcggaacagaactgcaggtaccccgacggcctctcccctggcagctgatgctccgggtcaaatgaatcaggactgagctacaaggtttaaacgtgttgccckcctttgaaagcactgagccccactacacgcctcacagaccacaaacatcctcatgttctgacttatccttctmggccgatccaaaatgaagcatcggacaataagagattcgtcacatgcagaccagcacacaaagccctgtttgggagttgtgtgttttctggctctttttttttccttttaataaatcgcaatatcctttctctctgtgttcagttgccctgaattaggcgttaagattctgtgcagcaaattagagttgagaaaaggcacgcattttatttaackcagtcttgctaagtttgcggtaagcactgcccatgaggaaaacaaaccagaacaagggaaggacgttccctccagcttgggtggg

SEQ ID NO: 3124 - DNA, 600 bp, Bovine  MMBT10633
aagtcaccattgtaaagtgaacaactcagcagcatttaggacacccatggtgccctgcaagctctgtatccacactgggcacagcaccaacccaacacacgtgatgggcaggagcaggggaccctggctggctcaaggagccaggcacgtgctcgcagctgcacggatcctggacgaaggcccgcccacccacatggggtcagcacccaggcatgtctgcaggaggacgccccacgggggtcaggcattgggggagccccggcttacctggccatggaaggatagtacagcatgagggcrccctccacgctcagcagggcagccaggccccaggtcatsaggtggtacagcaggatggtgctgggggagagagaatacaggtccagaacctcaggtccagcrcctgcccggscccacactctgcgagcrgcggtaaaacacatgcagagcagamtctcagcaagtagccccctgattgtgcctctgaggttgttttgtttgtttatttgtttaaacacagccctccgtacagatccggccctctgcctgcttttgtaaataaagttttattggcacacagctgtgcccacttgtgtatgt

SEQ ID NO: 3125 - DNA, 600 bp, Bovine  MMBT10730
catttggaatgcttcatggagaaaaacaaataaagcgctccatccttaatttcctgagttacattataaagtgaatttgtcacttattagagatgcctctttttacaaattggtgcttaaatacatctgaagtgcataagatttcatttaaaataatacattttacagtggtataaatcacactgcattcctgactccccaaatcctgtaccagataccattattttgcttgtcatccaaatacaaaacctctcaccatgagtcaccaagtccttcctccattctctgtagtcatccctstttttggacagagataaccaaagttaataaagtaaaccaggcatcattaaccctagcatgatttttttacataagtacagcaagtatggtaactgacctcataggatttttaagtttgctttgctggtactttgcataaggcatcacagatgagacttttcaaagcctctcttggctaacacacttactcaagacctcaccatctggcttctcttgcagggttcatagatttagatgaattcctctctttttgaggtccccaaggtagcctgagtttcctgggcctgccaaaaggtggcc

SEQ ID NO: 3126 - DNA, 600 bp, Bovine  MMBT12584
atgagttcactctcttgccaccttgtatcattgtgattatatttgtaaaggcacttttgagtgctgtaagtactaactgttgtaactttgcataaattttggttaaactgtgttttctttccaatggccagcttaaccataacttttctggctgttcttttaagtttctggctatgggccaaattgctaaaatatgattgttttggatttattattttctgttttctgtgtaacattgttcagatgttagtayatatcaaataagtgtatcaagaagaaagaagaaaattgaaaactagwgtgttagtaatagagtatttttaaatgtaagcaaatttgtatttattaaatcgatttgtatgtgtatgatgtttatatttttaaactccagtgaaaaactcagtggtagatctgataactttctgttgtggtagctgttaacaattattaaaacaatttaagataatttaaaaattttttactttttaaaaaatacattagattgatgtctgcaagagcacgctatgagagatacagtggcaatcaagttcttttttggtaagtatttccttaattaacaatgtttaaactttggactgt

SEQ ID NO: 3127 - DNA, 600 bp, Bovine  MMBT13789
cacttcaggattcctggtgcaaagcgttctgtaaatgctcacaaattcaggcttccatggccgttacgtgataggccacttcctctaaagtgctctaaagcgcacagcacgtttmagttagacttttctgtgtgtaagagaaaagtggtgctgtcacaagcagaaaacctaacagccactgagggccaagttaaaaaaccaaccacattaacrgtggactaaatagaagagttgcttctcaggataaaagcctccattaaataatcttcatcagytggtttttagccaaacttgacagayaaactactcatttgcagctgtggtgatttcgagtctaygactttttcctttaagggaccaacccatggaaagcactggttgtggagggagcctcggggagaaagtggtaaccttcccctctctaaccaactctgcgctgggggaaggtatactccttaatgggcttccctggtggctcagacggtaaagaagccgcctgcaatgcaggagacctgggtttgatccctgggtcaggaaaatcccctagagaaggaaacggcaacccactccagtattcttgcctgggaaatcccatggaca

SEQ ID NO: 3128 - DNA, 598 bp, Bovine  MMBT13826
  misc_feature (1)..(238): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacttaaaattactggaaaatgttggagctggcaggcatcttagacacaatctgccccartatcttcattttttcagaggaagaaaccgaagcacagagaggggcagtgacttaaataaaggtcataaggcatggtgaagacttcttgggaacaggaagttggttgtctcagcctgtgtttataccctcctaatccctggcatttcaagtttaatcaaagtcagaaagctatccagcccttcagcgctgcatttgcttctttccgtgaaacttaactgtacaaatacctgccacttgggagtcagcaagcccaagccaaaggctgcgaattcttgctgcaccacttgcagtacttatt

SEQ ID NO: 3129 - DNA, 600 bp, Bovine  MMBT14090
atctatgagtctggcagtggcctcgctgtacggcttctccaacaccatgtccccctgacgtgggaggtcaaaggagatctgcccgaccttctcgttcatgccaaactgaacaatctgaagaagaaggcgtggccagtggtgggcatccatttctgctcacaggctcatgggttttataaaatgtcaacaaggcaacatggacactgcatgcacacacttcactgcagaactactcttcaacccggcaaaatgacatggcagccttgagtcggccaagtagaccaggtgttctgcatagayggggcagtggggacaagaccagaaatgggcagacaatatgtacaaccaagacaggcagcaaacaggtggggacagaccccagcagtcatgagacgtgcgtgagatcactctgcatgaggggaggcaaggaggagccagagcctgtgacagacggaagccatgaccttgggcacccagyrgctcctcctgcatcacctgggctgctccaggaacttgggaggggtgcctgcactttccctgcgtccctggggcctggctgggctgtagagacccccacagtaaccatacagaaccccaact

SEQ ID NO: 3130 - DNA, 600 bp, Bovine  MMBT14863
atgtaacctgtagtaatttttcataaatrtaattataatataaaatgcaattatcatctcaaataactatattgacttaaatataaattctaaatcccttcttagaataaaaattgagtgattaatctttgcatagtcatggttcaactctttaaatgactatacaggtgagactatccttattcctagaaaaccctacaagtatccttattggtgatatccaaacatgttttaagaaattctcatttcttagtatgacaaatacagtattgatgtaaagatgaaggatttgctacaatrtgtctttcttcctttactttcatctcctctagttttagttttgcttttttmtttcagtcattaaaatgcctactgcttaatgaatgaatgatcataagcaatgatataagaaatgaagaaagttgtaatggtcaaaaaagaaaattatttaatgaaaaatagcatcatgtaaagttactttatcactgactaggtaaggaagttgacttgtagtaaaaaaaaaaaaaaaagtgggggaagaaaaaggtttgataaatggatgcagtgaactacagataaataaccacaataatatgactt

SEQ ID NO: 3131 - DNA, 600 bp, Bovine  MMBT15894
cattgaaggaagaaaaggcaggtgtttatgaagatgaaacaagatgagttatgaaaaaatttaccacagtaaaaagttagagaacaattttgacatttttctaccacaattaaaatatatcccaatccattactaaaatatatgtatatgattatttataccactaaaaatttaactatgtgtaaataaccatatagatatattttcatagatataaacaatattaatagatatcctaaaacaaacctaaatatgcctagtggtacctctgggacaaccactcttcgcttccaagcctgyaggtcacgctccgtagccatctgactgcgcggagcattctggtgcatctgacggacaccttccacttgtccactacgacgcagaccaatatttggaggagactggatrtctaagcttagtcttctaaaacctaggaaaaaattgtaaagaatgactgcaaaacaaacgtcaatctaatatgcatacacattcctcctaatatgatacaaaccaaaataaaacgatctactgaaaaaactttggaaaaaagaattaatgtgacttagataaaaatgtagaatacagaacatgattattaac

SEQ ID NO: 3132 - DNA, 600 bp, Bovine  MMBT16670
ctgttagggaggcatccatgtttcctcatggtctggcagagaccatgggcatcaaggggcaggaaaggattcaaaatactttctggagacctctcccaccatgtcagtgaatacctcctccctgagcccactttaataactagagctacttaatcttcccaatttatgcctccaagctctgagcagcacagagtcagtttggtacctacatttctcaggcaatatgctaacactctacacagagaagcatcagaagaacatggtgctttccattcaaaaaccagcatgtgaaattcacaratacatcatcagtgtcatctccatgactgtagttgatttcagcactcaaggttaatggttggaaatactcaaaaatgacagaattggccactggactcctgggctcttgccataggcaaagccaattgccgatgtatttctatatccccagtggtctagttccaagaataactcaatgccttaagcagcaaagtccataaaacagagctggaaagaattactcctggtgatgccatagcaaataatgagttgcctcagaaatggaagctcatataccagccctgccccatgggcacccaa

SEQ ID NO: 3133 - DNA, 600 bp, Bovine  MMBT16780
ttggcctccttactcctccctaccgatgcccaagcatcaggcttactcctttgcctctacttgtaaaattcttgtctcagatggttataccaaatttcctctgtatctctggatcatatgtgactttatcaggagcactcttgactatcctataaaaatttgtaatcctccatccagcattccataaaaacctttctcttatttttcttcatagtacttattaccatctaaaatcttacacactcatttatttgctgccccatgatctagagagttgctctttttcactcttatcctcarttgctagaacaggcctgccacattacaggccctcaaatatttatttattgaatggataaatgaccttagatctttttttaggcaataagctccttaaaaagagctaaagtcaatattatgtggcagcctggatgggaggggagttttggagaatggatacatatatgtatggctgaatccctttgctgttcacctaaaattatcacagcattgttaatcggctataccccaatacaaaataaaaagtttaataaaaaaaaagaagtgaagtctactttgcgtctcccaggtcactttgta

SEQ ID NO: 3134 - DNA, 600 bp, Bovine  MMBT16913
agactttatgtctttttggaagttgtctaaaaatggagtgaggtgattccagcttagtttgatttggtaaactgcttttctatgaatacttttatcaatattaccaaatgaatgtaagcaaatatttacaggtctctgctttaaaaaatactatgacagaaaataatttctgtatcacaaaattgtccctcataacttaaataagtagttttttgttattcatcccaaatcttttttaaaaacggaatttccacatcactcaagtgataaacatacggtgaagaggaaaatatctcacarattattgatttcgtgtattaaaacaaatgtctcaccgataggatgccacttatgcggagttggactacatgcccctgatttctagagaaaatctaggtttgctcctgtagttagagagaggttgtcaacagtgtcccttttattctcaaaggttcctatttgtccaataaacctataaaccaaagtagtggatttctaaatgagaaatttctgtcccacattcagagtctgccagagagggatgggatgtaacttggcagtaagtccccactgcaggaaggtatgagaaataagatttcc

SEQ ID NO: 3135 - DNA, 600 bp, Bovine  MMBT18229
ccttctgaatctgaagtacaagataaagactggtaactacagaaatattggatcaaagaaattcagacattggggttttgagataaatcatattaaatgacactctttagtatcaccagactgaactcacttgcattctaagggaacattttcaaagccagacataagtcagccaagccaggtttttctcccatttagttctactgaaaaaatacatcaagttctcttacaagtgctttcctggaagttaggtgggaaagaaaaatttttgtaataaattattgtgatattgcattgctracaggtaaatgatggaaactgggatggatttggtcctgtgtttgaaactaggtgatrggatctgcaatcatgcaaaaagcttgcaatcttgcagttgtgtggaacagcataataactaaggaggagagaaaatatctcaaagttcagcaccataaaacttaagtaaatgttaaaaggagtcaaacttttacttggccccattaccttggtgaaagaaagcttcatgcagccacctaattcaaatagaagagggatgggggaaggaggaaaaaatactttaacactcacaagaatagctca

SEQ ID NO: 3136 - DNA, 600 bp, Bovine  MMBT19078
acctcatgaactgtagcccaccagactcctctgtccttggaattttccaggcaagaatactggagtgtgtagccattcccttctccacgggtattcccaacccaaggactaaacctcggtcccctgtgtctcctccattgcaggcagattatttaccacctgacccaccagggaaacctcaataactagtactattaaaaaaatactttggtagcaaatgtttatctctgtcatcttgattaaatgctttctcagattttatggcagatataaactgacmtagtatgtcttagtactagygaggtaagcatttcacaaatgatattgatgtacaactaaatgttcatgataaatatagagtattcattttaagcactaatgtttttcattgcattgttgtgaaagtagcaaccatcaataayagggaaagacagccttttgtaattcactgcccgtgagcataccaggccattggaaacaacacgaacacaggaagcatatcttttcatccactgttttagcacctacgtctagtatggtgcctagcacataataggagtctaataaaaatgtgtcaagtaaatgaatgaattacgtatr

SEQ ID NO: 3137 - DNA, 600 bp, Bovine  MMBT19094
attgatatatggcagaaatgaacacaatattataaagcaagtatctgccaattaaaaataaattgttaaaataatctgtttttgacttgatcagtggatgaactgttgtgctttgtatttagatatcacttgtggaaataaagatcccccagatgatatcaaacagcagctatttactcagagattgatatagcaagggagtcagccatcatcacttgcatttggcagaggatcaaaagtgttcacaagaggtgagaagctttataatggaaaaaagagaaggcttcaggtatgccctgmttagaagttattggcaagaagaagctggaagtgccctaagtggcagcagggcaacctatgcaattggtttggagaatatatttgattttttctggttggttctgaggtggaaggaagggcacaaattaggggagctggcaggtgttgaccaaatcctgactattctgggctgattgctacagggctagtggattggcttcatgggctcattattgaagaagttgttggctataattctattgtgatatatggtctagtccttatctgtttgtatattcaatctcttgtgctagtttgatt

SEQ ID NO: 3138 - DNA, 600 bp, Bovine  MMBT19395
ggggtacccaaagggcaaagaaaaacaaggtaaatgataatacattatccacctcatattttggcttcaagtcaattctacagcaaacaggaattttcagaaaatcatcatatttcacacttacttctgaaaaccctaagaacaaattrggctaatcctgtaacaaatcacacttggcaaaatcatatagcaataactttacataatgaagaaaacaccaaaraactgaatctcagccctggttccaaattactctgtgtgrtcttggaaactgtcctccagcatcaacaactataaacraacaascttctctatgtatctcatttattagaatgaaatgagtcgacaaatgtaaacatcttatttgcatgtaacaygtgaaaacatgtaaaggactacagttgtcaaatgagccatggtacagctagcagtaaacatccatttacattctgtataacttaagatcattgtgagtccccaaagaaaggtattacataattcccttcaaaagtatttaaacagacattttccataccatagaagtgaataatcctcaagcttaaaatacagaactcaaagtagatgcaaaggtcaccaagt

SEQ ID NO: 3139 - DNA, 600 bp, Bovine  MMBT20288
ctgatcagacacctctctaagaaggtagattttttttcttaatgggagttcaacattgagggatagacagcaaagtcactcactcacagtctcaagccaacacggtacagcaggttamggcagtgagggaccagtgtgagcggtcagaagcctatccaggccaaaagcaggtcactcaagaactccctaagaaccaactgctgtgcagctttctccaggatggtcacagtggtgcggtttrtccagacaaaccacagggaytaggtcgtgccctgccctaagtatttcaagtttcccagytccacgacgaactccccaagttcactatccctgggccctttggactaggggacaatctgtcactatttcaaacttcctggtccctctccagcctgcatttatgtccccagagaattggggcagcagttggccagactcaagattgtgatgaaatggagtaaacagtgggtccttgtgtgtgtttagaaattaaatgaactctctttggagtcatgggtactcctagctctgcactaggagtaggatattaaaaccaaaaaaaaaaacaccttattttaaaagacactcacttccccaact

SEQ ID NO: 3140 - DNA, 598 bp, Bovine  MMBT20882
  misc_feature (1)..(62): n is any nucleotide
nnnnnnnnnnnnnnnnnnnnnnnnnnnnnnnnnnnnnnnnnnnnnnnnnnnnnnnnnnnnnnaacttaatgagcacatttgaataaagctggaatttaaaacaggagttctttggaacaaaatagccacttagagaaaagtacttgtaccctcaattacagacaagacatcaaagctcagggaggctaaatgactggcccaaggtcactagcttcaggttgctatgctatgctaagtcacttcagtcgtgtccgactctgtgcgaccccatagacggcagccgaccaggctcccccatcragagtactggagtggggtgccattaaggcacagcaaaacctgaacttgaacccagtcaagtctaacatccaggcactcctccaggagtgctgggcactggagaaacacctgctactgtgattacaaggtccatgctggccaccaaggggccctgaggcccaaaataaaatgcccacagttctcccaggctctgtccgtacccctggggccccggtgactgtgcagggagagtctggcccagggtggagtggggtctgagcagggaagcatcaggtaaagaaccccactcttaatttag

SEQ ID NO: 3141 - DNA, 545 bp, Bovine  MMBT21055
gagggcttaattgrtctatggaaacaggaagcttacattttaaaaattattggcagttgcatcttacttagcatcactctggtaaatgtactrgatgggagaattgcttaggagatgtcttaggtgagagcttgctgcttctctgactttgtcaaggatgacagtgatgactggggagttgggcagctccagtaaaatcgtgggctctgttcttcccaccaggcagagaggtggccactgggtgcactggcagatctttgaggatgaacataccaccacatcratgcctrtttactaacrgckgggcagaactgggcctattagcttgcttcccagttgggagaatgggcagtgtaatgaaaagaaccaaggcttcgtggtcagaccatcctgtcttgaaatcttatgactgtcactagttgtttaactgcccttgggctagttagaaaaatattgaatgtgtaactgtgtaaagtggcggtttagtcactcagtcatgtctgagtctttgcgacctatggactgtagccgcctggctcctctgt

SEQ ID NO: 3142 - DNA, 600 bp, Bovine  MMBT21656
cctctatctccagttcttaaatgtgagtgcgaggggataataatcagtttggtaccttgcactgttgtgaagtgtgagtagctgttttattgataattttctaagaattcatatgtatatgaactttactgaactttaattaattttgtttaaaatgtattaaggaaatcaacttgaatcacagaacaagattacacagattactttaaattcagatactctattacatgcactctgcatagtcccctggtaataaaatcttcattctgttttcccataaagctgattacaatactttcygggtacaatayaatataagccstctttggaataatccatttggatattactactagtattagaagcaggacaagtaaagggaaggagttcctaccacagaaawttttaaaccctcctttggtagcaaaaactaaagtcaagcccttttaatagcagttacttggtgacccaacactcaaatctagcctttattgtgactctatggagacctctggattaactcacttttcaattttcctattggtatagttaatttagtaattattgtatcataaatataagattgtgaataaatttgtc

SEQ ID NO: 3143 - DNA, 600 bp, Bovine  MMBT22426
cttcctgggcctcccaggacctggctctccagctctgcctgttcaagatgagttattcccccgtttagctgcatttctgatggcgcctgccccactctggggacagcagagatttaagggccgtggtgtcttgttacagtaccagagattttctctcataaaacccacccggggaaaggtttaggagatttgtggtcttaggctgaggaggcagtcacgaggcaggcagaccagcggtaggggtgagtctggagtaggggtaggctctggagaagctcctaaggctgccctgggcagacyctcctgccccrggatttgcccccatcccgcgtgaaggctgggactccatcctgctcctgggctgtccaggaagcctgctcctttggggcagggaaatrgtaccctaggcaacctccctctgagcctccctctgagcacagcactgtcctacctcctggtcttagccagccagagccttgtcttgctgaagaaggagggggtcctcggctgaagggtccaccctggtttgcccgttgacttttctgtgttcttttggcccccttgcccacccttttctttctgtttccagtttgcaggaca

SEQ ID NO: 3144 - DNA, 600 bp, Bovine  MMBT23293
agtaaacaagttcagtacttgtttacttaatcacggctacatttacacattaacatattgatttggtgttttgattatgttttatgttaaggtgagttaaccttgggcttccttgttggctcagtggtaaagaattcgcctccaaagcrggagacatgggttcagtgcctgggttgggaagatcttctagagatggaaaggaagatctactctagtactcttggctgagaaatctcagtgacaaaggagtctggctggcggtcaatgaggtggcaaaagagtcagycagacaaaacttasggattaaacgaacaattttgaattaaccataacactttaaacaggttcattaatttttacttaatcttagccttgaaactgtgaattcctattagtcaagtctgctactaaattaaacctgaaaaaattatggtggttgcattcaaaacatttaatgaagagtaaacattttcctcttatggaagggaaaaatgccaaccctaaaaaagaaataccaaccctactctacttgctgaaaatgatttctcattgagtgctcacacagctttgcatacattattacccatgaagacgtaagtg

SEQ ID NO: 3145 - DNA, 598 bp, Bovine  MMBT00133
  misc_feature (1)..(56): n is any nucleotide
nnnnnnnnnnnnnnnnnnnnnnnnnnnnnnnnnnnnnnnnnnnnnnnnnnnnnnnnacgtgtcggctgtaggcagcgagcaccagaaacgcaccaagccgcgggcggtgggtgcctgatgcaggcggcatggcttccacggctcacccctgttcaaccaggaaccagcgagggtagggggatcaagtttggaggtttcgcggggaccgagggcgcgtttctggacaccaccaccagggggcgtcccagccccgacgtacgcgacgccttaagtcctgctttggatcggtattgttcctgycctgaagtttgcggttaccctccagcagtgatcacgggagtgctccagccccgaccactagggtgcatgtcagccctgactccctgggcttcccacaactgcccaccagcagagatgcagccggtccctggcaccaggaaacatcccaagatgcgagctcctgggaggtctgcccggcccgcccgccccctgcacctgtggggcgatccacctgaccccgcctcttccaactcactcgagctgataagagaagctgtagttgtctgggccgactccggcggtggccgcttcctcccag

SEQ ID NO: 3146 - DNA, 600 bp, Bovine  MMBT00960
cagtctggcaggaagctgagaggacggcctggtccagacactcacacgatcttcacagtgttgagcatgtcggacaggacatacgtgtcatcccagccctttccgggcttcctcagggtctgctccaaggcccgrgccatttccaggagctctggtgtagcgagtttgcactcagagtgcagctgacagaacaggatctcgttgacttcaccctcgattcgccggacgtacaggagggggaacacagccttgagcccggccagcactgagtcctttagccccaggtctcggcacacaagrttgaggataaagacacctgcagggtgagaaaggagaatgaccgtggttcagggaacacaggagacaaggttctgctctgaggaataccaccattcctgatcccgggaggcaggtggagcaagggacacatccatggcagcagtgactgtgccgagaacacacagcatacgaaggaagagagttaggggatgcgtgaaccataaggcttcacgctcatttcttgctctcttgtgctgctaacaaatatgaccattctctatgcctctgtttcacaaaggacagtttcaactctgtatgcaa

SEQ ID NO: 3147 - DNA, 600 bp, Bovine  MMBT01276
gcctactggggaattgctaaacttgcaaaacctggactttgccaattttgaaaactctaatggtttgaattctcttctgctgtcctacacccatcctttggggttgatggaaataaaatgacttgaagggaggtgtatgtgagtaagtcctctcagggctcctgagaatgctcatcagaggtactaaagacatcagtgcatccgtacttgatcacatctttgtagagagcggtagtgtggattgtgaacgaggggtcctggagtgtcagagagatattggggcccgatttcatccatgcyttgctccatgacagttgtttctgacctgggctcctgtctctagtctgtctcctgacactccaccctttttgctgcagcctgggagatctttctgaaacagaagcacagacagrgcagaaccttgcttccaatgccctggggtctcactgcctgcagaaattatctccaggtacaatagtatctaaccctcaaaaagcagacacctatgtttctttcttgcttcactttcaaggatgagatttctttctatttgcactctcaaattaaaaaagaagcaaaagcaggcatcagaatccaagg

SEQ ID NO: 3148 - DNA, 600 bp, Bovine  MMBT01721
atctatggaggacactaggcatcttctcaaaatagagggagaaaagtgagttcttgaaagaagggctaggcacagtgtcagaactccagggaagcaagctgagatgaatgcagaggtctagtccaagtaggaatgtaaggtccaagtcagatactgggccgtaactcttgtgtttactgtatgtggcgtaagagactacagcctggaaaacaccataattccattgtctagggattcctggtaggcaaataacagtttgagggcagagtctaattctggaggactggaactccgcatatwttggcaagtaccatcaggattaactcagggactgcttagggctgagcctgcaagttgatctacaaggttrtaagtgattatagctgagtgagggtaacttgaccatctcagatggaaactagtatgagctttctttgacagtaaccactggctagcttttccgggaagactttgagaactgctaggaatatgggcaagaaactctactcactggagcatggtattctttttaatttccattttaaaatgaaagtgaaaatattagtgacagttatggtatgtcccagccctgtatctaaa

SEQ ID NO: 3149 - DNA, 600 bp, Bovine  MMBT01850
tatggggcccttagccacttacacaaataacctgatgcttggtttatggccgttgagggattataacacaagacaggrgagctcactaaaacagtcattattgtacaaaatgacatttcttttagactgatagcagttatgaagaagttgcattttatgtttgttgtcaaagactacaaaatgggctactgggattagattgtcaaaaaatctgtagaatctagccccttgcttgagtagcttgtattgaagagttgacataaattatagcaagggtccacatttttaaaatgtcttgtyaggtatgggaaygggaagttactagaaaatttacactctagtgtttatgtcattcttctgaaaaaataattatattctaggtgcctgctttgatcatgaaatagaaagattaaatgcattttgccaaattaggatttctaccaataaccaaaggatttgagaatatagttgagaacttggaattttttcctctgtttttgctttttgaggtttttctatattttcttccttgcctatagaataactcaaccaattatagaaacatcgtgcttaaagaatctcaaaaataatttggtaaag

SEQ ID NO: 3150 - DNA, 600 bp, Bovine  MMBT02009
ataacacatactctctaaataacagctccatttaaattattagcgttagtggggtgggaaaataaaggtgcagagtaagcattaaataaatatctgtgagttgcaagatttccaaaagagaaaacagagaaatctccagagccttctgccaagtgtctggcttgtgtaaaacttgagaccttgaggaaggagtgaagaaccgaactgggacgcaagttggaagtctttgaggtcatggaagtttgcaggcggcaaatatgacctagagagcttagcttcggaaagtgccatcagcactcrgaatgctccagtggttgtcgagggtgagagccaggaaacggcatctgcgggggtggttatcatcacatactccccagaaccacaaaattgcccacatcctgggctcatggaccagggtttccactttagtggcctgataacccaraggtcttattgacaaatcccagaaaggaagaggacttcatggatttgtgtgtcttggaaagctgagtcctatctcccctgactcactctggaaaagtggaagtgtctcttcgcctgacccaagggaagctgatgtttggtgtttcctgggagatc

SEQ ID NO: 3151 - DNA, 600 bp, Bovine  MMBT02051
gagtgtttcagggctctaaatttcctctgattccatttaagaattcttcctatgcagcagtaaagcttagtacttttattaaatctcaaaccttaagtatgtacatctttttattatcctagcggcaaaacaggaagtatgcatgcagtacttttgctgcataccacaatatgagtccagttaccacctttgacagaacagttctgctaaaattttatcttatgttattgaaacgtttacaaagggatatatccagtaatgtttatccaaccagtagaaaaaaggaatgcctcaaatgckaaagtatttagacagattattttctatctaaaggatgaagcacacccagaatgggaaacagtgatgtacactgctgtttattgatgtccacattacataaaagggaaagtataagtttaaaaaaccatcattttaatatcccatgtgtgggtgaaaatcttacatgaatataaaagtagtgtgagcattgacttgcctaatggtgctggagattataaagtttgttttygattatcaaattttttaaagtttatgcaataaatgaaatttacttgtatattcaggaaataaaacatactt

SEQ ID NO: 3152 - DNA, 600 bp, Bovine  MMBT02261
tgaggtggagctgatgtaaaaataatggaaacaaagtgcacaataagtataatgcacttgaatcatcccaaaccattcctccccctccaactccagtccagagaaaaattgtcttcaatgaaaccagtccccggtgccaaaaaggttgagggctgctgcatagaacactgagtgtgaatcaatatttagcttattcattgactttcaaatttaccatgctcaaaaagataaatcctagtttggcttagagatatttttttaaccagttctgagaaataaggtatttgagggcaaattttyaatttttagcaaacgataagaaaaatgttataagaaaataatatatagctatactaatgactgcaagcttgaaatagtgttctaccctgtttaatgaggtaacctatgactgatcagttatgtagacaagcagaatttaattagacatgtagaacaaatgtgatttaaaatagcaactaaaatcactttagctctacagctatttcaaaagcacatttagatcctggagtggaaaagaaatagtattacaagaaagccatgaagctatcactgggggattttctttctttaatagtggaa

SEQ ID NO: 3153 - DNA, 600 bp, Bovine  MMBT02721
ccatcgagcacattttgtcacaggtaagatccataccatggaaatctcaggcaggttttgccctgaacatcctccgtaattagcttgaattgtctaaaggcagcttcatcattctgcagatcagcaagattcatttcaaaaacacaacccttgaggccatcagatgtgattttgtttccttgagttcttgtggtcagtgctttcctactgttccttgtattgaacgtagctggtgctttcacatcataccaatctttcttagaaaatgggtcaaccactttcttcttggctccctttctrcctcctttcgtaaggygcttattcttgccgaccgtcttggtgacgttcagaaagccaaaagggcagacgcatagcttacttgagaacttcrgtgagcggggcagaatgcactgtctgtatgaccccaagtttcttctcttaatcattcctatttcctacaggtcttcaaaagagtaagactcctgtttattcctgtagccataaattaaaatagaaataccagcatggaagcaaaatagataacatataagaaattatgaaatttacatgtggcagtgtttatcatactacagaaaagag

SEQ ID NO: 3154 - DNA, 598 bp, Bovine  MMBT02822
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnttaatactaggttggccaaaaagttcatttgggtaagactttatggaaaatccaaatgaaatttttggccaaacaatataaggttgcataagaaactcattgacattaattcaaatccatttctgtaaaaaatttaaaagagttaagagacaaatggagctaatctatttctttaatttgaggggaaatttccagaaactgcccaaaataaacacytcactcaaacctctaattagatcaatattattttactattgatgaactactgcttaaatgtacagatttatattatattctccatgtaagatttcttctttcttgggttttatatcagataaataacctcattcatcagttgaaaagatttaagtcctaaaatttaatgatgattattatgttaaagtacagaaaacattagggaaaactaaaaaaaagttttacacttccttgcctttaactatgtaacaacctcagtaataacttattgcatatttattttattataattataaat

SEQ ID NO: 3155 - DNA, 600 bp, Bovine  MMBT02970
gcaacccttggcagtgaaagtgtggaatcctaaccactgaacctccaggaaattcctcacacggtttattttggaagacaggataggaaaagggcttagagagctaatgaaatcaaatgcactcagaaggctttcagaggctgatacaagagttctcactttctggtgcactgtgttatttccacggtcaggaatttgacatttatctgtctgcattctctctggatggtgggttaaactgtagacaaaacacaagaatggttgggggaataggattaattatctactcgttacccattyaatcaatcaaacattgttaagatcatgaaaatatgtgatgtagtgaatactactgttagaactgagttctcaggataggagaaagaacaatactaccctctgaagtcatgacacttaatgaggttgcttgttttatggtttgtggttccttgaaacaagagagagcagttgtgtgcatgatgtttgttttattgccacagatacggcaaacaagcctctgcaaaccactttgaagagagcatgggacccatatggctggatggggtcagttgctcgggaaaggaagccagtttccttcag

SEQ ID NO: 3156 - DNA, 600 bp, Bovine  MMBT02990
ggaaagcaaacttcagtcccactctggtgggagattggttcccagagcccctgcagataccaaaatccacggataatagtcacttaaataagatggcacaagttagcttgctccatcggagaatggaaaatttgcagattcagagggcaatatgattaataggccctcagttccaaaccaggctatgctagttctctagtctgtgatctctctggctctcttccccttctatggaatctgtataattcctgctttaactacgtccaaagattttattgtgagatgtgaggtgatgtaaawtttccctatttgatcactaatcagccaatgacttttagtgtttatgtggcccgtgtcctctttgcccctcccccatcactttatccttaattwaaaaaaaaaaaaaaggcatcaattctaagacatttcactttatttaaaagaagccaatatacaggatataaagggcatgatatttacaacaatacagtaaacaggttggtttccggtagggtcagtagtctttcagtgagtataaacccccccttccccttgacgctaaacccagctggcagacaaagagcagcagtggggtgggat

SEQ ID NO: 3157 - DNA, 600 bp, Bovine  MMBT03008
cagagaggtcaagcaacttgtgaaaggtcacacagctagctggtcagtggctgagctaggacttgcctccatgtctaatgctatttccacaatgatatgtgggataataaatgatggagggccctcatgggtgagctgttctttcaaaaagaaaaaagtggaaaataagtcccactaactggggaaaaattagtgcctagtgagttttttcttcctgattatacaacatgagcaggattgggatctaggtgagctgagtggacactcaccttgatgcaaaatttaagaaaggccccaaastcagtcatcaagacaaataatgctttaaaaagtcaaaattaattttaaaaatctacgttgaacaagatatcagcatgttagttaaagatgggctctgttgacagggccaggattagggagaggtggatgagatgagctgtgcaggtgtgaggttggaccttgaaaggtgtggaaaacaccactatgaattcacctaaagccatttgtcttcttccttggcttagagacaactcatgtttcattttcctttgcagtttagcttggccctgtgactaagttctagtcaatagaatgtctgtg

SEQ ID NO: 3158 - DNA, 600 bp, Bovine  MMBT03106
aaattagaacctaggttcttagagaatctggttcccttcctctccaaccctcataatttgtttagctaaaagcatctgtttcacataagagcaaattgcccttctagtgatcatgtattttgaaaaccataaaatctgtttacttttgagaagaaaataacatttttttctaaaaggagatctttgtcccttattccttctgacatatcttccctgtgtatgattccctattaatcaatttttcctactcccatgtcaagttttccttctctactaaatcagtcctaagccattttcccyccattttaaaagcgatcagtgaaacaaactcttgactccaactccttgaacaggactatctctaagttctctttttcaattctccagtcaaacttccagtccctttattccactgaagcaactcatcaaagtcaccagcctccatattgcaaaaaaagcggtcatctctcagtcctcacacttgacccagcagtagctttcacatggttgaccattcttcctccttgaaataccttcttcacttggcttcctggacaccagtattcccactccctccacttccccagtcattttataaat

SEQ ID NO: 3159 - DNA, 600 bp, Bovine  MMBT03331
gcctatatagcttaaatctggtgtttatttttcttgtccccattcagtatgtaaacatattcataatttaatacaggttatgtgcattttataattaacattatggacttagttgggaaagcactcagaccacactgtatgaaaaatatgtatctttttctatattagactatatggttcagtgtgaatcctaaaggtggataatcccagattatcttactttgctgggactactttaacaaaatgccacagactaggctgcttaaacaacagaaatgtattgtctctcaattatgaatrctgtgagaatcattccatccrttatggaagtgtgggatcaargtgtcggcaggtttaccttcttcttaggtctctgtccttggacggcagaaggctgccttcttactgtgtccttacaggctcttttgtctatgtgtgcacatcccaactgtcttagtcccagtttcttcttcttgtaaagacatcaatcatattggatgaaggcccatcccaacagtctcattttaacttaattactcaaagccctatctccaaatatagtcacattatgaggtactgggagttaacatttcaacagat

SEQ ID NO: 3160 - DNA, 600 bp, Bovine  MMBT03377
caaagaaggatgtactagaaagtgactgggtgactattttagatgggattgtcagtgaagacttctttgaagaggtgtcatttaagctgaagtcttagtgggaggaagggtgccagccatgtgaagattatagaagagtgttctaggaagaaagaaggattagtatgaacactccaagaaggaatttgtttgtaaagtcaaggaaacaaactaaaatcagtgtgaatatcccctagtgcatgatgaagagatagacatgagacaggttcagaaaggtgaagcaaggaaagattacaaagsactgtgtaagtcaaggtaaggagtctgggttttagtcaatgcactcctggaagacattggaaaatttaaacatgggagtcagatgatcaaatttttstttaaccaacaaaaattctggctcctgccaggaattgaatggtgggagaaccagttctggaaggacagaggccagcaaggaaagtagggcgatgtatggctggccgtccatcacacccatcacccctctttccttggcacacaactggatagcccttctcagtctcctttaaagtgagatgtgactgatttctgtttggtgta

SEQ ID NO: 3161 - DNA, 598 bp, Bovine  MMBT03585
  misc_feature (1)..(3): n is any nucleotide
nnntgttcggaggtgcttgtaatgcaaacagattctgcctctgaagacatagcacttgtgtctaaaaacctctccatttttctctttgtatatttctgtttcaaatactcatggacgtgcccctgatgttggtaggggaaaacccactttgtttcccttcctgtaaaaactgagtgtttatcaccatctcattataaaagatttgggaggaatctacactatcagaataaagccctttgtaactaagaatctttataagtactagggacatctaagtccagcatagttaattattgagayatttctctgattgttagccattttagtcaagattatattagattcttactttgtttcagtttcataatcacttcaatattttccagatgtaatttttctttattaaatgaacaaatggatttgggttattacatgggagcttttgttttgcaagtatattttgtgacatttcctgtctaagaagtcttatgtttttaaaaggagaaagaatgttatttatagtgaaaaaataattcatatttatgaagattttccaatgcttttgagtaatccttcagcattgtttgtaaaaatcaca

SEQ ID NO: 3162 - DNA, 600 bp, Bovine  MMBT03624
tagaaaatcagtgtgcttcaaattccacaaatacctatatactgttaaaaaattaaaacaaaattaattatttcccattttaaataatgtttttgagttatcttgtctgtgacatatattctatgtattatatttcatataataccttagaattgcaccaaagtcttttaaacttcagtaccatttctttctcataacaaccttatgaataagctctaattttattccatttgacatataatgaaaatgagtctcagagtggtgaagtaacttgtaaaagatttagctggtagttatagytggactcaggctcttcatataacactagatgcctttctggtctcctcaggaagacctctcataactgcaccagaatctttggcaatgtctgcctcctggacaatacattattttccaaaggtcttctcagtgggatcttgtgactgtgtctgagagcagaacattcaatagcacagktgctttctcaagatcatcacctgcgttcacatcagagtcctacgtcacatcagtgcaatttcaccaacaccacgttctcagtcctcgagcctcttgttgctgtgaccatctcacttttccacc

SEQ ID NO: 3163 - DNA, 600 bp, Bovine  MMBT03967
gaggcctttgagggactgtggccctaggacaccctgattgtggacttcaggcttccagggctgtgggaagcatcartgtccgattcatgaagtctccaagtctgccgtgctctgttacagccgcctcaggacacccaaacatcagttagcagttcctgactttccaccccgcctgccctccaaaccagtaagaggaagactggagtctgcagctctcctgggactgagatcatgtgtctcctccatggctgtaccaattctctctcccctcaccacagtttctcctcttagaagcagggytgggacaaagcrccctccggctcactttttacggcaccaaaaaagtaacgctmgtgaatgaatgactactaatagcaaagcccacgactggacaggactcgtgagatgaacaggagtctttatgaatcaaaatttgtaaaactattttatttgcttaaacaaaggagaatctgcaacgagcacacggaaggtgcaaaaagtgatttgttgtgatcwccagtgtccgtracrggcaaccgaagaccacacgacagccaggcccgccaaaggcagctcaaaatccagatgtctgtggcggga

SEQ ID NO: 3164 - DNA, 600 bp, Bovine  MMBT04028
caaggcatgtcatagagtatagaataattccatatcaaaaggaatgctggtattttgtttttcatcatttttgagttcctgcaaagagctggaataggaaatttaattagcaatattctgcatggcagtctacatgttcttcttattttcctttcattatcatttgcttcactttgacttatttagctcacttacaagataacatattttatttgataattaacatttcattcttttgagaaaactgaatagcaacaaacaatatttctactccaaagacacaatttcatactctactakctggtttttatggcatggtttatgttttgatatatttttcttgcatgttgagaaaatcaggttttaataaccaacaaagcaggacagaccatctttctcaaacaagaaatctgatatatttgctaaatgacatgtatataaaggtcaaagtaaaaaatttaaagttacctcctatcagaaccaatttgcatttataacaaaccaagaaagatctcaatwtcattacatgtcaatgttggtgaaaaaacttcctgttataacaatgctttccttaacatgaaggaatatttcctgttccaa

SEQ ID NO: 3165 - DNA, 600 bp, Bovine  MMBT04101
aacttagtcgtcttcggaaaaatgcattccactaacatcaagctatgtctgtgtactaattctctgctgaaatgcacagtacaaccagatccacccgttggcctcaactggactctactgaacatcagtttgacrgagattcatgccgacatcctagtgaaatgggaaccaccacccaatacagatgttaagatgggatggataatcctggagtatgaactgcactataaagaactaaatgagacccagtggaaaatggtaagatattattacatctcacattgaaaaaccctttgactyttcttttttgtgttcaacaacccctctcatttctaattagactttcttttgacttaataccacatatcccagttctaatttcttatttgagaaaaatggatataatcactaaaatttcatgttggaattctttaagacagcagatgcttacatggagttttatatggaaacctatggaagaaaaggaaaatgatttctccagtcatcactggtgtctggtctaaccttataataatatcacatactctagtcactcagctatctgtgaggatgtggctaaacatgggaaaggttatgatc

SEQ ID NO: 3166 - DNA, 600 bp, Bovine  MMBT04382
ttaggaagaactatggctatagcagggccctggcccacagtctaaaaagaaaataaatccaaaactggttatgccttttttataaagtcagtgattatcattttattaaactcacatagccaatcttttaataatttgttctggaatgtttctcaagaccagtaaaaagtttgaagtatttactttcttgtgaatttcagaaaaaaagaacaatctaatcttcaaatatctataagtttcttataacacttcacaggttgtcaagcagaggctcaaaaatgccaatcacacaaattacaraattctagtttgtaattttttccaaactagcagactgagctgcacttagagaatttaatatttcagagcaaactgttctagggggaaaaaaagagaagtacttactgtatttaccaaatgaaagaaagggacctatgcttgattgtagctgaaatgaatttgcctaaggaaggtggaaaagtggaaacagtgttcattataaaactcagctaataccgtctatggggtcgcacagagtcggacacgactgaagcgacttggcagcagcagcaatgcatatttccttctattaagttcact

SEQ ID NO: 3167 - DNA, 600 bp, Bovine  MMBT04532
gctggtgtgaaagactttgttttgccacaagccacagctgtatgattttggagaaatccttcatytccctgggtcttcatttcacgatgatactaatgatggtgatggtggtggaggagaaytcttaccacacagtgagagaggcatgtgccaggctcttgacctctaatatcttacaggaaaacccaaatgtactttttggccaacccaatattatttaatactcacagcaaccmtatggtggtggtaatattagccccgttttacagatgagcaaactaaggtcctaagacaatagcycagcttgctgaagaccatacaaatatcaaagtaaatgtcaaagtcaagttcaaacccagggctatttagctaaaaaaatcagtgatcctcaccactccctccctatgtttttccttctgggaaaatgaagagatttggtgagatgacctcaaaggatgctttaaactctaaaatccactgtggagacgtgcccatcctcatccaaaggttgttgatgttattgaatataaggtgggatctttgttccaaacaggttattctagcccacctggcagagcagggcaggacagagtacgtgga

SEQ ID NO: 3168 - DNA, 600 bp, Bovine  MMBT04713
cctgcaaaggatgaaagatggggaagtatatttccattgttctctctggcttctggtagataagatcctgctttatttgtacttggcacatacaatgtatatatttagcaactttgcactatttgaagtaccttacacattgcactttactctcctaatggtacttttatgtgaaatgcactttattgacaattatgtcttatcattcagtagaaaaagacaaattttacacctatgtcccagaatacttgttattccttgttctaatggaatgaaatttctaataattcctgagtaatrtagaaatatatctccttacattgggagaatgggaagaaagtgaaaactgttgaaaatgaaatgtgatgacctttgaacgytggatttcagagagacgggttcccaaagcagggtgcatctgtgagyactccttgtcatatttctttccatacgacatgrgttttcatcttatttccccyrcaaaacagagatccagatgctgctggattcattctaggcatatcatttccatcgtgacattcattattgctrcttcctgatgtagtcattttactctgattttgataataaagacaccat

SEQ ID NO: 3169 - DNA, 598 bp, Bovine  MMBT05055
  misc_feature (1)..(13): n is any nucleotide
nnnnnnnnnnnnntgcagagctggtgggtgtctttggtgtccagacacaaatacacactttgacattgaatggatgcctttagatgatgaaatcaggcatttgtgtgaagttcgtgttttcactcatcattggcttacataatttggaaatacccctacatgtggttgccacagaaaaactttttcaatcccctttcattgcagttgatgggaaattcaaagcaccttgctaaactgaatccatttccaagtgaaggtaggtattctgactccaccagatggcgcacgcatgctaaatcmggacttcatatagataaggacaaagacaccaatgtaatcagatactatcttttctcyctccccgggcaacccccgaattttcctgtgtgttcgtaatttacgtttctagatcatgtaaatacagatgtgctagagttagtcacccgaatcaactgttsagtgtctaaggctaggctgtaaaaatgatcattctcctttgttttcagttcamgtattctgactattcctttgccacacatgccttgatttttcatccacttacatcagtggactgagtctcttttctttcttacacata

SEQ ID NO: 3170 - DNA, 600 bp, Bovine  MMBT05274
ctgctcaaatcccttgtataaaacggggcagtatttgcatctaacctacacacatcctcccatatacttaaaatcatttctgggattacttacagcaacggatacaatgctaatgctatgtaaatagttgccaaggcttggcaaattcaagttttgcttttttggaacgttccagaattttttttctgaatatttttgatccttggttgattgaatctgtggatgcagggcctgctgacaggaagggctgactggatacaatttcctgtaactgcatcacaactttctttgttatcattwcttggtcttttagttatcaccctggcttgctgtgtgataattcatcacgtgggtgggctgtgctttgcttcacttctcttcaattattgtcacttgaattgattcctagtgctgatgatgattagccatggagygtgggggcttttcatactttggtctaattttcttagaatgaattcccagcagttggaacatcaaagcaaaggggaattagtgtttcagtgctttgtgtttcttgctgtcatattctgattctgcttatccccttgtctgcaatgccctgcccattcacttcttggg

SEQ ID NO: 3171 - DNA, 600 bp, Bovine  MMBT05341
ctgggcgccaagcgagatggaagcagcacatgctttctttctcctgcctctttttcgtttctactcttccctccaacttttgacgagaaaatgaaaagaagccaggaaaagaggctaagaaatgcaccagagaggagttctgggggactctcactcttggaggctcgaggacagaatcaaggggcccatgaatttgggtgggaaagagtatacctttattgtcatcagtctctaaatggaatctagcatttccttccattgtgaacgcaagtctcatggctcagtggaattagctgtacygtggctttgcctaccaggttacagttgtcagaattatctccccgtgktgtttacacttatggccacagtatttcaaaattactgttgttattacacccactgccagatcttattwtttaacacatcaacaaggaagcacatgtattattatatcacccatttgttttgtttaatattgccacactatacttaaaaataattgatttcctttattggtcccttgaatattctatttcatgcatttaaaaacacaattcacaggcttcaccaaactgccaaagggatgcaagcatgaaaagt

SEQ ID NO: 3172 - DNA, 600 bp, Bovine  MMBT05665
taaacacgatcttctaatctgaagctcccaaagtcatataactattgtaaagttgcaaaaagttcattaaaatcactaatagtaatataacatagttaaaatatcaaagcagtctttcatgaaacactgttatagtaaaagtggatgaaacaaagagataaaacaagaattgccttgggcagagaatacaatgctggcctatagctagattcacaatactgtgggctataaacattttcatgaggatttgataaacctgtaattttctcctttctttatagtggctttttttatattcartcaaactttaggacccagtcattgcaaataatttttccagaattaatttctgaaaaagagatttttgaaatctctaaatattttcattgaccatgaattgtttgaaatgctttccccagcattctgcctgkagaaaattatgatataaagatatcagatcccagtaacacaccaagctattctatggctttgtagagcactagaatgtgagtcagggcttcccatgtggcgctagtggtaaagaacccaatgcaggagacacgtctcttgccagtgcaggggacataagagacatgggtt

SEQ ID NO: 3173 - DNA, 600 bp, Bovine  MMBT05670
attttcctaacttcaaatcacaagaaaaataatgctgggatctctttttctcatctcctccttgaaacatcgccaagagtcttgaggtgcacaagtctgatccaagtgcaatacaatctccttaaactctttcttcaatcaccttccaccccagaattcagatacattaattttaaaataacactcctttgttttttaatattttatcttactacataccataagatctttcaaaataaatatcatttgtaaatgtgtccagttctctagagaagtagtaagtccccaagtcatacctgygaattcgctccaatggtaacaatttcatataaaataattatttcctttttggaaatgttttcaccataaccaattwtaattccacacagggaccacagaattaacactaaagttaaacttgccactttctttccttctcccccaaatccaactaaatgaaaaatgagaaagctatgtttatgaaagttagagctcctcaactagaaactggtacagaggactaagtgttgctataaagcttaatagtatgcatttactatgaaactggtaatggggtcaagcttttgtttttcagggttg

SEQ ID NO: 3174 - DNA, 600 bp, Bovine  MMBT05692
ctctccttctcttccagctcccagcatctggcctaccagagaaaaagtgagcattcctgttacagaccacctggctcaccccacctggtgctttcttttgcacaccaaatgatgcccattattggatgctcttggcaaagacatcttttgccctttgttaaattctgctacatccttgaaatgtagaagatgctaaataatctttttttgaatggtaatcattaccttcctaaaagatttctaaagaagaaccacgtgctcaaattaacaaatggcatatgttccagtaagccttcttcytctgattttttgcaggggaaaggctaaggccaaaaaaaaaaaaaaaaaaaagccctaggagattcaactcctttgttgcttaacagaaaatacagagtggaaagagccacaagacacagcttttggtttcccagatcaacatattttaactcacaacactgactgagtccagggtagggaattagagaatgggttatacagtagagccaatcatcattagaagagttaaataaaaagagacaaacacgggaatgagaagccaactaaagccccagggagaagatgatgtgtgagctgggc

SEQ ID NO: 3175 - DNA, 600 bp, Bovine  MMBT05745
ctgttaatacttggccagaaagtacactttgtctttgttttcrgtgtattttccytcctggaagaaaaacacaaatgggctcaaaagaaataaatagaggaacgtatagaataccttaaaaatggcagctctatgactttaccaaaaaagaaagaatgaaggcataatgtacttatgttcactgacaagcttgccacacttaacagtcactttctatggcactcttgaycttctttgaaaacaatggaatataaatattcagtcagaaggattatcctatggatggagttaagttataayaaggactaaataaagaacatggttaagaattatgcagccttcttattttactttttctgagtttccaggtgccccctcccctcttttggcaataacagaaactcaaggcacaggagcaaaattcaactgaagtctatatgccaaacgaaatagaacttagcatttatactctgcttctgcttccacttggaaattgtcttttccccctaagaaacatatttaaaaggatataaaagtggctttctatttttggccagaagtagaaaatgaaagacaatggaggaaaaaaaaatattagct

SEQ ID NO: 3176 - DNA, 600 bp, Bovine  MMBT05785
gagtcagagagtctgagaaaggaagataaactttrctaagtattgtcatagcctgaatgagaagttgagtgctaagggggcccctgtaaggtggtcagggctccaagagtttgtccccagcttgacttctgtcaaactgtctttatgacaaggatgttttttcctacccattgtgagcgttttatcctcaagacactaaatgctttcatcastgtctgcttgtgaagaggaagttgttggagttttgcccagtttggctacaagtagggtaggaagagatgtcgraaagtgagccaaagygcacttgaccggaccgtgtttacctcacatgtgctgtgtcatgataaggatggggggattggtaaaaactgtcatgctccataggtgccttttctagtgaagggtaaactgtagaaaagggaaattgatcaataatgcagatgtaaaggcaggctatttgtatatcatcaggctgtcagcatgtagtttcacaattttgctcccaaccatattttgttggaaataggaaatagcttaaagaaccataaaattgaattgttggttagaaggaaatttaaaaactttaaaatgaaactctct

SEQ ID NO: 3177 - DNA, 600 bp, Bovine  MMBT05957
atttgtttgctgtttaacagccgcctattaaaattgcttagtttgcaccacattctttttcttctttttcttttccgaacgatttcagcagtaaatggatacatatatacatatctacatacataaatgccactcttggcttttgcttactgggttttgttgtttaattaaaagctcagccttcctcaggcaataatataacgtgaccgcagggtgttcatacactaataagaggatctacttcacgaccttcatttgataatctctaaacacgcttataacccaatgaaaacttgggckacaaataagatcaggaaatgtcttaacgttaattcaccgaagcagagtttccctgacagctctcctgcccttgttccccgagttgggaaatgggaaagagatttttgaaatagactagtagccaaggtcaagaaagggtgcccctctgtttcaggaagggggctctgaaaacgccccctgtctccttttcgggaactcgaggcttcctgtcaggctcctgccccaccaggcagcgcagctccactgaaatctcaagtcagaggcaatccaagcgcaaattacccttcctccgcctgccag

SEQ ID NO: 3178 - DNA, 600 bp, Bovine  MMBT06032
gcatcatcaccaatttatacacaattgactgcactctgactctgtccttattgtttcctcagccctaaacctcagcacattattgcttcagaggccaaatgcccttaaggcagtccacgggatgcctctttccagtgtcttctttgtagcctgaaaatctttacagtccattcactactcccagtttgacttcatttctgttctgtagtcttctgatcttccccagcagtttttccttcaacatgctggaagaacctttggctctcttattgcttagctctctctgttttgtgtccattwatgtgttcgaatcgcctttgtgcctttatttttagtgaaagaacttaaaatgacaacatggatactgccacaattaacctttatttctttatattcttccccaaataaaatacgtgcatttttcctctgaagtgtgagttactctctaataatttcaatttaatttgctttctgtttttgttgcaggtcaaattaattgatgttaggaaagcctaaaattaagtacagtggaattcaatggttatttgtcagagctgagttcaatttatagttatttaccagtggtaatttttttatctc

SEQ ID NO: 3179 - DNA, 600 bp, Bovine  MMBT06292
gcatataaacagtttaagacttttgaaattttgactttcaagagagctcacagcaatttatatttctaatcagttgagtatgagaaagcctaccccactgtaccctttatttcattcaatattgtgattttttgatgttaggggcaaaaaatgtgaactaattgcagggttttttttgttgttgttgctgttgttttcttggccactccacacatcatgagggaatcttagtttcctgatgagggactgaacccatgccttctgcagtggtagcttgaagtcaaccagtggaccaccagrgaagtctctaattgcaactttatttcacacatcttgggtatttttttttaattgtctttgttttatttatttattttttatttctgtcagtgagcagcatttcccagttttgcctccccccaaaaattcttggtaacttcatcacatgggattataggatgcctctgtgatggtgaacatttttttccccatattttaaaatgctgtttgcgtgtccttcagtttttggtaaaaacctttctgtttttacatatttatcttttagcacatctatctattctttggccccttcaatacacc

SEQ ID NO: 3180 - DNA, 600 bp, Bovine  MMBT06880
ctggagagccttcatccctctgatcctctctaggctgtccacaatctgcagtcacgactcattatcctgaatrcacatcagaattacttggrtcttttttttttaaagtaattctggggccccaccccaagtttctatcaagtattaggtgaggcccaggtgtcttctcttataaagctctccagccggttcccttatgcagtgaggggcatgacccctttggtctgcaaccttgattgtgaatacaagtgttggaattttttwaaaaggcgatgagaagaggtcacaccaaccagtcayrtgtacagcttcttaacagtcattgaaaagcatcctgaggacacggtcattgtgaaattggggggtttggaggtaaacttgggcttagggtgctgccttgtcctgcttcaggtaattatgattcgggtgtgttttgacaaccgagtgtaaaccttgacaacagattatatctgtgtaatttctccttctctttgtctttttgtgcaagtgctttaatcgactgtctgataaacccacttcaagagcagatggaagaatggaagaaagtggccaaccagctggataaagaccacgctaaag

SEQ ID NO: 3181 - DNA, 600 bp, Bovine  MMBT07037
gatgggcacaatacttggaccattacaggtgttcaggaaatgttagtcacactggattaaaagtcagacactcacaattatttctaaactacaagaaaacaatgatcaatgtcagaagaaaaacttctgtggatacaataatatttctaagcactgattaccaggtgtctttctactcctttcctaaaaatcagaagaggtcaattcccaataaatgggttgaatcatgtttaaccaaagaagctactgaattaagcaatgatgctcagcaggaagattttaagtggatttgcaaaaatrataaaaatcccagagacagaactgccaaattcagcaacttaytatattaagagaagaatgaacttgaagagagagtgcacgatggctgaaggcatatgtttaaacagccgtatattttgctgagcactgccattcacagtttaattggagcatcaagataaaaactctgcttacacctgagtgcttaaagtaaaacactaaaatggctagcatatgctcaagatgattgagacattcatcttcttgggcgtacatctctctctggcacagaaatacaatatggaatccagggcactgcac

SEQ ID NO: 3182 - DNA, 601 bp, Bovine  MMBT07184
  misc_feature (1)..(1): n is any nucleotide
nttaaaaaggttcttaacaatayataataagtagtagctaccattaatgaccctggtagctcagacagtacagaatctgcctgcaatgctggagacctgggttcaatccctgggtcagaaacatcccctggagaagggcatggcaacccactccaagattcttgcctggagaatcccattgacagaggaacctggagggctataatctatggggtcgcaaagagtcggacacgactgaataacttcaccctttcackttcaccatttatgaggtgtcaggcctttaatctaacttaatttktataatgttcctctgaggttggtatattattagttctattttctagaagaggaagcagctgagctctaagaacactgagaagcttgcccagagttatacggctgtaagaagcacagttttgatcatacaagctctgtctgatctaaatacccygatctgcttcacgtcttcttgcatgctggtctcaaagaggaagcttcctgccataaaaacacagaggcagtgagatacttaagggaaaatgacacatgtagaatactttcagtaatttcagtattttttttttagcttcctgaggca

SEQ ID NO: 3183 - DNA, 600 bp, Bovine  MMBT07348
ttgtgtaaaaagatacagtcgattccacctaagtgaatatctgatttggggaaggggaactacacaccagccacctcggatttatgtacaacagcctattttaaccactgcttccaagacttacgtctgtggtccacctacataactgcctgcagagtcagatttgccaagaccttgtccggtcttttgaccacactggtacattgcactttctctcttctcctctgctctctgctcctctcttcttctcttgatatgtgtacgcagttcttaacactcaataacaatggctgccacttygctgcataaccttaggaaacgtgagaagagaggcagcagcgctggggtttcttctatctaccatgagtccaaaggcctatcattaccatcaaactcttctcagaaacaagtcacttttttttttaaaggtgagctccttaagggaagaaactaaactttacttacctggtgaatagatatgaaagrtattaaacygaaatccatgcgttgccatcaatcaatagctatgtgtagaaaagtaaattattttmaagagctagctgaatccaggagcagctttaattattaaaactaatggaa

SEQ ID NO: 3184 - DNA, 600 bp, Bovine  MMBT07549
tgctggacccttgcaaaggaggctctccctgagtgccaggcactctgcggagcatttacccaaaaacgtcatttaagccacagatacccctgccttcattttagaagtgaggaaactttttcccaagctatgtacctggctcgctctgtcacctccgttccatcacatgtcactctgtgccgaggctgtccttgaccatgcagtttaagtgtgcactctcccactgccctgctttatttttctttattgcacttgccatgacatctaacatgccatccagttcttacggactgtcccctraccaagctccactagcgtatcagcttgctgagggtggggactgttgtctgttctgttcactgctgcatccccagcatctgaaacagcacctgtcgcatagtaggcctcagtaagtatattctgaatgaataaatgagtctcagatgggtttgggactcacagctctaggactccatctggggctgtctgactcaaaaccagtgggttaatagccagactccatgactgagggtcagaccaaggaccacggcacagcctggggttcaaagaagacttgtgcagaatgtggtactcagctcc

SEQ ID NO: 3185 - DNA, 600 bp, Bovine  MMBT07893
ccactcccaaatctatacatagtcaaattaaaacagttacattttagtcctttctgtttcaaatgcattacttaattaatgagttaatataattcaaaataagttaaatttttagacttttcaattgccaattrttttatattttcaagggaaattattttattaacaaaatgtatcacacaaatggctcagaagtgcattatgagtaattatatctcaagacaatttatactctggcttaaacagtctcttgctgcattaaagccccttaggaaatgatactattgtaatatcaattcyatttcataaagctctagtggatgtcattgagattatagccaaaactcttcttgttatacagtaagtcatattaatgtgtgtataaagcatgttttgacaaggcagtataatattattattatttattaggtccaaggcacctctcagccagtaggaaattagctttaatatcacattatagctcctctagcttctgctttaatgggcttcagacaacagcctgtttccactccttcaagatggcttagagtcttaactgctcctgctgagctggtctctgtgaactgtgaagtttttaat

SEQ ID NO: 3186 - DNA, 600 bp, Bovine  MMBT07910
gaaggatgtcgtctttagaaaaagctggtttcttaaaaaaaaaaaagagagagagactgactcaagtttagcttgccttaaaccacagtggaaaatcagacgggcttaactattaataaccctctttcctttcaggaattagaggagaaagggctcctccaggctgacctttgtggaatctttacagttttctcttctgggcagctaaattcatcctggggatgacctccctctatcctgggcaaatttctgtccccttcctttacattcctctctttagcaaagggctatccattcatraayaggaccygcgcaggtccgactagacaatccratcccatttagaggtgaatttgaatcaaagacacagcaccaaatgcctcgctgctcatgggcctctacacgtctccccaagcggcgtgtaaggccaggttccccacgcaaagtgcatagcygggcaccccccttccctctgtctggaccagcccatcggatccccgaaggcctactcaagagcaacagatgcttctaggtttactgcctctgaagcagcaatgggcaagggagatgctgccaacttacaaagtcgatcatgacgaa

SEQ ID NO: 3187 - DNA, 600 bp, Bovine  MMBT08979
cgctgtggcagagctgggataatacactgcacctgctaacaccaagtccatccccttcctcataccttccgcctgctcctccacatgtcaaacctgtcgccacctttgggccttctcctgagctgttccctttgcccggatgctctctataatcttcacatggctggatgcttcttgccacttgggtctcagccaaaatgtcaccctatgagtcctctgccactctaggtaaagcagtcaccttgtcatactccaccacaccaccctgttttaattctctacttagcacctaaccaccaygggctattcttgtaattacctctttgcctgcttattgtctgtctctccatgagagggtaaaagccctgtgagagccgagcttctgaatgttgtgttctctgccccaactataacacctagaacagagcaggcgctcaatatagatcratgaatgactgaatggctttcctactgcctcctccacacattaggatggtatcaggaaagaatcaagtccagagagctagattcaagcttcacctctaactggctaggggctgcactctgggcaatctccattcagctcaatttctaggagta

SEQ ID NO: 3188 - DNA, 600 bp, Bovine  MMBT08989
tctgcctttataggacagatacggaggccgagctggacctcgtcagccgcctcgccaaagaacatggtgcttttgacgccgtgaagtgcactcactgggcagaagggggcaagggcgccctggcgctggctgaggccgtccagagggcagctgcggcccccagcagcttccagcttctctatgacctcaaggtgggttaactgctgtatgcaaaaacaataaaccaaaaaagcacaacgaagtttctgtttaggcttctgttcagagccatgtttagcagcttcagcctgtgggtttgcrtctcatggaggtgagttacatgaccacagcctggacgcccaactccagacagctttcttaacaatgtgcattgctgctttctgaccgaggagggcatccagacaagaacaccccaggaggttggctcacgtcctaactttggaaaagrctcacagtacagccccttttctggcaggagaaaggcttacatagagaaccacagcctttaaagcagggcaccagccrtgttactgcaaactggcactgggctacatcaagctgagaagtgtcgtctgactgcttcccagcataggggaaagc

SEQ ID NO: 3189 - DNA, 600 bp, Bovine  MMBT08991
ctgcaacctgtcctcacatcccatctggttcctcagctgctcctgggcayttccccaacatctcctcttcccygagccttccccaaagtcctgtagccctcccttggcctccagaccctccccattcctaagatgtctctcattcaaacagcagcccagcccaagctcctggacatccaaggagctaggctaacarctcccctgaggaaggtgaatgcacctgaccctgagccccttgaagatagtgaagcaaagagagaatgagatcctaggagctccatgatgacgacaacagtagtratgaccagccttttccaggtcccaygtctgactgttctaagtgcttttacaaacatcacctcatctaatctttacaacacctggagaggcaggaatgtgttatcctccccattctacagatgagaagcttacgtggtattcaaggtcgccctgcccccaagtgaggttcccaggtctgtctgacaacaaaggctgcctctgaaccccagggctctgttcctcctggctttacctgcctcctctcctctcttggcaaggagcgggtgtggggagggagggtggaagtctcaagtggaagcc

SEQ ID NO: 3190 - DNA, 600 bp, Bovine  MMBT08995
aaaccattggcgtgcttaaggagaagggaatgacatgatctgattaatatttagtaaggattactggtctgctctgtttaaaacagaataaatcacacaatgtgaaagaaaggaagctctcataggagttcacaaattaaggcccgtgggccaaaaccagcctcccactgggtttgaatagcccatgagcttagcatggtttttacattttttaatgaccagggggaaaaaatcagaagaataatatttgaagaagaataatacttcatgaaatgtgaaaattatataaaattcaaattrcattgtctaagttttattgaagcacagccatgcttatgcttcttcgtttacatattgtctgtggctgcatctgagctccagtggtgagttgagtaactgccacagagaccatatgcccagaaaagccatttactgtctggtatctacagaaaaagtttgccagttccaggactcttgaattaattcagatgagaggtgatgatgggttgggtcagtgtagccacagaagtgagtcatggtctcatttctaagcatatttttaaagtgaaactggcaggatttgctaatggatcatctatg

SEQ ID NO: 3191 - DNA, 600 bp, Bovine  MMBT09001
ggtattttttcataactttagaaattggaaagagaattaatctcagaattatcattatctattctttcttccactcatatccatcacaaacatttacacaacaagattcgttgaacaaatagtcaatcacatcattcagggaggggaacattgaatctaagaggaaaagccatcacaagccactagaattataagtttcaaagaacatattatgtaaaaaggaaatgatgtcaagtgaattgagttggtatcatagtacagtactattttaatttctttatatcagtaaatagctgtgaratttttggttttgtttgttttatttgtgcttcacagggaagccaagtgatttttgccaaaaaaagaagcagaaaaaaataagaaaatgctagagaaatgtaggttatctcttacatgttcttatagcccctataatgtcagcttagtcaataaatgtttgcaaaaatccaactagaatgtgataaggtagttgctgtagctgctttctcttttcctacttttgtaaaagtaggaaagttcatggataaatggtagtaattagcatgcaattgtgaatctaggttgcaatttgcaagtgtg

SEQ ID NO: 3192 - DNA, 598 bp, Bovine  MMBT09008
  misc_feature (1)..(145): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgagtccagatttctgagctgagcattaaggagtctatttggcccttgccaaattccctgggcccagttgcccctgaattaaaggacagccaactcttgctgttaaggaagagatgtcctcttaactctttctayatgagaataaagtctgmtgctttcaacttcctgaccttattctggtgctaaaatatgtaacgtagttgaaagaatatgtgatttataagcagaagatctaggtttggacactgacccttaaacrctttgtgtcctaaggtaaattaacatttcttaaattcagttaactcatccgaagacattgataatattaaaagtgcaatttttatttctatataaatattagaartcttattatgtaaaaacataacagccacaacagtaatctttcccaaaggtctaaacaatgcggaagcctagaaaatcaacactgtg

SEQ ID NO: 3193 - DNA, 601 bp, Bovine  MMBT09044
  misc_feature (1)..(1): n is any nucleotide
nattttgcaaatttycccartaaagcatttccttttgarcaactcaagagcaraacccattcaaactctggaaaaaatgatgatatagagaaggactatgttttctatccaatatcccatagtaggagcttagtaatagttagtgatgacacagctaaagtatgaatgcaaagcattaaaagcccttattaggagcactgttttctacttcagggaccttgggacagtcacttaaatttgctttaatccaattcttcctctgttcaattgagataatggatacaggatattgttttataasgtctgcaggccaaatgtggcccactgcctgcttttgtcaataaaatgtcgttggaacatagctgctgtgctcattaatctgtgtattgtggatggctgcttttgccttacaatggcagagttgaacagctgccaccaaggccatgtggtctggaaaacctgaatggccattcacagatagagtgtgcggaccacttctgtaagagactaccctttgtcttgctgcctaaaccactgtgtcagctgcagagctccgcaccataaggtgccactcttatttaactgtatgtaacccttggca

SEQ ID NO: 3194 - DNA, 600 bp, Bovine  MMBT09333
aaccacataggaacaagaaaccatgtagggacaaggaaactccccgctcagtctggaggaggagttgatgatggaagcatgacatcctctcaagaaagacaaagaaggtcttctccagtccccactttttgattataaaactgtaagccagtaagttccaggagcacagcatcctcttgcccacctgcttataaaccttacaagcatcctattctaacacatcacatcttctatcactttgcctctcactgaattctttctgtgctatcactgtggtactggagctcctccgagcccacygaagtgacgccaaacgtttcacctgctcaccaaaattcatatggtgaaacytaaccccaagatgatggttttgggaggtggggtctttggaagccaatgaggccacgaggttggagctctcgtgaatgcgattagtgcccttgtaaaagagactccagagagctccctcaccccttccgccatgtgaggacaaagtgaaaagacagctgtctgctcaccagggagtgggttctcaccagacacagaatctactcacagcttgatcttgggcttaacaggcttcccagctacggagaagga

SEQ ID NO: 3195 - DNA, 600 bp, Bovine  MMBT09550
ccagcactttgcatgcatgcatgctgtcacttcagtcatgtcctgactctttgcagacctatggactctcgcccacctggctcctctgtccatgggattctccaggcaagaatactggagtgatctgccatgccctcctccaggggatccccccacccagggatggacccacatctcttacatctcctgcattggyaggtgggttctttatcactagtgtcrcctgggaagccctcaccagcacagacttacgttcaaacttagcattacagttaggctctttccgttattttactaacrgaaagtaagaaaactatgtatgaagtgaaatcattactcaagtggtaatgcttaaaartcaagattttgaaygctgtgtgtgctgtgtgtgtgtgtgygcgcgtgtgtgtgtgtgacttacaaccactgctgatccagcatttgttctgccatttgactactcagagacccaagattgatactacatgaagcacttgacaattcaagtaaaaaataatgtgatattttyccaaaactggtcaataataaatgagttttagaatttaaatcaaaacaatggatttctcacagtacattatt

SEQ ID NO: 3196 - DNA, 600 bp, Bovine  MMBT09556
acttctaaaccatccctttgatcttcaccccacagttaatccctgttacccaggtttccagctcttaagggcaacaccatccaccttgtgttcaggccaaaccccagggtttattgtttatccttctttttctctcatccttccagtctatcatctcctttaacatgcagttttgtaatcagttaagtgaggataatatctcccttcctcagatgatgtgaggattagatataatctatataaagcaccaggcacataggaaatgctcaartgatatccattttcaataccaggctctaytcactgaacaaaagcccccattctcctgaatagacacataggctctgattctgtgcattaaaaaartgaattggaaaaasatatatcctagagtctaggtttggagagakaaatgctaaaggcctcagggtgagcatctaagagcctgtgggtaaggcagtggtgcattaaatgagagtgctctcattttagcgtgctccaaagtagcccactaataagctatgatcatcacaggtaaatggagatttcccaaaaagaagagagaaaaaaaaaaaaaaagacaaggaaaataaatgtgca

SEQ ID NO: 3197 - DNA, 598 bp, Bovine  MMBT09646
  misc_feature (1)..(137): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgtgaggcctgcgccctgtgcatgcacggcctgctcagcagccctccctgcctcacctgccctggttgatgttgatgttgttcactcggtcagcgctgagggctgtcttggtcagggtctcgatcacgtggtcactctgcagcaccacgtccccctgggrgcccacatagggacargggtcaggccctgcccagcgcttagaggacccgtcccctccccgcctccccaggccccaaggggcaccttctgcttattgtcctcacgctgcacgtggagcacaaagaggctgtcgctcaggctgctgacggagattcctggggggaaagggcagaggtcagggatcaaggggcagagcagggccccctctatggacccaacctggactcaggctcaccggtcaggttggtgtactcaatcctctgcttgaccttggcgtcctccacaatgaccacggcgtt

SEQ ID NO: 3198 - DNA, 602 bp, Bovine  MMBT10035
  misc_feature (1)..(2): n is any nucleotide
nntaggaggaactgtgggaggctcaataaaataagtatgtgcaattgtgaagacagaaaaggaaaaaaaaattacttccatcacagtccacaaagatcgtttccagtcccaaacatgggtccccagagatagcctggaaacaaattattgtcaaagagatgcttaccttttacaacagctcacagtgaaataaaacatatagcttaacatctctcccacactcacctttctcttgctctcttttttccttttattgtctctctctctcgcttccctttctttctgcctgatgctaaacttcrcrttctgagcccttctaccaattattggataagtcgcttgtccttcctaaacctcagtattctcataagcaaaatgaagtgtttatactatattagtactcttttacttctaagtgtgactacaggcacaagtttgctcaatctgctctcatacaattggtcgtattagtgctctaacttatttagttccaakatgatgactgtggtttcagcctgcacaatgaasaagtgaatttgttggtataattatgaggtctcatcttttggaaaagtgagatcaaatggttaagtgaagtcact

SEQ ID NO: 3199 - DNA, 600 bp, Bovine  MMBT10082
gaggaggaaatggcaacccactccaatattcttgcctgaaaaatcccacggacagaggagtctggcaggctacagtccaaagggtcgcagagttggacacaactgagcatgagcatggcttggcgtgttggggaacataytcaaattgcacaaagtaacaattatttaaagagtattctaaattcttggcatgtgttgatttaatccctgggtcaaccctttaaagccgatactatctttacccctattttataagtgaggaaatggtgacccagacagcttaagcaacttgcccaaaaygatatggcttgaaagaggcagatctgggatttaaatccatattcagttttggattcaaatccttgctttcaatggtggatacaatctcctgtcctttgcaagtgaagtkgatggtaacccttctacctttggcaggatgtgttccttgaggtgttccttccaaaaataaagatattctcattttttaattaaatactttgctacttttgactgcctcgagtcttagttttcagcaggcagggtctttccttgcggagcatgggctcctctctagctgcggtgcagactctggggcgtgta

SEQ ID NO: 3200 - DNA, 600 bp, Bovine  MMBT10151
acaacaatgatggactttaaacattaaacatttttctaatatcgagaaaattactgtaaacgatagttctttaccaatctcatatagtacagaagacagactgggatgatgggaaagaaattatctctaaataactttctctctgggtttccttcctcttaatgttatatagtttgaaaagataaaatttgccttgagggggagagtgcaaaatgttacaatttcaagctgttttctcaatagtgcaccctatttaacaaacaatagggatatgctttttaaaaggagagtattttgatwgaaaaagacatgaacaatggtaagtgtgctatggtttacaaaggaaattacagtagaaaatgcagcataaaaagattaagtgggaatgtgatgttaaaggaccacagatgctgttaatatttcaaaactggctacagttttaaactccaaagtacagagagaatagctatgtctttaacaataagcaaaattagtgatatcaataataataacatgaatcacttatataacacaaaatgccatatagcacataatttatgtaaccctgacattgtttcaagggaatggatagtaatcaca

SEQ ID NO: 3201 - DNA, 600 bp, Bovine  MMBT10245
cagttcacctgaaaaggtaagcacagccagtttcactggctccttttctcatggaaatatctctgagtagaatgggttagtctcgtagacacaaatgtgaaatcaagtttggatcaaagttcctcactgcagcaacaaagaagcattactcccacaagtccacctcactggactccatccyggctgggaccatggactcaacctcgtacagcgtcagctgagtcctctgtaaaatgggtgtgctgcctacttcacagaggaggtcaaggaattaaatgacataacaaaggtaaagcactyagcacagtggccagagcaagaaaggcactagatcattctccctcttctgcctccagtctgactctgctcttactgacaaatgatcatttccaatcttagagacctgaggtcttgattcctttaccttctaatacttttactgaatttttctcatcttaatcttcaacagaatatacatataaactgaaaaatgcttcaatcataagtattaggttgaccaaagtttgttcgagttttttcgtgagatcttatggaaaaacctgaatgagcttcttgaccaacttaataattttaacagta

SEQ ID NO: 3202 - DNA, 529 bp, Bovine  MMBT10760
gaaactccttgataagagattctagacctgccactgactaagacacttatgaaaatatatgcccccaagttcagtggagttccttgatctgattccctccacctacttaatagagctagcaatagtggggccaggggagcagatactgacaagcttttctcccgggtccaggtgggtgatgcaatgctgaacaccaggatctgtgatctcctgctctccaagtatggcatctatgtgcaggccatcaactacccaactgtcccccggggtgaggagctgctgcgcttggcaccctccccycaccacagccctcagatgatggaagactttgtgggtaagtcctcaacatggggacacctattccctggtggctcagaggttaaagcgtctgcctccaatgtgggagacctgggttcgatccctgggtcaggaagatcccctggagaaggaaatggcaacccattccagtattcttgcttggagaatctcatggatggagaagcctggtaggctacagtccacggggtcg

SEQ ID NO: 3203 - DNA, 600 bp, Bovine  MMBT11313
atgtgaacttgtatgttttacagaagttcactgaaactatgaagcctcctttattcgaagaagaaatacctacctgagtccatggagactgctgtaggtcaccttgaacagtaaattggccttttgaggaaaggcctctatgcaaatgcatagagctatacacttgtggctagaattaatgatagctaatgagttacttacattaagatctcttctcagaatcatacaagggtatctgtttttaggcacaaaattggaatgagctgtgaagactaaagaaagttcagatttgtctacacyatatactgtgttctaggagggaaaaattaggatcaggttgagttaaattagcttaattctattatccagactatgttcattggtagactcttccttccaattgtagactaattgaatataaatcccattaaaaggcattggattcatttttcatttgaatgaaaggagctcaatttcctacaaatctgactgcagagaatatctaatacrccactcaaaatgctcagaatttgcaattgaaatcccaggggataccaagtctcaggtaacaggtacaggcatccatgtgcatacgcgcgt

SEQ ID NO: 3204 - DNA, 600 bp, Bovine  MMBT11498
taagcccctcctccttcagtttcacctcctaccggggctgctcagagctgccccacaggtctggtctgggcagggaggagggcagggaagagtagcctgaactctccagcccacagcagtagctcagttcaatgttcgcccacccactcctctgagccccatgaggctccacctcttgccagcagggcagccatccccgacccagttcctgccttaagtcccagcctgcttgtttattacagcagcaacagaagcgtggagagactccgaagccacacaacttgaccgttccaaaagstmggtgctggcaagaggccaacagcccctgcagcagtgcaggcaggctgccaggcggtgagtccctgcccctggagcagcagggcatcctccaagctgggtcacagtgagggtcacaggcccagcccagcaggggtgggagcagcatgcaagattccccacgaccctagtcccccagggtatccaagccaggcagctgctgacaaccccacagccaagacagaacccttcctcttggctctatagggatagggaccctgagttctcaaggaacttctgtaagaaccaggtggggaaaggaat

SEQ ID NO: 3205 - DNA, 598 bp, Bovine  MMBT11705
  misc_feature (1)..(23): n is any nucleotide
nnnnnnnnnnnnnnnnnnnnnnnttcttggttggcccctttttttctctcgtgatttcatccgtatggagcttacgatctgccccgctgcacccatatggaggatgtgaggtagttccagcatgacctacacagagccatttgttctcatattcagagtgttttaaaagtccatcagtgactcacaggagataacagaattggaaagcctaacctytcttaaaaggagtctcgcacctaattgaaaaggattggccagaggtgatggcaacacgtcagtgtctgccctttccaaggagcygggaagccagttctgtattcacagctgctgtatttacagcaccggtctgtgccaacttcacttccaccccaggagccacccctttgcggcccttttatgtacccagaaaccagtgtgagatcagcttttgttcctccaggaggagggggcccagtgtctgcagggcgggtgcccgcaggagcaggaggggagagagggggcaggaggggagggagggggcaggagggggtggccaggggaagggacaggtgggcctgggctggcacactgcttgactggatgcgggggacacgcttgt

SEQ ID NO: 3206 - DNA, 598 bp, Bovine  MMBT11983
  misc_feature (1)..(14): n is any nucleotide
nnnnnnnnnnnnnnccacacacactgcaggcggggaagcggagcggctgacttgcccacgcatgtcacccgtccagaaggggcagagccaggactggagcccggggcagccagggactccacaacagaagctacagggcaggaagggctctagaaaaagacagaaagaaagcccctggtctggatactagcaggcctctctctgcaaagctccgggcttggggagagaggttcacgctggctgggggttgaggagggaattgggggcttgggggctcacagggtggagaggcccggggayccacgtgttcaagagcagaagctccaaaacacagggaggaggccacgtcctggaggacccgccatctccttattcctcaaccccacagcggcaaaacacgcactcgcatggtataatcacttgattacagccataatctggtacgatttgactacactgccagcttattacagtgcaagaaaatacaggaaacgtttcaattacgcctcgtgtaacccatgtataaaggaattgctgtccatcatggtgaaccttaaacgcctatttcttttaagataagcttgcaaagtctttgact

SEQ ID NO: 3207 - DNA, 600 bp, Bovine  MMBT12005
ataatgactgaatgaccacagcaaaggagcaacagaattcgcttattcagaacaacagaagtttgtgccctaagaaggagctctcttgtacaccagtctcagcgccacccatctctggctcccggaacagagagcctccagggacgctacctggcagccacgccgcctcctacctgtatggtggtgttgcctccttccagcagggcgatggctagaagaatgctttcatggaacactcggtcactggatgcgttcatgatgaggtcgatgaccaggttggaggccccctccttgtcaagrtggcactgaacctcggccaggctcatttcacccctgctcatggggctggatccggaacctccccctggaaagacgcaacattgcccttattaacytcactcagagcagctaacatttattgcatacttactgcataccaacattttatgcactcaacagtttaatgatactatctctctggacctttttaacaagcccacaaggcaggtaactcattattaacatcaagatgaagtcacttgtccaacaacacccagcacagctgggaagtaatagagatggaacttgaatgcagataga

SEQ ID NO: 3208 - DNA, 600 bp, Bovine  MMBT12144
agatacttagtgcttaaggaaaaggatctggctcagcataaaaaatttggtgaattaacattctggtaataagtagaaaccatgaatcacctaaataaaggaaaagggcttagaacataatcccactcaacatataaaggatgagtagataaaaaaagatttaggaaaataatatacattaaggtagaaaaaagataactgtgtaaccaaaattaaaggggagatagtcttaagacagaggaagtatttgtgccaaatgctaaggataacttacttcaatcagagtaatgaaggaaaaastaatattttatacatgttctatttatttatttttctactaatcagatgtctttatattgtacacacctcagtctcagcttgagttctttgacagcgatactgagcaatcagtctatcagcctgtgcaagggctagagcttttgcttctaagagatcctgtagcctgctttctttggactgtaagaaaacatatcrtaaatcttcatttgctggaaaatatctcttagggtttaattgatatacataattaaaatacggttgtactcacagctaatgtggatagtttcatctcatacacat

SEQ ID NO: 3209 - DNA, 600 bp, Bovine  MMBT12181
gataacagtcttcattttccatttctactattcatttctaatttttttagaaattaaaaaccttcagtgtaaatagcattctttatttacaacatgctttttccccgtttaatgcctttcaatttgaattcaaacttgtctgataataaaattgtacccctctcttttcacatatctttgcccatctttactttttccccaaatgttctgaatcactttggtttaggtgtggctcttgttttaaagtattttaagtgctgtttcatgatataatctaaaagaacttttcctttaatgtgraagttagtccatttacaattatttatgtaacagttttctactttttttttaaacagccaccattaaagttcacttaggggttgggctaatttaaagaacttttaaattcattttctttctcctaaagtattcattatttctgcttaacactgcattgcagagaaacaatgtatactaaaaaagaatatggcacacagaaggaaataacactgagacaagcagtatctttaaatattccttttcttggtagtaagcattaatgcctgtagtcttaatacttgctaagtacttgtctaacat

SEQ ID NO: 3210 - DNA, 600 bp, Bovine  MMBT12219
gccaataccttgatttataaaagattacctcaatttataaattgccttgatttataaaaaaataagtcaattatatggaagcactctctgcagtatcatagacaaccaaaagtagagaaaaacttcctgacaatggaattttttattagtctttaagtgacttggtgtcattttaccactaattgattcggttcttgtgactgagcaaaccttcttttatttgcaaagaacagagttatatttatggtggcacattcatgtggcagatttggaagaatgyattattattccattttactygggaaggcactaaaattcaggtgtttagttggtatcagtacctgcagcctctaagtaataaaatcagtgattgggacaagatactttgatgctaaatccatgtactttccacatcatgagtgcagataaattactcagctatgtttatactctaaaggctgataaagcacaggagaaatttcaagcagggaacccagaaaggtccaggagataaatattagagcagaatctacacatgacaagtataaatgaaccacatgcagcattgtagactggtaaattatatygatggagctaaaa

SEQ ID NO: 3211 - DNA, 600 bp, Bovine  MMBT12223
aatatagaactgttggatggggcagagagtatattcagggaactcaggaatgacttctttggctaaagagcaaatggcttcaattcaagaactacattctatagttacatgggaagaagtatgtttttcaataggagatatttgaatagaacaataatggtatgaaactgtgatttctgaaagttattctggccaaagtatatatgatgaaatggaaagacaagtgtacatggaaatggtagggtgatcactgaaatggagtaccatactctttgtaaataaggtggtaagtaatayggmataaattaytgatagcagaaatgccacttgcaatgtaatagaaaaaatactgaacagagatatcacatgtaaaccacatttattagcatatctgtataaaaatgtatactatagcaagcaaatttcagtcctttyccccccctcatttcttatttgaaaatcagtgcttgatttctgtgtttgacctgccatgggttttgatattgccatctggcagagcctgcttatcatcttcattatggacctagtatttctctatgctgattcctaattttcttcattaaatcctaagttaagcca

SEQ ID NO: 3212 - DNA, 598 bp, Bovine  MMBT12224
  misc_feature (1)..(120): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgtttatcagttaagaaaatgtactcaaaatttgccttctgtttgaggaagttaactctcaaaaataaaaataaaaaagagagagagattcctgttttaaaaaaatctgtgtcttaatcactcaggcttgatgtaaattaatatagaacccctgctatcttgtttttattttactktgtgttcacttttgatgaccatcaaatcataaacacatgccttccctaaaagagatgtttgctgctattctcttttggatggtgcaaataagtctgtaaaacaaatagatgtcttctagctccttcttccttcttttatacttattaaaatgaaaatccaaagcagaatgcctagaagtatattgcaatttgacaggatttcctttgtgtgcctatgagaaaatatgactagtgaaaaaggaagtagatatagtatgtgcatgtgatgctattttattggtatctgttgcacccattg

SEQ ID NO: 3213 - DNA, 600 bp, Bovine  MMBT12385
tacatagagagaaacataatatagatcttttcacctagtgccctttttacaccatttgagagtagatctttggccagaacttttctgtctggaggtgattttaaattacccaacaaatcatttcaaatcccacagtttgcaaagtcagggtttgagcgcataaaagatcgccagagctgacttctgaaactactaaaccttttcccaaaacatttactcctggcaatgcctgggcttttgtgttctggaacgtgagatgcaaaggcagcagaaagacaaacagtatcaaacaataagacrcctcaaaatttgctctgatgatcctcagatggcaattttgatgataattaagatgaggcattcactggcaagtgacttgcctgaggttatacagatgcttctaagccaaggtagattctatgactcctgattcctccgcttctactataaacaccccatcagtttcattattaaaatacaattgctaccacatggaggaagtgcctagaggactcagagatcttcagtctgaatatcttgagatcttgtgaaatctgaataatttttcctgttgatcaggcccycaacaaaagacaaaac

SEQ ID NO: 3214 - DNA, 600 bp, Bovine  MMBT12408
cgtggccgaccgtctgtatcaccaaggcacccctctcatctccctgcagtttcagggtcgctagttcctgctattgaaaacccagcttttttttttcccccatgggtttataaataggttgttttaagtgaccctgagctgaaaccaggcttacaaggtgtcaggcctgatgcaagtttcctgctcactgaagctttaaatttgccaggcctgatttctaaacctgagtgtaagggcacagtaacggaagcaaattttagttttaaaggcacttctttgaaagtctccttctccacttaygccggtgtaaaatacaagattttactttgagaagaggtgacagaggatgaagaggtttcaagtacaaaacctgagtcggctcagtagaattctaccaaccagaacccctggttaaatggattctgatgatgaagggcatgttatactccccagggacaaagacaaagggtagaaaacaagttatattatggttggtttttttttttttaactttccaagttatttcctaatgtcagtagaggctctgtctaatcacactccttttatatctacagtctaaacaatgattcctgatctatt

SEQ ID NO: 3215 - DNA, 600 bp, Bovine  MMBT12743
ctgagcataattctatgtgagacgtctcagttactggcccataagagaagctgcagtgattcactaggacagtatttataaaattgccacacacatgtgcacccatgggtgattcatgtcaatgtatggcaaaaaccaccacaatattgtaaagtaattagactccaattaaaataaataaataaactttaaaataaaataaaatttccacatatgaattgttgrtattaaaaaaccaattacagatgcaccagtctgttggtaaaagagcaatattcaaggaatattctaaacrattaygagtcaattatatcacttttagggacaagtgacarcacagtttgtattcaagtcaacagaaatgcttcattccaggctccctctgtagtagtgggattagtagggcaggtatgtcaaagatacaatgctgtyaagccctaagacttgcctaatttctaaaatggaatgctgatcctaagggacaagcaacgtggcaccacaaagtgaagccccacccccactctwcagactgacttccatgatttcagccactctaatcttagaagaaggtaacatctcccaatattgaccttcaggtaa

SEQ ID NO: 3216 - DNA, 598 bp, Bovine  MMBT13061
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctggggtgaaagttctccaggagaaaataattcatggcctcatattcctcaggggcccttccgctttcaaattccagttacacattcaaatagctgttacccgagatcaggggccagacatgctgagggcctgcccacgtgggcatagccagcctgtcctaaccagggccccgcggtgtggggcrarcacacaggggctcagcagagatctcgtcaccacgtcccaggaattttctcagcccccagayrcaggaggtgaggtcaagaatccagaattggacatcgagctagtcatcttatcattcaataaggaaaattccccataaacaaagaagacatagaataagtggctcatgttaaggacaattatttatatgttatgaaatgtctgaactccgtcccctgagaacaaactatcttgatgtatttcttcagcttcgctgagaaaaattccacaataataaacatgagatgtcggccctt

SEQ ID NO: 3217 - DNA, 600 bp, Bovine  MMBT13192
aaaataaggcaacaaaagtagtgtactatcactacctctattattaacattactaataattacaacataagcttagagttaatattcactaagtttttggtctggattatgaaagaccttgtgctaaacaatttacctacattatttcttcaatgtgcacaatttattaaatttacagttatactcattttgcagagtagagaaaaagtgagacttgtcaaagtaattatcacagatcactaagctaataattaaacattgaaaccaagatccaaaatctacatgccaagattttattcmctcagctgatagcagtgagtagggctgatatttttgaagtgattgygtctaaccaaaagatagatgccttttgaaatttgtctgaccagaggatgtgcttattacaaatgttcaaaaggtaagtgtgtgccaactatgaatcttcttaatacaggaaaaatccatgccagtcttggcttaagcctccattctttgaaaaatttccatgaagttaggataatttttatttctattaactctcagttccaagtgcatctgccagttcttatatgccaagtaccaactaaaaggttattatgt

SEQ ID NO: 3218 - DNA, 600 bp, Bovine  MMBT13237
agaaattccttagaaactcactggagtcttaaaagctatagtaatgagtattcacaagctaaaatatttctaatattttattttattagaaataaaataatattttattagaaatctaatattaaaagaagcctcttttggtttgacaagacagtaaagggggcttttctttgtttgggctgcaataatgcagaaatcttcacaactcaatatgaagtacgtacatcattatcattcacgtacagatgtggaaacggaggcacagagagttaagaaatttgctcaaggttgctcagctartgaatggtggaacgaagattcaaacccaagtaatttgggctccagaatcaatagccacctgccataattccaactgcctcacactaattgcaagttatgattagcagtaacatctttaatgaaagtgagaaaaatraaatattggtaattaataatgaaatacagtttggcaggcaaaaattttccagaccttgagtcttcagaaaagaagcaytttcaaatattatgaaaagaatgaaaatgtttaaccagcattagattagatgatactcacatttcctcctagttctaatgttctgt

SEQ ID NO: 3219 - DNA, 600 bp, Bovine  MMBT13266
aatattattattagcatcattactctgttcctgagctgatcccagtccttggttctccagcctctgaaatgagcatcctggggactgaggcatcagccaccggaaacagaacaggttcttgctggagagacaaaggaggctgcccgccgccctgggggagcctgcgcccctcactggagagagaggcctgggagaagcttggagaaggcacacagccccattgaacagggctgccagaaggccatacataattcattgccaaatggggcggcgggcggctgtgcgctgggggctcactcygcgcctggcactttgctgactgctcctcacacgttgcctcgttgcatcttcttggatttgtggggtgcgaaccttcccccgcctctcccttttccccgggggggagcctgaggtttagaggatggggmcaccgtgcaagtcaccagcttctcagtggccaagcgggatccacagtccctgcctctctctggaggaaagagacagcactggggaccgagtggggactgagacctacccgagacggggcagcagaggacgggccgggtcacagcagggccaaaggaaaagggcaggggaccc

SEQ ID NO: 3220 - DNA, 600 bp, Bovine  MMBT13378
ccatctctagtttgagcatggctatctcagtccttgcatgcaatatttaagatgttgctttattacatctagaagttttgaggtgtctgggcccatgtggtaccctaacattaactgaaggcctgaatatcacataatacccaaggcagcttcacaaggtcctcgtggtgcaagaaggtttaaggcccattttgctgatggggaaatggaggctcaaagagatgacacaaacagcccccgatcacaggatgtgtgagatgggtctgaaccttcagttttgcaatgtccatcagcatctcmaagaccctggagcgttcctaactcttagcaatggtgctctcaagggctttgttcagccttgtgggatacacttcaaactccagctcaagctaacagaagaccagcgtccgtggcatccgtcaccgtgctcctgtaactccaaggtggtcatgtgggttctgacagtcaaccaagaaaaacaaggtgtagccacaacatgtgctcatcttgtctgcccaggagaacacgcatttcttaaagagaaaaagctggctagtctttcctacagctttaataaacaagaagcaatattcaaacccc

SEQ ID NO: 3221 - DNA, 600 bp, Bovine  MMBT13772
ggacattaatgtctttgtacttcaaacaatattgtgaaaacacagccagtagtgaaacatctctcttaagatatattgtatcatacaatacaaggttccacagatcaaacttattttttattcttctcttatctattattagattaacactgatatgaatgatactatcaggattcatactgtacaaactagagcttttgcctcatttgaaagccagattagcttggtaaataacaacatgcacataaaaagtgatttatgcatctgaagaaaataaaaacttagatattttaatatctyaacagaatttataaatatggcaatttttactgttcattatcagtcaataggaacaacagcagattctggaagtgaattctacagagtggtatgacaattactgttatatatctcagcaatcttctaataaataatatgaggcttgtttgcatttatcagagtgatccttaagcaaaaacccatgtgagaaagaaagcttgcatatttataagagtaaatttacatataactacacataaaatattccattcctttgtaaaatacttctttataatttccattaaaatcatcatgtaatta

SEQ ID NO: 3222 - DNA, 600 bp, Bovine  MMBT13800
gtgacttgtaaactgagcaggtgcagaaaggacttgtaaggcttcagggcaggaacttttctgaacctgattcttttctttacaggaggcagctgggaaaataagcacatgtgatagttccatggcacaggttcttgaaccagacctgctgaacactgagcgaggcccagaattttccctgagccccaaccaaacaccagaggtaggtccctgctgctgatgagccatctgcccaaacccctggactagcacccagaggyggcgggctctctgtgttttgcgatattttttttaccaagyaagaggtctttgtgaaccttaacacctccatgtgtgctgccacgctggagaagtggaagattttccatcagatatttacatggagactaagcgtggcacagggcaagtaaagactttttcctcactcaccacgtgccaggatgaaccagcctttccagtagtatccccttcttttytctgtaatacaacttatgggggtgacagaagtggaggagagcgaatgttaattatctacctattacattagaggcatttgtgtttgctctctaatcctcagattaaataaggtaggttaacatg

SEQ ID NO: 3223 - DNA, 600 bp, Bovine  MMBT13823
taaatctgtctcctctggttgaggaaggatttagtctccagagcccagaggaaatcctgttgaattttagaacctgaagggttctgtaaattccaaacagaaatttacacccctcagccagccaatggtccatccggtagagcatcctgcttcctactgtgtctagtgatggatggtttaggagatggccaaaaatgcaccatgatgcacctaattgagaattattgcatcgccaaaaaaatttcttctttaactctggtggttggttagtttatttcacgatgcctgaggcctgataaytatttatctctatactccagttatagagaaactcttattttcccttagaacaaacacactattaaatttctcaaaagcatctaatctttaattgaatcttattaaccctctttctgattaataactcactgtagagtgagcaagtaatcacattccaccttttagcttgacttaaaaacttccaagccaaattgtatacataaaatagctgtctctgtatattataggtttcttaatataatacttcttaaaaaaatagagcccgttggaagtcaacattaaaaatgtactcttgtaatt

SEQ ID NO: 3224 - DNA, 600 bp, Bovine  MMBT14006
agaaccaaaactaggtatttccacttctcttcccccatcactgttagcaacccagctccactgggaacaataggaaggcctggagtccctgcggggtcactggtgatgaaaaggatgtccttgcayctctccccactctgaggtctgcagggagcaccagggtgtgcaggtgggatrtacaggtggtcggggtggggtgggggtggtctccgcattcgaattaaaaaccaaaaaactgaccwgatagacaaaatctcttttgtatctttcctggcagatcagctctttaaaagctgggaygagggacttccctgatagtctagtggttggaactctgggcttccaatgcagggggcaagggtttgatccctggtcagggaactaggatcacccatggctgtgcagcacagcaaaaaaaaccccaaaacctggractgtgttttttcactgcaccttgcccagtggatgaatgaggctcaggtagacctctaaggcagtcgtaactacaccatgcccctggatcagttttctgccaaaagcccaatagacaggcattcaataatacatgctgaataaataaaactaacgacagctaacttt

SEQ ID NO: 3225 - DNA, 385 bp, Bovine  MMBT14168
agaaccaaaactaggtatttccacttctcttcccccatcactgttagcaacccagctccactgggaacaataggaaggcctggagtccctgcggggtcactggtgatgaaaaggatgtccttgcayctctccccactctgaggtctgcagggagcaccagggtgtgcaggtgggatrtacaggtggtcggggtggggtgggggtggtctccgcattcgaattaaaaaccaaaaaactgaccwgatagacaaaatctcttttgtatctttcctggcagatcagctctttaaaagctgggayggtcagtgctaggtgtaaatttgtgctggtcctaggggttagcctgggtgagacctgtgatggattccatgaccctgggtggggg

SEQ ID NO: 3226 - DNA, 600 bp, Bovine  MMBT14229
acttgaggagggaggatttcaagccccaaacgcattctcactgccagacattctgaagtttggtttagtagactgtgtggattcataggctaagtatgctgtccttacactgaatcaaaaaatacagaagtatttaatctacagagaatcatatatcttcataaacagtgaagaccttgtgcagcccccatatgattgaaatatgatattcttaccttgaacttggctttagacatttccattttcttgttagacaatgcttctgtgtccctctgagtgtcatttgattgggtctgtgcrtcttggaacagttcctccaaggaagctctctcccccttcccttctgatacagcagggaaccatttctgaacagctgttgaatatctataaacagtgttttaaggtcagatcaggcttctcggttttttaaaatttatgtttgagagcactttasagacttgatttcgtgaatgtttccttgcctctatttccttcctttatttattatttaaaaataaatgttttatggtttgctcggttctcatgcacccactctgtccacatgttcatctactgccaccctgaccaagggcatcccca

SEQ ID NO: 3227 - DNA, 600 bp, Bovine  MMBT14562
cctgtgccaagcagctgaggtccctctaacagatgggtcaggcccctacccccaccccctgccgctgctgctgaagagagagaacctttccagacagcccctgtctgtgtttcattacaaagacgcagccatattccattaattcctcatttgctatgggctgagcgctgatacgtacatttttacctggggtggttttaatcagttaatttaaccagaagcattaataatgtatttctttgccactcgactgcccatctgttgaacaacttacctgttggagagcaatgtcacctcctrtgactcggagccctcaagcttcccaggaacaagatgagatcctgcatatttaatggctttgcagaccaagggtgagagctgggagtgcctctccctgctcggcatgggccccaggctgcagctagcagcatggcctgctttaccccaaggtccggataaacaccaccttcccgcctttaatcatgcttcgtggatagattcaagattgcaggagaggttaaggagtggagggtgctatgtgagccaggagataccagcagacagatccagcactctgagtgcctcctggcctctgcttgg

SEQ ID NO: 3228 - DNA, 600 bp, Bovine  MMBT15147
ccatttagacagaattacatggactgggcactatgaggtgcctgtgcccaggggttctctcctcccatctggctcatgacacgggctttcactaatttcagttatgtctacaaaaaagaatgatgtctgactgagctttcttatttcccagacaacctagaaaaaaaaaamaaaacatgtaagtatatttttaaagagcctaaaagtgcagatttttctcttattwgttttttctaggttaatttattctatattggaagttaatgaaagtcaatatattttgcttctaggcaagcatcygaatattttaagaatatttcatttgattatctgcttgctatttattgatcctactgcagtggtctctggacaaaattgtgtgcagtgaggagcacaaaatgggtctgcccttgtttggcagctggtgataaygaaatcaccccacttcttagcctgttttgaaatgtaagtaacagaagagagttacttctgttacttkcaacctagacagcatattaaaaagcagagactttactgtgccaacaaaggtccgtctagtcaaagctatggtttttccagtagtcatrtatgaatgtgaga

SEQ ID NO: 3229 - DNA, 600 bp, Bovine  MMBT15279
tggagagccttcatccctctgatcctctctaggctgtccacaatctgcagtcacgactcattatcctgaatrcacatcagaattacttggrtcttttttttttaaagtaattctggggccccaccccaagtttctatcaagtattaggtgaggcccaggtgtcttctcttataaagctctccagccggttcccttatgcagtgaggggcatgacccctttggtctgcaaccttgattgtgaatacaagtgttggaattttttwaaaaggcgatgagaagaggtcacaccaaccagtcayrtgtacagcttcttaacagtcattgaaaagcatcctgaggacacggtcattgtgaaattggggggtttggaggtaaacttgggcttagggtgctgccttgtcctgcttcaggtaattatgattcgggtgtgttttgacaaccgagtgtaaaccttgacaacagattatatctgtgtaatttctccttctctttgtctttttgtgcaagtgctttaatcgactgtctgataaacccacttcaagagcagatggaagaatggaagaaagtggccaaccagctggataaagaccacgctaaagg

SEQ ID NO: 3230 - DNA, 600 bp, Bovine  MMBT15349
ttcaatatgtctcttgacattttttagaaatgccacccaatttattaatgctaagtatattgttgctgaaagaaaagttaaggacatgttgaatatcaagattctgatcactgaaataatatgacatagtctattctttgtaattgctgttgaaaccaaattgatcaaagaattaattcagagactgtcataatgttgttttccgtttctggccatattccatgattatattaaccactagcatagctattttatcagagataaatgtgccaaattaaggatgactgaagatccaaggayaagaagggcccattgagattcacagaacacatactgctgtaaaaatagtcttagtagcaaagaggagggraaagtataatatgagaggtatgtgagtagaggtccaaggtagagaatcagtggacagtgtcagagtttaataacatggtgattgataattcactatccttgtgtttcacaggtaaaaccaaccagagttgttagcaacaggtggtagagatccagctcatatttcagactttgaaaagactaasggaaaaggcaagaagtggtgccattacttctaggtcatggttactc

SEQ ID NO: 3231 - DNA, 600 bp, Bovine  MMBT15745
ctgctgaaaatttaaaacacgggttgtacattggaaattcatctagaaatgatctcaacatttactgaaatagagtgaaaataaattagagtccaaattcagcccagcaaccctcacatatggttttaagctaattaaatatttttttgacaactgaactgaaactaaggagctaattaatgattatactcatagatcatcctactatgggtttaatcagcatttggtttgccttagctctgagatggactaaaataagtcactctcttttgaccaagtgttataacaaagtgaggctcrtttcatttaatgctgtcactcattgtcataaacttatcatcacttaaaacatctgtcaaagttgtcttgtaaaattgtcttcagggctgaaaatatacgcctttttttttttttttttaccattctcagtacactttgagggaggatgtaatttttggcaatcgtccaaagaaatttggattaaagtttggggaatacatttgttggatctgatggattaatttaacaacaaaaaaaaagactattgtgttgtatcactcataatagtatatttagccttgaggaatacaaaaagtaggt

SEQ ID NO: 3232 - DNA, 600 bp, Bovine  MMBT15796
agcaactcttgtgtaaattaatctttatatggaggaatgggtgatttacatcagatacagcagttaaccttaaacaccagaacattgaccacagcaccttcaaatagtccttgtaggtgtgtggttggggtattcagtgactctctaataaaggtttgctgttgttaatatcctaggaaccattgggatgtttttagtggagaaattgagggttcagaagcaaatcccaaytactgtggcccattttcacagaccctgacctcccaccagctcttgggtctccccagtggctagcctggmgatgccctcaacatgcaaagcccagcaagcatatttggtcttcctcaagcttacagaatgctgttcctccctggaaacccatattatgttaataacttgtgatgaaatatcccagcagggagttctgggattcacacgccttggctgtatagtaaaacgctcatttatggtttatgctgctaaatgctcctttgctagaatgcaaggtggtaggacccaggagaactgtaacagctaaattctggtcctttttaacaaagttcatctgctgtcttagttatgccggcatttgcgtggaat

SEQ ID NO: 3233 - DNA, 493 bp, Bovine  MMBT16350
gagacaatgtaaaggaaagtcagttttcagaaactatatttagtcagaaataagcaagtactagtttggttttaaaatatgaactctccaggagtcaaccttgatgctatatctttgaacatccaaatacagcagaccttgaaaaaaaaaacaaaaacctctcatcacttcaaaaactaggaccaacaatccatttacagcagtaatctaaaaacaatcgacaccaagacatartaaaactggaccaggaggctatcattatatttgccagaagctgagcaaagttgctagccagaatcratgttagaagtaaattttctttgagtacttcaatttttcctgggcagataaatgcaaaatctgtaagcaataaaactggtcacctctttcatttctttcaagcaactggagaactggtcacccgctctctctataattattcttgtcttacatttctacatccattctgagatggattctcctggaaagagtg

SEQ ID NO: 3234 - DNA, 598 bp, Bovine  MMBT16842
  misc_feature (1)..(199): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattcagcttggaggaaatcaataagatcacttaaaaacacttttgggttatgatttcttaatttgcttaatcgtctcctaaaatgtgaacattatttcrttttcaaagtgtgcttattatttgctgaacttgaatttgcattcccaaagaattattggatgaacccttttttttacagcagtgattttaattaatcccctaaccagcaaattcattgcaatgtaaattatgaatcgagtgaattaggaggagaattataattaggttttcctgtaattcaattattttcatttgttagataatctagttttttagaccctaaagatagcatccagttctacattatgagaaaaaaattaatttctttgaataatttaatagcaattaagtacagttt

SEQ ID NO: 3235 - DNA, 598 bp, Bovine  MMBT16910
  misc_feature (1)..(86): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnntcactcagagtggagcctgtcacaggatctccttcttcctcacaggttaccacagattcgaggaatcacaattagggaagtaaaattcactatgttcatgatagatcttgccacaatatcctatatttaaaaatttttactgttacacgataaatagaactcagatttatgaatcacaaattatatacctcatatttcacatttggttatagcrtttttcttctttctctgattcatatagatgttacatgacrgtgtgggtgggatgtgtgtgtaatgtcatccgaggaaagtgcactctcgtgtgctatctgaaaccactgactgcagccgaccccaatgagatgcttctcactcacaaagcttggagtttgcagggtatgtcacttacaaaaaaggcatgcttccgcagttatctgtagcttggctgataacagcaaagagctttctgcaattgtcattcaacgtgggatccagagaattctcacagttccattagggactgttgagag

SEQ ID NO: 3236 - DNA, 600 bp, Bovine  MMBT16999
caatcaggaaaaatgcaaatatgaactagggatgaccacagcactgattatgcaggaaaagtcattgtattagggatacatacagaaatatctagcagtaaaatgccacattttttataatttaaatattttccaaaaattggacaaagcaaatattgcaagatgttagaattgttaagacctaagtgatggattatttgggtatttatcaggtttctatttttcagtacatttgaaatttttcataataaaaagtcaagacaaaattactttgtgaacacctgtgcatgaagcagtgcrttggatctccatgattacaattaaatggggacaggatgaagaggagaaaaccaggaatattctatggttatcttaccatatcctgccatagaagcgccattctcgacatccattgtgttcttattttcctctgctagggctttaacatattttttgcttaaatctagtatctgctcacgtaacttgacactgctttgatgtcttggtcgttgaaaaatatagtgcagtaacatcaatccccaaaggagtccaaatacaagcaagagtaaactcaatttctgggacatagattttcttgag

SEQ ID NO: 3237 - DNA, 598 bp, Bovine  MMBT17042
  misc_feature (1)..(67): n is any nucleotide
nnnnnnnnnnnnnnnnnnnnnnnnnnnnnnnnnnnnnnnnnnnnnnnnnnnnnnnnnnnnnnnnnnnctggttactgtttcacaatgcagctgtttaataaccttacaaatcatactgattgaatggttacaagactgagaactaaggaaagataattttaataatccttcctttgtctagacacactggtgctttttatttcctaaatgaaatttttccttgattaacattgtaaaaagttaaatgccttgcagaagctaacatttgtcaacttcagttaaacttcagcatgacttctstgttaaggacattcctagaaaagatttatacacatacacaaacacatatacacacatatttattttttgccaacttcrtaattcttgtattgctctcattaatttttatgtgataaaaaatttagtaaatttctgtgctttttggcattttcacttttaaactggctatgaatctatgagttttaatgttatttaaaaatcattaattatagtgtttattagatataaacttaaaaatagataaatgtttttagattataccaaattactgatggattctttaattttgtgtaaagtg

SEQ ID NO: 3238 - DNA, 423 bp, Bovine  MMBT17340
agccaggagtccagctcacaaatggagtgtggaaggagataccaagtttcttggtatgtgtggtgacttctcttttttatgtatttactttcacataccctaataatatgtttttttcacctgatagaacagttaattaccagccattactggtacagagttccatgaaggatattttaggaacctgtagtctcaaaaaagagcctttatattcataactataatgttcttaataacgttgttgggattgtggctttcttttgtttcttatttttagatccttgagtggaagctatttastgattactcataattgtgaaaataatctagcaatgataggaacttgttaggaaaatctgtgttttcctttcttttatgtagataacaatattaatcccaaataaatgttggcaggaatgacca

SEQ ID NO: 3239 - DNA, 600 bp, Bovine  MMBT19051
gtttgtttaaagaagttttcattttgataatacttggcagaagagaaattttacttttggaagaaaatatgaagaagttacctgcttctggctacaagatccattttcctatattgtgaagagatttgtttcattcaacttggaataccatccccttcataaaaccttcccaggccatgatagtcagaaggtacctttaattccacacctcactttgtactatcaataaaaatcacagtgtaaaacgttgaactctacaaatctcccatggcacctaaaaatgtcccttasatgtaacaracacctagtaagtctccttaaatgaaagaatagcggggttgttatggaggggaaatgaaaatcaattgcaattctctcccacaacagatttgggctaataatgtaagaattcttctgttaccaagtactaatttccaagtttatggacaaagttatttgacttacacacgatgaacagcacattcccatggcaggatctgctgtgttatcaggctttcagaagtaccagctgcaggtaggttttattttgggattttaaatacacacacagaagggataagtacaacaacagagaagcca

SEQ ID NO: 3240 - DNA, 600 bp, Bovine  MMBT19072
gaaacaaaactttaagagtttcatgtcaaataaaatgctaacttgatcctcttgtggtgtcctctttttcttcttcttcttcttcccccagcagcttggctccgaatctttgctgggagactcttttccgagtaagtcatctaattcgttcagccccagcagccgggcctgaggcacctccagctccagccgatacgacaggttcctcagggtgcacacgcagttctccacggtctgaaacccaacacggcgcagggttaaaaycatcgtagcgtgttagtgcaaaatgcttctgtaccmagcaccagtggcactaaataaatgtagaatatgaaagaactgtttttcactgatgggaacctrcaaactgaaagttagaactctgattccagactcaagttggtgggaccccaagctcacagagtgtgcagagccacccaaagtagagctgaggatctgatttcacactgagtgaaatgtgtggggctctgggaggggagaatgcccaaggtttctgcttcagggctgctgcagtggcagagcccccatattaccagaaccccaccccttctcccagctgggaactctcatcatgacagc

SEQ ID NO: 3241 - DNA, 396 bp, Bovine  MMBT19171
aatgctccagtggttgtcgagggtgagagccaggaaacggcatctgcgggggtggttatcatcacatactccccagaaccacaaaattgcccacatcctgggctcatggaccagggtttccactttagtggcctgataacccaraggtcttattgacaaatcccagaaaggaagaggacttcatggatttgtgtgtcttggaaagctgagtcctatctcccctgactcactctggaaaagtggaagtgtctcttcgcctgacccaagggaagctgatgtttggtgtttcctgggagatcrcgattcttccttagatctttttcttgatctgatgttcatctttccaatggaggacgagggtcctcagctgtgttcaagtcatcaggggccaaaaag

SEQ ID NO: 3242 - DNA, 600 bp, Bovine  MMBT19239
gataaagataacatcttttcaaggttctgttttttctattggattcagtgtttccatggtcttcctggcctcaccaaacagtagataaactgtctccaaatttatcttttcttggaaatacaataaaagaaactcaatattccaatataaagcacaattttttcccaatgtattgcataatgcactgagaccaaaatctaacttttacttagtttattcttaattatatctagaagggttctgcaaaacagcttatggccctttggcatgagtcaaaggtatgcactgtcccagacttamtgcaaaaggcttgttgatgagaagtggatttaattagaaagacagctgctaatagggtaaattaacaggttatctggaacagatataagataatatttagactttataatttatttttcctaaatttccatattttccattataatttccatctcaaaaccaaagactgccatcaaatcctaatttcctaactactcctaattttactatcccaggacacaatactctctgtcacatgcctgtcttgtctgaagcactatgctgtgaataccagcatttagtcacattcaggtctaggtt

SEQ ID NO: 3243 - DNA, 600 bp, Bovine  MMBT19439
tccagaaaacttgagggggagatcctgagcatcctggaataaaccaagcagctgaaagaagaccaggggctatggtaaggtgagtgcagctggaccctggtgccactcaagatgagagctgagtcctacacttttagcgctaagaacacagtctccttacagttggtgtgagtggtagagagtattgtgggactcctgtgaaaacaatcaagtcacctgggctgacaaggacctgagacaaccacagtcatgaagaagaggaaacacagacaagccctggagaccagctgcagcaaggaytctcccctcttcctggsaactttcttcccagcctcctttgcaactcagttctagtcaattccaggcctgtccccttagaaacatcccttcagctcattccttcccagttgcaatattttggggaccacattttcccratggtgcagctacaaaaggaggaggatttgtgagtaacattatgttaagccactggattgcagcattaatttgttacaggagcataacctaatccactctgattatattccctctgcaacagagacttgtcttgaytggtataaggtgaattacctacaaatg

SEQ ID NO: 3244 - DNA, 600 bp, Bovine  MMBT19442
gccctggagaccagctgcagcaaggaytctcccctcttcctggsaactttcttcccagcctcctttgcaactcagttctagtcaattccaggcctgtccccttagaaacatcccttcagctcattccttcccagttgcaatattttggggaccacattttcccratggtgcagctacaaaaggaggaggatttgtgagtaacattatgttaagccactggattgcagcattaatttgttacaggagcataacctaatccactctgattatattccctctgcaacagagacttgtcttgaytggtataaggtgaattacctacaaatgtactagaaatacagattcctaggatccataccaagtttctgacagatttcctagagttcagataacctggggtgtagtatgtctggtacaaaagggaatgaaaaatgtcaagaaaaatacctaatgaggaagctgcaggatttctgtgacagtttggttgaagcattggagggaaaaaatgtcaaaggcttctagcttgagaggctaaaaaaaataataataaaataaagtgacagtctgaagggttcattttagagaaaaaggcaggtttga

SEQ ID NO: 3245 - DNA, 600 bp, Bovine  MMBT19716
gaaggcattttcagggtttccttaaaacatattttgggtttattcagggttctttctcctcgctgacattcagctattcctctggcaagattctccattcttccatttttttttttctttcaacattgattgttgtaccaacatccacatcatcggtgtcatcttccgggggtgggtcagctcctctcggtcctccccggcgctgggcagtgagggaggaagaactggaatctgtgttccatgagtgggtgtttggtggcatcacacaggaagttccgtgatgccacacacaggagaacrttttttaaactctcaattcaagtaggaggtgatgctcttccctgtgagaatttacatctcctctctctctccctccatcctgcccactcctggctgggatctatcaagggcacagctgatgaaatataccctgttcagagggaccacaccacaggagcgtgggacagactcggagtgctatgtgggtccctgttgggctccctaagtgaaggctgagagcagacatggccaactgtcatgggtccgccawgtaatagcaccactcaagcagcccagaccacatgtgggaagagtaacacr

SEQ ID NO: 3246 - DNA, 600 bp, Bovine  MMBT19739
acccccccaggtcccatctacagtagaaaactgtttccttgttctttcattccataagctctacatctttaataaaaactatcatttatgtgttcatgtttatcattatctgatgtcctactatgtctagaatataagcagatatctttgtttgcttcactagagtatctttgaaaagtgcaataaaacctgactcrtagtatgccactaatgtataattttttttaagttgtattaaatgaaacagaaataagtcatgttttgccctaaatgtatatgattgcattaaattgtcaattrtccttagaaacagttaaacaaaagatagaaactctcctccccatccccrcctttaaagaccagaaaattgtgtagarttgagaatttacgttggagcaatttagaactcatgtgttgcttggactctgatttagcaatatctttttagtggtkcatgcacactcagttgggtctgcctctttgtgaccccatgtgctcctctgtccctggaatttcccaggcaagaatactagagcaggttgctgtttccttctccaggggatcttctccactcagggactggacccttatctcttggat

SEQ ID NO: 3247 - DNA, 600 bp, Bovine  MMBT19851
agtatgatgtagtcatagaaaatgaaaaacacatcttgcccagagataacgtagatcctcgctgccttctacataaaccaatgataactgataagagatttagcatttcctcagactsaggtacatatagaggtacatctcctcacagaartgctatcaagcccagggttcggatcagcttggaaccacctcaatcataccatgttcctgtacgtgctcctggcttgtgygtcatgggtcttggaaagccattctgccccgatgaagataatcagtgggtctacccaggacaatcacacrgcagtctgtgctgagattgagaaagaactcatggctgacaacgttacatacaaggtaagtctgggtcttcatcaaatatcactttactctcagtggccctctgtgtttctaaccaacttttcctgcttccagggctccttcgaaaggcctcagaacaccagtgaggtaaggagcagtcaacccatggtcatttctgaccccacttgaaagggaaatcccagggcagagacaagaacaaaagttgttgggtcaasaaatctggggagaaagttgggagtttgaagatgaagtctctggctc

SEQ ID NO: 3248 - DNA, 600 bp, Bovine  MMBT19962
aaaaaaaaccccagaaaaaaccaaaattaatgtgattctggagtatctgaatactttcaaatgtgcttttaaaaatgcttgtgttttagcctttatctttaatttgatgactaagttttgtattcatagtactatgctgagaattgctgtatttctccagtggtcctggggtacaagtttattctgtttagttatcactcttcttgttgctgctgtttattcactaagttgtgtctgactctttgcaaccccattgacttgcagcacgccatgctcccctgaccttttctttacagcatyggattttacttttgcccccagacacatccacaactgaacatcatttccactttgacccagctgcttcattctttctgaaactattagtaattgcccttcattcttccccagtagcatattggataccttctgacctgggaggctgatctcccggtgtcakatctttttgccttttcatactgttcatggggttctcttggcaagaatactgccaagagatgggttggctgttccctcctccagtgracygcrttttgtcagaattctccacyatgacctctacatcttgtatggccctac

SEQ ID NO: 3249 - DNA, 561 bp, Bovine  MMBT20210
gagctttcttatttcccagacaacctagaaaaaaaaaamaaaacatgtaagtatatttttaaagagcctaaaagtgcagatttttctcttattwgttttttctaggttaatttattctatattggaagttaatgaaagtcaatatattttgcttctaggcaagcatcygaatattttaagaatatttcatttgattatctgcttgctatttattgatcctactgcagtggtctctggacaaaattgtgtgcagtgaggagcacaaaatgggtctgcccttgtttggcagctggtgataaygaaatcaccccacttcttagcctgttttgaaatgtaagtaacagaagagagttacttctgttacttkcaacctagacagcatattaaaaagcagagactttactgtgccaacaaaggtccgtctagtcaaagctatggtttttccagtagtcatrtatgaatgtgagagttggactataaagaaagctgagcgccaaagaattgatgctttgaattgtggtgtggagaagactcttagagtccctggactgcaaggagatc

SEQ ID NO: 3250 - DNA, 600 bp, Bovine  MMBT20411
cacgagaggcttttcccagagctgcaatcgtcagcaaataaggtgagcaagagcgactgtcttacttcttccagggcctcaagttcttcctccagctgctgagtctcctccttcacggccatgaggtaatctgtgactgattgtcgaggctgcagtcccttctcaaagcgattatacattccattccaaaacctgcagaggacagcagagcttcgtgaaaccgtgtcacagtctgtacattcactttcttgagtcttccaaggtatctttgaaaccatagtcctaataataaccaaatgygaagtacagggtcaaaaaagccactcactaagctaatggggtcgcaaagagtcagacacaactgagcgactgaactgaactgaaggtaataatttcatgttaatgttttcattttcttgaatcagtcaacttcttttggggagagtaaattcatgaagaatctacttgagtagatggtactgaattaaaaagcacataatatatttttctgaaatagattgtagtagtacatgttaccattttctttatttttttggcttaagatgacttagttaggaagtcaacttggaaaattagtgt

SEQ ID NO: 3251 - DNA, 598 bp, Bovine  MMBT20422
  misc_feature (1)..(38): n is any nucleotide
nnnnnnnnnnnnnnnnnnnnnnnnnnnnnnnnnnnnnnttcatatttatgtgaggggcttaccctgacagtaaccataaaatggtacaagcctaagggctcaatctcagtttttcagttcttattaagtctctgttgtaggatggtgttttgtatttctgaagttgtgtactgacattacraagggtggctttagtcctacctggacatgtttgctccagttgaattctgttttaagtctctgcttgctcctgcatggttcctgccatccagcacaatgagtctgttgattgcaaagtayttttcttcttcaggagccaatcttcctatcgatattgtttctctaaattacactttatggattttaggcaccactttcatctatttggaatctgaagtgtgttatcccagtactttaatatacagtagtttattcaccgaaaatatattctgacaatatttatttcatgtttgaataaccttgcctctccttcttgatgtttgtttccaaaatgtggagccattatagtagcctgcacgtctttctgtgaccattgttgtctcttcaaattgaagtacacagtcctagcaaactcagt

SEQ ID NO: 3252 - DNA, 600 bp, Bovine  MMBT20625
caaccgtatccccaaataccaggagtttgaagggctttaacagctcctcctccactaataaaactgcttgcctaataagaaggacatatactgactgaccatttgaaaatgtgggggtcttccagaaacagagttaaaacaataaatacatattgaaacaataacaacaaaagactttaaraatgttggttcagtactttcatttgatagaggaggagtctgaggcacagagagtgattctaacatgagaactaagggtaggagacagttgaccttcagtatccgtggctctcatgtccrgatttaaccactccacgtagttatcagttttcatataagaaacttgaacatctgtgaattttgatatccagaggagycctggaactaatcctccatggatactgaaggtcaactgactatatcttctaaattgcaacccaaagttttctccagaatattgctccttcacttcattacaaggaaaaactatggcgaagattatctgtatcttttattaggattgcagacatttctgttcatctactgtttggtggaaaattttgtggttgggagcaagcctggactgagagccatattacg

SEQ ID NO: 3253 - DNA, 600 bp, Bovine  MMBT20827
aagtacgtacatcattatcattcacgtacagatgtggaaacggaggcacagagagttaagaaatttgctcaaggttgctcagctartgaatggtggaacgaagattcaaacccaagtaatttgggctccagaatcaatagccacctgccataattccaactgcctcacactaattgcaagttatgattagcagtaacatctttaatgaaagtgagaaaaatraaatattggtaattaataatgaaatacagtttggcaggcaaaaattttccagaccttgagtcttcagaaaagaagcaytttcaaatattatgaaaagaatgaaaatgtttaaccagcattagattagatgatactcacatttcctcctagttctaatgttctgtgagattgaggaggaaatatggatattaaagaaaaacaactctacaaaacattactcagaatggagcatttatattccaagaggaatcaaaacactatttctctgttaaatggtgcaaacaagtttaattttaaaaaccgataatcaaatgaaaatcagtggacttgactattaagaaatattaaagtcaaaagcaaaaggaccttagaaacgta

SEQ ID NO: 3254 - DNA, 598 bp, Bovine  MMBT21432
  misc_feature (1)..(2): n is any nucleotide
nngagcctaatgggcctggggtcacaaagattcatacttgacagagcaacaaagcacgcgggcgcacacacacacacacacacacaatttgccattattgctaaaaaatcacctacttttgaagttagctgaagagttgcttgtagcaatttccttccagttggcaatgtacctaagcacattatataggcattcattaaattaagtcaacttattagtaaataataaagtggttcattagtacatacttrgactacttctaaaattctactttctctatgaaaccatagattaatgatkataaattcactagtccaaatgcttaatttcttgacttctcatctcaaagtagctctcatgcacctgaggcaacccctaggacaaggarttgtaagaggtatgaaaatggtgcccaccatctaccatattggtgccctttggcctccctccagcacacatctcctcatgttatactgttccattctgctagatcatgtcctcaaytgagtgacagctaagatgttggttaacttctaaattcaaagtatgaagggraaatttttgaaagtcatgggaaaacttcaacaacaaaacttta

SEQ ID NO: 3255 - DNA, 600 bp, Bovine  MMBT21775
tgccaaaggtgaagtgtttgatcagagcccagcaagtttagttgtagccccaggacaccacctattgcgtttatttttggcacctctgaaagtgtattacatttattctgaacaagtcagtagtgcctgacggaagaatgaagacaataacttgcttgtgtaatgaaccagctcaaccccacaaccaagagaaaatgtttcaagacagtactgaacattcaccaagtcggtccaagggaaaccgaagcacgcccgcaggaaaaaggaagtgagcatggaacgaccaccttccggtcgatkaagtgagagcccctctccaccaatccacactgcccrgcacccactccaaaaactgctcctcgtcaattccgagctaacttcttatcttttctcctgaattaataaaggggaattgaaaatatgcagttttatttataaatgactagtggataaaacagaatctgcaacaatattagtgtggagactgttcatctcattgtttaaacgatgatatgccaaaatgtagaagcaccaaaaagtacaatacagatgactaaataatgctctttagaagcatgagctcatttaacrcttttgaag

SEQ ID NO: 3256 - DNA, 600 bp, Bovine  MMBT21963
tgttgatgtagcaacatattctttggtgagggtcattatttaatagcttttctggtacatgcaaaatattttaaacagcatttaaaaaatcatttacctgctcgaattttgacagcctggggggtcaaacgcctattaatattgttaatgagtacttcacgttcatcttcattcaaatctaagctatccaaaatagatgggtctctgaaagaaaacacacacaacaaaatgtcaaggttactttactgataattaggacaccaaacataatataacagaataatgtttaagagcacagcrtttagtgtcagaattaagagttcaaatcttagcttsacaatttaatagctttgtgcttgggggcctttctagatctgtttccaaatttgtaaaacaggaataaaaactgtgtatctcactggactgcagaattaaatgagctaatgcaactgaagtgcttaggcttgtatgacaaaaagaaaacacccaaatgatcattattaaaaggaaaattttagagatctgactaaagcaagcaatttaatgtttcctatacaggcataacttgaagatattgtgggttcggttctagactacaat

SEQ ID NO: 3257 - DNA, 600 bp, Bovine  MMBT22003
atttggttccctcacacttatcccacctaatgggcgcaaacagagcctttctgaccctcacgatggggggagaggaatttctatggctgtttgggcataaattaccaccaaaagggtgggctacactggatggagttaccacatgagggacccttgtcttcctgtggggtggcccgtccccacccaacgcctgctgctgttccatcctaggatccccctgacccagggccagccagaccgaggaaacctggctgcagacttggcaaccatccagcacttgaggatgatcacggaactccyggaggaggattccagcaagatttaggatcttaattaacaactgtaacaacctaagtctgctcagcctggttagatgacatttaaatgccagtactctcctaaactgcctgctgagagccctgctaatttgttcaggcctcaattgattgtaaaatgcattctcagtaagatacagttatctagactcgggtcctcaaaagatagcatgttgttaatttcatgtacactgagttaaaaatgtcactccatggggtctaaattacgataaacttacttacgcagttgaatctcacctcaact

SEQ ID NO: 3258 - DNA, 600 bp, Bovine  MMBT22567
gggatgtttgcttctttagaatttaaactgctctacagataaagacagttaaatgtaaactgttctgtggcacatagaggacacctgtgtgtttctccttaggaaaaacattaggragaggcagggagaagagtggaaactgtgagcaccattacaggaattgcctgwggctgtcatcttacttcccttgctggtgcgtgtgcagagaagctttatttttggcacaatattaataatccaatatcaaaagaaccttgtagttacatttctggtaaggtgaaacatttcctgttttgctastgtcatttctcaagccttgggactcatggtcaggaattacacttatatattatggcaatagtgaaagcagaatgtgaaatgaatagccaggctcctgtttaaatcttcatcccagaagtctgacactggttttgtggtttcagttgaagttgtgtgctctgtgctgtttctctgtcattgtctgactctttgggaccccacggattatagcccatgaggctcctcygcrcatggaattctcccggcaagaatactggagtgggttgccatttcctcctccaggggatcagctgaagctaa

SEQ ID NO: 3259 - DNA, 600 bp, Bovine  MMBT22682
gcagttgacaatttattgttaatttcaaaattatgtaacaattaacttccaattaatgtagcaattaattgttggcctcaccatagaaaaactccacaaggatgataacatggtaggctcattgaaagaaaatcctgcagagatcacataattacctgagagagatccttgggggaaatgatgaagactgaaagtacttgcttgcagacgtgatgattgttaagattatgcagcaaaaacaaccatgaagagaaggacgcagatgacgaaactgaggcycagagattcagataactcayscaaagtctagtgtaggatgcagctaagatgagttgaaggcattatcctcctcgttccataacytataacaggatttgcctagagcctccaaaggttttatcatctgcaaaatggggataataacagtccagtccttccaaggaggctgtgagttttaaccgagataatgtgtgtccacgctcagcacaaggtcaagcccaggagagacagatgagtgytgtgactcttactatttacagcatcacgatttgacatgaagwrgctgcataaatgattcaggcttaccaaacataaatacat

SEQ ID NO: 3260 - DNA, 600 bp, Bovine  MMBT22693
ttatgaaggcagaatatggtttgaactaggaggcactgaggggtcctctcctgcctttccaataatatcaattttctcctggctgatgatggcaatgctaacagtctaacgttttaactttattttaaagctctgattcatgatcaaatgcaaataccgctgggwgaggtaaatgaaatggtaactttatcaacyactttcattttaaatgactgggtgtgagatcttccctgatctgatttcacgargatggagaaagatggtgcgtgtggaggcaggaggcaggcttctggtgcctcrttctcccgaccttcccgtcacagagatgtgactgcaagtgtttttaaaaatatgaaagaaaaagtatttcagtataattcatatgatgttaaagtgataacagttcaaagaataactacaggatgagaaatttctgggaatcaaggggcagggtatggagtgggggggacgggggaatgtcgtggaataaagacaggtaggtgaagacaggaaggtcattaaaatttaggattctgaggttcacactccagaggataaccactggctactgaaaagttacaagtgaggaagtatgagttc

SEQ ID NO: 3261 - DNA, 600 bp, Bovine  MMBT22791
aaattctagagcacaaagtctttattccaactgccatttgaaattctgaaacagttggatgtgtcatcaatgacccaacccatatggccacaaggtatgctgagatcttctaaatggagcaaattatgcaggtgtgagtamagaggagtgaagaagyaaagatggtttgagtcggaaaagacatctattccctacaaaatgttctggaagatggcacttyctaacaagttgggatgcaggttgtaaaaccctttggttacaaagaacagaatcacaactgtgtcgaaagatggaagttastatcaagctactatagcaacaagttcagcataaactggtgtctcctttcaactaggacagtagttttcaattaggaaagatcttgcctagtgggagacccttgscaattttgtctggagagatttttgattgttacaactagggaggatagtggtggtattcagtgtgtaggggctagagatgatgctagacatcctacaatgcacaggacagctcctaacaacaaggaattgtctgtctacaaaggccaatagtgctgaagttgagaaattctgatctcaggaaagatgtaccctctcc

SEQ ID NO: 3262 - DNA, 600 bp, Bovine  MMBT22794
aggcaaatagaggttagcaagtttcataagggcacaaaatcacccagtgaaaggcatgggatatgaccccaaatagcttcatacttaaggttcacctgttccagggaactgtccaattttcctgtggaattagaagtgtctggaggtccctggatgaggggaaaatttgatgagtgcagattctctttgtgagtagatgataaaagtaaagataagaactttggaactataaaccctggaaaatttatcaaagaaaccctcccactagctattaagccctcagataggtttatcaccaartttcttgtgggcatctattgtttctctaccagcatctacttcctgagttctggaaaagcatatgcagaattcctctgggataccattgctcctccaaaattttgctaaagtcttttgttagggtctgagtccctaggatgcatcacgattgcatttgggccaatcagaaacaatgaaataagatgcatgttttttattgtggaaagttgtagaataaacatagttgtcatttccctccatccttgagtcaaggacaggctggagttatccttgacatccctctactgaaaagggacatct

SEQ ID NO: 3263 - DNA, 600 bp, Bovine  MMBT22843
agatcaagcaccacatcagtgagcttcagtgttgcccagaagacacctgtctccagtagttgatgggctgagatggaggaaaggcaaacccagaaacctcatcctgggagaggtggacccacaacacaagtgaagcttctagtcccacagagtgtctaccattcaagtgggggggcattgattgggaaggaatggtatcctgagaatcaaaatggggatgygtgggaagatcatatcctaaagatgaagctgggcaccctgagcccctaaatcccaatagaagcaacccctccatacccrgtagaagcagagccttcatctccacctgaggatatcagctccctgtgaggcrgatgctttaccagaccccgttgatgccccccaggatgctcaccccatcccagcctccttcccatcacccttctgtgcttctagatccgtaactggactccagtcccagcagcccccagctggttgtgacctggcagctgccctgcttgctttctcatgtgcgcagacagaaggcaaggaatgcttgcgggcgagtgcacagggtaaggtggaagggacgaggtcagatctctcacagcagggcgtgga

SEQ ID NO: 3264 - DNA, 600 bp, Bovine  MMBT22924
acaaagatggggagggacacctccaaaagagtactaaagaycatggttgtggaatgggtgtttctgtactaaaaaatatttaattaagatcatttctgattttgaatctccctctgtgctgatgaaraggagagttataaggaagaagcagggctcctgccagctataaacagggtagaaaaaatacaccccaactccaamacaaggaaacgtggacccstctactgactagcaatgggaggaagttatctcccacaggcttcagagatgactcccagaaagtaatatggtatgagaacyataggcacttagggaaggtagaggaaatggagctaaaccactcactatggtttagttccactgttgtatcatgacacagtcagatttttgaaaacaaatggctcagactttatatttcagaaatcatggctgtaatatttctaaaggggtgcggaggatgttccctaatactctattttagcagcagaatgatgtatcaatagactgcttttgtgcatcagatgaatattgggcttggtactacttcacatcaatggaaaagtttttttctactgaatctccagcaatatttaaatatat

SEQ ID NO: 3265 - DNA, 600 bp, Bovine  MMBT23385
aacctgcccccccagataactgccgcgctgagccgtttccaggatgccctagaggaagctaaggagcggatagacaagttcagcaataagtccaatatccagaagtttctaacagcagggcatgacagcataatctttggtggggtgaaccagaggctgagcgatgtctgggargagctctctctgctgctccaggtggatcagtggaggcatacttcaagcctcagcctaggagtgtcctggcaacaggaagatcaacaggatgcagaggaggacaggaaagctatccaaggactgagkggtgaggacttttttcaggtggggggatgcacatacaggtgtattcgtctcattttggaaaatcaggaaggttgaagtggttttgrcaggtatctgttgacragactcagaattycagacgtctgagtggagaggggtgcccaccatgaggctgcagccrgagtgtggatgtatgataygactacatgggagtgaagacttggggccaataactcagyagagccaggggcaagaggggamgtgtgagtgctgtcaggagaccacgtcagaggctgtgcagacatggcagtggcttgggtc

SEQ ID NO: 3266 - DNA, 481 bp, Bovine  MMBT23392
tggcaacaggaagatcaacaggatgcagaggaggacaggaaagctatccaaggactgagkggtgaggacttttttcaggtggggggatgcacatacaggtgtattcgtctcattttggaaaatcaggaaggttgaagtggttttgrcaggtatctgttgacragactcagaattycagacgtctgagtggagaggggtgcccaccatgaggctgcagccrgagtgtggatgtatgataygactacatgggagtgaagacttggggccaataactcagyagagccaggggcaagaggggamgtgtgagtgctgtcaggagaccacgtcagaggctgtgcagacatggcagtggcttgggtccaagtggccggggctggactgagtggagggcagggctccaagggaatgagatacgcgctggactagagaggaaacaagggaaacagatatgactttacacttttgcagatcatggtgatgg

SEQ ID NO: 3267 - DNA, 538 bp, Bovine  MMBT23503
cccaggcaggcacccctggggcacgtgggggacagtgcgggcagaggcaggtcacaggccctcctccagagccacagcctcccytccagcaaggacccaagtctgggaayggggcrtcatctggaaatgggtgcccagccatgctttcaccgtggtgacggagctggctttctggatrcggactgttagcactcgtcaaggaaatgtcctcagagaggtttagttcccacagggccctggcacccaagcaggtctagaaggcgaagcttctgttccagaggagacaccttatgcccctargaagcgacccccagtgccctcattaagaacatgtctttctcatgagcttgggaccgccttcggacgccatgagacagctgaggcccaggatcccacccaggccccggcgggactcacccactctgcccactgcacgcccccttcaagagtccacacggcatccggtcccagctctcgacacgatgctgaagtcttatttccagaaatgatgcactctcaaatgtttgttccaaaaaaa

SEQ ID NO: 3268 - DNA, 600 bp, Bovine  MMBT00554
ctactagaggccatgaaacttaggcttcgagcggcgcctaagataccgaagtctaaatgtcataggcgcactcttttggaaaggcgattctctttttcttctgcgatagaaaccgtattgccaaaawtttaagactcgaagaagccacggggatcttgaagagttcagccccttccacactacctgtttcagattttttgctgtcctccggagtctaaatttatgtctcatgagtcagtcgtaggataagggcttgacactcctaagccatgagagaaccgttagttttcatttcattgratctttgaaagccggtctcttaaaatgagaagaattttcacgagatgttcaggaaaaaaaaaaaagtcagggaggggctagtgccagatttcccaaatctcccagcaaccctgattttaaatttctccgttttgcaaaaaaagtttagatcaaataacatcaatcacattagtatatttgctgcatccagaaatatggtttggctgtgtggcattgaattgacacgagttttaaatggtctcatatgacatgaaagtctttttttaaaatgagcacattatatttggtttgaagagagct

SEQ ID NO: 3269 - DNA, 600 bp, Bovine  MMBT01291
tgttttacagttcatttacattccaatatgtacagtctatttaaatttgagaatacatatacacagtgggtttgtacctgccctggaagagttccctgctggccaggatgggcacaggggtggcattcatgacgtcagctcgtgccrcccagatagccaaaccgggcagcagggagatgaacggcccaagcaccagcccccaagcctcaggcygaaccagagctagaagacaggtgacaaaggaaatttmagcttgtgttaaatgagtctraaaacctccccggcttccccatctcactsccaagccaagccgagaaacagtgtcactgcaaaacaaaaggggcgtctatccgtgcccccacatcgttaactgtgtctgtagcagctgactgaacggcatgtcattcagytgtgatggcattgccatcatttcgagtttcgcccatttcctttaaaatcactgtatcggcactggagggcatgtttggcaaagggcagggtgcccatcacatcagacgcactgcccgcccagcgcctgtgcaaatgcaccacaggtaagctggtgccggacttctgcagaagccttcacagtgagaaaag

SEQ ID NO: 3270 - DNA, 600 bp, Bovine  MMBT01427
agagcagagaagctgcccatgtcatctggattaagtgtgaaatagagcattttagaaaatgttttcaaaagaagataacttcgaaaccaaatttgttatttctgagtgctttgcgaataaccatggactttgtaataaagagggaaataaaatgcaatgaacacagamtctcacatacacacaaaaattgatggaaaatatacttcaaaataagagaaaatattatgataattataattcaaattagtatcagattgattttattttttgtgttatatttttcctctctgtttctacaarttgagtctgtgaaaatarggactgccttcctttgatatctgtaccaaattggcatacgggatagtacaaaggttaacaagtagctctgctgtgaagaaaatacatttacgttattgtcgaaatccatgcatcatcttccagctgccttcatctcccatgaacccaaacagctcaggaaatcttcctggggtgtcactgactgtggatctccagtaagttgagcctgcccccaaaaggggaccagcaagtcataccctgtgggcttccttggaagctggaaaacaatctgcctgcaatgta

SEQ ID NO: 3271 - DNA, 602 bp, Bovine  MMBT01880
  misc_feature (1)..(2): n is any nucleotide
nnttctcattagtaaataaatctgaaagaggacataatgatgctaccacagataaccactggcagataaactgcaaaaggtaatataaagccccattttggtgcaaagcttggttttcactttgcatgtgtctgtaccctggtgggctacagtacctggggtcgcaaagagttggacatgactgagcgactaatacacacaacacacacacacacacacacacacacacacacacaccttgccaatgaattctgggactcctgccgtgttcccatctgttggaaccaatcacgatatttggsggcaaaatattggggcaaaatatttaagcatccagttaaagaattttatcatctgacataaaagaacacagcatttgctgttcaaatatcacatatttcacgtgctttctctttttcttcagaggaaggggaaatttcatagcaaagtgatcttgaatgagaagactcttggtctcagggggaatgtagaacaaggtggcaggtgatgggtatgctgaagtgtggcgtaactgactgccaaagaatacttgaacaagcagctgatccatctgccatcagtggagctggcttaatcctttc

SEQ ID NO: 3272 - DNA, 600 bp, Bovine  MMBT01987
gccccagaacctggcccagagcctgacaccataattgacacttagtactggctsaatgaatgaatgaatgaatgaaaagcagttgatcaaaaccacaagtaccataaaacagagtgagagggccgatactttggatactagagaaagttttcaaagttatcttttcagattaatataacaggtctaaaagtaacaggacaaaatttaagatggagaatatgacaaagaagtgaggaggtactgtggagcagatggaaaaggagtgagttttaattaactgtaggtttaatgtggtctcaraatagtgtggcagaaaagctgattcagcctccaactgcagtaattggaatgtatattcttcacacgagagataattatttccctctcctcgacatccccccaattactcacggaagattgtgcccaaatctgaagaaaaaaatatatttataaaaaagaagcatgtttagaggatggccagaatgatttttggagactcaaaatgatgttgtgagaggaagcttcaagggttagcagtgcttatctaggaggaaaaaagtgtgtcagaggtcacattagttgtctgaaaatctatgattg

SEQ ID NO: 3273 - DNA, 598 bp, Bovine  MMBT01993
  misc_feature (1)..(165): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctacatttgtgagtggaatagccccatctcagccctgataaggggccagatttcaagctcagccctatttatgtccttcacatacaaagaaatcaccttgacccaaacatgatcagctaacaaggcaccgtyttctaaaagcgttcagaaaacgtgttttcctaaaatgctatctccatcagacactaaaaagtaaccattccccatggtcaaataagtgtttacagttttcagataatcaaaggtagggacaggacttctcaagtctgtaatacagtcaagtgccaagctcactaaaatggaagacagcatgcataatatgtctcaaactcatttaactgtggggttttgttagcttgtttgtttggaatgcctaagacatgtctacaagtatcccatggaagacctgtaagaaatgtaagggctcact

SEQ ID NO: 3274 - DNA, 600 bp, Bovine  MMBT02237
taccaccatctgtatggttgctggctccaagacatggatctaaattaggcacagaaagtaaaccaggattattttaaacaatgacaaactgatcttaatttgaaataagcctttgttggctccctggtttagaccttttaccctctctatgtggttcctaattttctgggtaataaaaaacaatggactttacagtaattcttaccacaagcccacttacagaagtataaagagaatgagcccctacccattttctactcccaaattccttctggacagaggtgcttaccaggagaatargacacaagatatatgataggtagctacatgattaatcatttactcakaattctagccaagttattagggaaaacaatgggcctcttaggtacctgggaatactttcaagcatgcaagatcaaaagagcccttttgcatataacaaactcttgcctacagcacaaaggtcttcttaaatcctcttaggcattcaacaaaagtaaaactagctagacaatatatggctcaactggtggcactagtgataaagaatctgcctgccaattcaaaagatacaagagactccagttcaatccctgg

SEQ ID NO: 3275 - DNA, 600 bp, Bovine  MMBT02254
tgctgcaatgaacattggggtacatgggtcttttatagttatggttttctcaagatttcttatatgtcaagtagtgggacattgggtcatatagtagttttatttctatttttttaaggaatctccatactgtcctccgtagtggctgtatcaayttgcattccaccaacggtataagaggattcccttggaaagcagctatgctcaccaccataccatcaacatgttaactgacctttgtagatgaatttggaatggtcctaggatgagtgtcaaagcaaactytaaattaacctgaayattttattttacaggtataaagaaaatagaagacagcacatataaattttaaataataagtataaatcataaatmatgaataaacatcattttggttattatctttttatttttctgtattttaaaagtttatctttgtaagaaaaaaacattcaaaaaattttctcaaaatatttacttgttaatttagggaagtatttttatgcaatacatgttgataccaaaggaaccctggctaaaattctccatgtaattatcaggcaaaaaaaataatgaccttggttaaagtgaaaagtatta

SEQ ID NO: 3276 - DNA, 600 bp, Bovine  MMBT02260
ttaaaataaatatagtcttgcaagcaacaaagtctagataacataaacattaagttataatcatggttattttgatattataatattttaaataagagctattaaaaatgctactccaactcttatttccaatatttgaataatgattataaattatttcatgtaattgttttaatatgtttcttggattttaatacatcaatataggtccttcctgtgtagtgtattctttccttgcattaacacaaatatttagtttgacgaaatacagtctacccatcatattcacagattattccyccatgaatatggagggttgacagcactaggccattttatgaaaggatattgagcaagcacctaaagtcctttatccctccagtctgatagcaatctgaaattcagaatagatattcttaccatggaattatattaaactttggctagcaaaagcaacaacattttaatgacttgcatttatgaaactggtaaaactaactccattcattctgtcaagtacctaattgtagagtctataaaatatgaagataaccttgtttgactatataagaaattattccatttggacttcttcaaaac

SEQ ID NO: 3277 - DNA, 600 bp, Bovine  MMBT02292
cgtctttgccaggccacataggttctgtgtgccttaccccagagagtgggtacctggtgcccaaagacaggtgtaagtaatggaagtcactcaagggaattcattccaaataaaatctgttctgagctgactttctctctccacctcttgaagtagagaaaacatgactgaagtgacttagcagcagcagcagcagcamcaccaccaatgtaatgcggccgygacaggtcaagacaaaaaagagcactccataatcctgtgtgaaaccagacaaaagcacgaatgttgtccacaccctaraatgagtaaacacccctgtattctggctaatgaatgctgccactccaccgacagcttcagcctccatccgtccctcccaccttctacagaagaataattaagataaacatagacttgtcttgcttcctgacagcatccagtccagatcaaagccctgcttccttcaactctcaccaaaaccacctaaaaacagcccaaatcccacaataagccctctccaggaccccctttctgaggcacttcctggttccccaggaggatggagctttctcacagccacgagactagttcaacttctac

SEQ ID NO: 3278 - DNA, 600 bp, Bovine  MMBT02324
ttttcttttataatggtttgtaattagctttgttttagatttctgttaagaatgtattatctgctcaatatttagcattcaatttttaaaaagatatgctctgtatatcccagcttaattgaggattgatgtaacttgtcatgatcagctaggtcaggaactttttcatttcaaatgctgacttggtgaggtggtgtcaggaagtacttaatgaccgaaagaaactagagaaagagattagcaattatattcacattgtaagatctatgtagctctttatttattcaactgacctctaaytcaagtcagaaaattatttaagtcctctgtgatagcctacagatgataaatcttcctgttggygtttctttacctgagttagcattctagagttgtctgttttcagttttgtgactgtggcattwgaagctttgtrtaatttaattgtcaaaacttgaccatttctttaatttgttattgggcagttcatcaagcagtcttataaagtattatcatggaaggagttatagctctgtaggaattcttctgaagctggactccattcaggagtagaaatgttgtacatttaaccaaataatg

SEQ ID NO: 3279 - DNA, 600 bp, Bovine  MMBT02331
tccctatcttttccttctccttctctctccattccaaaaagctgatgattaatatttccattttactgtaaggatgcataaagtttcagaaaacacagtagcagacagtgacgtgaggacagactcagagacaagaatacttctgagattcttagcatcaactgtgccaaaagtaaatgcagatctgacaaatgacacaaaattattacctcgccatttctttttctgctgattggatttttaaatacaagggcccaattttccatagaaacagatcagatttacagcaaatacaaaaaytgcatcttttatttataaggttaaaaatctacccaaatacttttcattaaaatcgtgtgtctataatattgactttcagagggttagtcaagcattacataactttgcttcttcctgtgggaattagtaagcagagacctgaaggtcaatctcctcaacacaattcctgagactaccaattctgaccttgattacttgattcagtttgatactgaagtagttgtgagatatgtgaggaaatacacatgctcactctcctttctccactctctgctttctttctagaggaacatcttttgt

SEQ ID NO: 3280 - DNA, 598 bp, Bovine  MMBT02394
  misc_feature (1)..(60): n is any nucleotide
nnnnnnnnnnnnnnnnnnnnnnnnnnnnnnnnnnnnnnnnnnnnnnnnnnnnnnnnnnnnaccaagcagccaggtcagggtgtgggcgtgggagcgtaggcctcaggggcctcagcgcggaagaggctgagcgccggctgacagcgctgggaggggccgcccagcgggaggcctgcagggtcccggaggcgtgggactgaagcgacagactcccagaaggtgggcggcgggcgggggtagggagggccactgaggatgcccaggtgggagggacccagcgtgttctgaagagcaccaggytttggaggctaccaagtaaaccccaagtggcactcgacctggggaggagcccagcgagacagcaggactcgcaagtcgggactagccccggggagggctccaggggaggacggagaagggaaacactaagcgcctcacctcccaaacaagccgcaccccctccggcgcggccgcggtgacggcgatggcagcgcccaggctctccgacaaccggagcctgactccggccccagacgttcccagcaccggtccgtggctcatcagagtagccccgtcgggggtcccaggcccgccccca

SEQ ID NO: 3281 - DNA, 600 bp, Bovine  MMBT02412
gcccagaagggctaactgacttgtccaaggtctgtttctctgatatgactgattgacttgatatgacaggatacacatacacagagagacagagaaaggaaaaatgatataccagtttgcacattaaaatctgagatgtctggaagcagtatgatgatatttaaagtactatatcctcaaagcatgcatcatccagcaaaattattcttaacatcttgaaacctaggattacaaaagctgttgccaaccttcttgccacggttttatcaaaaggaaatttggattgggaagacttatttmtttacatgctgtttccagggataactgcaccaatcaatggatgacacatttcycagagatttgtcacaatatcttgactgacacttctatttctactcacaaacaggacagactaagttttcaactgggttttgattcctaagccttttcagagtatgaaaaattgaccccagcattgcagttgatgcttttaaaactcattttattcaacatggctttgcaggcatgtaggacagtaagaagtaaattatgaactgtgttaatagcagaaacaggacagtaatatcaactcaaacagtt

SEQ ID NO: 3282 - DNA, 600 bp, Bovine  MMBT02589
tcctatattttaaattaatgacaaaaattatgttatttattcttgatattttaaaagatactgatttttaggccagtgttaggttcacagcttaattaagaggaagatagagagacttcctatgtattccttgccattccacatgtgtggcttcccccatttactaacagctgtccccagaggagtatgttcgttaccaccgattacccatgaacctctactgacgtatcataatcaaccaaagcacagagtttgcattagagttttactgacctaaaaaccttctgcgttcatcccttyccccactccctggtaaccactgacctctttattgtctcccaagttttgcctttccagaatgtcatacagttgaaatcatatatagtatgtagccttttcagactgacttctttcctacgcttttcattagagctgcttacattaaactttattttatgctcacccccattatattaatacattaactttcttaaacacaaaacctatatyacctggtccctggctctcgttgcaagagggtacatgtaggaaggtgacatgtaggaagagaccagtcatctckgcattgtctattaagca

SEQ ID NO: 3283 - DNA, 600 bp, Bovine  MMBT02640
tgaggaaagaaatggagtctggttggggccaatggcttgagcgctgagacatcccccttccatagctccaggcatgggtcacctaacaaagaggccaattcagcactgcagttcagcaaagatgaacatggggtgacccctggatcactctgcaatgagccatttccttcttttcaggatagcgagcatgtcttttcaagtcatctcaccatcctggacctcagtttcctcatctgttcaatggatataataattgtgcctgcttcataggattgttgcagaggttggacaataatacayagrtctgtatagtcaaagctatggtttttccagtagtcatgtatgggtgtgagaattggactacaaacaaggctgagtactgaagaattgatgcttttgaactgtggtcctggagaagtctcttgagagatccttggacagcaaggagatcaaaccatccattcctaagggaaatcaactctaaaaattcattagaaggactgatactgaagctgaagcttcaatactttggccacctgatgcaaaagagccaactcattggaaaagaccctgatgctgggaaagattgaakacargagg

SEQ ID NO: 3284 - DNA, 600 bp, Bovine  MMBT02717
cctcaacttacaatggagttatatccagataaacccatcataaatgtcagaagtttattacattgaaaatgcatttaatacacctaagctactgaacatcgtaacttaggcaagaccgtcatacacgtgctcataatactgacattagctgaaaattgggcaaaatcatctaacacaaattctattttataatgaagtgctgaatgtctcgtaatttattgaatactgtactgaaagtaaaaacaaacaaaccagggcggcttgtcttgggtacaaaacgactttaagtgtattggttgkttacccctgtgaatgggcagctgtctgggagctgcgggtctgggtcactggcaagcatgtcctgggagtgcctaccgcacaaggctggccccgaaagatcaacgttcaacattacaagtatggtttccattgaatgtgtatgcttttcacaccatcataaagtgaaaaaaaatctcaagttaaaccattgtaagtgacagctatgttcagagacattaaatcacacatacacaatatcgaagtttctactaaagcattcagcaaagttaagatacagtaggttctacatacactactggg

SEQ ID NO: 3285 - DNA, 600 bp, Bovine  MMBT02880
gagtgtcacgccacttctctcagtctctcccaaacagaaggttacctctagaattgaaagttaagaaaagatttatttatgtatttttattaaagcagagttgatatacaatattatatgttaacaggtatacagtatagtgattcacagtttgtaatagtatactccatttctagttactataaaatgttgggtatattccctgtgttgtacaatatacccttgtagcttatttctgtataatggtttggaccttttaatcccctaagtctaagagatttcaactgaattgagaagctrtgaaatttatttttgtggttcctgatacactgcctttctttgtaggttgttccaaaaccgatcaatccaacttctcagatagtcaccaccagccagccacagcagcggctcatcatgcctgccaccccactgccacaaatccagccaaacctcacgaacctgccaccaggcactgtgctggcaccagctccaggaacagggaatgtgggctacgcagtgcttcctgctcagtacgtgactcaggtatgggcagaaaatccagtcactgcatttcaaaaagcttatgtgtgcatgtgtgct

SEQ ID NO: 3286 - DNA, 598 bp, Bovine  MMBT02895
  misc_feature (1)..(56): n is any nucleotide
nnnnnnnnnnnnnnnnnnnnnnnnnnnnnnnnnnnnnnnnnnnnnnnnnnnnnnnncttgatcctaaatttccagatactctgatggaccccacttgagtcagatgcctacaatcgggtaggccagtggtaagagctaggttgcataaacatgattcttggggtgcatcccgataaatttagggtggagggaggacagttcctagtgaagaaggaaaccttatgcattgacactcaaaaagctgcatcttaccgataaacagtgtatttcttttgtagcttttcatgaacgtactatgtrtttgccatcctcggtaaccttgtgaaagaaaaaagcccttggtgatctgaagagtccacttttcatacatcaattactcagttaactggctgccatttgtctcgtcgcagggtcctgacccactctgagctcgcrcctttgcgagcatctctcgtgcccatggaacactgcataacgcgcttctttgaagagtgtgaccccaacaaggataagcacatcaccctgcaggagtggggccactgctttgaaattaaagaaggtaaattgatcatcagcccagggagaggggtgctctctt

SEQ ID NO: 3287 - DNA, 600 bp, Bovine  MMBT02926
tattctgaggccttactggaagcatcagagaggggttggatacatgggcggagggagtaggactctggggtggtggtgcctcatgttgaccctctattttcacttcccttaaaagagttgggtcactttggttggggtagtgatggagttcttccaaaaccccatcattcagagtgccgtttccttgagaaggaagctgaggaacctgcggaagaggaggagggggagaaagaagcaattgcgatggtggtggtgtggtagtggcagaaaaggaatccttagtgaacactgagctttgcwtgaagcaagcaccattcatttcattttgctttaaataccgttcagagctgccgctgggagactgcaaattgccgctgggacccaagcagaattcttcgccagagcctagctttgcagttgcttggatgttactgttttctgccagagatgggcgtatctcaaaagcggaattctgctgctctggtttctgaaaggggcaggcccctagcgttgcagctggtttactggcaccatccgcctcacagctctcagtcgccgctgcggctggctctggaggcagctcagagttcgaggtctgtg

SEQ ID NO: 3288 - DNA, 600 bp, Bovine  MMBT02934
aaaaaatatgtgtacccatgacatttctgacaaggagatttttcacagctgtgtactaatacagctgttttcatgcagaggatttttaaatatagcccccaaaacagactgttagactttcagctgtttctatgaacaagtaatgtgtgaaacagacatattcatcccattctattataaaatctctccacagccttgatcctcattctgttgtacatacccacccctggggtaacaaacagggatcacatggggtcacgtggggtcagaaacgggatgaagacgagggatggagtgacrttaggcatggtctggcagacaacctctaggtgaccagaagttacacgcttactacacttactcatctcagagtsggccagacatcattcttagcaaagtgctcgcttattctctgagaattcatttatatcttaaacgtctactaaattgacagtgggcacactgttctttggaaggactgatgctaaagctgaaactccaatactttggccacctcacgtgaagagttgactcattggaaaagmctctgatgctgggagggattgggggcaggaggagaaggggacgacagaggatgag

SEQ ID NO: 3289 - DNA, 600 bp, Bovine  MMBT03286
catagggctgcaaagaatcagacatgactgaagcaactgagcaagcaaaattaactaatcatcaaaagaaaaataatagtttctcatatctacaaaatttaattttattttagtagtaatgtgtgctaacttagtattaactatctacaggtcacatttttatctgttttacaatgtcttaatagatgttgtgtgtaccttccattagctctatctcagcttaaagtcagtctaaaagttgattgttatgattaatataaacactgcaatgtgtaatgttgataagaatactaaataggrcctagaataaaatctagcagaatacttcagaaagtgcctcagactgaagcttccttgcttagaaaaagaacgtgtgtgcttttaaaagatggctgatgtacatatttttttggatttcacttgatatataatttcagctataagttataaaactagagttagtattagatttaggcmtgcaaaaggacctattattataaagcaggaaattatttactctatcctatctttgcaaagcagaagcagtgctctacaaaaaacaacaagaacttttatcatttrcataaagtgttccagaat

SEQ ID NO: 3290 - DNA, 600 bp, Bovine  MMBT03296
atgttcttcaaagtgatttttcggtaaagcaactaagaaataccagaaatgcaccagaagggaaatgaaaaatgtggctcagactccagacaggaggcgggggtggccgcgagtggtgggggaggggcgcagcctcagcctggcggggaaggagggctgctctgtcacgggkaaggtctgcggctccaggaagccagagaccctggccgcccaaagggccactgccagtagcgccagcagctctggctcccctcccccactcccttctggtttgctttgcaccatgatcaggccaaggcrgagacagccagggatggggccatgccttggagaggaccccggagccaataggaaaagagctttcacttcctggacaatttacagcggcttctgaagcacagtggcttctgtgatgcaaggtacagttggtacagctctgaggaaggcattttatgtcctagagatgttctgtgcctgtcagagatgctgccttttagacagacaaattgctgatctaactcagatgtccgctgaggcctcgctaaccctggagttgagggaaccttggcttctcaagccctcaggggccttctgatgact

SEQ ID NO: 3291 - DNA, 600 bp, Bovine  MMBT03824
ttcttttcctgtaytctatctattgcattttcctgactttaaagttatgtctttgtttttagtttttgggagactcctcttaagctataaaagctcacacctaaatttctgttccttattcattttgaagtttctttatcctatcttcctcctgaaccacatgaatacttctgcgcccctacagccactctcattcttcaytagcaacgctctgtactcttccttaatactgtatgttggtatttctccgggtttaagttcaggtgaaagagccatcaaccatgctacttgccactgtawtaagtgctgaaaaatcgttgctctaacatttcatgggtcaaagtcccaactgctactccatgtttcacttggtaggggcagtaaggatgtactttgtcttatgaaatgagaatcatacaatttgtgtccataaattgaccttacagatcatttagtataattgtctttttgagcatataaaaagtcattttcttgtggctttctaagcaggttgctcccattgtcytcatgttgtgcaaaggaatacagttaattacaaaacttagctactctacacagtatatttagtatcactctctc

SEQ ID NO: 3292 - DNA, 600 bp, Bovine  MMBT04009
aaagctgaacaaatgctagttatcatttgtagtaattttaaataataaaaccagaacccaggctgacaccctacctcatccactagtcctgcaagctcagcaagtmactgaacttttctgcatctcaatttcttcactacaaactggggtcataatgctttatctgctgactttatggtgataacagggataaagatgaaaggagaaataagtgtaaagatcctgaaagtgagaattgctttttatgaatccttttgtccatgtcctctctgtattattctttcctcaaatgcattatcygaacacatcttaaatctcaacgtttgcatggttattactatattagttgaaagaattaagagacagcagcttgttttgatattggagggaagcagaaaagatactgttaaagaagaaattaaagtctaaagaatctggcctaataaattattttatatcaaatgagatctccctaaaattattagcaaaaaagtacccaggtggcactagtggtaaaaacaaacaaacaaacaaaaaaccacctgccagtgcaggagacctaagagccacaagttcagtctctgggttgggaagatcccc

SEQ ID NO: 3293 - DNA, 600 bp, Bovine  MMBT04084
ttagaaaggagactaacaatcaataagtgttggcygataataatggtattgtgaacctgctgtgttccaagtactgtgctaggtgtattacatagactatttttattcatcatgtaaatccttgcaaagtaggtacatttttcatttcatagataagggaatagattcagagaggatgaataatcattctaggcttaaggtcagtagcaggactcatgccaccttggttgactctcaaaatcatatttctttaccttgaaattgcttgataaagaaaaactgtgaaaatatgttgtatcrtctttaaaacagagtttaaaagcaatamtgtatttaataccactgaactgtacattaaaaataattaagatggtaaaaaaaaaaaccccraggaaaagactgggaaagattgagggcaggaggtgaaggggatgacagaggataagayggtttgatggcatcactgactgtatcatggactcagtggacatgagtttgggcaagctccaggagttggtgatggagagggaagcctggcgtgctgcagtccacggggtcgcaaagagtcagacacaactgagtgactgaactgataatcaa

SEQ ID NO: 3294 - DNA, 600 bp, Bovine  MMBT04197
cccctcctttttggattcctgagattyatttatttaataaaatgartggaggtaactyttaacttagtcgyatattgttggaaaagcataaagactcttagtagaaattgtaatgttaaaaagcacatatgtctaaagcaaagtcaggtagtgaaggataaagttataagtattttatatttctaactgaatttataaagcttgacatattacagagataaagtagaagatgtttagatagtaatgtcctctcagtgtgtttaaaatttaaatcaatttgtagaattaaacataaacttkaagaagtgacacaaatgatgtgactgttcaaagcctcacttagaaaaccaattagagtgcctttaggtccaacaagccctaagttcacctgattttggatataaggatagaattagttgtttagaaaaaataatgtatttttacttacagttgatttacaaattcctaaaaaataactaaattctttttttgtataattactagaaaacaagtaagaaaataactttttgactgagtaaaaaatctctttatctggcttgatttctgcagctcctcaattatttttcttttttcatcttc

SEQ ID NO: 3295 - DNA, 598 bp, Bovine  MMBT04273
  misc_feature (1)..(43): n is any nucleotide
nnnnnnnnnnnnnnnnnnnnnnnnnnnnnnnnnnnnnnnnnnngtcctcccatggcattttttattgcactgaatctctagtttgtgttaggcaaggtgttcatctgacaaaagttgtaatttgtttattttctttcctgaaaggaaatgaatttcatgacattttccccctttcctctatttcgagtttcaaatgaaaaacaatggaaagaaattttaaatgaggtgggctctcgatttgtaatttgttcgtctaagctggcacgggactgttctccactgcctgaatgtctccacttygtaacaggtatctccaggagtctgtaccgcccagcagaatctctgtgcagaggaagtaaggcatatgtccatgttgccttccattcttggctttatgcaacatccaatttcttttcttgtgtcatgcgtcacaacctaagatgagctatcctgaaagcagccttggtcagctgtcttgagtctgtgtgtaagcttactatctgttggccatagtttaacagattctcacatgcttgcccaaaggaagtcaccaccccctgatttcaagatgtcttcacgttcagatcctatcctgtta

SEQ ID NO: 3296 - DNA, 600 bp, Bovine  MMBT04880
gtcacctgagcataattctatgtgagacgtctcagttactggcccataagagaagctgcagtgattcactaggacagtatttataaaattgccacacacatgtgcacccatgggtgattcatgtcaatgtatggcaaaaaccaccacaatattgtaaagtaattagactccaattaaaataaataaataaactttaaaataaaataaaatttccacatatgaattgttgrtattaaaaaaccaattacagatgcaccagtctgttggtaaaagagcaatattcaaggaatattctaaacrattaygagtcaattatatcacttttagggacaagtgacarcacagtttgtattcaagtcaacagaaatgcttcattccaggctccctctgtagtagtgggattagtagggcaggtatgtcaaagatacaatgctgtyaagccctaagacttgcctaatttctaaaatggaatgctgatcctaagggacaagcaacgtggcaccacaaagtgaagccccacccccactctwcagactgacttccatgatttcagccactctaatcttagaagaaggtaacatctcccaatattgaccttca

SEQ ID NO: 3297 - DNA, 600 bp, Bovine  MMBT04921
gtgaggatagtgtttgaatttttaatatttaaatctgtgttttgaataggtaatgcattccccttgttctgaattcagatagtacagaggagcgtgcagtgagaagacctcttctttcccatccatcccctccccgctgtagcagtcagcctttccagcttagtgtctgctcttccaaaactaatttatacagcagatatatctacttatttatccagttatttccctctttttacatagatgatagtctaatcagatttactctttggcatctctcacaaaggaccccaagttctaaaraattagttgttatttctgttgagagatttgttgcagttgaaaaacatatacacatctcagagttgaagagatagttttctttctttccctttcccaaaactcagtttgccattttgtaataaactttcgatcagaattgaaaactgagcacagttcatggagtgtatgttcttagtcctggctgtgtgtgttttgcttttagtgtgtttttattgaggtatagttggtatattagtatcaggtgtacaacataatgattcaacattcgtatacactatgacatgatcatcataataagtc

SEQ ID NO: 3298 - DNA, 600 bp, Bovine  MMBT05145
ataaaattgctggggatgagaacaggtggctcagtgtaccattcaaaatttaaaacctcatcaactcctgctacagtcatgaggcttgaccccagcagggcacctcacagtgggagcccttttctggatggggaagtaagaccttagcgtccattttagtaaacttctctttctcatgtgtaagtgcagatgaaaagtgctgactgcttcttttttggcattgctttttaattatgaccatcaataaatcattctatccctgaacaggacttgagaatggcccgaaggcagagacacgaytcctcaggaactaggccagcagagaacagctttctcactccccacctcttcctttaatcctctgtcagaaacagaaacattctctcttcaagaagctggcarcggacagccacacttgcgttccgtctgggaaccctgttagcacccagttctacccttggcctgccttactggccactgtcacagaaatgggatctgtcctctsttctgcattttttcccaattcattttcccttcttaccggtgcaatggcctgaacggtccccccacccctcctcaaggatacgtccatattcttat

SEQ ID NO: 3299 - DNA, 598 bp, Bovine  MMBT05706
  misc_feature (1)..(110): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataatttaaatgacttagtagaattacctaaacaactattctctaaaactggcatgtaaattaacattaaagataccacagaaaacattaacaggctgaccagaatattatgagccaacagactgccctcccttttctgttttctttctaattattgctaggctaacaaatgacattttcattggtaytaaacctgccagaggttctttgtgagctggcttgaagaggaaaaacttcataattatacaatctatgtagcaataagcagatctaatatttttcctttaaagagaactttggggaacagatggaccacacactatcagaatattttcaaattcaagtattgggttggccaaaaacttcatyccagtgtttccataatatcatactgaaaaacctcaacaaactttttttagccaacctagaattaacagaagtttgggggtcattcatgtcagttttttcccctgtgttttaatattt

SEQ ID NO: 3300 - DNA, 600 bp, Bovine  MMBT05854
atagtctatgcaacagctgacagcatcttctgttcccttttttggtgcacactagttgccacaattggctttggcatcccctagtttggaaacaagtttttgtgcaggtcgatgggccacatttcataagaggaagaatagaacaaaacatgtttcttcataatgccattcaatgatttcctttgcaaatctgcttcctgaagttttgcagatgcagaagtcatagaacaagtcagtgggctgggaactgcattgcattttaagtgtttctagaagcaacatctccagccttttaaatgmgactgaagtgatagatttgcaggtgtttgaagaaacagatgcgctggaagggcaaaggttatttttttgattaatttatagttgatttacaatattgtgattctttttttaaaagcaaaaattggggtcctactgcataacgttcttcaaaagaaaacaagagagagaaaataaaattttaaaaaaagagaacaagagaagaaaagacccattgtgtacttccaaccgaaaattctcgttttccttgatgtacacaacatcaagcatatgtcagcaaagagaaccttacagaataggaca

SEQ ID NO: 3301 - DNA, 598 bp, Bovine  MMBT06098
  misc_feature (1)..(186): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacatgtgggtgttgggcaagtcgaaagacggggcagtgacaaaggaagagacacagatacggaggcttgggcagagcaacaggcgggcaggagggtcatatgggaactgctrtcccagaatgccacagggattaactcactttccggatggagggagggctgtaattttaggacggttgggttgcaacsagtccaagtcccttccgatcccttctgcttgacacaggaggtcccagatcccaccaagtactttgtcacccgctggagcacggacccctggatccagatggcctacagcttcgtgaagacgggrggcagcggggaggcctacgacatccttgctgaggaaatacaaggaaccgtcttttttgctggcgaggtgggtttcgtcactctgaccctgactgctt

SEQ ID NO: 3302 - DNA, 600 bp, Bovine  MMBT06151
tgagaatagcacataagtctgtaccattcctcaaaaggcatttgagctatatgtgttgggtggatggctaaatggaagatgaataaaaaaggaatgacttaattcctttgctgaaaaatagattgcaaatgacaaatccagtcttaaacaatacttcaaaaattattaagcaagcacagtcttttttagcatatgattaaatccaaaaatgctgtgtgtttcctgaatgtagagataccctctagagatcagaaaagtccagaattttagcccagactctcctcttaactttcctatatragtctccttgtactacccaatgcctataaaatagggttaccagtgaacagagaaaaacgacaatgatgatacttaacaacatatctgacaaggccattgtcatcactgaaagtagatttttaaaagtaaagcattttgacacttaaactaccataaacatcagaactatgattacttttagcaagagctggcaacacctgacttaagggaaacagaaaaggactcaagtgccagtcatgacttcacttgcacttattagaaactttcagacttttttcccctttgagacttaaatagagg

SEQ ID NO: 3303 - DNA, 600 bp, Bovine  MMBT06187
aaaaatgctgataatgaagactggctactttacccacttcagataatttataatacagttaaatgccacaaaataacaagacactgtgaaatgctcttcagatcttcacaattcataagtgttaagtgaaacagtagcatacacagtggtatatattctttatctttttatttcaagtttactaaataggtgaaaccattattccgggtttagcccatatagtctattctgatggcaaatctatgtacttctgatgaaatgtctaagctcttaacctaaattataacattttgattttgytttaaggatcaagtgttatatttatgaaggtatgcagtcaggtcttttcagctcctgatcttacctgctgaatcttccaaatcaatcagtttgggcattaagctctcagggagtttttccggtaagtcatagccattcttcctagcaactaccagatgaaaagcagcacaaaactcatccagtgtcaaggctccatctttatcaaagtctgagagttccctagaataaaaacttattattaatatgatcatattctgctttggctccttttaggtttcaaaaagaagcaagagaaattat

SEQ ID NO: 3304 - DNA, 600 bp, Bovine  MMBT06327
tattcgcaagaagcaattatattgtgacagatctttctgaatgcaaaatactctgttgttccgatagtgctctaattctctttctctgaatctgtctctggttctctcttgtttcaatagtgctatgtcaacaaatacattttaaattaactagtttacctggtctgccacctaagaaaccatgccaggattttattaagaaatgaagcattttataataattaacaagaaccttttttgtttttcccatgaatattttcatgcattgtaaaaagtttggaacccttttctcctcacccrgtaaaagagttttgtgtgtccactgagtttgctaacttttcttgcacacttacatcttagccaatatcttgttcaacacttagcaaagaacatacttttataatactagtcaaaatgtaccctagtcctattaaaaagttaaacagaagtttaaatttgatttctaactatttcccaaatagcaataatgtgtattcaattgagagaaggaattcttaacaactgagaatcgatgcatgtactataatcctgcttgcaatgaaattacatgagtattttactgtgcagtatgtcagggtg

SEQ ID NO: 3305 - DNA, 600 bp, Bovine  MMBT06526
gttttacatttaggcctttaatccatttagcatttgtttttgtgtatggtgctggagcatgttctaatttcattcttatttcctctttcatatatgtgtcaggaccaggataactccctgatcgtattagggcaggcccctttgaagatcaggtgggttgggcgggacaccccgtgctaccatctcattaaaaggcccttcatctctggacaagtcatcagcacatctgactccaggattcccttgtggctcctccaaacgaccttggttcccacgtggtgtcagcttccgcatgccttyctctcctggttttttggtgctgttggggcctctgctcccctgctcatacctgtccgctctccagcacctctccatgaccactgtccctgagctgggatgcctccatggattgacttgcagactgctytctcctacccttctcagagccaggccaggatcactctgccactcactcatctagtgtctcccgaatccattggctcccaggagaaatttcatggtaacagattatatgtgagttctttaccctcaaacatatcagtctcagccagagatagtgatgccataaaggaatccatt

SEQ ID NO: 3306 - DNA, 600 bp, Bovine  MMBT06528
tatacagtagtttattcaccgaaaatatattctgacaatatttatttcatgtttgaataaccttgcctctccttcttgatgtttgtttccaaaatgtggagccattatagtagcctgcacgtctttctgtgaccattgttgtctcttcaaattgaagtacacagtcctagcaaactcagtaagaggtccagccagggaacaattttctaattttagactgtcactgcatatcgtttagtttcccctcrgatttctgattgagattgttacaagggtattgtaaaaggaaaaggaagaggraagctttctctgaatatgatatcatgaagtatataaacttgacttacagtgggaaaattttgtgtattttctccaatatgaaatgctatttggcacagtatatgtttcccagtgtcatgttgctatagaatagttgcctatttgtcagaagctatttgtcagttttctcagtatctgcaggtggtaagtatgcttcagaattcagagaaggaaaattgtgtgctcccagggattcatgcaagtgcttgacaaaaatatgaccttatttctgaatatttgcacaacgtgaatgtgtgtagt

SEQ ID NO: 3307 - DNA, 600 bp, Bovine  MMBT06889
cagatagacaaaccatggtccaaagaaaaatactaagatgttggcaacatgcttgaaggaattagaatttgagtacaagttttttgttttttctttttttaaagcaaggccagaaaattaggatgagtagttactacttaaaaatcaaaaaagattttattgagggaaatcacaataatatagaacacaaaacaacacaaacaagctatcaatgattatagcaccatcacacaggtaatatgtgtttcatatagttcataaaaagcactgatagttattgctctatggatagttggtcayccatcagaaaaacagatttgtgtagatctgactgtgcatcttataaactcgccagagaaatttctggtatgttctagtaaaaatacacttttcctttgggagctggctttatataatgccattcatcttacgtttactattgtggaaagcttcacaccatgtaaactcaactttcttctgaaggactacactattgcagatgatacctttaagagaaactaaaagaaattcatcatacagatcaaagtttggtagcacaataggaaagtcatgtggtagacgattgtgactagtaaaagg

SEQ ID NO: 3308 - DNA, 598 bp, Bovine  MMBT06990
  misc_feature (1)..(39): n is any nucleotide
nnnnnnnnnnnnnnnnnnnnnnnnnnnnnnnnnnnnnnnccttgattaatgaactggcagggtaagcctcactcagatggaagtggtggaagcacctgcaatatagatttcagaatgtgttcatttgaagtattggggaaaaaaatccaaggaccatgaaattactgttgactgaaatatgaagtctccagaataaccaaatttataccacataataccttgaggatttatttcaaaatgtactgagatgcaaaaaatttaacttttcctctaagaaacattcatttatcaatcttcctsgaactattgtttttctttactagatagaatccttcaaacacttkgatagaagaaatgtayytcatcagtcrtgacactctgttttctattgagtactatgcacaaatcctggaaataaatagataaaaacatcccaaktggatacttgtagggccagttagagtttcctggagcacacataactgtgagattttcccttcstacagtcctttgtgtgccattttcctggcctttgaaccaaaacacagtccttgccatgccttgaacgttgcgggggccctctcctccagttggtgaa

SEQ ID NO: 3309 - DNA, 600 bp, Bovine  MMBT07359
cccataactgtgtgtggcagagtcgattgtcgacctaacagccactgctgtccccccttcactgctggaatgccgtgtccctattttcccagggccctttgttgctatggtgatcacaggacacagctctggccaatgagagggctctgggagtggcctccctcccagaaaaatggatgctggatgggggggtgccttcccagtctgcctttcctcctggagatgccagggctgctgagcagaacagagcagtgagaagatcccagtgcccccatgacaccactgagctccgaggcagcyttgcacagcctaacaccacatccttgtgagrtgaaaacaagcccttgtggtgccgctccttttgggcaggttttgagtgtggtccagggcatcctcactgatggagtcacatgggagaaccttcctccttttggagttgggaggaggtacagtcttgggaagaccttatccctgacactggcctggtcttcccacattcaaggtgtacatatcacagtattgattgtgagcctgtctcctccacgccttgagctctggacatcagggaccacatctcactcctccaagatctttagaggc

SEQ ID NO: 3310 - DNA, 600 bp, Bovine  MMBT07395
gaaaggctatggaaaaatagaactcttttgaagacttctttttggaatacttctcaaacactattaagaactgtgtttaactcatccccctctttttaaaatttgaaagatatttttccttctgtcttttttcttgatgtaatctctctcaagaaatgttcaacatctgtagccttttttctcaacaaatcttctttataaactgtgtccaatcctgtagtcatttttatcttaacatggaaataaaccactttgtcccctgaaaagtttacaagattgtacttgagggcttattatgamrgtatcgttatgtaagacagttctaattccctcataaatctaaatgtatagctatgctttttaaagactacattttctttcttttttataatcaataattttaaattatgccactcttgatctctggctcagctcagctcagctcagygcattcgctcggtcgtgtccaattctttgcgaccccatgaatcgcaggcctccctgtccatcatcaactccyggagttcactcaaactcatgtccattgagtcagtgatgccatccagccatctcatcctctgtcgtccccttcttctcctg

SEQ ID NO: 3311 - DNA, 598 bp, Bovine  MMBT07450
  misc_feature (1)..(42): n is any nucleotide
nnnnnnnnnnnnnnnnnnnnnnnnnnnnnnnnnnnnnnnnnncctagaaaacccccatggacagaggagcctggaggctgcagtccatggggtctcaaagagttggacacgactgagcgacctcacttttgcttttttaaaattacctgtcttcacgtcaagaaagaactctgagaagaatcagcctttatataaaaccagaaaggaaaaagggattcacttctaatttctaaaatatgcctcccagttgtgtgtgtgtkttttttaaatctaaagtaagtggaatttacattaattttwaattattgattgttgaaaccaatatttgaacrtatagggagtgaaagatatgaagtgaaagtagttatagataattacrtcatagaatcagtgaatgtacactccagtggcccaggaaagcctcatgcatttggttaaaccctgtctttgtacataacaacatatttcttttctctcrtattaatacagcatagtaaatgttgtactaactataaaaagaccaaaaacttatttgaagaatataatatatatgtattgtatgcacaggattgttgttcaaatttgacatgttatatcc

SEQ ID NO: 3312 - DNA, 600 bp, Bovine  MMBT07634
ttttgaggagctcttaaccatcataccctttctttcatcaagatgtgaacctggatctctaaaagataaaggcttgtcttattaaatgcatacccacagtgtcattatctcacttaaaaattaatagtaattccttattaccatgaaacgttcatttactgttcaaatttccccaattgacttataaaagatttttacagttcattttgtttgaataaggtccaaataaagtccatacgttgcatttggctgatatgtctcaaaagtgtcttttaatttaaaagttcccctgcgtatacrtatgccccctgcctttttccttgcagtttatatgttaatttttttctatagagtttcccacagtctgaaattatgtccctgtggtatccttataacatattcctttctcctctttatttcttgtaaattgctagttagctctagaactttgctgggttctggcttgaagttttggcaagataacctcgtgtggcatagcaaatatccatcagatggtatgtaatgtctgattgtccttaattttgtggtgttggcagtcactaatgattattgcctaagtaattatttcagtagggcctg

SEQ ID NO: 3313 - DNA, 598 bp, Bovine  MMBT07649
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnntgaatttaaactgatggttatctttgcaagaggccgggtggatccccccaacattcccccagcctgggacctctggctcagccaagcctcttccccatctgaacctccagagcgccgtcatcccaccccacccccggccttgctcttgttaacccaagatgctgctacacagatgccaaatggaaatcttccacagggccctcaagtaaactcgaggtgtgtcgtccacrctcctgcccttcctgctgggtcggtatgtggttgttagaaaagcagtcagaccttccagctgtgctctgtgccccgccgagaaggcgcgtccagacccatgtgtctcacggagggaactctggggactgccagcccctgcccccccgtccagggagccaactgtccctcttcccctcagccctgggcccayggggcccagcagggttgggctctgtgcctctgcctcggactyggcccatgccagagaggctgcctgtaacagccagggtcagtttggccccaaacagggattcagaa

SEQ ID NO: 3314 - DNA, 601 bp, Bovine  MMBT07766
  misc_feature (1)..(1): n is any nucleotide
naaaatttgtgttctccagtgttctagcctggggaatcccagggacggtggagcctggtgggctaccgtctgtggggtcgcacagagtctgacacaactgaagagacttagcagcaacagcagcagcttcctccccctgattacaggtcacacccatgctgggtttctgcttcctcatccatttcaaggtggtcagaggcatttttcaggcctttgtccagaggcttggggcagagcagtgttctgtagacctcagggtgacatcgctttacccacatgactgaagtctcagttgtaaacyagtgtctccagaacttactgtctgtttcttgtctcctcaggaggtgaaaagtgtcctggaaaggtaaggaaaggttttcttcattagaggagggggcagtatatatcttaaaaaagagttttagttagaaaacatgcattgaagtcttccctatcctccttcctattctcaaagatccagtcctccttaaaatatgttctggtctcggaaggctaattaatggacatctcagttggtgaatgtcaacccactccagtattcttgcctggaaagtcccacagacagaggaggctggcgggc

SEQ ID NO: 3315 - DNA, 600 bp, Bovine  MMBT08408
ctaccccataccacactgccccagtgctgcacaccatgggaacccagcagcctggttcttcaggacttgctcagggccacaggggaggcaagtgcctgcgtggtggggtcctgaaatggactagggcatatacaccaaggcatcacaaacacagcgaaacagatgaaaacacacacagataccacgaaaaccgtctgttgatttgcttcatcttggttctttcttgcccttctttctcagctcacaccagtgtgcagtatagcacggagatagagaacatggaccgggtcaaactccagytgcaccttggcccagccacttgactgcaggcaattcatttgtctgtctgtcacttgggttctccatctttaaaatgatgacgaataacgataakggccacctagggccactgtggttgtttaaaaaaaggtaatactagtttgggcatcattatggcccaccatttggattctaagattcaaaagarcaaaattttagaagatctcaaagatgatctaactcagatccattttaggaaacaggagcttagagaatttatgtgatgtatccatggttacacagctagttagccatgggatg

SEQ ID NO: 3316 - DNA, 600 bp, Bovine  MMBT08507
tgattacagctgattgtacgtcttgtggtagtggatggctatgggaggagagcaaagctcccgaacagcagagcaggaacagggcaagcccggaggatcctggaaaaagacagtgatgctgtgaggtacgcggaccgcacacccccaccgccccagcttcctccacyggagctgtgccgcgttgggcccctccagtcttcttctccgtctggggagacccgaccgtgccccccagcatccgtggccgcaggacccagtgatacctgagagggagaccatggcaggagagagcaaggctgyttcggcaacagctgctggagtgagatgtgctcgccatagtcttagggaggtatatatataaagggccagttgcaaggaagagggacactgaaagtcccacccatggcaaagtcattactcagcttttctacagaaggcactttcaaacttctgccatccgagcctgggtgaaagcagggctggaaggaaatgctgaggttaccctcaaggtgggcagatgcctgactcagtccagatgcacacacggagcccacaggaaggcatacacgtctttgccatttcttcttggaaagagcttgg

SEQ ID NO: 3317 - DNA, 600 bp, Bovine  MMBT08634
gtaaatgttgtttcctctttccattttaatgaatcaagttggatgctggaaggaaaatcaacaggatggaatggttgtagggagcaggtttasagggtaatgtgaacaggctccgtggttccaaatgttcatatttcattttttggctgcatgcacagcatgtaggattttagttcccygaccagggatcgaaccctcactccctgtagcagaagggtgggatcttaaccactggactgtcaggaagtccccaaatattcatatttcaacagtaaaagtttcctctggacaacctagctmtgtcctggaggtccctttaccactttgtctggctttacgtaagttgcaattaaaaggtttatttgtgtgacatatgacaagttcctctctgaaatttgatttcatgtttactcatgaatagcagctgctctcaaaagtgattcacttttaagtaaattaaaagtttgtctctgaggatatrcatatcctaaaggtttattttgttttgtgtctcaggagaagtaagtggggaagaatgagctggatattcataaggctgcaggtaacttgttttgaacactttcagtagactgagagaac

SEQ ID NO: 3318 - DNA, 600 bp, Bovine  MMBT08861
ggtttatcatgattactccagcagtgcaccaaagacaagagctttagaagtataaaatatatttagtgttttctgatgactaacaacactttcagtttgccacttactttcgatttgtgattttcttcaaaatggaattcgtgctgaatatgctcagaaggcggaagctggtgaggcaaagtatctcgacattattttggtgatttttttttcataaaatttcacattgtttaaccataggtccacaagaagcttttatataatatcagtagatacactttcagtatggttcttcttagratgttgtcacatcccctctattctctcttctcatctgcctgttcctgagtgagttctaatctacattcctggcttcagcggagctcaggtaagaatatgcaccatgatcttccactgctgccaatcaaagagtaaacactttttatttccaaagtaaaatttgtgtttcttctttctaactttgggattttgcagtttcacttaaacctttctttcacatccccaaggtccatttaattaccacgttgtgatactccatctactcatcaccgcagctatccattttgtcctctctatcca

SEQ ID NO: 3319 - DNA, 601 bp, Bovine  MMBT08871
  misc_feature (1)..(1): n is any nucleotide
ngtggggagaggagcacttcactgcgttctcattcgatgttatccctcaaacttctgcttagtgcctttgccttgtggggaaagcccaggtggagactgagaacagacttgtcatggcacctccctcccttattttgttaccctgagaatgccattcctcccaccaaggagaagtgtgattgcttgcatatgccatctgcttacaaaccccagtgagctgaaattctcccccaaaaggtttatgtaagccccctgtgaactcaaaccactatgctttgctcagctcaaataaacatcgaaraagtatctaagcatttgaacttataataacatatttatcccaacacatgaggctactcatcattggtgtgtgtgtaatatataattgcagcatgcagaaaacaaacagctctcgatcagagaagtctctggatcccayggggcactaatcatctaccaaaaatagagatggttggggaaaataacttataattgcattggcaatccactattaaagtataatttcatgttgttttcatttctagcaaataaataataaaaaactgatttgaaaaaattgcttattgcacttaccagcaga

SEQ ID NO: 3320 - DNA, 600 bp, Bovine  MMBT08967
ctgattcccgtggttcaagacatctctgatttttttcctttctaaatcttggctcatctgtttcagaaaagatggcacaatgatgctggttagagaaccaaaggccacatctgatattattaattccattctcagtctcttgtgtagtttttaatgaagctgtcttcaatgyccttactacacatctagatctctgttacattctgattatatttgggtatgtagaattttactcctccagaaaggaagcagaaaggagatggggaacatgctctgggactttggacttggggacccttsccaactcaaatttggttacttgataagagatggaaaacagagattaaatgtccaacatacttgcatgtagagatctatcttctttaaagttttacactctatgaaaagctcatgcatgtaaaactgctagcacatataatatctagcacatgagaacttattagggaagaaaaccaggaatggaaatctcagcctaagccacaacttaagaaagagcttgttattttaaagaaaattatactgaaatatgtactgagtacagtcttggtgagactgtaactagtgcaaggcagaactgtg

SEQ ID NO: 3321 - DNA, 600 bp, Bovine  MMBT08971
tgaaatgatgagacaagatgccatgatcttagtttttgaatgttgagctttaagccagatttttcactttcttctttcacttttcatcaagaggctctttagttcctctttgcttctttctaccataagggtggtttcatctgcatatatgaggttattgatatttctcccggcaatcttgattctctgcactttagcatccttgttctcatcttcaatatcgaaagaactgagcccctcaatgactcatccagattcatggctccgttttgaccccagatcaccatgttatcctctgcyagactctgtctccctttcggcattggttctcccatgtgtggctgaacactcccttcctcttggactgggagggtacattctcagtaatggtgcattcagttaagtggtcctttgtttaaaaattatattcttaattcttgcctatactatggcccttcatcagccagatgagcaggctgggcatttctgttagcaaagcttggcttgttcactgagcattttataagcatttctaggtatactcattctagggaaccccttttcctatgtttttgtctctcctcactatccttttcgtgg

SEQ ID NO: 3322 - DNA, 599 bp, Bovine  MMBT09000
  misc_feature (1)..(22): n is any nucleotide
nnnnnnnnnnnnnnnnnnnnnncctgcgtctccacaccctgtaagggtggggttaccaggactctgtactgctgactcacttggagatattcgagaaggtatgtctatttgtaaacttgcaytggctaccattttggatgagggcagcagactaaaattaaagtaaaactcaagtttctttaattttatatgaaatttgctacgaatcagtttttccctcagaaaaacttcatgggacattcagataaaaraagagaaggtcaaagagtcatggtgaaatggagttttgacttggcttaasaatcgctccaaggaaatcacacacttcacctttgcctcctgtgagaggagagcagaagacrtcagaggaagaaaggagagcatactctctcctcccgtaagatgcttggggccaaacttaggatctgtgtcttagggtgcctcctgggctttgtgatgacaactcagagtggatgcgcagttgggttagcagcaggacatagtccagggcaggtgggaagtgtgtggaaacagagagaagttaagcaatttgcccaaggtcacaccacgcataccaaacatcttgttccagagcccac

SEQ ID NO: 3323 - DNA, 598 bp, Bovine  MMBT09050
  misc_feature (1)..(147): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaatgtaacatgcaaactttcttttgcaagaaaagcactgatgttattttattctcgttcatcgatgttgcctttcattttggatcagtttcattgcctctctcattttgtgtacaggaaatatattctagattactgaattcagtaaakgyactttgttcaccctgcttctctttgtttcacatctattagttatcttcctgcgccaattttaaccccctgaggttagtattctgactgttcaagtgaagagaatatctaatctaaacagtcaagtctcatcatactttgttctattttgacaagtgtggtttagcttttatttattaaaaaaatgcctcccagtaacctgtaaatgtacagtaatacattgtgtgaaaataacagcatctgaataatatgagccaatgcaatttcctgaaaataatctggtgtacatgttggtcag

SEQ ID NO: 3324 - DNA, 600 bp, Bovine  MMBT09080
ccaaatgctgagtatcaactatgaccaccatcaccatcatcattttgtaccaagtgatcaccaagtccactaatgaccagagcctctcawgggggcctatctcattartgccctgggtctgccctaaaagcctagtgaggagtggagatatttgtcctcagcaaacttggcaggcacttgagtcctccgtgtgtttgtgggcgggcctttctcaggctgctgcagatctgatcctgctggggatcagactggttgacctctaagactacttccaaatagaagaggcagtgatgctctcayactctggagacattttcaaggacagcccaaaggaacaactgggargtttccagctgttccactccctgtccctggctctgcaactctcccgcccacagcttgcccacagcttgcccaagcctgtccacagstcagggtcctcaayccctggcctttgtttgtgcaaatagtgaaagctggtgagatatttagatctgtaagtgccctgggcatttccatgtatggctgtaccctctgaagtcctagcccagagctcmaagggttttcaagagttgacaaggaagtcggaacaatcctctg

SEQ ID NO: 3325 - DNA, 600 bp, Bovine  MMBT09116
ttggttttcactatttataaaattgcttttctgcataaattactatataatatggtcctatttgttacctaaaggcatgagctgacgctgaatctgtcttcattaaactctgtgaccagatgaactcaattacagattgcatttgttcgctgaacattctagtgcctgacacaggcattttatgtgtactgggaaatgaaatgttatgagtgtcttaaatatctgctaaacgatgcaacttttttctaaaaactaggcttgtcttaagtcataatatttcatattcggtctctgtaactragctcagcagctaaacatttaactgaagaagtctctcagtctaagagacgcaaaccgaaaccacaaggaggcaccactcgcagcagtcagaatggctgtcactaacaagtctgcaaaaattaaacactggggacggcgtggacaaaggggccctcctgccctgtcgggggaaacgtcagctggtgcagccactgtggagaacagcatggaggttccttaaacactacaaatagaggtaacatgatctagcgatcccactcctggggatctatctggacaaaactataattccacaagata

SEQ ID NO: 3326 - DNA, 600 bp, Bovine  MMBT09331
gctccaccctcggcccagtgctcactctttctggctcaagataatgccctccgccctgctgattactgctgataggctaatccacacagtcagcagtaagtcacacactggtattctccccctttattccatgcctgccttttcccctyggcttgtttatgctggcctgccacacagcagagtcctctggagcactcctcctccataccaccacrgctccygacagcatctggcacrgtactgagcacccagtaaatactaaagagacgcctgactgacatgaccatcacagacagacgratgagcttccccataccatttgatggccaagggtccacagcatgtaagaacaaaaatcaatcttccccaaaatatctgaaagtcccagaaggcttacctagtagctcattatgaaatccagcctggttcaacttgctcagttggccggagaggtaacagagaccagagaaggggggagtgagcatcagctaactaaataagaacctcaaagccaaggggagggcagaaggcagcgctccacggtgattggtaccttcgggaagaggaacactcacacatgttatttcaatgctcccttgg

SEQ ID NO: 3327 - DNA, 600 bp, Bovine  MMBT09365
agtttctccaaytgaagtgggcagggagctaattttctttcagctggaatcaattttttctactcaagtccattcactagaattaatcgtttcggaagaagctcaattttgctggaaaatccagaaaagattttagttacagctccacataataaagcaattgtgtaattaataatacatttgtcactcctttagagagtgggaaaaaaagtaacacatgtatggctttagtgtaaatcctgacagtggagatttttttttccagggaattatactattataccataaaaatgtcaaggygcaagtttactgttcctactaatattctaaaatattctcttcagctgacatctctgtcaattaaaattaaacaaaattgcattytgccatccacacttcaaggaggaagctttcagttttatggctgttctttgaattgatttttaagatggcatctgtaaaacttgtctgaaacaagatgaggtgggatgaatctaaggaccagtcaatgtaaaaaatgtttttaaagatcgtgaattgacagccagaatagactgcacatgtctccaggtttctcaactattaaaatacatccagcaa

SEQ ID NO: 3328 - DNA, 600 bp, Bovine  MMBT09368
cataaataatcaaaacactctacagcattcttaagagaggcttaagatcaatgtttaataaatacgatgtgtgacttccataatgagatagcagcctgctcagtttcctatgctacagaattctccgtggaacatctttttatttaccccatacacaaaacaccaaagttagaagctgacatggcctcacataaaattagctctgctacacatcccaaattatgtacgtggagtgactaattacttcccctgcttgtttggctggtatcattagagtacatctcattttactgtttttgyatgtgcttttacatgtttctccaatttgatattatctgttacaaacagtcagctacttacaggctgcttccaaagwattttataacaagcccaggcgggtgcttaatgagcctattacaagggcttcaggaagaagaggcttttgtgagttcctttctgccccctttcgagtttagaaggtgggagaaagtggttgagagggtttcaatgagcctttgcgggtcgatccacctgtgaatagaactggtatgttgcaattagaaagggcgagtggctgtggaactgagagctctccaggga

SEQ ID NO: 3329 - DNA, 600 bp, Bovine  MMBT09403
caaattctagtccgggtctcgatggtaggtccacatttatttcccctaagtgatgcaccctctcttttattccttctaattccctgacttatttcctttaacatttttgccactgccccagatcttttcaagcagtgggaaaatctccatttggcagaaatgttttgttttcctggagccttgaattccactgtggattaaaacaaggatcaggccgttttcttttttggycgtaccatgcagcttgcaggatcttagttccccaatcagggattgaacctgaggcctcagcagtgaaaktgtggagtcctaaccactggaccgctaggacatttccccaggctattcttgactgagggttgacaaggagcaggagacgtgtaatgaattctttaagtcttcagaaatccagaaaatccctgacgttctcagtcccttcaaagccacagaatggtctggttccagaaggaggggcagggggcctgggggtggatgaggtcttcccagcctgacttctcgtaccctctccccaaggctaccccttcaacgatgtgtgccagtggttcattgacagagcggacctcatcttcgtcgtcttcg

SEQ ID NO: 3330 - DNA, 600 bp, Bovine  MMBT09604
ccttttctcctgcagactctccccatgttggccccggtttctcgccagagtggattctcaggcagggcgtctgccgggcttacagcgagctgccactgggagatgcactgtgtccgtgacagctccaatcagctcggaacaaaagaacgcctggcagtcctgccgaccgccttttctcaggggcgtggggttctctcgaaggtcgtgggtgctatgcttttgtttgttgttacttatggaacgaccggctttgtgcttaggtatgcacgtgcacacacagacacaccccgtggtcactgycctgcatgggcccaggtctgctgtttgctcctctgcacccacagggtcaccctgaagaacacaggtgtgacctaaaggaagacgtctccctccacactcgagaggggagagaccttgttagcttcctgatagaagaactggtagtaaaacctattgaaataaccatgagacccttactaagcgctcgctattcactccaccacccattcaggattcatggattmttttagcaaatctttaatgaatcacttttccctgcaaagasaggaagggtcatcccatgggactctgtggggaatg

SEQ ID NO: 3331 - DNA, 600 bp, Bovine  MMBT09645
atccagctcttgcctctaccaaccacttggccagggtggaaaaaacgggaccatgcttagaaccaaaactaggtatttccacttctcttcccccatcactgttagcaacccagctccactgggaacaataggaaggcctggagtccctgcggggtcactggtgatgaaaaggatgtccttgcayctctccccactctgaggtctgcagggagcaccagggtgtgcaggtgggatrtacaggtggtcggggtggggtgggggtggtctccgcattcgaattaaaaaccaaaaaactgaccwgatagacaaaatctcttttgtatctttcctggcagatcagctctttaaaagctgggaygagggacttccctgatagtctagtggttggaactctgggcttccaatgcagggggcaagggtttgatccctggtcagggaactaggatcacccatggctgtgcagcacagcaaaaaaaaccccaaaacctggractgtgttttttcactgcaccttgcccagtggatgaatgaggctcaggtagacctctaaggcagtcgtaactacaccatgcccctggatcagttttctgccaaaagccc

SEQ ID NO: 3332 - DNA, 598 bp, Bovine  MMBT09682
  misc_feature (1)..(74): n is any nucleotide
nnnnnnnnnnnnnnnnnnnnnnnnnnnnnnnnnnnnnnnnnnnnnnnnnnnnnnnnnnnnnnnnnnnnnnnnnnacaggtccttgtcgtgtgctttgcagaactgcatcccaagcgttagtgaccaccacaggacatcatcagggggtcctcagtccctggtccagagagaggctccacgcgccgcccctgcccccgccaataacaagctattatctcaaatgtccttttttatcttgacatatagaaggtgaagaaaggtttaaactatttacaaaatgtcactggtaatatctgaagygcacaaatgaggacatggaaattatttccagccttttcatcttgcagccaaatttattttttaaacattccaacatataaaacttggaagtcggttaacgtcttggagccgtgaaatctgtaggactgtgcaggccctccatgtaaacatgtgtccagcagatcccagagcccaattttccaagccttccgtccaagaagaggcttaaggcagtttggggcctgcggctccctgcagggtgctgggctttgcgaagagaagcctggccaaggcggctccccaaacaatgcccagtgcc

SEQ ID NO: 3333 - DNA, 600 bp, Bovine  MMBT09792
ggataaccaacaaggaccccttacttaacacagggaactctgctcaatgttwtgtggcagyctggatgggaggggagtttggaggagaatggatacatgcgtatgtatggctgagttcctttgccatccacctgaaattataacaacattgttaatctgctataccaatacaaaattaaacgtttaaaaacaaataaacaaccacgatcattcctaacaagaaagataggccctgctcacaggcactgctgggcttattatgtgctaaatccatgtgggaaattgtccgtcctccaaaargccctcttgactttacacttttttcagcaaaagaaccccaaaatccctagtgctgagctctccttactatatctgatgggacacagtgcctccttcctgtcctctgctccccagcctgtgatctttccagtgagaggaagggggagagggctgggctccggggtgccctcctggccagcctacagcaatggtgccccagccaggaggcgggaggyggtgccccaggcttaaggcatgaatggagcgggaggcagatgaaagacagccagtgctcctggcctaacgtacaaagaggccaga

SEQ ID NO: 3334 - DNA, 449 bp, Bovine  MMBT09946
atttagatacaaatttgattcatttaactaacattttctcccatcaacattttggattatcagtcctattttggattgccatttgtagtcactgttttctttgaatacaaatgtttataggttaaccgttgcagttctaaaagtgacatcaagttattgtcatgcaccagccggtgtctgagcagaacacattatgaggtttcagccagtgtcaattttatcattttcatcaatattacttactgtgaacttgaaaaaattacttataagatttttttgaatcagtgagaaatttgggargcattttatcagccaaaatgtgggaactaattgtagaataatgcgggaggggagagaagtgtgaggggtggcgttctctggaaaggaagggagggcgttccagaacggggaaatggaggggctggggggaggtggaagggtgagctggg

SEQ ID NO: 3335 - DNA, 600 bp, Bovine  MMBT09965
tgtgtcaaaacttagctttcccaggactcccctagtggtccactggttaagactccaagcgcccaatgcagcaggcctgggttccatccctggttgcaagtaagacctggcacagccaaatattttaaaaagcaaaacaacaacaaaaaacttagctttcccataatgaaagtttgctccttctgatttcccmaaaactgctttattttattagctctgactgccagctcattctccaatgacacaggcctgaagcttgccctctggtttgggcacatacagatggtgaagcgcaccctrctaattcccttgtgtccagccacaccctgcggaacttggatctaatgactgggacaaaagatcttcataaggaaaaatgaactcaaacaggatgaatggcacagctaaagacagaggcacatacattataagagcataactgggggcagtggaagggactctacaagatatgtgcagaattgtacctttatttctgatctgagtgcacaagtctgcaaagatgcatagaataagcattcactcagccatcatttactgcatccacaatgaaccatggaaacatcaatttattcccacagt

SEQ ID NO: 3336 - DNA, 600 bp, Bovine  MMBT10037
aagacagagtttttgatggaggttgttcatttgttgtctgtgattcctgctttccaggcaggtgattgaagcaactcttgtgtaaattaatctttatatggaggaatgggtgatttacatcagatacagcagttaaccttaaacaccagaacattgaccacagcaccttcaaatagtccttgtaggtgtgtggttggggtattcagtgactctctaataaaggtttgctgttgttaatatcctaggaaccattgggatgtttttagtggagaaattgagggttcagaagcaaatcccaaytactgtggcccattttcacagaccctgacctcccaccagctcttgggtctccccagtggctagcctggmgatgccctcaacatgcaaagcccagcaagcatatttggtcttcctcaagcttacagaatgctgttcctccctggaaacccatattatgttaataacttgtgatgaaatatcccagcagggagttctgggattcacacgccttggctgtatagtaaaacgctcatttatggtttatgctgctaaatgctcctttgctagaatgcaaggtggtaggacccaggagaactgtaa

SEQ ID NO: 3337 - DNA, 600 bp, Bovine  MMBT10038
cccatccatkggagcacacccctcacctgagtcttctactgcagtctttgaagttgccagtttcacaaaaagctgtgaggaccagaaaaaaaacaagaagaggaagtcaggaatgctgggccaggcttctaaaggcaaaacaggtttaaaagcaaagtctgtgaagagacaagttctaagtcatacttatgtttctcttgtaagttaatcactcaacttgctctttaatcttcctaaaacatatccctaccttctgattgctaacaatctttatccagatttcataaaattcaatttatwaaagacccaagcaggagggagcctcgctctaaggaacacatgagatggagttttgaagaaagatgaaaacatcagaacccctcccccatgaccaggtttctctagctcttcctcaaaataggacatgggtttttccrgctcagaggactctaatagcctgaaggagggtattgccaggagcttagagtgcaagtccattttttgtttgtttgttaagaktattaattggctctagtttgacatacgtgaatcttggatttttcaggctattggctctcccaggtaccttttcttgttgct

SEQ ID NO: 3338 - DNA, 600 bp, Bovine  MMBT10053
caggctccccagaccccagtaggtggagagctgagtatgctccaccctggactccttccagcccatttcagacatcccaggagatggaaaacagagatcaacagtatgtcactataaacctacagatgggatctccgcagactacagctgccaatcagagcgattagaaatgtgctttaaatcattcggacaggtgaacaccactggcagcgtctgttgtagcatttttaaagctcrtagttcactgagcctctatcattttctttaaattttttttcacagcrgtcccacagagtttakgtttctaggatacacttaaagcagagagaaaaataaaagacctggaaagatacaagcctatggtatccagttaatgcccacctttttactggttttcttctcactaagcataactcttacatctggtaggcaaattcatggttttacttaaagtatttttatttggagagagacctattagctttttccttttgtgtggcatccctggtaagaaatgaacaaatcagtgtgaaaaactagtcaggatgggatggaagataaccacgaaccctgccagccaaaaggctgttgaagagctcc

SEQ ID NO: 3339 - DNA, 600 bp, Bovine  MMBT10234
ccttctccaggggatcttcccagctcagggatcgaacccatctctcctgcattggcaggtgggttctttaccgctgagctaccagggagcatcactgagtcctaaaagcaaccctgggatataggctctattattatgcaatcattccacaggtgaggacaccagagcatggggaggttgagctgtcaaccccaaatcacatggcttgtaagtcaggcactgtgcttgagcacctttccaataataataccttgaaaagctcaaatattacaacagtggctaccattcattgaggcagcrttccaagtacctcacaagggtcagatcacttaaccccggaaataagtctgcaaggtagggtctattacttttttttttttttaatttggttgcactctctggcatgtgggatcttagctccctgaccaggaattgaacccacgcccactaccttggaagggggagtcaaccactggacagcccaggaagtcccaaggtaggtcctactactaaccccctttacagatgggaaaactaagggtcagggatggctggtaacaggtccaagagcgtggggggtggggctcactgtcatcatgt

SEQ ID NO: 3340 - DNA, 600 bp, Bovine  MMBT10304
taatggctttgctcacactctgcagagctcccctgagatttccaggtggtgctagtggtaaagggcccacgtgccaaggcagagacaaaagagactcgagttcgatccctgggtcgggaaggtctcttggaggagggtgtggcaacccactccgttattcttgcctggagaatgccatgggcagaggagcctggcggactgcagtccatagggtcgaattgcaaagggtcacaaacaccactgaagcgacttagcactcatgcagagctcccctcctttcaactaggtcctctacccatmggcaagcactgacctactcaaagggatctaaccagaagcctcacctgggactttcttaaaaatgcaaattcttgggtcttwtgccagcctaataaatctgaaattctcagaatggagctcagctatctgttttgtttctctttttgttaatcaaagtrtaactgattaatataacagttatattaatatacaatgttataaacaattaagataaacaatggtatgttaatttgagggcacatcatcgtgattcagtatttttacagtaatattttaactagcctcccaggtgattctgat

SEQ ID NO: 3341 - DNA, 568 bp, Bovine  MMBT10370
tcagggctgcagtccagtcatttgccagttgatggagacagtctaatcttagcttctgttgctgaagcaagcttggcattttcttgtctgagtaatccactgccctacaggagctttgagaaccttgaatagacttggacaatgggattgggcccagggttgtcttttccaattggaatgacatctgtagaccttgaaagtcagatgtccagatgtttaataggtgaactcctctgcttgaagtcctgtcacttgggactccatggagtgggcatctccaagcacctatgtgcatgacarttggtttacacttcaaatcacttttttttttttttaaagaatctttatccttggctgtataaagtaaaaagtttagcttctatttttttgcacctctattttatcatatacttacattgtatacagtagtggtagattctctaaatatgttatatgaagagtagaacatgtctttggtatcatttcattgcatgctaagtcacttcggttgtgtccaactctgcaactctatggattgtagcctgctagactcctctgtccatgggat

SEQ ID NO: 3342 - DNA, 600 bp, Bovine  MMBT10381
atctcatttgcatggcttgaaaataaattgagaagagggtaaattaagagacagaatgacttcccagaaatgtacccagaggtgaaggggctgaggcttcttcttacagtcatcaaactgggtaccacaagaagcttaagagtttctacagtggagagactgttaggaaggaaactgacaaagtcttaatagctaactatgggctctctcagggagtaccagagaagagagagggatatggcagaactctgtaaatttccccccgaatctattgccatgttaaagcagcataaaaccagsgaaaaaaggaggctcggaaaatgaacaaagtttatttacaaccacctagccttgtctctgctttagaagctgagatgtatgaaagaacaaaggtccttgcattcccacctaccaaatagcaggtcaatgatctttctggttctttgcttaagaggttgtttacttttaccctaattgtgtcccctagattattagttatttgcccctcccagattcatgcaatcattcatgcatttgttcagacatgcattcttatatttcatcactcagcaaatacttatatctatcatgtaccagaca

SEQ ID NO: 3343 - DNA, 600 bp, Bovine  MMBT10446
tgccattttctatattttacaggaaggcactctccggattgcgtcaatattcaagataaattactccgaaaatatcaaaacatggttcagctgctaggtggccaaaaaatgatagatatttcccatattgtgtcatgacatcataatgaaacatatcaatatgtaacaccactagggaaagaaaaattatgtgaatagaaaatcttgaaacttttacttcacatgtgatacacagttaatgytaactataaaagtttaaaatttttctaaaataggttatacattctttcatacttacasgtgacataaaacgaaatttaaatttgygttactgaaatcatttggaacagcaattgttaacttagggtataaaaccatagttactaaggtcctgatagccttctatgatcccattaaaaggtcccaaatgctagagttgtagggtcctgtactttagactttttcttctccttggcttccaggttcttctattgtgtstcttttaagtagtccaaatgttttttttttttaatttttcctttctaatctgtaggctgggaaaacaagtaactctgagaattggcctataataaattagag

SEQ ID NO: 3344 - DNA, 600 bp, Bovine  MMBT10488
ctgtgatttgccacacctactattaaggaagtatagaagatgatgtgaagatggtgatgttaaaactcaggaaaccatctaccttttctacaayggcactgtctattcccgccaccatgatctactatggcaacaactacggggctatgaatatgataggcttagctgtggctatcaaggatatggtgactatggatatgactgctgttgcccctattactatggaaaatattggtcataaacattctactgaaaaactctagagccactgaacccattatatttgtcctcttgtgaaayagagattctgctgttgggcttactcatctcatcctgtctcttcaaaaagcaacaatcaaaattgaaatctaaaccatcatgaaaataattcagatctcatctttccctggttccattgtgcaagatcataaagatttttttttcttaaatgcaatgaaaagtttccttttgttctctaagtatttcttttaataaatttaatgtctttgcaaatatgatacactttcacatcattgcatatggatgattgtaacaaaaaaacttgtatttactatcccaagggattgactgaccccaaag

SEQ ID NO: 3345 - DNA, 598 bp, Bovine  MMBT10494
  misc_feature (1)..(38): n is any nucleotide
nnnnnnnnnnnnnnnnnnnnnnnnnnnnnnnnnnnnnnaaattacttgcacttggggtgggaaaagaaagaaaggagtaaaagatggggctaacatctgggtggaaacatgatgccctgtggttttgccaagagcaaccacacaggtaatcaaaagtagaatatatctgaagaagaacccatgggatgaatttgcttacggacccttagtggtgaatcagttatgattcactccaccctggaatttcctcctgattggcacagacctctaaagcagccctctgtttcactctgtaccatyatccggtactacggggctaaagcgaagacatgaaaaggaggaggtaagctgcattccctattatttcagtgcccctacattcactgaaaagtggaataaagcatggccaagctaagagcagcatttttgaaccaaactatgttccccttttcttaagaagctttcaggtgaattcaagtaaaaagaacccctccacttaagttcagctccatctgaattaacagagaagcaaaagttagaagaatcctaagaacatgttttatgtttaaattattcaaaaccatgcttagatgttgca

SEQ ID NO: 3346 - DNA, 600 bp, Bovine  MMBT10503
cctctccctgctggggagacaccccacctcctgagtctgggaccccaaggcaacgagggggtagggatgagaccacaacatggctcccttctgccctccagaaggcagcctgccacctcctgggaccgccagtcagctacgaggatgggtcctggcctttaaaatgcagcatcctcaggtgggtctctgccccaacttggggccgtgtgcgtcccttcggagtaattgctggaaccaaggatgctgcgctgtacatgactaaccaaggagtctgtggccagaggaggcaaataaattgcsggcagatcctcggagctgttccatagcttcttattccagcacccagagctggcggggaccgattcacgttaccaggggctttcactgccggcagcgccaggccggtgtctctgcctgggcgcacgtgaaggggccgccatgcctgcttgctgtgttactgtgccacctgcaccgcagaggccagattaaacagggcttcagacggacggctggacgtttcaggaaatgcctctttcgtagcagagcctgacccggctctgagggtggcactggagcctctgggagtgccctgttttgttc

SEQ ID NO: 3347 - DNA, 600 bp, Bovine  MMBT10512
attggtcaatttaaaatgggaacacaaatttagcaactgccagactgtgttacattaaggcagcataatctcaaaactaggcacctgttaaaacaccagcctgctcatctcaggtcacgcgtgcgagttctgctttactcgtgctcatgttttggacctgttggtgcaatcgaggtcttgctttcaagtttacaagtaggttaatcaggaatacaagaatcaactgctagttccatagcttctggatccagtgtccctttaccttcagaagcctgaacacattgaggatgtaacagctgytgtaatcttgagttaggtgtcaatctatcatgttcagtacacagattgctgtaaatgtattggctatggattcagcaacagttccagttttgtttaagcaatagtacagccataattttcaactgacatttaaaaatggtctagttacaccttgtgtcaaagtgcagaactgctacattattggttacagacatctatgtgctataaaaacagctttggtacaataaattatcaaaaaagaaaataaatttttgtaaaattcacagcataattgtgaggcaaaaaagcagtcacataaaa

SEQ ID NO: 3348 - DNA, 600 bp, Bovine  MMBT10521
aatgtatattttactatcactgttggcaaaaagtctacttaatatttttttctacttaattattaggaagttttctttttgggcagtgtagagtccatatacatgaccagacaggcttaaaaaaaaaaaaaaaaaaaaaaggagagggggaaatgactgcctatctgtatgtgaatttgagggaaatactgtttttcatcttttggttaatatttatacttgtcttgcaaaataactcaacttcagggactttgctggtggtccaatgcttaggaacctgccttacagtgcaggggatgygggttcaatccctggtcagggaactaagatcccacttgcctagaggtaactaagcccgggtgctggacctactaagcttgtgtgccctggagcccacacaccacaacaaagatcctgcgtgctgcaaccaagacccgtcaaagctaaataaatatttttaaactaaaatttaaaaaatcaatattctttcaataaggtaacttgaaaacaygtacagagtgaatgtaatacaaaccctaaatgtcctctgtctttaccctgacacatttaatcaagtcatggggccctggcaaagctgcc

SEQ ID NO: 3349 - DNA, 600 bp, Bovine  MMBT11200
tactttagcattaggtagacataagccgtgtgagtgatggttaaatctaaacatgctagttttagcattgtgtacaaggtagtgtgctgtttggaaaaaatgcctggacatttcccctcatagttactattcttgatacaaagccattaaaaaaatctaaaaaaagaaaagctagaaaatgaaaagaagtaataagaagaagaaactttgggagagaattccctttccaagaaaatggctaaattaatctaaaaaatgttgagcacgttcagccaactgtttaatgaaatggggagatgkaggctcttcaggaaaggatttcttacagtgacactgtggaattggcctggcagaaacagggagacaaccccctccagtcaatttttattgtgttttgtaaaaatcagtccattataaatacactcttctctgatctggggctctgctgcgcatctctaccttctctatttttagctttgctcatattaaaagactctatactaaggtaatggagaaggaaatggcaacccactccagtaatcttgcctagagaattctgtggacggaggagcctagtgcgctgccttctctggggtctca

SEQ ID NO: 3350 - DNA, 598 bp, Bovine  MMBT11318
  misc_feature (1)..(25): n is any nucleotide
nnnnnnnnnnnnnnnnnnnnnnnnntgaaagtgaagtcgctcagtcgtgtccgactcctagcaaccccatggactgcagcctaccaggctcctctgtccatgggattttccatgcaagagtactggagtgggttgccaatgccttctcctcatgtctctctaagtaacctcaaattttttataatttttttctaaaatttgggcatgaattaataatctacacattcccttgttaaggataaagtagtgtcacttataatgccttgtgtttgagggagttgtgagaataggtccatttaytggagaatgatactctttgcacactcaagaaccccaagacatgggaaacagaagtagaaagcacctccttttccctctgggaagagctgagtctgcctataagtgggtggactgtccagcagtggaatcttgttttgggtctggaaacatttgcctaagttgatgctttgacctctttctcagagttaaacctaagactggcgaagattttatttgttcctacagtccactagaaaccttgacagctttccaaggagcacatctgtctaccacgtagaaagagcacttacaggtaaaa

SEQ ID NO: 3351 - DNA, 600 bp, Bovine  MMBT11320
cagatactgagttataatctcattgaattctctgaacagtagtaatgaacacttatggaacatttatttttctacatgctttctgtatattaacttaaataattcaatatggttattaccctttatggcagatgaggaaactgaggctttagagagatttaagttagctggccttgttcacaaaagttaagtggtcaagttgggatttaaacaygggaggcttggctccaacattggttttcttaacacacagcacaacacagccactttctttgagaaaagtatcaggaaaaaaaracrtttgagaaatcatggagaaattgtataaagtgaattaagagtatagggttaaaaagccaggctttggcatccaagtcttataatttcatcaccttaggaaagttaccacctccctgattcttrgtttattgtctataaaaatgawataaaagctaccttgcaaattagtagcaagaaaaacagatgattaaggaaaaccttggtagcagctcaataaatgatagtcattattattactcttttgaagttttgcagacaggtcaaagactccagtcatacaacttccctgttttacttgtt

SEQ ID NO: 3352 - DNA, 590 bp, Bovine  MMBT11408
tggttcaccttttgctcttccaacctatttaccttaaatactttcaatatcaaaagttctgctttcaaataattctaaattctcttttaaagggcttatgtaacagggagaggaggttttcttttatttttgttaagtgctattcacaaatatgattttgctttaagcctctcttacaaaagaagtcagtgttcttgagtcaaaagaatgaacctattagttttctgatgggcacactgtatgtaataaaaacacgagagctttatggtataaggaagcctattaattgaagcctctctytatgcattgctatcacttcttcatcttgctatgattagatgacaagatgtgattttaatacagaatagtggggctataaagatgatttactttcatctttgtaacactaagcagtatgatcactgtgtatttttcctgaataaatattcttttaacctgcgttgatatttttaacagacaggacactctatgattggagaggatctgtgtcaaaaaaggttctcccgtttgactcacgattccagttggccctagtttctctggatcatcattagcatttcaggattatt

SEQ ID NO: 3353 - DNA, 600 bp, Bovine  MMBT11474
caagggtttgaatgccagcagttgagaaatgatcccggggaaaacctcaaggagggggtcggggtgattgagacagagaaagtgctgtggattgcattgtgtccccgccaaaagcaatgttgaagtcttaagtccaggtacctgtgagcgtgaccatctttaggaatagggtctttgcagctgtaatgaagtgtagacgaagttgtactagattagtgatctaatgcaacctctgattcagtgattggtgtccttatgaggtgagagaaatgtgggcacgtgracacacaccgagggaaratagctctgtgaagacacagacacacacagggagagccaggcgctgacagaggcaggratcagttaggcygccacactccaaggatcggcagcagccaccagaagctaggagaggggcctggagccgactccccctctgagcccccaaggaggaaccagccctgctgacatcctgattttgatctctggcctcctgagctgtgagacgatataccgctgttgctttcagacacccagtttgtggtattttgctatgacggccttagaaactattaataatacaaataggaaggggaggaa

SEQ ID NO: 3354 - DNA, 600 bp, Bovine  MMBT11492
aggacacactttcacatcaatgtcttatgagacctcgtgtgttagaragatgaaacgcttgcactgggctgctgattgtcatattgagttaaatttgatcacactagtaaaaggatttgtatttttgtascagaaaatggatacctccagaattagaaaacaaaaagatgactggaaataaattcaaccaacgcagtctgtcgagttctaagcaggaaggagtctgggatgactccctcgtgtcatgaggatatgacatgaggtaagtgttggcacaggccgggatgggaggggctgctsacgcctgctaaccccacagggtcacactggaatcatcagcaggcgggtcygctgccttcctgtctggcccctcctgctcgmcaccttatctttgacwcataatcctgcaggcttckcccattcaggccctcagcagagcccaccctgacccaactcagcctgggtaaaaaccccacaagcatggatccatggccagtcactctgccatcagcccaaggaccctcagtgcctagggtggattttgaatcccagaacccccttcggaactcggggaaggtcatggagactggaatttgttcc

SEQ ID NO: 3355 - DNA, 600 bp, Bovine  MMBT11640
gaaggtaagaagtggggggcggggcacaatctgttcaaatcttatacatatcctaaatcctaataatttaaaatgctgaccgcttttttcctgaagaacctagtaaatttcatatgaataaatacttttcctattcattactgacatggacttttgtggttacttaaaaaataaataataagtgcttctcatttttatgacagcattaagtttcaaaatgaggctaggtaatgtcagcttaacccagaaaggagctaaatgtcgggggagggggaggacsggaatggcataagatgaatratcagcaacaattctagtggtaaaaactctttaggggagtaaagggtccaagttgctttttaaggaataaaagatggatcaagactcaagaaaaatgctcattcattgtaccttggaggcaacactctgtctaaagtacagaagtagtaaaatattttactaagttaaaatataggttttatattttatacgatattgaatacacacataaaaataccagtgttttcatcttgtttctgttcagacacttaattaagcaaatatgttctttggtgtctgggagagttatcaatattaaag

SEQ ID NO: 3356 - DNA, 598 bp, Bovine  MMBT11704
  misc_feature (1)..(104): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagatgccctggtccgtctcccgcgtgttctggatctgagggtcccgtcatccagcaagttcaaacgggaatccgtcttcatgctcagctcgttgctataacgacagacctggctggctcaggcccccaaagcacaggaaacatccagtcctctgtggatgtctggtcccagcccagggaccctggcctccaggyacagagcacttgaggtgccagagaaacgtcttctcctctttgcattccctccacggaggagcagaaagggttgtgtgrgaggaggaggaaaggtcagggtgggcaggcaccctggagcttctggggtacagggatggctggcacccggtggccagcacccctctgacggctgggacccggcacccggcacccctctgacggctgggacccagcgcctggcaccctgtccgggagcactcacttgttctgcagccagatgatctcgggcttggggttgccctcagccctggtgcccagc

SEQ ID NO: 3357 - DNA, 600 bp, Bovine  MMBT11829
cacctacaattacattccttcttacgtttaaactcggctccattttgctctaatgtacagtatgtacaataacccttaactcactaaactggcaagtttatatttctgtttgtttttaattgtcattacatttccacttaacaatttgtttcactctctttgtgttttctttttttttttgtcttaagctacattattaaccaaaacactcctcttcctraaagagcaaaaaatatgcctttgcacctttcactaatgagccccgctgtttgatacggagttgatgatayacctcaaacratggtggccgaagcttctgtagtttctggcaagaggctcactttaaaacaagcgatataagacttaagatttgcctgtattccaacatacagtcattggacttttggggggcaggagarcaaactcgaaaacggatgaattgagatcaagacatwtcaaactttctttrggagtyttcattatgattatttattaaaaacccgaggagctcatgaagtatagatgttgctggtagcttgcgcgttctgtcttactggaacgatgtttctggaaagaggggttgctctctttggctcctgg

SEQ ID NO: 3358 - DNA, 600 bp, Bovine  MMBT11893
tgccaagcagaagaaccctgaaaaattcaagattagtgagtaagaaagatgacgtgcatgtctgtatcatgtgtttacgtgccatcatgaattatcaggtatgtttctgtttataatccttaaaaaaaatctgaaatcatcagactcaatcttgttctctttggtatctttgtatttctatttgaagtaaatatcaggatttaatgaaatattttagagaagaaaggtctggttccttctactgctcataattcattacccttttagttagcatttctgatgtgtaatgcatttaaaggsaagacattttcctcttccagtggtaagcttatctagattacttggtaagtgtttttgactattagagacagagtaagccactggtctggggcaataatggaacaactttggaacctgggaatgagtaatctcacacactgcgtaggtcattgctcctcaaagagttatgtgaggacaggcaagggattatgattactgtgttggaccctgtggttcctcatcttcatgagaagcacttagaggatgcttggtagaagagcagagtccctctttagatgactgatacagactgtcttcact

SEQ ID NO: 3359 - DNA, 600 bp, Bovine  MMBT11943
agccacttacacaaataacctgatgcttggtttatggccgttgagggattataacacaagacaggrgagctcactaaaacagtcattattgtacaaaatgacatttcttttagactgatagcagttatgaagaagttgcattttatgtttgttgtcaaagactacaaaatgggctactgggattagattgtcaaaaaatctgtagaatctagccccttgcttgagtagcttgtattgaagagttgacataaattatagcaagggtccacatttttaaaatgtcttgtyaggtatgggaaygggaagttactagaaaatttacactctagtgtttatgtcattcttctgaaaaaataattatattctaggtgcctgctttgatcatgaaatagaaagattaaatgcattttgccaaattaggatttctaccaataaccaaaggatttgagaatatagttgagaacttggaattttttcctctgtttttgctttttgaggtttttctatattttcttccttgcctatagaataactcaaccaattatagaaacatcgtgcttaaagaatctcaaaaataatttggtaaagttagaaaaatac

SEQ ID NO: 3360 - DNA, 552 bp, Bovine  MMBT12013
ctgccaagtgtctggcttgtgtaaaacttgagaccttgaggaaggagtgaagaaccgaactgggacgcaagttggaagtctttgaggtcatggaagtttgcaggcggcaaatatgacctagagagcttagcttcggaaagtgccatcagcactcrgaatgctccagtggttgtcgagggtgagagccaggaaacggcatctgcgggggtggttatcatcacatactccccagaaccacaaaattgcccacatcctgggctcatggaccagggtttccactttagtggcctgataacccaraggtcttattgacaaatcccagaaaggaagaggacttcatggatttgtgtgtcttggaaagctgagtcctatctcccctgactcactctggaaaagtggaagtgtctcttcgcctgacccaagggaagctgatgtttggtgtttcctgggagatcrcgattcttccttagatctttttcttgatctgatgttcatctttccaatggaggacgagggtcctcagctgtgttcaagtcatcaggggccaaaaag

SEQ ID NO: 3361 - DNA, 600 bp, Bovine  MMBT12032
ctttcattttgaactaaacacttgttaccaaatcatgaaaatttgtccttcatccaacctacatccaagatcaataatgaaaggtcatgtcttgggaccaaggtgacttgaaggcttccactaaatctccagccttctgtgaacttgagcttcgaccttcagagacaacagggcacagagtttggcagcaaatgatccaattactttaatgccgatgtgaaaattgtgactctgttaatttaaaacatagtttcactgtgaatagttcaagttttattttgattctggcttttaatactyactgataagtatgcagaaagagatactttgggactttttattaccatattgcctaatactgcttctgtgtttaaaaaatctgcttattgtaagcagggtacagtcaattgtgcatattggatttaattttctactatgcaaataaaaatgcctaaattgcaatttacagatcttcttttttttttttttcaaatactgtatatgtgtatgttggtttctagtgccatctgaatgacccatgctgaaaaggttttcattttgcatttccaaaatatatacagaacccattaaaagaaaaaa

SEQ ID NO: 3362 - DNA, 600 bp, Bovine  MMBT12053
gcccactgctccgtgggaaggtataacaggatgtttgtttgggaggtctggagctctgcagccctgagattcattgaatcactttccaatcaaattcctgagacaggaaggtcaatgggatgaaagaaggacactttgcctagggtctaggagttgtctggggagaaatggattgataccaagactttccccctggggttccaagttgattggatggactaagtacagtgaacacaccactgagattcttgaactctgcatgagccagtggcactagagaagaaagacacyctccccgaraacagaacagagcttggagttatatgaatttgaatcctaaaggaggtgtgattttattttgtacccaagctcctcgctacaataagattggatgggggcggtgctggcaggagaggtatgctcttgttcacattatctctgaaatagaggcacattcattaaaatgacaattgtcttagagtcataattgatacctgctttcataattttaaagtaagagaaaaaaaataggcggaagaaaagatgcctataacagcgagggcagtgaaatcagaagaaacacacttcacgaaacactat

SEQ ID NO: 3363 - DNA, 600 bp, Bovine  MMBT12193
aaaaaacagcagctttgacctcagtttttatgccgagaactttggggctggtgtttcctgtgccaaaaacagaggaggataagctgcctgaccagccaccgccagcagcatcaccagcacagggacctcatgcctgtaccttcagagagcctccagagagcggggccaggcaggggaggactgagttcacagcttttcaggcgagttctgccagacccaagggccataaatcccaggaatggaaaacaggagtaagaaataaaacccttggcttctagtgaacagccagccacttgcttmgggccataaataaccacagttaaaccaagcaccccttgcacttctcggcagggaagtgcatgaaaacatctgatgtaaagattttaaatgcttaactgctctctgccaacatctacttgaccatccagagatgcctggtccagatctttgaagtgagcctggcatatctctccctccatggccctgaccactgcctcagggaactctgactggtggagtgctgggtagcatcatgggtgaggaggaggggtcaattagggcctggcagaaggaagtgggtaaccctcagctgtgggtcca

SEQ ID NO: 3364 - DNA, 600 bp, Bovine  MMBT12413
aagaggagggcagcaaaatctcaaatacagattttgagtagaaggaatgtgtgtgcaaagctctgttgtaagagaaacatggtactttccagggactgaaagaaggtctgagagggtgcagcagtgaattaagtgtggcttgatgaggctggaggctatgcatatgcctgagcaggaggtatcttagaggccrtgttatactttggatttacttttcaagcaatgggaagacatgagaggaacaggcagagccaagtatattgaaaagacaggcttgcattttgtaaagcccacactttygcagatgatgaacagattrgagggggccagagtggatgcaaggggacyagtgaggaggtgaccgcagtcctcctgggaagagaggatgaagtgcagatggagagacagagaccaagctaaagggcaagggagaaatagaaacaaagatgactcccccagctacatgtgggtgcactggtcttaaagatggaaccacggaggatgccagccaatctttatatgaataaacatataccactctgtgttcagtagaatactgtatttctcacaagttccatctctaagagttcagatagatcg

SEQ ID NO: 3365 - DNA, 600 bp, Bovine  MMBT12623
tttaccagctgaaccatcagggatagtagtttgctgttggggttttcctaatggctcagatggtaaagaatctgcttgcaatgcaagagacttgggttcaatccctgggtcggaaagatcccctgaggaagggaatggctattgttgactggagarttcaatggacagagaagcttggtggactacacaccatggagttgctaagagttggatacaactgaataacattttcactttacaacagctacagttctagagcctattagtatgtgtgcaaaacttgtgttactcaaaattatmgttttgtaaagtatcaatgtgtatttccatgtatattctatttctgttaacatactttcctgtttatacataaacacacacacttttaacttacctattgtgcacattatgaacattatgtactttgctatttcaaatyatattaaaataaactgagaagtacatcttccttttktgaayttgcataaatgttcwttagagtgtaacatagaagaggaatttctggttatgttcattttcacttttactgataataccaaattgttctccaaagttgttattacaatttgtcttcctaca

SEQ ID NO: 3366 - DNA, 600 bp, Bovine  MMBT12634
gagcccggcctgctgatcacgccgcatacatcttctaaatgagtgttattcttttgaatctgtgttttctttccagacccctccagacctatatgatacgttaagatttcacagcttcggaagtgagattaattaactcaacactggaagatcttcaggaaaagctgtgtccttcggacacttttgaaaaccaattttcttcctgagaaagctggagtgttgctgagggagaatctaaaagagatattaattgatgcttgggaattgacacccattcctctttcatctctcctaaaaaayattctttaagggaagaggaaagatcagttcttcccattgcctaagcctctcaatagaacgcagtgttctttatgtgacagttctgagcttcggtttcttacacgaaaagttcagtcccaaaygcacttccgtacatcgaccatttacttgtttcccctaattcctcgtcctccaaatcccagaacacgtctgccaaaggataggaacttgtggtcagaaggtacaaattaatctccaaattctagtcaacctccacggcttaagagcccgtatcttttatgaagtctgtttctatcatat

SEQ ID NO: 3367 - DNA, 600 bp, Bovine  MMBT12636
tctaggagtaaattttaaattccacatgtggctggcgcttgtagctcctgttttatttctattagatagcacctttctagatcacactctaagcacacatacttagggaccatggaaaccttgcccaaagggctaagagcccaagtctagaacctgcatagactttcccctgtttgtcctyccaaaggctgagcgagctgcccttgtgcacacctgaaggcccagtggaggccraagtgcagctattggaggggagagggagtagatggtggggcttagacatgaggctggggtgccctygtgcaggtacaaggtctatctcagaacaggacagggcccaggatgggggcaggaaccagtcctggggctggggactagctctcctatgtcacagaattctgaggcatctgagatttctcaattccatcttagccttccagattgttaggcagatatatttgtaaggtgtgcggacgggccytattttatttaacagtttgttagcttaatttataattttcaatatttagacctatgatatgtgtcgctatttgtgctctcgccctgggcaagtaaggtaattactacagaactttgtaa

SEQ ID NO: 3368 - DNA, 600 bp, Bovine  MMBT12767
atacttgccaagtgctatgttgccatcacttcagaaatgaataagacacaggccstgccctcaaggtattcatagccaagacagctaagtacccaagcagttggagttcacaagagaggtgctgaggaagcaattcaggcctgagatggagggctgcaaaaacttcactgaaaagtgcactcacataacttggtaaaatatagcctgttcctaaggccttggatttaagttgcatgatccaggagagctgaaaaggataaagataactggacatggggaaacataaccctaaattggacrtgaaacaaaagtcacaggtaatctaatttttctaatggcaggggagacagaatatgaggtacacartggaaaaaggacttccttgttgtgatagaatcaaaagagtctatgattaaatggtagccaraaacattgtattgttctatgcctggtacagagtacactcttgaaaggtatttgttgacccaacraagatgggaagagaatgtaaaaatgtttagctcagtggtgatcattttggaatgtacagaatatcgaatctatgttgtatattagaaagtaagatgatgttgtgagtca

SEQ ID NO: 3369 - DNA, 600 bp, Bovine  MMBT12798
cagacatatctttcacggtatatcattaaatgtgcacataattcagggccctgaggcaacttccagataaatgctcatcatttccactggcattaccacctatcagtaatactttggggagaaaagctctaagaaaagataaccttggttttgcattactgaatcagcactctgaaataaaatgtttggtctatttcagtattgagaaatgtttatattctgagatcttttcttttttctacactactgatttcttaattatgccagtgtttaacaggctacaccatgggacacttcttycagagaacagaacaaccttgcggagctgccaattagcactactccgggcatttttacagcactctaccttttttgtgccttcgctttttctgaaactacttttcatgttagggtaattcaactagacctatttaaacaagcataatgagggctaatcacaattggaagaaagtggacacatgtagtagaggggaaaggaagaaaagggaaaaggtaatcaaggagatccaaccagtccattctaaaggagatcagccctgggtgttctttggaaggaatgatgctaaagctgaaactcca

SEQ ID NO: 3370 - DNA, 532 bp, Bovine  MMBT12822
agctgttgttacaagttagtcatcaggcagagaaatatattgactttcctaaaatgtcttatgcacacacattgttatacaatgtacttaatctgcttacatacttgatacgtgtgtgacacgtgtatcgttctcattcagctgaactgcgtcatttctgtttatttggttaaaatggtgccctgtgacctgtaccgtaaaatgctatcaagaccagagtcgaccctcccacccagagtttcttttaaatgaagcttagtaagtaatcctacaaaaggttagctagaagcaaackgttasggagatagcctgtggatccttgggcaggaagtatgttttgctctttgattcctgagtattcatttttgcttacaaaattatggctcactaatgatgggcgtggtccctgtggtgcagggtgtcctctgggtggtgtggtgttgatacaggtaaaatggctgctgttttgactgactgtagtttatagtctgtggccctgtgctgcaggcagtaacttctatgtctgaagttt

SEQ ID NO: 3371 - DNA, 502 bp, Bovine  MMBT12886
cagaaagaaaacaagtgtaagatatgtgggaaagtctttaataactcatccaatctaagtagacataggaaaattcatacaggaaggaaacctttcaagtgtacagaatgtagcaaagcayttayctgtyrctcacatcttactcaacatcagcgaattcatactggagagaaaccttataaatgtacagcatgtggcaaagcctttaatcasaactcaactcttactcaacatcagcaaatgcatactggagagaaaccttataaatgtaaagaatgtgacaaagcctttatccgttgmtcacatcttactcaatatcagcgaattcatactggcaagagaccttatcattgtacagaaagtggtcaarcctttattcgaagttcaacactaactgcacatattcgaatccatactggggggaaaccatacaaatgtaaagaaagtggcaaacctttattacaagttcaaatcttactcaacatcacccaattcatatggg

SEQ ID NO: 3372 - DNA, 600 bp, Bovine  MMBT13360
aaaattaactgatttatatcaatttaaaccatattattgatcgagcaaatactcattaaatgctcagtatgatacttgctcttgaaaagtgtaagtatagagagatctaaaataaataactttttatagtgtgataaatgttttaatataaagatattcaaaatccctgctaaaaatgttcaaatttctctaagctgggtaaagaaaatacattaagaaaatgaaatgatataaatgtctgataatgattttaaacagcaaaagaaatgtactgytacttttttttttccttctaactasaacacagattgttttagatacttgatatttgtttaatcaatgaattagtggatggacaggtcttcatgcaattgcatgctctatttcaaatatattaatagttcaaaattgaaggtcagatataaaagacaattgactgaagagcaccctaagtgcttatataatagttttttcaagttggtttttttgtttttaaatctaacttatttagctgagttcttttgccattttgaaacattttcctctagactacttaattatagcactctccattaatccttcaaactctctcacacacac

SEQ ID NO: 3373 - DNA, 456 bp, Bovine  MMBT13535
gactaacgagggcagagatttcagaaaaaaaggtcaccaatccctttcagtttgtgaaaatcacacactttcaattatttttaccactactggggtaatttgtccttcacatgtggctcaagtgacctaaatgaattagattctgttaccaggtataatgcttagatcacttctagtgttaagagcaatgtgaggtcactatttaagaaaatacagagtggagctaataagctatttgacacatagaggctaaaagaacaaaaccaattggggctgaggcactaactagatagattctcyaagtaaagaagttacttccagagaattaaacattttaaaggcatgttaactctgagtttgtaaagaacttttgaaagttactgtagtagtgcaatcaattggctttgaaaagaaaacctacttaccatcttctcaaattgctagaatattttatca

SEQ ID NO: 3374 - DNA, 600 bp, Bovine  MMBT14095
atgtgcttactggccattttcattttctttaaaggattgtctattcagatcctttgcttattctcagtcrgagtaattgtcttattattgagttgtgagagttctttatgtatcctcagtgcaagtcctttattagacacatgatttggaaatatttttctcattctgtgagtcctataatgttttaaagtgatgagaattttaaaaatctgtttttaattgtgtttttttctccttatctaagatgtatcctttgaaaatatccagtggagtatagatccaggagcagacctttctcartataaaatgggtgtcactgtagatgatacaaaggtgagttagaaagtagaaccagagcccgtgtggttattcccgtgtgttgttagtcaccctgccccccgattcattctgtgaccttgagacagtcacacacctcctataatcttcatatatttattcagaaacgtacaaaataataacatttattttccaatttatggtatttttraatgggtaataatactttctgactttttagagacgtttgctgaaaaatatagttttaaaataatgtcaaatgctaattacatattaaataac

SEQ ID NO: 3375 - DNA, 600 bp, Bovine  MMBT14116
gctgacaatttaaaacaaggaagaatatagtcagaaaaaggctgtgtttatgaggctgcagacggtccaagaatgagcttcagtccttcacatgatgccagagcagggccggatattcaaaaggggatatcccagggacttccctagtgctgcagtggctgaactgcattggaagaatccaccttccaacgcaggggatacaggttcaatgcctacgtggggaagtaggattccacatgccatgggccaactaagtctgagcgccacaactactaagcccacatgctctggagcacccaygtcacagctagagagaagctcatgagccacaaggaaagatccagcatgacgcaagtgagattctgtgtgccgcaactaagacccaacacagccaaaaatgaaacaaayaaaatataaaggaaagaaagattgatgtcaagcttctgacttctgggcatctctctgccatctttttggggcacctgtgccatttggtttttgatttctgggcatctctttgcagtttgctctatttaaaatgtgactgccagctggtgaggttttggtttggcttggttactttagtttgagcatgcagac

SEQ ID NO: 3376 - DNA, 600 bp, Bovine  MMBT14315
cccgctgaaccttgaaagctggttccaggcttacagggcgtggagttgaacctgaggagttgggtgggtggtcggatgggcactttgggaagctggtcctaggcccgcaggacccggcctggtgggcgaggctggggcagagccagctgggggccggcaaggagcggcactccccacggacacttttgagttccaagccccgtttccaagccctcagatgcgtcacttcgttcaatcatcccaaggactctgtgaattagctactatttttatcctcctcttagggccaaggagacttgycccaggacacacagggagtggttacaaaaggtggagccaggcagtgtggcccaagttcaaggcctgcccttcgagccccactggccttgacctggtccaggcaagamctgatgctcttggccacacctaggggagctcgtggtagggtgagcaggggtctgggagaagctgggagaagaggagagtctaggtgttgtgccagtggtcaccaggcrtgcagrgtcctggggggcgggggtctgggacagcggccccctgcccagcgcccaaggcccagcgcccctccccaccgctgccccy

SEQ ID NO: 3377 - DNA, 600 bp, Bovine  MMBT14354
gtgtggatcataacaaactgtggaaaattcttaaagacatgggaataccagaccaccttacctgccttctgagaaacctgtatgcaggtcaagaagcaacagttaggagctttcaagatggaggtggttgggtggttgaccgaaaagcagaggtgaaggcccctacgaagtcaaacgggccgagaatcatcccctccccacttctcccagccccaggagcccagcaggagcccagcagaagcstgagtgttttaggctttattttttaaacaagcaagtaaatcaaacaacttgtcaacktggggcggagatccacrtcatccaccaaaagtggaaaatttatgaaccctacagaccaagccagaaaagaagctcrgaaaagagaattaaagaagaacaaaaaacagcgcatgayggtacgagctgcagttttaaagatgaaggatcccaaaccaattatcccgggtgccgggagccrgcgagagacactccactcgtgacaaaggtcatgaggaaggaggctcggcatacacaaagggcgggatcgagcctcaggagtccccctggatattctcgagcatctacccccaaaaaaccaga

SEQ ID NO: 3378 - DNA, 598 bp, Bovine  MMBT14452
  misc_feature (1)..(72): n is any nucleotide
nnnnnnnnnnnnnnnnnnnnnnnnnnnnnnnnnnnnnnnnnnnnnnnnnnnnnnnnnnnnnnnnnnnnnnnntggagagggttgcctttcctcttccgaggaccttccccactcagggattgaactcaggtctctggcactgtgggcatattctttaccatctgagctactgtggctaatccagagagaagacctggaggtaagacagaaccaggagtggcggttggtctctgagctgcttttggcagctgtgcagcartggagaaaacagtcacaacatcagatccaacacagttatcrggaatgtggatcctgttattaagccaaataccccsagggtgaggcttccaagtcctgggctgrgacctggctgccagcctgcccagcacaagtaaggccccactcaccaccagcccctcttcatctttggggatttagtggccctatggaggatgcacaggggcctgagaagggcacaggatcctctacaygcatgtctgagaagccccaaacatgtgactacgcaaagatttatagtgcaaatgatcatgagtgagacagaggctgtctgtctcacaaagaaccaaggtctgtttca

SEQ ID NO: 3379 - DNA, 600 bp, Bovine  MMBT14894
cgccatgtgattgttcaagggattacataaaatcatatgtataaggtgtctgaagtagtgcctaattccagaatttgcatataatgtatttaatggtaattattttatatgatggagttttcccaggcagctcagagggtaaagaatccaaatccaatccaatgcaggagactgaggttcagtccctgggtcgggaagatcccttgggaagacactggctactcactccagtatccttgcctggagaattctgatgacagaggatcctggtgggttaaagtccatggggtcacaaaagakttggatataactaagcgacttcctgctctgcctctaktttatattatgaactatttataataatcctatgaacacagataatattattttctttcaattttcaaagaacaaaatttgaacttacagagtaagtaacttgcctagarctaagcagcttgcaygtggtggagctgagattcagagtacagtggctcaaagtgactgtaacatgtaatcctgaaaagtttgcaagtgccttggggtgtgaagctgagatactttctaataatgcgttgcttggcaattactctggcacccaaa

SEQ ID NO: 3380 - DNA, 563 bp, Bovine  MMBT14906
gtaaactgtggactctggatggttaactgttgtctttgggtgatgatgatgtatcagtttagattcatccttgatgaaaaatgtaccgttcaggtgaatgatgctgatgatggggggaggccatgcatgtgtgggagtggaggggatgtgggaattctctccgtacrtttctttccattttattgtaaacctaaaactgctctaaaaaaatgaagttaaaaaaagtccaggagtaaaatgaaatggttttccctcactgagtttagggttctttgttggatttgttccagtgaatcaatmactgaaacaatatcttttgtcgatgtatgtatatactctctacctagtctgaaagtgattattgatttttttttttttttcgctttgagctgacttgaagactagagaaattgcctcaggcttttctcctttaggaatatattcccttcacagtctgagattgtgccaaccaatcaaagaattaagtgagttttaggtttaaatgttgcaagaatgcaggggggagctggggcatatctccggcagagtgcttaattttgtaa

SEQ ID NO: 3381 - DNA, 600 bp, Bovine  MMBT15060
acttggcacatacaatgtatatatttagcaactttgcactatttgaagtaccttacacattgcactttactctcctaatggtacttttatgtgaaatgcactttattgacaattatgtcttatcattcagtagaaaaagacaaattttacacctatgtcccagaatacttgttattccttgttctaatggaatgaaatttctaataattcctgagtaatrtagaaatatatctccttacattgggagaatgggaagaaagtgaaaactgttgaaaatgaaatgtgatgacctttgaacgytggatttcagagagacgggttcccaaagcagggtgcatctgtgagyactccttgtcatatttctttccatacgacatgrgttttcatcttatttccccyrcaaaacagagatccagatgctgctggattcattctaggcatatcatttccatcgtgacattcattattgctrcttcctgatgtagtcattttactctgattttgataataaagacaccatgaatatacattcgcttcctctcaagtctagccctgccctagaagggtagaagggaccaggcatcatctcagcagtgtttt

SEQ ID NO: 3382 - DNA, 600 bp, Bovine  MMBT15460
caaagttattaaatttcattctacgaacaaataaatccatttttattgcagcgggaggagcgggcagcggtttgctgtttgacattttttatttttcaaagtcctgttaaatctgccccgatcaggtgggcggccccgcggccccagcatgccaagttagttttggtgtttccttcctcactgcggcagcacagaccttcccccgagcagtcggcgggtcggatcctgcccagacctgccactggccctcaggtgaccctccattcacctgcatgcaggatggggaagcttccggaagcytcttatgtgtctggcattttatagtttttcagacacttcccacgcatttcctccccacgcctagcccagccatttcacaggagaggaaaccccagctcagaaaggctctggggcttgcccaaggccaggagaatcctagccctccgatgcagctctgtgggtctcagtcacctcacagtacagcaggaattcagttcccatctctgtcacccaccagctgtatgaccctgaccacacgaactggcgggcgtctcagttgccacgtgtgtagaagggatattataataatagcatcttctc

SEQ ID NO: 3383 - DNA, 598 bp, Bovine  MMBT15777
  misc_feature (1)..(7): n is any nucleotide
nnnnnnnttcttagggtcaggaaggcaggtgttggagcatgatgctccacccaacaaccgtgaagcatgatgcttcattttgcaaatgaagaaacacgggtggtgaaagcagtttacccagaacaaacagctagaagtagccagtctgggacttgaacccagatcatgtctttttaaattctgtgtttttcccataatgtcaagagcctggaagtggtttcaggagcctggaagtgaaatattgtgctattgaatgttcaggttcttagttgttaaagaagaaaaacacatagaagtgcrtttgaaggattcttccagagcaactcttagagagaaaccagagaattttcgctgtgacttccccgatgacgtgatgcagaacgaggagaaggaacgtgcccagtgcttttaggtttttcaggggagggctttttgacagggaaattaaaatggcctgtcgcctttgtcacctccatccacttggacagagtttgttatcttggccctgggcagctctttttataacagggaatggaaaagtttctaggctatctcatttgtgccacatctgatccagatggctttgcacactccaatt

SEQ ID NO: 3384 - DNA, 600 bp, Bovine  MMBT15779
aacagttttaaagacagcttttattttcctaagcagcataaattgagatttaatctgattatttaggtcagtttttatagatgagatttttataaagccttagcaaaacccatccatcttgctagtcattcacctgaagaatgtagaaatgaaaatttacttcattttatggatgtttctttaggttgctgctcctgctgctaagtcacttcagttgtgtccgactctttgtgaccycatggactgcagcctaccaggctcctccgtccatgagattttccaggcaagagtactggagtsgggtgccatcgccttctccattctttaggttagcttcctttttactgcagatcttgttttttttcaacagcatccaaggaccaactctcccacctgttaaaacaatgctacgtcatcctcatattttatgtaaaactcatctttaaaataaccactagatggcaatgaatcagcataaaaatgtaggtcttgcaggaagacactcattgttagttcaaaggggcaagaagagaaaggagatattacttaacacccttctctcctttggtatctatacagcctgggaaggatcctagaatc

SEQ ID NO: 3385 - DNA, 602 bp, Bovine  MMBT15795
  misc_feature (1)..(2): n is any nucleotide
nnggaggaactgtgggaggctcaataaaataagtatgtgcaattgtgaagacagaaaaggaaaaaaaaattacttccatcacagtccacaaagatcgtttccagtcccaaacatgggtccccagagatagcctggaaacaaattattgtcaaagagatgcttaccttttacaacagctcacagtgaaataaaacatatagcttaacatctctcccacactcacctttctcttgctctcttttttccttttattgtctctctctctcgcttccctttctttctgcctgatgctaaacttcrcrttctgagcccttctaccaattattggataagtcgcttgtccttcctaaacctcagtattctcataagcaaaatgaagtgtttatactatattagtactcttttacttctaagtgtgactacaggcacaagtttgctcaatctgctctcatacaattggtcgtattagtgctctaacttatttagttccaakatgatgactgtggtttcagcctgcacaatgaasaagtgaatttgttggtataattatgaggtctcatcttttggaaaagtgagatcaaatggttaagtgaagtcacttg

SEQ ID NO: 3386 - DNA, 600 bp, Bovine  MMBT15861
tctttgtagaagacgctcttacttctttccctctctctccttcccctcttcctttgcttccaccccgtacccccaccggcgcccagcttttgcgtgtcagctttcaggagcatcttccagaaacaacagcaaagagagtcatcaaatgacatggaggaagcactcctttcccccagttacggcctctgcaaagtcccagattcttccaggaggaggagcagaccttgggggcatagctggaggtgcaggtcacacctgagccctggggcccttgtttgaagcccctgtaacttagaactrccagagggtctacagggaggctgtggtcttaggtttatcactttttccagctttattgaggtataactgacaaaaatttaaggtgtataatatatcacttacactgcaaaagtggaaaagtgtgtgtttagagcaggcatctgaattgttggaacccttagctgaacttgaccattcctggtggctgggaaggacctggactggccgggcctctctgagctggcaccccgggccccccggggcccacggtcccttgtcagggttcaggctatcctctcggtgcagctgtcgttaagtgaa

SEQ ID NO: 3387 - DNA, 600 bp, Bovine  MMBT15863
tgtgtctcaggctgactctggtcacatcccatcccccgatgatcccctgcttctgtcctgcacccgatccctggtgggtctgggcctgcagccccctccgccagcaacatggggacccaagctggctggtttggattctgttgtttctcttacctttagatgttcaacagcatgaatattcttattttttatttaaaactaatttggagttctcactctccaaggggcttctaatcaccaaaaagtgcctacggcaagagctgattgacaggccagcgtggccacttctgaagaacaaaytggccattggcagagccacatacaaaggaggacgcccagggctggttatttatgagctattagggaggcgcagtcagcatctgcttcccacatgggcaaaaacacctgtcagacatcaggaggccataaaacacacacatttaacagttactttgtttaaaaagtcattaaaattgaatgtcagctaaaacttgggaaaacatttattcttcaaacccctttgaatcttgctggtgagccagagacaggactgtctctaactcaacaaagacatgagtgtgtaaacaggcaggcgaggcc

SEQ ID NO: 3388 - DNA, 600 bp, Bovine  MMBT15866
aatatacaatgagagagtaaagagacaatgtgttaaaaagagagraagacaaaaagtaagcctgagaatgattaggatgggaacaaagcyatctctgccttggttttgggcagcctggctaagggtactggaaaaatgtgtaatgatttgttggttacagttagagaaaagattggccccattgccacaccggattacatccagaatgcacctggattgcctaaaactcgctcaggtatgttcagaggcctctagggattgggattggatgggccaaggcccactaggggcgagtatgcrtggatggaagcttttggcagggccggagtgggtcagtgtgttgtcaccaggtaaccakaagcgtgtggacccccagggaaaatcatgaggcgggtgcttcggaagatcgctcagaatgaccacgacctgggggacacgtccactgtagtcgacccatccatcatcacccagctcttcagccaccgctgcttgaccatccaatgaataagatcctgcctggaacccaggattaccccctgcttggctttccaaagttttgcccaccctccctgcccccatccaggagtgctgagggccagt

SEQ ID NO: 3389 - DNA, 600 bp, Bovine  MMBT16074
ttttatattatccttcaaatagtgttaccacctactctttactgaaacccaacagacccaactcacagagtaaaactgcaagagtttaaatgcgaaggtcccacccaaacctaaaatagcaatttaattcagggcttgctggttaacactgcattaacacgccactctctgttgggttccctgctccatttgctgggctggatcccatcttctggtgacttacgcagtacgcttactggagagagtgaaagtaaaagtaaaacttgacactgctgaccttcctatatactctgcttggtrtattactgcctctgtgaattttcctgtttatgagcccaaacatcatcatgtgtctttacctgtgcaaaaaatctacctgcttcaaagcattcaacattctgcttatagtatgcaacattattttgaaaacttttagaggaaaccccaaatcatttgcaaacaaattctaaaattactaccaactagaataagcctatcatttgcttagaatgaaggaatgcaaatattttcaagcttaaaacaccaaaacratgaaatacactctacagacacttgtgcaattttattaaaaaaattaaa

SEQ ID NO: 3390 - DNA, 600 bp, Bovine  MMBT16085
gtcttttaatttctccactacccatagaaccttgtaaagtggttctatgtgtagaaaaaatactcagtaaatgtattgatcatgaaaaaaattcaataagtgccttttggaagcttgatttaaattaaacagtgggtgtaaagtaatagtggctagaaaatagaaggtgtttaacagatggagtctgtcacaggcatttataagaaggaagcataaaggaaggaagttagtttcctaggcaattgttaaccccagatcaaataggaggtcgttggatcaccactctaggttatctccacrgtcactgcagtgcagaatcttgcttgagtccaggacactaaagggaaaattaggagaaaacagagttgttctcctagatgtcaacttaacatcaccctcttcttccctggtggctcggacggtaaagcgtctatcaagaatgtgggagacctgggtttgatccctaggttgggaagttccctggagaaggaaatggcaacccactccagtactcttgcctagaaaaccccatggacggaggagcctgrtgtccatggggtcacaaagagttggacacgactgagcgacttcacttcactc

SEQ ID NO: 3391 - DNA, 600 bp, Bovine  MMBT16181
tttagtacatttacttggaattttgaaacaggtaattgctctaatgcaaatcatatgttctgttggcaagtaaagggagacatgaaaatagttaaagaatacaactgaatgttaaacataccaagaggaaatttactctacatcactgaacataatgatcgccacatacaaattaatatgcataaaattttacacagagaataactctttacaatgttcaggtatctttttcctataaggaaatggcatggttggcaaatgatagttgatgctctatttcagtgaatatggtagtctaakttttagagattgacaaaattttaaccttgaagactatgtttcgcaagtttcacagaacatctgcatatatacaattcctcacagaattttagcatacaactgatgaaatgcatataaagagatcatttatcagttttctatgttaaggaaagaaaaaaacaatgttcctaaatgatcttataaattacataaataaaagctgaaatcctttgagagtattgaatcatgattaacaaaatccagggtttttaattttttctcacagcaccaatttgtaaagggtgttatttaacaaagtga

SEQ ID NO: 3392 - DNA, 600 bp, Bovine  MMBT16297
gttaaataggaaaagccagtaaagacaacatgggggagagagagtgaggtacagaagaaactgagagtgtgtagtgttacaaaggctaagggaaagagtagctcaagaaggacagagtggccacctgtgtaaagcactccaagaagtcaaggggataatgaaaaaaattgtcagttgaattccacttcctgtctattagggcaggtgggaagggatgagacccagaggacatggaaaaggattagctttggtcaggagaaaagattcctcctcctttgcaacagaagaatgggtacagayataggtaggtttgtaaattmattgcaaatacattgtgaatttcycacatyagaggcaaaataatctgctaaaactgagaagagaagccaargagtctagaagctttgaagtggtaaccatggagagcaggtggatcagtcaagggaaacttggcaggatgtatgagcagtgttgagctcccagttgaggctggcgatcatgaaactgtagtgataatcatcagcatgttatgtgatatttcccctgcacttctcagctgcctgatgcaatcacagaaaagacagatcgctagatgagcca

SEQ ID NO: 3393 - DNA, 600 bp, Bovine  MMBT16310
catacatcaattctctcaataacgcatccaataatcatgaatattccacctttaatattcaagaacaggctacaggatttgatcaggattcctgacttttcacatgtggctcgtaataacaacatttattcaagggcttaccaagaagaatcaggaatgttctcctttatcccattatttattagacgtgggaaaaggatgtgggagagagtaggctggtaagaaagggatttctttctgcttctaatatcaaagtatctttcctgtcacccaggttgcccacaactgcctctgacctcrgctctcacatgcttatacccttgctcaatgaaggagatacattaccatgtactaacccgaacccaaatgcaacgagagatgcagagttccaaatgcggctgttctcacctcccagtccaggtaatcactggcatcctcaaagttagtaaggagggagacagagcagaaaagtttaggcagctcctctcgggtcagggggggaaatcggctgtccttaagtgcactggaggggacagaaaacatgagtgaggctgctccggaattgggagccaatatcataagcctgaaagtttacggctc

SEQ ID NO: 3394 - DNA, 600 bp, Bovine  MMBT16328
tggtttttgtctcacacatattaaattttacaaaacagaaagaaacaatagagcttattaggaaaaacttgttttgaatagtaaattaagcataatggaaataggcacatgttttagcacggttttccccccttttttaccaattgaacatttacatctttttcaaagtgctgtgattttccccttaagctggcaccacacactttcaataaatgagacttayatcacttgtatttactgagagaaatcattgtaatactgtaggttccaaatgcacagctttctgtaaaaaagtagttktaagtagtcacccctaattgtattaatcaagtcattgtggcattctaagaatccaaagaactacctaatttcaaagacagtgtaaaatcaactgtcagttctgactaatttcaaatgatgccctgttcttgagactggacacctgtacatttaaaggtgcacctgactgcatggtttgtttttgagagatgttccccaggtggaggcatctacaaagtcaatatattttctttataactggtgtcaagttgatgtatatattaaaaaatcttggaaaatgatctcaaaaaggaagtaaca

SEQ ID NO: 3395 - DNA, 598 bp, Bovine  MMBT16394
  misc_feature (1)..(60): n is any nucleotide
nnnnnnnnnnnnnnnnnnnnnnnnnnnnnnnnnnnnnnnnnnnnnnnnnnnnnnnnnnnnattagcctacgttcctgtgaaatggaaactacctttatttagcgattagctctttctttacgtagcagttagctttggttattttaatttacagaaacgtcaatgatgataatctgccatttctcccttgtatgtacattatgtaccatctggtctttaacctgaaaatgtctacactatgaatcatctttgttaggtcaagcaatggggataaaaatgcacagtaacttactgcagaaycgaagaaaggcgttcaaagagaggtaccttcagcatcacactttgagaagtagtgagagtgcaaatacttttggtgacctaatccccattccatcccctttaacttayaccaacaatgttaaaaataatttttaaacaagaacgcatataaacctctgaagaaaccagaagaaawagttcaattcttcccctatcgcatgttttcatgtagttttatttcacatttggaggtgatattattccattaaacttagtagcatttggtcttatactamgayaagatataaaagtagaaggg

SEQ ID NO: 3396 - DNA, 598 bp, Bovine  MMBT16403
  misc_feature (1)..(85): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnccttgacgtgccccttttcctatttggaaccagtctattgttccatgtccagttctaactgttgcttcctgacctgcatacatgtttctcaaagaggcaggtcaggtggtcttttatctttttaatatcctttaatattagaggagcaaaaactacaagtatatttttggcgatttggtgttatatggggctatttcatttgaatatgtttttcsttgccaccaaaaaaggatcaaatatttaatttaggagaactgcaaatcttagtgttgatgcagattaaatcatgaaacttttcctgcagttaacgaaaagttttttttgttgttgttygttttttaagaaatagcttttgattgcatttcctyttcttttccatttgaggaaactctcggattaaaaaggatgaaagtcagaaaggacctacttagctatctttagtattatgtttttattagtgtaaattaattagggtaaaatcagataattcaaacagcttttaaagattttata

SEQ ID NO: 3397 - DNA, 598 bp, Bovine  MMBT16514
  misc_feature (1)..(104): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagcttgtatgtgagcatacagtaaacacatgctgctctataaatgttggggctataagttgcctacttggctgggtttctttttgttcccattttaagagtcgagctgaaatgatttcttgtccattgtctcatggctggagcagagttttttgtctaggcatgagcasttttcagttagaatcattcatctrctttctttgaagagtctagacaccctgcacctctcacctagaacctatcattgactcttttataacattcatttcccatcaggaaactagaaagctttcaccaaattccatcaaggatgcaggatgcctttattctcttcaccctcctgttttccaggttccaagctgcagtagagactattctgctcaataatacatgttctcccctgagccactaattcccagaaccctgttgcagctaagagtggccatgggctaggttctggccataggaacatgaacaggagtraagtctatg

SEQ ID NO: 3398 - DNA, 600 bp, Bovine  MMBT16583
tgagctgcccagcaatattttcagaggtatggatcaaactttataaccattgagtagcaggcagaaataaaatcactgtcatgtaaatattcagtaaatacttactgttaaatgagtggtgtgacagattatatataataaacaatttcacaagattctatatctagccatagaataaatttctcattacattagaaaaaattaaaagtgggaacaatatttgaacacaaaaatcctaatgaacatttaactgcattttatcttgtccaggtacttttgtaagcagtggactaaaatatrgcacatttggagtaaatatsaataagtaggactatgctgaattatttataataataaagttaatatcttataatttttctattctcataatactttcaaggttattcatttttataccagcaacctaaagcttctgttcttgcatataataaacattatgtctgagctatcagagtttagtcatggcctttaacagtaatttctacttatatggctcagaggtttaagtgtctgcctgcaatgcgggagacccagggttcgatccctgggttaggaagatcccctggagaaggaaatggc

SEQ ID NO: 3399 - DNA, 600 bp, Bovine  MMBT16671
tttaaaatatatttgtttatttggccgcactggtcttagttgagatgctcaggatccccgaccttcattgcagcgtgcagggttctttagttgtggcctgtgggatttagctccctgaccagagattgagcctaggccccttgcattgagagcgtgaaggtttagccactggaccactgtggaagtcccaaaaagaactactgtaacacctgggtgggaaatacaccyggaatacgaagcgtgttccactgtgagcctgaggatggaggtggcgtcttttgttggaaggcgtttaatagygccccgtagcccggagryggcaccgtaccrtgcggctctgtgtgcttgtactctgttacctcccaagcgctgacactcaccttcaccaccttcagtctcagcattttattcttagagtctagaatgtcaggcacatttctctcattgcgtgcaaacctccaaattatgctggatcctgggagcagtggggaaaagattgtctggcgccttcatttcagaacccctgtgtggacacacagaggtgcacctccgttcacagtgcacctcgggtgggcgtcttgtggcagaagtaagggggag

SEQ ID NO: 3400 - DNA, 600 bp, Bovine  MMBT16702
aggactctggaaactaatgagagccaggacttctattacagtcagctccttttagcactgggagcctagtctaactccaagcacatcagcccagcaacccccgccatctgggctccttcaggcccctcccccattcctactcctttttttctctaaacaaaagacttcctacatccaacaccttttgcaccttattctgtctcctcttctactttgctggcaaactggacttactaacaaatttacattgcctgttggaacagcttcttctgcctccaaagttttctccgcatagacgtrgagcatcctccattgctcaaggcatcaccagagagtctgttgcgccaggctaaacaaatctacaagcacactccctgtcagattcttgtcagaaggacagagtgaaatcttgtttttgagtgagcgtcaaaacaaatctggaaaaagatgccactagcgtcttgtggccacagttcaaagccccagaagggccgcacagggctcaaagcagcaccccgagctcttgagcaccaagcacaggcagttgtgtctttgctcacttcatgctaaccgcagggagacagcaacactgagctctgt

SEQ ID NO: 3401 - DNA, 600 bp, Bovine  MMBT16715
ggaaatggcaatccagtccagtattcttgcctggaaaatttcatggacagagaagcctggcaggctacagtcccatggggtcacgaaagagtcaggcatgactgagcgactgagcacaagcataacatctaccccagaggctgcattgggtccattggattctctctcagagaacactacaattggtacaatcagatcaatcaaattcagttactagacttgtaaaatgaatgatctcaaatatagaggtcactttgaggggtaagtcaagatgagtctgtctctgcaaataagcagagyatattctctaaagacaaagcagaaaacatgcagggagagagaaggtgtatacacacacagccccagagaaaaacagatggagagggtgattgcctttattatagatgacttctcaggtcctgtttccaattccacataaggcatggctacagtttctgytcttggctttcgacagatggccattcttatttgcttagattagttgtagtggatttcagtttcttgcaaccaaacaattgctggaaaagacagccacctagggataaacttcagtcatagaggatggttagcatagtgcag

SEQ ID NO: 3402 - DNA, 598 bp, Bovine  MMBT17324
  misc_feature (1)..(40): n is any nucleotide
nnnnnnnnnnnnnnnnnnnnnnnnnnnnnnnnnnnnnnnngtggtacgtcctcagtgtttgtttagtcttcatattatgattcctgtccaagagctatttggataaaaatgaaaaggtcccaaacaaggtccttgaactcagatcactcccagggagcatatgatgcattgaaggtatgattatatcagtacttaaaggcatatgccaaaggaatggccygacaagaacccaaaacatggcaattcagccacatctgttcttgaaagcgcctgcagaatgaactttttaagaggtatcayctgtcaagattcctcgactgtccctctggaagctgtctctctggaaacktattccaaaggcaagcccaaggacctcagcattccagtctttgataaataagcccctctctctgatagcctcagcaacagataaatctgtccacccaaggacattttccaagcgggacgggctgtttmaactccttaccagattgcagctggcacccgccacgttgatttttccctctccttataatcataatgggatctcagcaataaagatggatttgttaatttccatccccttctcactttctct

SEQ ID NO: 3403 - DNA, 561 bp, Bovine  MMBT17356
  misc_feature (1)..(1): n is any nucleotide
nttgaccacactggtacattgcactttctctcttctcctctgctctctgctcctctcttcttctcttgatatgtgtacgcagttcttaacactcaataacaatggctgccacttygctgcataaccttaggaaacgtgagaagagaggcagcagcgctggggtttcttctatctaccatgagtccaaaggcctatcattaccatcaaactcttctcagaaacaagtcacttttttttttaaaggtgagctccttaagggaagaaactaaactttacttacctggtgaatagatatgaaagrtattaaacygaaatccatgcgttgccatcaatcaatagctatgtgtagaaaagtaaattattttmaagagctagctgaatccaggagcagctttaattattaaaactaatggaagagaaaatacttgcaaaggctcaaatggaagctctactcagtctggttgggtgggaggggggaaggtaaagcttctcatgcccaagtcttcataacacatcatccatttccacatgaaaaccaagactgccagatacatccacaca

SEQ ID NO: 3404 - DNA, 600 bp, Bovine  MMBT17368
gggacacagagagatggagacttggtagcaattgtcagtgtgagatggtggacacatatgacctcactgcttacctgacatcattcagttcgtaatagacatttctgctttcgtctttgatgtaaatggcgacactgggcgactccagcattttcatggtgagctgctgtggaaaggcacttacgaagagagcacggattgtgtctgcacttgtaatctcgttcggcatcctgagctgcttggtttcatctccgtactggagataaagaacccctgcacacaagatggacacagttatcrgccacagctcaagactcacaagacacacagcacaagctaagccacttccatccraccgcaggcaggaatgtgccagatgcgcttgcaaaaaagcatgtcacaagagacgtgaccttggaattttcaagaaacacactctctggttatgatgtaaataccttattctttagagtcaaggcaggtgttacagaggctcctttttaactatattaaaaaccaaaggacaagaagctaacccttggtagcctaaagcaaaacacaatatttaattcccttgaaaggtgtatttaggaatctgac

SEQ ID NO: 3405 - DNA, 600 bp, Bovine  MMBT17370
ttactgaccttaaattataacttgtagatatctttctgttctgtcattgaggcaggccagttctagttaaatatgtgctgaggtcaaagctgaatcacatctatacccaaatatagctcatctttctgaaaactgtggcctcttttcctggctgttgtgtgtacaacattggagttatttaggcttgtgaagagaagcagcctcctcttagagtaggtcagtgaaaaacactggcttttaaaataaggaagaaagtaggagtgtgcaaattaaataaagataagttgttaaaggttaacyagtttctcctggtggtgttataagcaaatggcacagtcattctctagttctacaatatttagatgttttatttcagttacatagtgggagctgagaacaaatgtgggtaaaccagatacaaaataccttcacagaacataagctaaaacctattcccttaatccttcagtgttgaatcatatgttctgtctggaccataaatgtgaagaatgccaaagtatctgggctattgccatggtcttgtacacgcacacacgcacgcgcacgcacacacacacaaggaaaagcacatccatgatg

SEQ ID NO: 3406 - DNA, 598 bp, Bovine  MMBT17491
  misc_feature (1)..(69): n is any nucleotide
nnnnnnnnnnnnnnnnnnnnnnnnnnnnnnnnnnnnnnnnnnnnnnnnnnnnnnnnnnnnnnnnnnnnnagccccaggaacccaggtatctcatcaattaatcatgcctcatttccttttttaaaaaatatatggtcattaagctgatgattcaaggaatctatgagtgctttatgagcacctaccacgtgcaacatattgggcaagtgccagactgccaggggtcagaatgccagaggcggtgtaacttgatttcagtgaggccttagacaaagcatcccacgattcactgataggtcrggaaggtgagtggtataaaagtataatgacatgattttgcagctgactaaagagccatatccacagaggattgataaataactggtttccgttagcaggaagttttccatcagactcatccttcttataccttgctttagtcagcatttttatatatgacttraaggaagaagataagcacaaagtttagagtcatagctaggagatgaaagaggcaagatgaaaaacaatctgaasagcatgaaattcagcaaggatcattattcagttgtgtattttgtttttttaaaatcggyag

SEQ ID NO: 3407 - DNA, 515 bp, Bovine  MMBT17563
acacgaagtaggaaagtaaagaactttgggttttttgtttgttttattttaaatggtcatagagagtttacatttgctggccttacatcaacaaagattatccaaatttactcatggagatcaaccattatctattaatatttttaatactgtcctggtcattggattataaagaagaattacctgaaattctctcaattcttttgtacatatacacataaatttcaatactaagatcatgcaagtcttgtggagactcctatgctctcatgtaaagaacaggccttggaggagaagctraagatttctttttgtggcctccagcctatcacttacacagctagtgattgctccctgatgtagcagattcagctgaaagcctgagatatggagaaagtgatgtctaaccctttctccatatcttctgataagacagaagttttatcagaagtgattttgtgctgctctgctatttatcatacacataaaaaatataaagttaacctaaatctcat

SEQ ID NO: 3408 - DNA, 600 bp, Bovine  MMBT17593
acagcagccaggagggcacgggccccctcccggggcccctgggtcaggaaggaggagatgggtgcacgcctgccaccaaatgaggctgggggccaaaggaaggaaccagcagagaacaggaggaggagaaaggacccctaatccccctacaaggccacaggaaaacggaaacaggtggtcagccatgaaggatgaaaccaaagctcttccatccacccgaagacacatgaggctggcccacagggcccaaagtgctcagccagggcactctggtccagaccaaccccaagrgatggtggracagatccctgctgcgtcatcagtgacggtcatagaaggcacttagcaaggtgcctgcatagagcgggcaagaaacgtctgctccatcccagctcctccaggagtgcccgggcccggcctcacctaaagtgttcacagtgaccacctcactgaaggcgctggtgcccagtttgttctgggccaggacactgaactggtacgctgtctcgggctccagggcttccaccagcagccagctgggtccyggaggcacgggcagggacagccagtcatggggcccaaactgtgcccgcttcatcc

SEQ ID NO: 3409 - DNA, 600 bp, Bovine  MMBT18004
aacaatagttgtggtgtgaatccatcaaattcctgcatccagattaaagtatccacacagtctacctttgggaactgtgtgccttttaaatccttttttaaaattacacagagaaagtcttttctatcaagttttaaacgtaaggctcttacaataatacaatccaatatatgtggtcacatttcactccctcaaatagattagcagtacagtggtttacatactttttggtctggaagcataaggataggtgaaagaacttcaagtctctgacagctttgtaattctcttttatctacrtagtttcttctcaaatttcctctcaattcctctacctattcctaagtatcattcagataggtcagaaactgtttatggatccactcagctcccaaaatcagtttcatgattatatccagtaaacaaaatagactgactcaatctcaagcagttcctcatcacaggaagttcatcctagaactgcagctacaaaagcattcttctaagcgatccccaactactaaacagcaacacaaagttaaactaaatcctactgacaaaaggctccgggtggattcattctgatcagccccaggagtc

SEQ ID NO: 3410 - DNA, 600 bp, Bovine  MMBT18014
cgagaagttcacccgtaagtgtttcctgtcatttcactgcaactttcttgataggattttaaaagtctaatgtttttcttcccttctctctgggactgaaaaggaatatggcagagcagatctcagaaagactattgtctctgaaacatggcaggaattccaatagcttaggaaaaagcagtggaagggggaaagtctttggacaagactcccaggtggtcagatgcctctgacctctgtcctcaaggccttagtaataatgacctgtcacatgcgcatctgcgtctctgctgcccagarcctggggcaggagccactgagtcacagtgatgccaactcaatccaagtgccccttttcacaatgccttagcttctctgctgccccatttctgcctcccacaaatggaacaagagtatctttaagtcagctgggacattccaggagacaggatgtatttcctaacctccattcatgtcccactccctgggtatgcctactgtttgggaggattgccttctaattggattttttttttccttcagttatccaggcatctgatgttggtaaggaaatttgtgtttctccctacatgttggcag

SEQ ID NO: 3411 - DNA, 465 bp, Bovine  MMBT18054
tcagactctggtgcgcacctctgtgaaatggggacacagggtctccctggggcagcatgtgccaaagtgtttaaaatggtcagtgttcttaacaaaggcggcagttctgtggccaaatgacttgggagattgttgcccaagacaacaccccaagtccgatcctttggaaattccaaggccacacctgggcagagcccagcaagaacaggaagccctgcagtccctttaggggagrccgggtgggggttaagttacacatgggcctgggcctctttcccctcctgagtgtccagactggcrtcctcaggcttcaccccacgcagggaggacagcatggagcttggcaaaggcctcccaagacaaggagtgagctcaccgtctccgatggcagctgggccatgatctacaaagacagcgtgctccgtgcttccagcagagccagagctctgtgccccaatgtcgggg

SEQ ID NO: 3412 - DNA, 600 bp, Bovine  MMBT18071
gtaatataaaattacatatgccagcttctttgaaatgtttggcaaatgtctagccaaaggctttaattacagttcactctcaattataaaaattaaaaggaagtatacttttaaaaaaatgtatatgttactttgaaattctctgatttaatattccaggaatttacaaatcctgacaacaaaaattataaaaactttgaatataagagttaagatttttcctattagaaattaaaactctttatcaaactgattaaaataccagcctaaaatcataattttacctctaactacgccttyggagaagcctaacaacatataatttaaaggggtaagattcactttagtagacacgttaccctcacaatctgggtgtgctgccgctccacggcaaggtggagggccgtctgctggttcacgttctggatgtccaggtttgcgtttccctgaaagamgaacaaggcttacagttaaatgtgacaagagggaagcacataatctagctctctatgaggaagccataacactggatgctgctgagcacgccccctccaagggctagaccttgtaatatatggtaacagatgtgaatagcaggaa

SEQ ID NO: 3413 - DNA, 600 bp, Bovine  MMBT18089
ctgggaagtgctggtcagcactgatctctgtggtaaattttctcctctttgccttccatgcacctgttgctgtactcccttctgagggacataccttaaactttaaacaaaattaaggataataggataaaatataaaataaaaacatcatgagatccttcccaggaaacaatattcttgacaccaaatcataacattatggacttcagttgtttatttctttccagggcagccccttgttttatatcccaaatagcatttccctaaatgcatgaaacaaaatgccattatgatttctarcattcatttccagtgaagtttctgttaggttcaactataactatgatggaaggggtggatgtagagcactgtgtcttcatacatcaaacaaaggattataggagttatatctacatagaacaggaaactaactggaggggtaatgtcaggttgactttaaaatgtcacagaaaatgatccgaattttcaccttttttttcacaactcattttattacaaatctgcagagttaggaagtttctacctttgaccaactttatttttcttactgtcttttggtcagaactaaagagacaagac

SEQ ID NO: 3414 - DNA, 600 bp, Bovine  MMBT18168
tagatggcatcactgactcaatggacataagtttgagtaaactccgggagttggtgaaggacagggaggcctagcatggggtcgcagagttgaacacaactgagcgcctgaaatgaacttaactgaagtataatcagtaaatattagctcataggagatcataattttagacttaattagaggtggtttgttgttatacagaggctatttagagtcagtaaatgaattcagtttaattttttattgtcagtctagaaagttgggctctggcctttatcacctgccagaattagggaagarattttaagattagttacatgagactgagtttactctttaaaaggtgatgttggagaagctgaaagggcagtgaagctgaaaggaaaagaagtggctaattagctgagattgagggatagcagagcctggtgggcttgccatctatggggttgcagagtcggacacgactgaagcgacttagcagcagcagcaggatcacttggagtgggtgggcaggaaccaggcaggactcctcacctgatagcccaaactctcacctgcttactcaattttctgaacattggaagcagcacaagtgcc

SEQ ID NO: 3415 - DNA, 600 bp, Bovine  MMBT18348
gaggacactccctctctgggcatgcaaatcgcggggggaacttcagccaatagtccccggcttgtcaatcaagggcagcagttcctggaggccagaaaggcgtgggggcgctggggcacggtcstgatttcctgctccgcacgtgggcacgtccagacccggcctgaggagccggagctgggacttgcctcggaagaccgcggctaggctctacctggtccggctccaggagcatggccccggcctctctcctcacagcaccagtcaggacccaagtccacaggttgaaaatgtgagagrgaaaattagattaaataaataactctgcatttatatccgaatagagcatagcgagtaaataagtatgcattcatatccgaatggagaataagtatgcatttatatccgaatagcaagtccgcgctacaaagcaaccataggcgcgatccccaaatgccagctttgccaccagttcatcggagacttggattcagcaatatttgcaaggaggaagaaaccccactttctctgcggagggaagggatttcaagctctttgtaaggcggtctcaagctaagaagcaaatgtgggaactcggtg

SEQ ID NO: 3416 - DNA, 598 bp, Bovine  MMBT18693
  misc_feature (1)..(9): n is any nucleotide
nnnnnnnnntatcaaattaggtcaagttgaatccttatccagtaaattaaagggctctccttaaaatggctatcaaaggagtcaatgcagtaaaattacactaaatggtataaaaaaatgatcctaatattaagagctttttcagtccttttaaagcaaaatcttaatatagagcaggttttagtaacaaaatcttccctcctccgtccatctccctaaataaaagtaacgaacacaacctctgaagaccatcaacaaattttaagtaccactgaactgtaagatactaaaaggaaagcrtttgtacaggatcacagaaggcagtgtgtgtttatgcacagcacactaccacaggagatttacatgtccacgaatacaacttcaaacaaagaaatataaatatttgctactattacccctattgctaaaagcaagacttgactttaggcaacagactgattctaaatgatcaaaatataagattggtttgggtgatcatttttaaagtgaaactcaaaaacacaatatgaaaatactctgatataaaaatatccatgtaacagcaatacaaggtcaaaaaattcaacttaaatgtagc

SEQ ID NO: 3417 - DNA, 600 bp, Bovine  MMBT18695
acatttaaactgctgcctgcctgtgcagcagctgaggaaccgtggatttcatattacagactaaaaccccagtgaaacggctcagtccttcctgcagctgccaggcaacgacgagagagttaaatcctgctcytttccaataccatcgaagcactccattctagctctggctgctttacattgcagctcagggttcttactagaaatatggatactgaaaagagaatagagcactgcattgtccggccaggaagacagcagatgtaaaaagcttcaatgcatcaactgtcagaagagtcracagtgctccaaacagaacgaaaccaccacagctcttttgttaaagagaaaatgaaaggaaagacctcagaagattagcacccatatgaacaaggaagggtactcgaagacaagcagacagatggacactttggacatgtgataagcaatcgcaggaggcagactgttgggggaggtgtgtgtgttcgatagcgtctttttgctggagcgatggcgtgccaaaagtatcttcagtgggcataatcctcgccacataaatggcctgaccaaggaaggtatgtcgatatcttgtgtgtgata

SEQ ID NO: 3418 - DNA, 602 bp, Bovine  MMBT18779
  misc_feature (1)..(2): n is any nucleotide
nnagtgatgcggstttgatccctgggttggaaagatcccctggaagaagaaatggcaacccacttcagtattcttgcctggagaatccccacagacagagaagcctggtgggctatagtccatagggctgcmaagagtgggatggacatgactgagcacgaacacacacacactgcacaatccttcatctcagargtcacagtgtacacacagacctcacctggagtctcagatgtgcctggaccatgctatcctcatcctctatcctccatactctctayaccayacataggctcccaccygcctgtgaagtcttatgcctcagtttcttccactgcacccgacaaacatcccacccataggtcctcacaggacaacacacacggcccctttggagcatcaacagccagggactgtgtcattaagctgctgacaggtggtccctaccagcagctaccctccccccacccagttctgcatgcccagccttctgccagagccagacagtaaagcctgcctcctggcaggcctggccaaaattgtcaggaggttgatgatgtgtctgaaaaggggggaaaaaaaaagacatgatttggaaaata

SEQ ID NO: 3419 - DNA, 600 bp, Bovine  MMBT19076
ccatggagctattattccgtggagaaatcatctcagttgacatggtcagagaaattagaaattgtcaaataggagttctcctatgatcaagactgtaaaacctgctagaaaaattaataggctcttccaagataacttactaaaatgtattcttaactgcactactgtctttttctaccatgattcattgggtatagactatagttttcttcatttgtcccttgtagagattacaatcagcatttggtttagaagatagttttacaaatgtttgccttaaaaattgctcagtgcttaggragctttctagatggtgttgctagcctttttctagccgagtcatctttttttcttactaactcatatcagtraatttgttcacaaaagtagaaacattgcccatctgtaataaacatccctgagtgcagtagccatcaccagagaagagcacttttatagatattgtgctattttcaggcttgctgaccttttgcctctttattggttgctatagtgatgatctgagctctgcttaatagagctttactaaaatgaaagcaatcaataagctttttaactataatgtttatattgatagtt

SEQ ID NO: 3420 - DNA, 600 bp, Bovine  MMBT19160
tccgtgcgctttgcaggagacctacaaactgccgcaccggctcatcgagaaaaagagacgtgaccggattaacgagtgcatcgcccagctgaaggatctcctccccgaacatctcaaacttacagtaagtgagaagctggcccctctccaaaccagctcctctgcccaaagggcgggcgagggtcacccgccgcctgcaggctctgccaggaactgcagaccagatggctggatcctagctagtggctggctctgtttgggggtacccttctccagtctcagaattttctggcaacctcstgcaaatgagataagaatcatttgtacttgtccagcttggcaccaacaccagccggccttcctttgctagagtttaaggtgattctcagggttctccttttcccacattgagcaaatccagcaacccactttttttttttaacccccttccccgaatccctttttaaaataagagracttgttttgatgtgtcccttttttttttttacgtcctgtcctttcttggcgatcctcaatagattaytagcgtggcagcctttsgttggggaaagaagaaaaaagtagaatttaggagaaaaa

SEQ ID NO: 3421 - DNA, 600 bp, Bovine  MMBT19161
tggggatggcaagaaggcctgcttccagggcagatcaaccccctgcctttggctttcctgatcccccatcatgacagtcctgcgtctaaggacaaatccagtttctgtgttgtctgagaactcttcagaaacctcaaccgygagcacagaaaacaggactttgcctccattccacacacagcgctgggaagaactgcctggggacaagatttctgaagcatctgcaggagcctccacactctctgtcctctaatcacccccaggacgcagacccggggctgctgcctcttctgtcacagrctcatagatggttttgtgagggaaagaaaaattctctgggaggactagactttcctcccaaaacaagtttaaaagttggggataatctacaatccattcccagtgccaagcccgcaggagcagcagaagcaaacaaccacaaagtcactgtctctggattaggagagtgcagggagaggcctcagagggcaaggcggtaaagccgaagatttctttggcttctaagaaaataggcaatgtgaagaagaagctgcaagaggaaagaaacagtgacagaagccaagagcctaaacccaaggg

SEQ ID NO: 3422 - DNA, 600 bp, Bovine  MMBT19164
acagggaagcctggtgtgctgcatgcagttcgtggggttgcaagagtcagaaatgagttcgcaactgaacaaaaataatacaggcgtgtgtgtgtgtgtgtgtgtgtgtgtgtgtgcgtgtgtatgtaaagtcccctaaggcttggggaagcacaaagcacgacactaggattagacacacctgccttaagttaccacccaggcactagcaagctccccttcctccgttcaatgccggagagtgggtaacgtacaggagaaaacgagatgaaggaggtaaagtgcttgggaaagccctckccttggtatgcgtgttataaaagatagcttttgccctcctcactgccaacagcatcgtcatcttatgcgcaaacatgagtctgaatgaccacgagaaactgtgcgatcaagttaagctcacggagtccttcaagtatccccaagaggtttgctgcatgggaaagagagggaaagccttagccagtatcacactgcaggtggacatttttagataccaatttgatggtagaccaaagacaaaacaagttgctaaaataacacactagcaacccaaatgcatctgttagagtctcaacctgc

SEQ ID NO: 3423 - DNA, 600 bp, Bovine  MMBT19354
tatggcagatgaggaaactgaggctttagagagatttaagttagctggccttgttcacaaaagttaagtggtcaagttgggatttaaacaygggaggcttggctccaacattggttttcttaacacacagcacaacacagccactttctttgagaaaagtatcaggaaaaaaaracrtttgagaaatcatggagaaattgtataaagtgaattaagagtatagggttaaaaagccaggctttggcatccaagtcttataatttcatcaccttaggaaagttaccacctccctgattcttrgtttattgtctataaaaatgawataaaagctaccttgcaaattagtagcaagaaaaacagatgattaaggaaaaccttggtagcagctcaataaatgatagtcattattattactcttttgaagttttgcagacaggtcaaagactccagtcatacaacttccctgttttacttgtttttaacctaacagtcctaattaatgaagaaaataaaatgttgataaaggaaaattgaaacaaaagaattgatagtaatgagggctatcaggtgcatttttatatcaacatagccagaagaggg

SEQ ID NO: 3424 - DNA, 600 bp, Bovine  MMBT19528
gcagaggatttttaaatatagcccccaaaacagactgttagactttcagctgtttctatgaacaagtaatgtgtgaaacagacatattcatcccattctattataaaatctctccacagccttgatcctcattctgttgtacatacccacccctggggtaacaaacagggatcacatggggtcacgtggggtcagaaacgggatgaagacgagggatggagtgacrttaggcatggtctggcagacaacctctaggtgaccagaagttacacgcttactacacttactcatctcagagtsggccagacatcattcttagcaaagtgctcgcttattctctgagaattcatttatatcttaaacgtctactaaattgacagtgggcacactgttctttggaaggactgatgctaaagctgaaactccaatactttggccacctcacgtgaagagttgactcattggaaaagmctctgatgctgggagggattgggggcaggaggagaaggggacgacagaggatgagatgaatggatggcatcactgactcgatgggtttgggtgaactccgggagttggtgatggacaaggaggcctgga

SEQ ID NO: 3425 - DNA, 600 bp, Bovine  MMBT19674
atatgtagtcaatcgttcaagaagttcttttttaaaaatatattttttaatttaataaaatagtacattttaagtatataaaatttccactttaaaaagttaaaaaatatatgactttggagtaactgagttttccagcagtctatcatgaaaattttcaatatacaacaaaggataaagaattgaacaatatatattcatataccctactaactagattttaccatcagaatttatttctactttgccctagcacctattcattaatctattttaatttttcatcacgttatcactctyttcagacatcaaactatgcacttttagaagccttttttcattcaatgtaactctgagattcatgcatattattctgcatcatttttattggcacaaagtttattgaaaaatgggaggaaaataaagcattttctctccagttttttaaaagataagttttgtttttctaattataaaaatgtttattttagaaaatttcaaagatatagaaaggatgataacatcacctacaattccatcaccccaaagtaactgccatgttttttggtctgtactcttcagtccttttactgagctttt

SEQ ID NO: 3426 - DNA, 598 bp, Bovine  MMBT19706
  misc_feature (1)..(38): n is any nucleotide
nnnnnnnnnnnnnnnnnnnnnnnnnnnnnnnnnnnnnnaggagcctggagggctacagtccacggctgaacaagcacgcacgttactcctggagcacgactgttctagtaagtttcctctttcttcaaatattttggagacttttgccattttctgttcacgtactctgagtagacctcatgactactatccactctgtaggatgctcacctggtacatttcacctgcactctatctgatttattgttatcatatttcagaatgtggagtaggtggatgaacacaggaagcggctgatcrtttgtgtggtctccagtccgctgagcaaagccagagaacgttggtcagaaagaaacaacaggggcagatggagggcattggctaaggaatgtctaaytctttgatattaaatgagcaacttgaaatatacatcgattacaaattaacgtgcatttcgatgataatttccgacccactggctgatatcgctaccatccacctgrgatattgctaccccwgtggtgtacatgtttgtttaaaactagtttcttctccttcctgtcaaaagtcagtaaaagggatgggaggagtgggtggg

SEQ ID NO: 3427 - DNA, 600 bp, Bovine  MMBT19887
aatcccataagagcacaaaagaggttttttcatgaaagtagaatttcagaagtaaattggaattgatctgctcttagaaatgaaaagtgtttgatccagaggtttactattatatttaaatcaaacagtgcttgaagaagcagtagaaartctatcaaaagcagaggaagattcccttccctttgagggttatgactcctttctggcaggaaaacagcaatcagccrgggagccactatgtacctgctcctttttgtgaatgaagagaggctgcaaagccaggaaccagagcagagagayggctagttgctttcttcttccttcctgttatctagaagcctcttccttgtagtatcagggcaagaagatggacaggcaggtggtaggccagaaaggctgtggctggcatgagatacccacagagcagcagttccctgccagtacttggggaaacctgagagttracgtcaaacttcctgcaatcctaggaagggtctgattccaagaaaacaggctgtgatgagtaagaaaccagtgttctgatcaaatatgcctgcagattaaatagtgaattgtgccaagatttgtgagaaaggtgac

SEQ ID NO: 3428 - DNA, 600 bp, Bovine  MMBT19913
acctgcccctcccctgaccatgattgttccatgttctcagcctcagggtccctcaatggttggacttagagactcatcagggctaactaggtgaatggattaaagaatcacacacacatacacacggatacacacacatgcacacaygctcataactggtctctctgtaatcttrtaggttaaaaaaaaaacaaacacactttcaatccatcttttcatttgggcttttttggtttcttgtcctctgagatgttttgagaggacacggtgatgctcagcatctcttgagctttttgaggygggaggataggcttggagggccaaaaagtcatctctctgggatggattgtgtatttctgggtctgaaactgtaaagtcggtaagaagtgagccactgagatgaagaagccccacccggtaggaggcaagacgtcacagggccctctcctatagcacgtggtctgtctgcagtggctgaggtggggggcatctttggctaatctggtgacccatgaagatccctcgaaggagagggtgggttgtggagaatacaaagggcagaggggcaccaggaaagctttgggagctgaggtggctctg

SEQ ID NO: 3429 - DNA, 600 bp, Bovine  MMBT19955
acccagctgcttcattctttctgaaactattagtaattgcccttcattcttccccagtagcatattggataccttctgacctgggaggctgatctcccggtgtcakatctttttgccttttcatactgttcatggggttctcttggcaagaatactgccaagagatgggttggctgttccctcctccagtgracygcrttttgtcagaattctccacyatgacctctacatcttgtatggccctacatggcatggcttcttggagttacacaagccctttcactacgacaaggctgtgayccatgaaggggatttagttatcatagtagtttttaatcattaaaatgaatgtatgtgtaaggtttcttctttacttatttcatatttttaatagaaaaaacttagaagactgctaaaatacatgtttttccgagactacaaatcaaagattgtcaaaggcattgacgaggatgatcttctggaaggtaacttaaagcactaaactaaaacttatgtgactcctgtatgctgatgacacatttatatagaatcaaagtagataactcccatcagagttcaatatatgtccttctattaaat

SEQ ID NO: 3430 - DNA, 600 bp, Bovine  MMBT19957
cagaaaaaatactatataaaatactacataaatagaaaaatactatataaatactgtaaatactgcataaaatatatataaatactatacaaaaaaggaaaatacctcacaaataactttgaagtctagaaaagaaaaaaagcagtattttatatatttaaaactagagacttttcaataaatatttgctatcaaggaaagaagctaagatttttaaggctcatgtgtgggtaatacaatatctagctaatacctaaactcaatttacatccaagagcttagaaataagagttatactaygttaaactatagtgaacaaatatcatgttttttaatgaattttatctcactgatttatgtatgactgttatggaatgatgttccgatttttttttttaaatgtgtttcctcctttctcaagttacaaatctaaggttctgcaattgtatttaaaatcttttagaggtagatacacacaaaagaaatacctcaacacaaatcaccatgacacacaacgaacccaaaaggaataggcatatatcactaacggcaagatgttcagtttgataaaacaaaatctgacctttaatattttttaaa

SEQ ID NO: 3431 - DNA, 600 bp, Bovine  MMBT19959
agtaccttacacattgcactttactctcctaatggtacttttatgtgaaatgcactttattgacaattatgtcttatcattcagtagaaaaagacaaattttacacctatgtcccagaatacttgttattccttgttctaatggaatgaaatttctaataattcctgagtaatrtagaaatatatctccttacattgggagaatgggaagaaagtgaaaactgttgaaaatgaaatgtgatgacctttgaacgytggatttcagagagacgggttcccaaagcagggtgcatctgtgagyactccttgtcatatttctttccatacgacatgrgttttcatcttatttccccyrcaaaacagagatccagatgctgctggattcattctaggcatatcatttccatcgtgacattcattattgctrcttcctgatgtagtcattttactctgattttgataataaagacaccatgaatatacattcgcttcctctcaagtctagccctgccctagaagggtagaagggaccaggcatcatctcagcagtgttttctcttgctctgtaattatttgcttccttgaaaaataaatcactagt

SEQ ID NO: 3432 - DNA, 600 bp, Bovine  MMBT19960
ggtacttttatgtgaaatgcactttattgacaattatgtcttatcattcagtagaaaaagacaaattttacacctatgtcccagaatacttgttattccttgttctaatggaatgaaatttctaataattcctgagtaatrtagaaatatatctccttacattgggagaatgggaagaaagtgaaaactgttgaaaatgaaatgtgatgacctttgaacgytggatttcagagagacgggttcccaaagcagggtgcatctgtgagyactccttgtcatatttctttccatacgacatgrgttttcatcttatttccccyrcaaaacagagatccagatgctgctggattcattctaggcatatcatttccatcgtgacattcattattgctrcttcctgatgtagtcattttactctgattttgataataaagacaccatgaatatacattcgcttcctctcaagtctagccctgccctagaagggtagaagggaccaggcatcatctcagcagtgttttctcttgctctgtaattatttgcttccttgaaaaataaatcactagtaattgcattaaaaatcagattagatcaaagagt

SEQ ID NO: 3433 - DNA, 600 bp, Bovine  MMBT19963
actttattgacaattatgtcttatcattcagtagaaaaagacaaattttacacctatgtcccagaatacttgttattccttgttctaatggaatgaaatttctaataattcctgagtaatrtagaaatatatctccttacattgggagaatgggaagaaagtgaaaactgttgaaaatgaaatgtgatgacctttgaacgytggatttcagagagacgggttcccaaagcagggtgcatctgtgagyactccttgtcatatttctttccatacgacatgrgttttcatcttatttccccyrcaaaacagagatccagatgctgctggattcattctaggcatatcatttccatcgtgacattcattattgctrcttcctgatgtagtcattttactctgattttgataataaagacaccatgaatatacattcgcttcctctcaagtctagccctgccctagaagggtagaagggaccaggcatcatctcagcagtgttttctcttgctctgtaattatttgcttccttgaaaaataaatcactagtaattgcattaaaaatcagattagatcaaagagtgttttgtttctggtaacctg

SEQ ID NO: 3434 - DNA, 600 bp, Bovine  MMBT20404
ggcaccactttcatctatttggaatctgaagtgtgttatcccagtactttaatatacagtagtttattcaccgaaaatatattctgacaatatttatttcatgtttgaataaccttgcctctccttcttgatgtttgtttccaaaatgtggagccattatagtagcctgcacgtctttctgtgaccattgttgtctcttcaaattgaagtacacagtcctagcaaactcagtaagaggtccagccagggaacaattttctaattttagactgtcactgcatatcgtttagtttcccctcrgatttctgattgagattgttacaagggtattgtaaaaggaaaaggaagaggraagctttctctgaatatgatatcatgaagtatataaacttgacttacagtgggaaaattttgtgtattttctccaatatgaaatgctatttggcacagtatatgtttcccagtgtcatgttgctatagaatagttgcctatttgtcagaagctatttgtcagttttctcagtatctgcaggtggtaagtatgcttcagaattcagagaaggaaaattgtgtgctcccagggattcatgcaagtgcttg

SEQ ID NO: 3435 - DNA, 600 bp, Bovine  MMBT20635
tgtacccttaatgcctggtggcctgaagggggccctcagtaagtgttagctaattaaatgcagaataactagtcaaatattcacagattaaccatcctaagagtcagtaaattcagcattgaaagcacaagaaagtacagattgggcttccctggtggctcagatggtaaagcatctgcttgcaatgcaggagacccaggttcaatccctgggttaggaagagcccctggagaaaggaaagaattctttatatattttggatataagttcctcatcagatatatgatttataaacttttycccccattatttgagttgtcttttcacttcctcgggttgtctttcaaagaacttttttttttttaaattttggtcaagttcaattcatgtatttgttttcttttttgttgagtttctgctgttatatctaaaaggctattgcctaatccttggtaacaaacctttattcctatttttttttctgaatgttttatagtttaagtgttacatttaggtctgttacacatggtccactttaatttttttacaagtggtgaggtaagaggccaggtttatttctttgtatgtgggtatttagtt

SEQ ID NO: 3436 - DNA, 600 bp, Bovine  MMBT20740
tgcggagcgcgggctctagggctctcgggcttcagtagctgtggctcacaggctccagagcacaggtttaacagttgtggtgtacagacttagctgctatgaggcatgtgagatcttcccggaccagggatcaaacctgtgcctcctgcactggcaggcagattctctaccactgagccaccagagaagaccctccttttgacatctgacattggaccttccttatgaccaggggcatagcaactaagagccaagagtttggcagacccagtggagaaaggctgacrctaaattcatttsctataaataaaagacgccawgaagaagatctgtatgagctactctactagggacttctttaaaaataagtgttttactatgaaaagagaagtttagactcttgagcatcctgcaaatagaaaactaatttgccttatcaatttttgtccactgtgcttgatccttgggataatctgtgaggcactgtatcagtctcacttatattgtagtcttttatcatatggatgcaagatatatttcttgctgtcaaaactaatcatcaaagcatacaagaaaaccaaagcaaccttatttacttcc

SEQ ID NO: 3437 - DNA, 448 bp, Bovine  MMBT20868
tggggggcagggatggataagttaagagtttgagattggcatatgcacrctaccatatatggaatatatggtcattagggacctatcatatagcacagggaactctgctcaatgttctgtaataatctccatgggaaaagaatctagaaaagagtagacagatgtgtatrtgtaactgaatcacaactaacacaacactgtaaatcaactataccctgatgtaaaatttaaaattttttaaatgaaagataygtcatgaaataatcacaaataaaataatgtctggaacatgcctaaacmtaatcacataatcaggagaggggatgaaaaggtgggagaagagatgaaacaactggccaggtgtgtatgtgtactgttgcatctgggtgacgggtaatggtgctcagtgtactgttctctcctgtattgtttaaaggtccatatttaa

SEQ ID NO: 3438 - DNA, 600 bp, Bovine  MMBT21319
gcggggctgttccaaatacaggttggaaatggttcaaagggatctgcagatggaaacaaggcttgtgtacttgccaagggatggatatcctccactctcattgccaacaaaattacttaatagtttttgaaatgcatcttgctttttctcaccttcctatctttgcccatgctaatcccagtgctttaaacaggcaccctctaccctgccagctctcagttctcctatggacttaaataattttgttggccatgaaagtggaggaaatataggcagcactttgtaattactgaattttcrtgtccatcttactagtttttgagtttaggcatcatgctttgtgtatctttataacctggtgtctggaaccccaggggcttcagtaagtttttgttgaatgaatgagagttggctgagactgagtcaatgacatctgctggcctcagctctcagagctactgctctgatgttcagccctgtaggttttcaagacaggatgggcatagtttcctccagctatgagacagctggaagcttctttgcaaatgacatagaggagmactgaatatttaatgcttaaaagttaaatattattataaa

SEQ ID NO: 3439 - DNA, 600 bp, Bovine  MMBT21735
cttatttttattatggacattatcgtgttttttattgcatataaacattgatttgtttcactgttcccagcttcaataataacaatagcagcatttatgttacaaaacattttttcttatgtgtcaggcattatacttgtaaagacttcatgttgtttcatgacattgccacagaaaaggtaaacgttagttccattttacagattgggaagtggaagctgagggagattaakaagtatcgaaacacacgctactactcactcaagtctcaaacccaatgcctgcttaaccactgtgctytcaacactttccattccaagcagattgcaggctgaaatctcacacacacatttttataactcattaactcaaatctctagtgttttccaggttgtaytaaggaaaattgggctatcagtttaggataatttctaggaagaaagtttttattggcgcttaagtgccttagacttatttcctattttaacaccttccatctcaataatcaaaaaatggaatttgtattcatttctccaagttgctgaaattactttttaaaatagtgatgtgtgtttcacagcagataatttctgcacctgt

SEQ ID NO: 3440 - DNA, 600 bp, Bovine  MMBT21905
catctccctctggacacagggctgcccaggtgtcaaggcccagcctggagctctggcccctgccacaccaggtgatagaggccttgaccaacgtggtcaggtccacaggtccaccccaccgggccctccaaagatccgtggctgatctagcccaggagactcagacctcaacccagtgccatgragaggggacccagacctccaaccagaggcccactggtcctacccttcccctaaccctccatactgtctttacaaggctgggcctgcacttttggggggaggggggtaagaaaagcrttctgggagtttcttggacctgcccattccctatctccccctatttatctcccttttcttccatcccctatctcctcgttcttatctcccttttgcaggtggcagattttggcctgtccacatttcagggaggctcacagtcaggggcaggatctggggagtcagggtgcaccccagcctacttggccccagaactgttggctaatataaaccagaaagcctccagggccagtgatgtctacaggtaaggcacccactccaaacatatatccaaacatatatccccaatttctacacctg

SEQ ID NO: 3441 - DNA, 598 bp, Bovine  MMBT22045
  misc_feature (1)..(109): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgtgcacagaagcaaagaaattgttcctgaaaaaaaaaagtgcaaattgctggttcgctgcatgtaaatgaaccgttaattgctttttgcaaacaatatttatgcaaatagtctcccactctgcaaggctgtgcagataatgccctcacatccccatttgtcaccactccagccggacccccaccgyacactctcctgtcttcttcctccgcagtccgtgggcccctctctgctgcctccttccccttcctcctcagcactctgcccccggatcctcctccctgaatcctgcctccttcctccatacaygcaggtcctgctctcaaacctcctatccccaagtgaaagtcaaggcctaacagctcgccctgcactcagcgctgccaacatctctccatcagcaaaatcaacaggaaacctaagaacctgggggaagtcatgcagacatgtcacactgctccgaatacataaagaccttctgaaag

SEQ ID NO: 3442 - DNA, 600 bp, Bovine  MMBT22132
aatggcaacccactccagtattcttgcctggagaatcccagggatgggggagcctggtgggctgccgtctacggggtcacacagagtcggacacgactgaagcgacttagcagcagcagcagcatattaaaaaaaaaaaaagccaacccctggtctaaatcaaaaggcagacacgatgccatctttcaatatggtgtgtaaatgttcagagggaagcatgcagagccctgcacaaagacggaagctgaacttgatggctccagtctgcccctgatggccctcatcctgtatcacacrccrctcacttgatttgtctcaatgtrtctcaactstaagatrcaaggtcaagagttaccttccacctcagtcattttctttttcccccttaagcagaaaacgcatacttttcaaacaaaacctcatgcagaaatagagaaatttcaatacataaactgagaaaagcagaattgttctgttgaagaggggctggaagggtttggaagccccatgtcttggcatcctgccagctcttcctccttgtagccagggtttttcaacagcagctctagtgccattttggcccaaatagttcttggttgt

SEQ ID NO: 3443 - DNA, 600 bp, Bovine  MMBT22195
cacagtgacccatcctggatgcccctgcggtcagtggcatgcattggcaggatggctggctgggcacagggcacagagtggtggctcagaatggccacagccgattggcctctggggcgatcgcgttcacaacctggggctgaagagtatcatcatcactggattgatacttacrtttaggatctcatttcagactcttgaaatcggagcttctagttgttgaggtttttgaggcacgttttatttggttaatcagttgtttgtgcattcaacaaatattagttgagcacttactgtgcrccagtgccaaacaccacaagcaagcccttcattcactgcaggcccccatcacagtggcaggtagagggacggtcacacaccgggccttgcgaggtttctaaaaaggaaagcactccctgttgaattgatccttgctttgaattaatcataggaaaaacattcctattctgtttcatacaaggcctgtttctcccacttgaatttattttgcagtgtcagcaagtttttcatttggatacgatttaaatcagaaggccagtgataatgtggttctagaaagatagacacagatagattacc

SEQ ID NO: 3444 - DNA, 600 bp, Bovine  MMBT22325
ttgccagcttctttttaatcagaagcaccttgccacgtctaaatagttctactgtggtccatggcagttgatgtaagcctgttctaagaaaatccatcattaatgaaatttttttggttaggcccgaatttatgacttccacttactcctgcaaacccaacagaaaaccatcacccaggtgggagctgttggaacaacacagatgtatttcaaaaacacaatgtagaaagacaagtgcacactgcatgattccaagaagaaacgagacaaatmtaggtaacagaaatcagaacagcggcygccccaggtttggggggcagagactggaaaagggatactaggcacctttctgaagagaaggaaacattatatcttaatttgggtggtggtttacatgagtgtttgcagttgtcaaaactcactgacccacattataatgtagatatttgatttttgtaaaacatgcctcaattttaaaaacttgaaaaaaaaaattgaaagaactggaggttgagggtataacatgttactccctgcagatcccagtcatgctggccttttttccattccccacgtgcactgtgctttttctcacctgtc

SEQ ID NO: 3445 - DNA, 562 bp, Bovine  MMBT22359
tcttgcagtgmcctgggggtgacaaaaatcaccctgatccccacgcaggactttcccaaagcgacaattcaggctgaccgcgaggaggactggcccctcctttgtgataaccctactcgagcagagaggaaayggtctcgaattctggtgtatcccatcattgggggatcgagctccacccatacagaacaagggggaagagaagcagctgggtgatggacacagaagctgtaggcagagaggtccatgggggctctggagcgatgcctccagtaggaaacgaagctgacagataaagcratacagcagagccttcagagcagagaaaacgtctactctggcagagggctagccatgaattaatcataggtacctagaaaaccagagaaaacaaaaagttgtacaagaaggtaaatgaaattataaaactctacatggctcagctgtgattaatatttatagagttagaataatgaaaatactgaatattaatatgcccccaaattattatttaatcataacggaagacagattggagggtaagacagaatgtgttgagggg

SEQ ID NO: 3446 - DNA, 600 bp, Bovine  MMBT22457
attagaactattatccctcacatggtgaggctacttgttttcactccacaggaaaatgcagccatttttccaagaagccctttgagaggacagcatgttgggagtcagaagactgagtcctgccctgcctccattgttgactgggctgggtgatttagkctgagccagtagacacaccttggcttgaattgccttcattgggaataatacctgttctgtttgcatcatggggttgttggaaaatctgataatggatataacctgtctgcaaaaaccgtaaagcactcttcaagtggaagrtgatactactactattccaaagactaggagcccttcagaggtttggcccatgggtagaaactcctagagacttggttcttcagccctcactctgcatacccctcttccaagaggcagagtgggagaagggatggaacaaatgtccaagaaggcaaagttagacatctcagtgagatattctaggctcactagcctccatggatgccaaggtttttctcacatcgaatctaggtttttccttttactacttatgcttgtttcctcctgtttttcttgaagattttctctcacctgcttcaa

SEQ ID NO: 3447 - DNA, 432 bp, Bovine  MMBT22578
gtggaaggccatagtgtccaaaaggtgagttctgacatcttttcacagctgtctsgtgggaacatagtgtcaactggccaggagtgcctcatttccacccagaagagttcactccacctggatggtgctgctcatagccaggctcctgcgaaagtggcagcagcacactgtgctcctgcagcaggacgtcttgctaggtaacaacaccatggttggtgtgtgattggtgctcactcattctggtgtgagcttgtcacctggctagcctgtgctgggaacatacttccaggggactgatcsagacagtrgttttgtcaaccagccagtcaaaaagctctaccagtgctgatcttgcactctaaaataactttttttaaaggatttgtactattttaacattgtatttctatttcttttatttggattatgata

SEQ ID NO: 3448 - DNA, 564 bp, Bovine  MMBT22580
tgggaatgggctcgacttttattttcttttcaaagtacctttattcatttgtagaaattgcttattgtattttatatcacagatacagagaagaatgtaaaagtaacttcatactctactgtctagttataatgactgtttagaatattcttctagacatctcttcctatatgtacatggtagaggtgatttaccattgagcatcytttatgtgctgctcttaggagtacgtgcatctttacataaatgacaaacttggctttaaggagtcagccaggctgatggaaagggtttagacaygaagtggaactttccaggcaaaaggacatcattgtgaagtgtcagagagcaagctgtttttgaaactaacagaacagcaggatgccagcatggtgtgtgtgaggggaaaggtgtaggaattggaggggaacaagtgatgccagttctcttttttaatgttagatcaatgattttttttttttttaatttgagtctgctggctcttagttgccaagtgtggggtcttcattgcaacatgtggaatctttagttgcagcatttggg

SEQ ID NO: 3449 - DNA, 600 bp, Bovine  MMBT22590
tccagggaccaggtcaatctgctttaatgaatagcttgaattttaaatgtttttaagatgaaacaattttttttttattttgataggatcaaagtgggaatgggctcgacttttattttcttttcaaagtacctttattcatttgtagaaattgcttattgtattttatatcacagatacagagaagaatgtaaaagtaacttcatactctactgtctagttataatgactgtttagaatattcttctagacatctcttcctatatgtacatggtagaggtgatttaccattgagcatcytttatgtgctgctcttaggagtacgtgcatctttacataaatgacaaacttggctttaaggagtcagccaggctgatggaaagggtttagacaygaagtggaactttccaggcaaaaggacatcattgtgaagtgtcagagagcaagctgtttttgaaactaacagaacagcaggatgccagcatggtgtgtgtgaggggaaaggtgtaggaattggaggggaacaagtgatgccagttctcttttttaatgttagatcaatgattttttttttttttaatttgagtctgctggctctta

SEQ ID NO: 3450 - DNA, 600 bp, Bovine  MMBT22598
aatgtcaacaaggcaacatggacactgcatgcacacacttcactgcagaactactcttcaacccggcaaaatgacatggcagccttgagtcggccaagtagaccaggtgttctgcatagayggggcagtggggacaagaccagaaatgggcagacaatatgtacaaccaagacaggcagcaaacaggtggggacagaccccagcagtcatgagacgtgcgtgagatcactctgcatgaggggaggcaaggaggagccagagcctgtgacagacggaagccatgaccttgggcacccagyrgctcctcctgcatcacctgggctgctccaggaacttgggaggggtgcctgcactttccctgcgtccctggggcctggctgggctgtagagacccccacagtaaccatacagaaccccaactaagaagaaacgtctggaagtaaaatccaaactgactaaaaaagaggaggcacaggtaagagaggggagcagcacagctcagaaagcaggaagcacatttttcaaaagttcatgaaaacaacagaaaaagatactctaaaaccatgaaactagaaacactgtcttaatccaccttcttcc

SEQ ID NO: 3451 - DNA, 600 bp, Bovine  MMBT22606
atgtgatttcctctggagggatttctccttgcccctgcagtcataagaagcagaaggatggtctctgctgaaagacgtatctcttgacttcatttctcagaggtgtgagcattacttgtgagacagagtcaagtggcaatgytttcatttactgtttcatttactctgttttcatttactggagccatgtactatgtttctgtcccacggagaagtctttgagcccctttcacacttgatggcttttaaatattatttccctccaaaaggcatttctctgtaaataaaaagctatragtyattctgctttattattctttcctctgaggggaaactctgggagataaacaatacccagataaataaggcttagagattgtgggccaaggyttctattgattcacaatatatttatctctctctctctctctctcaaataaagaaataatgatagtaattactttaaaaatgattctcttttttaatcattttaaattgctatttcccactctactcagatagtaattgtttttatggcactattgtaactcatgggaaaaaggaagayggaaaaagcagctgagatcactcctgggcagc

SEQ ID NO: 3452 - DNA, 567 bp, Bovine  MMBT22614
  misc_feature (1)..(2): n is any nucleotide
nntctcttgctctcttttttccttttattgtctctctctctcgcttccctttctttctgcctgatgctaaacttcrcrttctgagcccttctaccaattattggataagtcgcttgtccttcctaaacctcagtattctcataagcaaaatgaagtgtttatactatattagtactcttttacttctaagtgtgactacaggcacaagtttgctcaatctgctctcatacaattggtcgtattagtgctctaacttatttagttccaakatgatgactgtggtttcagcctgcacaatgaasaagtgaatttgttggtataattatgaggtctcatcttttggaaaagtgagatcaaatggttaagtgaagtcacttgagccaaagatgaaagggatgtcacataggttaagacatgggccagaagwatctgctttgaaacttcactgaacagctaattaattggtcaacttggctataatgtgggcattttctctttaactgcacaatctggtgcgtgtatgtgctccaattccattgtataaattcgagactcctagactatcgt

SEQ ID NO: 3453 - DNA, 497 bp, Bovine  MMBT22620
ggcatttctctgtaaataaaaagctatragtyattctgctttattattctttcctctgaggggaaactctgggagataaacaatacccagataaataaggcttagagattgtgggccaaggyttctattgattcacaatatatttatctctctctctctctctctcaaataaagaaataatgatagtaattactttaaaaatgattctcttttttaatcattttaaattgctatttcccactctactcagatagtaattgtttttatggcactattgtaactcatgggaaaaaggaagayggaaaaagcagctgagatcactcctgggcagcatctctaaggcacaaagtagatttgtagtagctcatctatcaaaccttcttcaactctcagtctgaattttacatggagatctgtggtggaagacagagaatttgaatctgctgagtgtgctatatgcagggaggaagaatatttgggggagatatgtcctcata

SEQ ID NO: 3454 - DNA, 598 bp, Bovine  MMBT22680
  misc_feature (1)..(97): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgcggcctgtgcctgccacacagggtgcacctcagcctcctccatccccactgagccaccccatcacgaacgtctcaggtggatgccttacgtctgggcgcaggtgaccagcttctctgggctgtgttgtgttaattacaggtttagggggagtgtttcactgtcttctctctgtatcttcttcatgggatgttctccayaaaggagtgaactttgaaattgttctgagcagtaaacaggagagggttacagtccactattcttactagagattaggaacttgaagatgttagtttgtgtcaacataaagatacttttgtartaagtatctgattagtgaactccctggatatctgcactgacagtccccgccttcctcyggggatcatgtgaagatggcttctcctctaatgggagggaggcggatggcccagcagggaccatcctttttacagggaccggcttttacaggctgggmggctctttaaaccccctggt

SEQ ID NO: 3455 - DNA, 600 bp, Bovine  MMBT22681
agcagttgacaatttattgttaatttcaaaattatgtaacaattaacttccaattaatgtagcaattaattgttggcctcaccatagaaaaactccacaaggatgataacatggtaggctcattgaaagaaaatcctgcagagatcacataattacctgagagagatccttgggggaaatgatgaagactgaaagtacttgcttgcagacgtgatgattgttaagattatgcagcaaaaacaaccatgaagagaaggacgcagatgacgaaactgaggcycagagattcagataactcayscaaagtctagtgtaggatgcagctaagatgagttgaaggcattatcctcctcgttccataacytataacaggatttgcctagagcctccaaaggttttatcatctgcaaaatggggataataacagtccagtccttccaaggaggctgtgagttttaaccgagataatgtgtgtccacgctcagcacaaggtcaagcccaggagagacagatgagtgytgtgactcttactatttacagcatcacgatttgacatgaagwrgctgcataaatgattcaggcttaccaaacataaataca

SEQ ID NO: 3456 - DNA, 598 bp, Bovine  MMBT22783
  misc_feature (1)..(65): n is any nucleotide
nnnnnnnnnnnnnnnnnnnnnnnnnnnnnnnnnnnnnnnnnnnnnnnnnnnnnnnnnnnnnnnnntgcttggtacccgcactgctgttgctactgcttctaggtgagtggctgcctccctccagacctctgaaccttagcttctctgtccctgatcctcctcgatcctcaagaaaaaggtgggagcacaagaaggtgattctaggaaaagccaaaatgcaggaagaggcaccagtgagacacctgtgcccgaggtttgaggacacacacagcaccctgcctccagcttttgggccccgcrgagccatggcytcccaaatctcaccttggtaactttgccccagggactttctttttcctattgcctgccctcccacctgttacccttctccyaggcccagccctccaccttcagtattgcaacttcacactgattccttgccctgcatcctcaatgtctccatgccatgcatctgctrttccaaccacctggactatccctccccaacttggggcatcatggagggagggggtcactttagcaggtggtgtagggtagggagaatggagaaggtgaaggagatcttggagctgagatg

SEQ ID NO: 3457 - DNA, 600 bp, Bovine  MMBT22789
attttcccatccttgtaagggcttgacattgtttcagaaaacagtgttgaattggggaatgtcatttccagttgctctcccactgacccatgccatcctctgtcttcattctcctcaaaaccttttttggaatgaggcagggtataaacaataaataaaattgcctccaaagtaaaaggaagttgagaagtttgagaatttcttccccattcaacacttgaaggaggataaagactggaaagagtagagctgtatattctagatataaayaagatcactgaataaacaagggtcattggrtaaaatatggtacattagarggatcagtatttaatgacttatgactgggtcaaggcataaacaaatatttttcctcccctctgttgatcgaattgtatgcagcatagaaattctagagcacaaagtctttattccaactgccatttgaaattctgaaacagttggatgtgtcatcaatgacccaacccatatggccacaaggtatgctgagatcttctaaatggagcaaattatgcaggtgtgagtamagaggagtgaagaagyaaagatggtttgagtcggaaaagacatctattccct

SEQ ID NO: 3458 - DNA, 600 bp, Bovine  MMBT22790
gcttgacattgtttcagaaaacagtgttgaattggggaatgtcatttccagttgctctcccactgacccatgccatcctctgtcttcattctcctcaaaaccttttttggaatgaggcagggtataaacaataaataaaattgcctccaaagtaaaaggaagttgagaagtttgagaatttcttccccattcaacacttgaaggaggataaagactggaaagagtagagctgtatattctagatataaayaagatcactgaataaacaagggtcattggrtaaaatatggtacattagarggatcagtatttaatgacttatgactgggtcaaggcataaacaaatatttttcctcccctctgttgatcgaattgtatgcagcatagaaattctagagcacaaagtctttattccaactgccatttgaaattctgaaacagttggatgtgtcatcaatgacccaacccatatggccacaaggtatgctgagatcttctaaatggagcaaattatgcaggtgtgagtamagaggagtgaagaagyaaagatggtttgagtcggaaaagacatctattccctacaaaatgttctggaagatg

SEQ ID NO: 3459 - DNA, 600 bp, Bovine  MMBT22853
ccagtagttgatgggctgagatggaggaaaggcaaacccagaaacctcatcctgggagaggtggacccacaacacaagtgaagcttctagtcccacagagtgtctaccattcaagtgggggggcattgattgggaaggaatggtatcctgagaatcaaaatggggatgygtgggaagatcatatcctaaagatgaagctgggcaccctgagcccctaaatcccaatagaagcaacccctccatacccrgtagaagcagagccttcatctccacctgaggatatcagctccctgtgaggcrgatgctttaccagaccccgttgatgccccccaggatgctcaccccatcccagcctccttcccatcacccttctgtgcttctagatccgtaactggactccagtcccagcagcccccagctggttgtgacctggcagctgccctgcttgctttctcatgtgcgcagacagaaggcaaggaatgcttgcgggcgagtgcacagggtaaggtggaagggacgaggtcagatctctcacagcagggcgtggagaactttctgctatttgttgatttaatagttcaccatcattgaacctttctc

SEQ ID NO: 3460 - DNA, 600 bp, Bovine  MMBT22867
agtaagattacctggttgctcttaatgtcactggacaagatggggagcaataaaatgggctccagaatctgaaattcccagatcaagcaccacatcagtgagcttcagtgttgcccagaagacacctgtctccagtagttgatgggctgagatggaggaaaggcaaacccagaaacctcatcctgggagaggtggacccacaacacaagtgaagcttctagtcccacagagtgtctaccattcaagtgggggggcattgattgggaaggaatggtatcctgagaatcaaaatggggatgygtgggaagatcatatcctaaagatgaagctgggcaccctgagcccctaaatcccaatagaagcaacccctccatacccrgtagaagcagagccttcatctccacctgaggatatcagctccctgtgaggcrgatgctttaccagaccccgttgatgccccccaggatgctcaccccatcccagcctccttcccatcacccttctgtgcttctagatccgtaactggactccagtcccagcagcccccagctggttgtgacctggcagctgccctgcttgctttctcatgtgcgcagacag

SEQ ID NO: 3461 - DNA, 598 bp, Bovine  MMBT22876
  misc_feature (1)..(45): n is any nucleotide
nnnnnnnnnnnnnnnnnnnnnnnnnnnnnnnnnnnnnnnnnnnnnatgttttccaattgttgggacattgggttgtttcacaaatttttatattataaataacactattaaaagtgcttttgtatgtatacacacacagatacacatattcacaygtatagagatagttttgcttcttcaaaattttttttctagagtaaatgtctaggcattgaattggtaaatcgaggagcctgtatacctcacgacttctcagatttttgtagtcctttaaaatttgttattcccttctgtctctcrctgacataagtttggtgttttctctttttagacaaagaaagggagccaaggaaygtttagaaaatttcctgattgtttattttttwaaaaattactgctattttctattggttttcatgtgattgtccttcagctcttagctccatttagaatttatttgggtttgtggattaagtgtgttggtgggatagggattgatagagggatttagtttgaaagggtttgcttgggtgtgaaattgatgttcttaaaactttgtgcagatgtgttttatgtcatgttagccatacttactttc

SEQ ID NO: 3462 - DNA, 598 bp, Bovine  MMBT22883
  misc_feature (1)..(66): n is any nucleotide
nnnnnnnnnnnnnnnnnnnnnnnnnnnnnnnnnnnnnnnnnnnnnnnnnnnnnnnnnnnnnnnnnnaacagttagaaatgcaaactcgagcttaaggagaatggtgcagttttaagcccgcttgttggcgtaacgagaggcaggcaggccgagagaagagagactctgaagttgtctcaggttcatttagactctgagagaacaggattaacccagaagcagagtcattttcccttctcacctcaaaatgacagtttttctaggtcaaacccacaaagttaaagagcagacwgactgccycagaattttgaagaaaatggcaatgccaaatttgtctttttttttcctccccaaatgcctgtttttcagctcatctgctccactctgacgactgcttatgatcagagtagttttagagaggctgggctyagaaatcatgtagttcagcaacctcattgtacaggcgagggccctaaccctctcctaccccaagaaacttggtccctccttaactaagcagtccaaaggcacttgtcctaaatggattgatttctccaagagcccagccactctccagtggctgcccrtgcatggcgga

SEQ ID NO: 3463 - DNA, 600 bp, Bovine  MMBT22919
aatgtaagtaaatgtagattctctaaatatcttttgcaccttgatgaatatttattcttgtcttttgtgataagctttactgccttcaattttactaagacaaagatggggagggacacctccaaaagagtactaaagaycatggttgtggaatgggtgtttctgtactaaaaaatatttaattaagatcatttctgattttgaatctccctctgtgctgatgaaraggagagttataaggaagaagcagggctcctgccagctataaacagggtagaaaaaatacaccccaactccaamacaaggaaacgtggacccstctactgactagcaatgggaggaagttatctcccacaggcttcagagatgactcccagaaagtaatatggtatgagaacyataggcacttagggaaggtagaggaaatggagctaaaccactcactatggtttagttccactgttgtatcatgacacagtcagatttttgaaaacaaatggctcagactttatatttcagaaatcatggctgtaatatttctaaaggggtgcggaggatgttccctaatactctattttagcagcagaatgatgtatcaat

SEQ ID NO: 3464 - DNA, 600 bp, Bovine  MMBT22937
ttaagcctatggcatggctatatctcttgttgctgagaagactgggggaggaaatatctgccattttctatattttacaggaaggcactctccggattgcgtcaatattcaagataaattactccgaaaatatcaaaacatggttcagctgctaggtggccaaaaaatgatagatatttcccatattgtgtcatgacatcataatgaaacatatcaatatgtaacaccactagggaaagaaaaattatgtgaatagaaaatcttgaaacttttacttcacatgtgatacacagttaatgytaactataaaagtttaaaatttttctaaaataggttatacattctttcatacttacasgtgacataaaacgaaatttaaatttgygttactgaaatcatttggaacagcaattgttaacttagggtataaaaccatagttactaaggtcctgatagccttctatgatcccattaaaaggtcccaaatgctagagttgtagggtcctgtactttagactttttcttctccttggcttccaggttcttctattgtgtstcttttaagtagtccaaatgttttttttttttaatttttccttt

SEQ ID NO: 3465 - DNA, 600 bp, Bovine  MMBT23004
gttcactcaaactcatgtccatcgagttggttatgccatccagccatctcatcctctgtcgtccccttctcctcctgyccccaatccctccacttacctggcagattggagcattctgtgtcttggtgtaatgaagcatcatgttggcatagcaaaaaggaaaccgccctcctgacaggaattcggtctcagcggaagcccatggtccggtgcggggcgtcgcctgggagtggacgtgtgtgtctgtrtgggtgtgcagccttgtttctgatgggaagtcaagaccaaactgcccattwyatcgcttaattccacctgatggtttcctgaaacgactgttggagagcaaatccttccctgtttgcaggatcttttattttttaacttgtggtttttctccccccaacttttgctttggaaacatggaaatgatttgtgcagaattattttgatgaagagtaaagaactgaaagggtggagtaaatcagtcaccagatcattactgcagccaaaacccactggagccaaaagctgctggctcatccggaactttgctctgggcctggtgggcataaactggaaccttggcaataaacttct

SEQ ID NO: 3466 - DNA, 600 bp, Bovine  MMBT00592
cctgggcattaccatctagcctctagcatatgtctggcccgtattcctgtggctcacttggctgagattcctgttcaccactcagattttgaatctcttctttgtttctgatacttgaagttgtctctttcctattttcaagcttggcattgtagcaaaaccaccttttgggctttgcttgatccagcatttctatgtgaatgggggtggtgggtgggaacttcttaagttggttcagtccactacatcgatcagtcgtctggactaggccatgaacagcagacagagaagtggactgaktttggaagcatttggagtgaagtcaggaagggtggggacaggtagagactgaggtcttccttgtcctcatgtaggtgctcagagaggtttggaggggtgagttggggaggggagatggtgttggatcaatgtctaaggaactgaattgcttgggacaggtgatcacattgggagtccggagggggtgacaggtggggagagaagaaatctggcgcatctttctggccaggttcgcttgtatgtctgctggaggcatccttagttatgcgcctgcgctgtcctttctgtcccttatgtccc

SEQ ID NO: 3467 - DNA, 600 bp, Bovine  MMBT01031
tcaagaagaaaggatgcagagaaggtaagaagtggggggcggggcacaatctgttcaaatcttatacatatcctaaatcctaataatttaaaatgctgaccgcttttttcctgaagaacctagtaaatttcatatgaataaatacttttcctattcattactgacatggacttttgtggttacttaaaaaataaataataagtgcttctcatttttatgacagcattaagtttcaaaatgaggctaggtaatgtcagcttaacccagaaaggagctaaatgtcgggggagggggaggacsggaatggcataagatgaatratcagcaacaattctagtggtaaaaactctttaggggagtaaagggtccaagttgctttttaaggaataaaagatggatcaagactcaagaaaaatgctcattcattgtaccttggaggcaacactctgtctaaagtacagaagtagtaaaatattttactaagttaaaatataggttttatattttatacgatattgaatacacacataaaaataccagtgttttcatcttgtttctgttcagacacttaattaagcaaatatgttctttggtgtctgg

SEQ ID NO: 3468 - DNA, 598 bp, Bovine  MMBT01034
  misc_feature (1)..(125): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatactggggctacatgcattttcacataaatttctctatcacatttgacagcttaattacattgttgttatttgcatttctcatgttacttcatactttagagtcctagctaatggctttccataaagtaatacttcatagtattctttgctgaatcaactcctatcttagttkcttgttctgcaagataaattcaatcaacagcaaccatatgttaagaactttgaagttaagtttgtgagaatgaatgatttctgaaagcctctattcttggctttgcataatacatgtctgaaaatcaaagagcattccatgacagaaagggaatttagagaaatggccatggatatgctgaagaaaaaaagaaattgtgttcatatttcaacacaatttggaatgtttgtatatacttcccctctagcaacatttacctgaggtttagaaaaatttctgtcatctatcatctttcctc

SEQ ID NO: 3469 - DNA, 600 bp, Bovine  MMBT01126
ccactgtctcccggagcttgctcaaactcatattcattgagtcagtgacattacccaaccatctcatctgtcgcccttctccttttgccttcaatctttcccagcatcagggtcttttcccaaaatacatacatatatatgtatttgtttttacttgtgtaagcaaatgaaaatctcttgatggatagagaagaacagtaacagtggtgaccagttcattacggtggtaggaggaactgggaaaatgggaaacaagcataggagtgagacctcgctgaactttttatattctaagattcktgaaccaagcaaatgaatgtgttaccatttaggtaacatgttcttaggcccttgagacagtggaggacagaaaatgaacagaagcgatctgctgacattatacatttagcattctccaatttaatgtgatagtcaaactaaccaaaaagaagttttttttcaataattaaaagttgaattcatctaaaactttgtttcacttcaactgaagtttccgttttattacctggtctgcttcttaggcccttgtccttcccctgctccatttggtgacagcccacttccttgggttttaaagga

SEQ ID NO: 3470 - DNA, 544 bp, Bovine  MMBT01539
  misc_feature (1)..(3): n is any nucleotide
nnntcaggagaataagacactacagggtggtcggccctggcctgctcagcccacttcacagagcgatgagagtggctcgtgctacagaggcaagaaacccagggccagacgcaaaggacactgtggagggttcgggagcaggacccgatgagtcggcctctggacgtcaggtcggggggctgaggagctgatggggatgggcccgagagccccaccaggggctgtgctgcagcacgcgcaacacccacagcagggcccccaccacagaaggaaaagccaaggagaacaggcgcccctaaagcyctgctcgatgggcactgcattcctgtccygactacagtctcttccccagtgcgtgaaatgactctagctcactgcagtggggccaaacagacccygcccaccatttcctgggcgtgggcgctgcgggcagatgccaggaggaatttaaaagaagctggctattttgggtgttagaacttgccagaatgccaaggcagcaatatgtctgcctgagtgcaattcctgctctccagacatggag

SEQ ID NO: 3471 - DNA, 598 bp, Bovine  MMBT01551
  misc_feature (1)..(82): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnacaaagacatcctggtaaggtagacatagtatagtattaaagtgctttgatttcttataagtgactccagtgtagtcgatttaaacgaacaattggcagctgaaagagtctgaggtaaatataaaccyaggaaaaccrygggaatctcgaaaattgtttcactgctttcacaataaatgagatagcacatattttaaaagtcaagatgacgggacgtkaaaggaacattttgtagcaccggtgattttcaagagaagttaagtttgtagtggcaactaaccagggctgctcgtctcttgaatgggataggtgagctgttgcggaaataatatgcatcttttccaatggaatgaactaaatgagtcattatggagacactcattactggctgtttcacttaatggctccatgaaaagatgtatcaagggctacaaactttgtgaccaataagagagtgaagaaataatgaggtaaactggtccaatctgtacgcagataaaatcccaataagccaca

SEQ ID NO: 3472 - DNA, 496 bp, Bovine  MMBT01610
ctggacctttcaagtttcttccaacgtcacttgcattacaaagcccttctatacctttcctggctctggaagattctgcaattatgccccagagacttaactccatgtgtttctctgtggcttctgtttgtgcagaacccaggtttgatttgattttgtgcgttcagagacagagaacctagcacactctgtgacacatagaaggtacttcaaggtggacaaacttagagactattacatagaatgaagtaagtcagaaagagaaaaataaatatttgtatacaatatttttacacatayatatggaatctgatattcataatattagagtccaagctaatgaaaggtgtctgaaatgtattgtataccccttgagtccaaatggacttgagtccaggtttacggaattcaaaaggtttctgtcatttttttttaatttatttttttattgaaggataattgctttacaaaattttgtgttttctgttaatctcaa

SEQ ID NO: 3473 - DNA, 600 bp, Bovine  MMBT01648
tgtattaaaagaaaataaggtaaaggtatctttacagcatccgggcagtaatgtatttttctttctaaaccaaaatgtaagctttattaccattaaagatgatgttggagaacatggcttagatgtgtgccaaactggttttcaaatctgagctccataattattcagacaagaaaagcacaggtcctcagcaaagcatccatctgcaatgcaggagatgcgagttcaatcccaggtcagaaagatcccctggagaaggaaatggcaacccactccaatattcttgcctgggaaatcccwcgggcagaggagcttgatgggccatagtccatcgggtggctaagagttggacacggtgagcacacgkgcatcccagtggaggaagagcctctgcatcaaatgagcaaaggttaagagaacttgtgctgtctgcagaactgcagatctcaaatagagatagagagaggcccgtctccctaatacacggatcagacaagaaagccacttcttccctggggtagagacaggccaagattattttaaaagaagattctttcatataaatggaaagagcaggaatgagaaataactgtttaccct

SEQ ID NO: 3474 - DNA, 485 bp, Bovine  MMBT01668
agaaaaaatgccttttctcttgtatttttcattcagtttaatttgtgtttcactgaccaaaacataacagagttcagtaaaagttgtttttgtcctcaacacctgccacagactatcttctgtgagaaactccaatatcttgaaaatttgaattcatggaagccatagtgaaactaatttacagcctacaacttagtgagggggagatctcacattctcttttcctttgcactaatcatgactcactccaggttttgttcttcataattaatgattatgttgccctctcttcctttggaycataaaaattattccctgctttaccacttgctgactccttatgcacagatttcaccctttaattttatccttttcttatcttggtaatttcaatatctaataaaacaacgttccattataattttcagtagctgcaattatctaaataggtaatctgaaaattgcttttgttaataaatgtaaca

SEQ ID NO: 3475 - DNA, 600 bp, Bovine  MMBT01737
acttttcattcaggcttccagcagtatcaacttcatgggtcacaaacttcccactcatatcctttcattgcattttagctgcctacctcttatgtttttaagaaactccagagagttcatcattatttcattccttttctgttataccatcttaccctttctgtaaaactaaagcaagcactgcagaaacctaaagatgcaagacgacttttgtccagacattgtatcagacgagctagataccctagttctcatttattttagtcagttatagtaaagggttagaaactagaaagaaarttttaagtattcttccatgtctgttctgtcaccyctttatagtcagctccacttcattgtctacctactttaatacacatttttcttttctgatcctaaaggatagatataatatgagaaccataatggttactgaaaacaaaggtcttgctttgaactcttatgattttttggcagaacagggagccttctccaaatctctatatagtaagggtgttctgttttgattctgtatagcaatgcttaatgtttatcttagaaattttacgggaacctttctcatatggtaaaaaatgtgtt

SEQ ID NO: 3476 - DNA, 600 bp, Bovine  MMBT01916
taccatcataatggagctgatacaaagtcttcccaaaggatgcgttccatcccagtcctctactcatacccacaagcacatgattggattgtctcaggtggaactcacctgtgactttcctggcacttggtatggaatttgcctggtatatgcccacttctgaatggcacattgcccttttgctcctttgctctcaaaatatcttattcttggaaaacagaaaaacacacctagacaaacaacaaaggatgctgccataaaaggctttcagcaagcattagccaagccaagatctgtatktgtttgattacagccgatacagtcatccagaaaacagatgtaaagggagcttggagggacgcagagcaataaagttctccactgtgctgttactacacagcattgcaattacaggcatctgcactaattcatattttctgggaatctaatagaaagtctttgatttcattcttctacctgcactgaaagccaaaaattgctatttcatacatttcagtatcctggttttacgttgattaaatctggtgacaaggtgacttgctattttcactgacccccactatgtcactgctccatcac

SEQ ID NO: 3477 - DNA, 600 bp, Bovine  MMBT01970
cggcaggttcttgcctgggaaatcccatggacagaaaagcctggtgggcagagtccacagggttgtagagagtcagacatgatataagaggctaaacaccaccaaccaggaggtgcgtgtgcaaaaagcatcaaatgcacagcagactgggtgtttagatgaacaaagaagggctttagatacatgttacggaagaagcgtaactaagacattcatgtatggagacgtttcaaaacagaactaaaatctgtaaaacaaaaaaaaggagtcaaatgatgttctagaacaaaaatcacaatmtgtgaaattaacagctgatccttgagcaacatgggtctgaactgggtgattccacctatgtgtagatttttttcagtaaatacgtgctacagtattatgtgacccttggatgtggaacctcggattcagaaggatatcagatcagcacacctaacacaggtgaggggggaggggccacggcacacctgctcaggtgagcacgtctgcggcctcagcagtaactggtggtgtcatcctgagcaaacaccaacgttctctggggagaaagaaaaaaagcacctctcaccctcctttatgctt

SEQ ID NO: 3478 - DNA, 600 bp, Bovine  MMBT01985
tcaaatagaatgcacgctaaacattgaaatgttgagggagggaagcatggcgcattgaaggaattaatgattcaaggaaacagcccaatcagaaatcatttactatcagctgaagactacaactaacttaaccccttttcagggtcttacggaaacatgatctctttcacactctaagtaattctcttcacagactttaaagctactttccttgttaaatatttgacaagactcattttacacttggattgagttgtccattgttcaaaacagtgactcacaggttttcgtataaaatamaataaccagaggcatttttataatgcagatatcaacagagttatttaatgtttactttgcacagaaaggaaatatctcaaagtttaggtatttycccaaaagtgctattagcaaaattgcatgcattatctgtctcccctatgctatagacatgtatacatacatatacagtaatatacacgacccactttactttgggctgggaaaaacatcctgtaaaccaggatttctcaatcttttttcattctttcccattcccccatagagtctttttagacatattttcctagtcaacacact

SEQ ID NO: 3479 - DNA, 600 bp, Bovine  MMBT02107
acctggaatgcccactgctccgtgggaaggtataacaggatgtttgtttgggaggtctggagctctgcagccctgagattcattgaatcactttccaatcaaattcctgagacaggaaggtcaatgggatgaaagaaggacactttgcctagggtctaggagttgtctggggagaaatggattgataccaagactttccccctggggttccaagttgattggatggactaagtacagtgaacacaccactgagattcttgaactctgcatgagccagtggcactagagaagaaagacacyctccccgaraacagaacagagcttggagttatatgaatttgaatcctaaaggaggtgtgattttattttgtacccaagctcctcgctacaataagattggatgggggcggtgctggcaggagaggtatgctcttgttcacattatctctgaaatagaggcacattcattaaaatgacaattgtcttagagtcataattgatacctgctttcataattttaaagtaagagaaaaaaaataggcggaagaaaagatgcctataacagcgagggcagtgaaatcagaagaaacacacttcacg

SEQ ID NO: 3480 - DNA, 600 bp, Bovine  MMBT02117
ttaacctcattctaaattcaaaacccagatccaactttctgtttcccaatattcatagcagggacatatagctctgttccattttatcatccactggccatttggtatcagtaaacatcacaggaaattaaaacattttaatgctacagacccttaaagatataaaactgtctgaactgcctccagcataacagaaactgctttgaaactgagtgcmttatagacagacaaacatcatatgacctatgctagaaaagtcacagcagcccaacatctcacttgcaaaacttaaccttggayaccattttacaatgcacaacaaataagtttccctgcgatattactgtatagattttcaactcattccgtaaaaatttcaagaaacattaatattaaaaaggaaaactataagaataaacacataaatgactaacatcaagcaggaaaaataactttattgatgtaagcatgacactaaaataygccaatactaaacagaacaaaaaccgtaaacaagattgtttagttcttccaactcagaaatccaagtaataggtggatattgttcttaggcatgtttctcctatagtgtataaaaat

SEQ ID NO: 3481 - DNA, 600 bp, Bovine  MMBT02289
aaagcaggaaaattattgttttcatctgcactcagggaatgccagctaaagtctcacacctggagttagcattcttggggagggctccaaactgctgtgttatggatccagagaccacagaactagtcccctggccattagaatcaggtgggggtaatgtcttgttaatgtggccaccaggcctaaatcaataaatctcaagcctgggtcaaggaaagaaaccgcagtgccttttcaaaagtttaagagaatagcaatgctgtgagggctaaaaaaagatgtcttctaaagtggtaggawatcccatacctgcacccagataggcttttgcgatataatcatagccgtaggatgtaagcctgcttgccttttgatcttgaatgagtctcattttgtaacccattcacaaaaccaaagcacagtaggatatgtgactctgaagcagtttctcagtcttctacaaagatgaagtacatcaagagcctttacttatgtccttattacaactgaaatgaatactctaaaacaatctgaaagcatttataagtgggtctgaaattcagtgaaagaggctgtgtgtggcgaggtggtgtttcgcct

SEQ ID NO: 3482 - DNA, 600 bp, Bovine  MMBT02523
tagtattttctttgttttttttttttttaatcttaccctgcttaatacaaaatctaatcacgatcaacaaaggcacttgcacaaagcttctgacctactcgcatgtgctcttttaaatcagtcttatgtcatatttgtcctcaactgtagctgatttccctcctgtttggttggacagatagttgtgattaaccagtgtggcttctttttctgatactgtttcatttttaaaaatgatgaattgaaggagaaaataacctcttaggccaaaaagaataaacrtgaatggaggaaatccasattcatccagcagttattcagtgctactgtccatcagattctgtactaaatgttcccttgagagaatcccagcctatcaaaactgaacaagccattcctatctctagtactacccttgctcttttctccctataaaattcccctccctatgcatttcctgtttaataaattggactactgtctgtccayctgctcaagccaaaaaatggatcgtctttgactctactgtctcccacaccaaccttatctgatttatagttcctctgttctttcaaagcctccattctttgcacacactgg

SEQ ID NO: 3483 - DNA, 600 bp, Bovine  MMBT02546
ctacttccatcatttctgtgatttaaaagcctattgatctggtgtttatctccatcaaattccagttgtttcagagatctgattttgttattgaacttactcacttggtaaatgtctaaagggcagctctactaatgcaagtctcttaacgaacgattcttgttctatctgtttggctgtgctgtatttggaatctgttgaaatgggaggaaaaatgcaaatacacagggccatatggtgttgaatataggtaatacctatgtgcatattggattgagcttcttttggtcaatctttttmttttcgttgacagtctgcaatagctgattcaattggtagaactgatagtctatcagttggaagaaaccaggataaaacagcaagtgtgtttactttacttgctagttttagttccattaaaaataaagaaaaggctagttacctagtttttttgcatattgtgaatgaatgaaattgaaacaaaatataatagacaatgttatggataacacattgagattgaacaggtaaatacatttgtgttccttgcagagatatgataggacctgttaacatgaaaattgagtttacctctcttat

SEQ ID NO: 3484 - DNA, 600 bp, Bovine  MMBT02549
aagttaggacaagtaagcattgagatatgacatttgaagagaagaaacatgcagaaaaattagcagagggttaacatttcattgttgacagagagctctggtacagcagagaaaagcaccataaaactactgtccatagtgtcttttcctccactgtattttcaaatgaatattgctagggaaacagtcaactttaattttaactgctatgtattataataggtaagaaatctgatctatagtaaagtgtaagaactaggaagtttcaaataaccccttctgtaactattcaaactgatktgttttaccacaagctgatacagattataatccttagttgtccaacacttttgaaaaaagtgtaaaatgcagaacattaacaatctatgccatgcaataaaagttaaccctttgaaaatgaaaggctgtcagaaagttctagtaactgtagtaggttatcatttaataaaacatgacaaggctatgcctgtaagtatgcttcaggcatgcttcatatgcctgtaagtttatgcttcaggaaatcgaagggaaaggtagaatacctggagaatacaaggtttaawaaaaaaaaaagacaaa

SEQ ID NO: 3485 - DNA, 602 bp, Bovine  MMBT02641
  misc_feature (1)..(2): n is any nucleotide
nnttttctgaggacagacctataatttcagagctgggcaaaatgacactttgatggaaagtgtgcttgcaaaggctataaaacccggttttgcttttgaattatcccccagccccccaataaaacaaaccataaaatgtcagccggkctattttaaaaaaaaacagcacagaagtggctctgattcagactgcaaaaaagggccatggggacatatctgcacgtgtccctttgcagggggtctctgagtgtctgcaatcttatgcagcaataaagacaaatgaaaacctgctggaaaaggarccacgtctgtgaaatgaacatctgtggatattttacccctagggaaagaacatgctgttgacatcacggaggagtaaagggagatggacaggagaggccatgtttctatcccaaatctgctggtcctgargtcttggcacaaygcccagggtagagcctcagtttccccatctataaactggataataacatgcactccaggtagttatggcgaggatgttttcatcctgctcactgttaaagcacccaaaagcgtcccaggtgactcagtggtagaggatcctcctgcaatgcaggaga

SEQ ID NO: 3486 - DNA, 600 bp, Bovine  MMBT03006
ttggtctgttttgatttcataaatactgaaacaccactgacagtaagatgcataatttgatgtacttccctaagaaagaaaaaaatgccaccaattaaactatgacacagtgctttcttatcatctattgcaagactcatctccatttcagggatgttaaaatgcggaggaaaaaaaaaagtgtgattttgaatcagtgaaatatggtcatagaaacaacactcactgcagtttatcaagttctctgctgagggctatccgtgtagcatctctttcaatcctcccaaaccctgtgagtcragatattgttcagagaggttaagcaacgttacaaggtcacacagacaatcctaataatacttagtgtatgactaaactcaaataccagcacgatcgctctgcaaatctgtagttaaggagtttgagacacccagagcttgacaagcttatctgagtgcctgtagcctgtaggtggcggaggagttggggctggctgacctctctaccatcctgtgagcagctagcaggggtggaactgggcctcaaatccctcccccctggaactccaggctgtgctcctagccactgggcatcaccacc

SEQ ID NO: 3487 - DNA, 600 bp, Bovine  MMBT03386
gatagtgcaacgttcttatgagtgatggggactcatcctatgctgaatgaaaatttctcttgtcatagttgaggaatgtcatgatgctgaaccatcagggccttgaataacagtgttgcaacacctggggatttcttcatcrttattagttcccccaaaacatcttccataaaagaatggcctgcacttagttgaggatacatatgtattagttcatgatgctaatgttgggtttactctgatgaaagcctataacaccagcattattttgagataaatttatttagaacaatgtttctscaactgtaacgtacatgcaagtcacctggagtcctgttgaagtgcagtctctgactcaggagtctgctgtgggcctgagaatcttagttgccactagattcctaatgacactgaagctcctggtgcacggaccatacctttagtgagacttgagaagagtgtcttgtcttgacttcagtgtagtttgatatacagatttcaaatacaaagggttttatttgtttacttctacttttatgagcgtgaatgaaccaaaaaccatgtgatttattttcttccgcacacagtatagcacctttt

SEQ ID NO: 3488 - DNA, 600 bp, Bovine  MMBT03820
ccagatgaataggcagagcccagagggtttttagggcagtgaaaatattctatattatatgataatgatgaatatatgtcattataattttgtccaaacccagaatgtacaaaacccaagagtgaaccctaaggtaaactgtggactctggatggttaactgttgtctttgggtgatgatgatgtatcagtttagattcatccttgatgaaaaatgtaccgttcaggtgaatgatgctgatgatggggggaggccatgcatgtgtgggagtggaggggatgtgggaattctctccgtacrtttctttccattttattgtaaacctaaaactgctctaaaaaaatgaagttaaaaaaagtccaggagtaaaatgaaatggttttccctcactgagtttagggttctttgttggatttgttccagtgaatcaatmactgaaacaatatcttttgtcgatgtatgtatatactctctacctagtctgaaagtgattattgatttttttttttttttcgctttgagctgacttgaagactagagaaattgcctcaggcttttctcctttaggaatatattcccttcacagtctgagattgtgcc

SEQ ID NO: 3489 - DNA, 600 bp, Bovine  MMBT03940
ggccgtgcacccgagtgttaacacactactgtctcacttggcatcaggctggcccgtaccttgtgctgacgagtccttcattctcctctcactgcacatccaccttcgcccagttaaaactggcccatttcaagttattctccttgcctgtggctctctggtccacatgttgctgccagtttctaatgtagaagaatatcaccatgccttccacattccacgagggttggttcagttttaagaacgctgttatagcaagcagcataatgaccactctttccctcctctgcttcctgcccrtctaagcagcagagtgtactaggctgaatgaacccagtaaatgtggcaccagtttgtacttttcttgaatgaaaagccataattagtttcctttaaacagtgtaaaatgaacaagatggattagagtggttgcttcaaataattatgtaattaagatttgtgtgcactgctaagtgaattcataatctttgggaaattcttttcaattatgactagggcatcataagccatgttttaaactttaaaatctcaaaaaatgtttttttgttttttcccttgacacgtccggctagacattat

SEQ ID NO: 3490 - DNA, 600 bp, Bovine  MMBT03948
aaaggtcgaaataatatttaaataagatgtgaaacatacagcataatcatacagttggagagtagtttccaaaagtcactacagaaaactgatctcatcaacttataaagagtgctgtgtatatgaagatatgtctgcataatgaaagcttagatatctctgccatgaacatttgtaagacaaataaccttttcagaaaacgtgtgtgcatgggggatattttgaaactcacaacacttgtcaagaggaaattaatttccacttgaactaagctaatgtgaatgtcaaaaatgccctttsaaagtttaatcacaagataaaagatcatgtctaagagtaaatttgcatatataaaaccaatctataacactgactaaatgttgttttatgacaacccagttcagtaaacaagcyggctttgtgaccttgggtaagtcatatagtttcatcgtcctcatataaataactgatatgtgaggacatcctgagacatccattcaataacagcaaaaataataaagtacgtctacaatgtattattttaaaaattgtatgagatatttatatatgcatgtatcatatatactcatatatacatgt

SEQ ID NO: 3491 - DNA, 600 bp, Bovine  MMBT04444
taatcaggtgaaaacactgtgttctacttgacgtgcaaccacagagcaacaatgatgcaggttatcctggcgaggcactggctcacttgagagcatgctgaggcagtgggaatgatcacgctcccatagcacatgacttctttttaatttttattgcagtatagttgctttacaatgctgtgttagtttctaccatacagcaaatcagtcagtcatacatatacgtatagcccctccttttgtattttcttcctactcaggtcaccacagtgcttgcagtagagttccctgtgctgtacratatgtwctcattcattttcgattttatacatagtatcaatagtgtatatgtgtgaattccaatgtcccaattcatcccacctcccttttcccctttgtatccatgcatttgttctctatgtctctatttctgctttgcaaaaaggattacctatgccattttctagattccacatatatccattaatatatgttatttgtttttctgttcgtgacttacttcactgagtatgacactgtccaggtccatccacgtctctacaaatgatccagtttcactcctttatgtggctgagtaat

SEQ ID NO: 3492 - DNA, 600 bp, Bovine  MMBT04871
tgtgcaaatgacagaaagcacaccagtggttgcctggatccagcaagtggaatggaaattgactgaaaataggcctgagggaatgttttagtgagaaggaaatgttctatatctttttgtggtggttacacatgtgtccacattttcaaaattcatagaaatgcccaattgaaatagaagcaagttatggtacataaatcatatctcaataaagttgattaaaaatacataaaccaaatatttcatacttgtgaaaagatcttgagttaaagccaatattttatattttgtaaatatcaramcttgagatcagcaggctggaaataggagtcctgtttgcatcactgaatgagttttcagcagttctcttagttcctctggctgtggttttataatctacaaaccaaaggggttcctacaatttccaaggttctatcaactctgcagtatttagatacaactctggtagaggtggtattgtttagtcctccatgacttctggaaaatctactttacaattagtcaagcaacattagtcagctaactatccagagaaatggacagaagtaagaacatgtgggggtgcccataatctagtga

SEQ ID NO: 3493 - DNA, 600 bp, Bovine  MMBT04873
atttcaataggcagaggcctagataatgcagtttcaccttaaaagtggtattctttatgtcttgacatttttcttatatcccagtgaggaaaagactcaaggatggtattaaaatcatgtatttttaagagccctactttttctattttgtaaagaatataacatttgataaaatatggttattcttacatagtaccatgaactacattttacctctgtgtcagtaatagctgcataactacatgattctgaaagtaatccctctaagaatacaaagcagttgttttctttgttagtatmcacagaacaaattaaccagatggaaagctcttgtcagctgttttgtttcatgggagagcagtggcatcagctctcaggagaattctcatttgacctctctacacaaaacattcagcttccaacaaactgagcttgtgaatacacccctagagactaatatcaaacattccaccacaattctatgatgcttgttttaaggttatttttgattaatggcctgaagttatggctttagttatttttaaaattgtttgttgagttttcaaaagtagtgtttgaggggttatgaaaatagcctcc

SEQ ID NO: 3494 - DNA, 600 bp, Bovine  MMBT05189
tgtctttagtatatttgtattccaatccacattgtcttacttagcacttatttctaataaattatgatatctggtatcacacatcacttctatcatgtccttctggattgtcttgaatagttctttgcttttcttcataattttcaaaacagcctaagttacaaacatgtatgtaatatgtgatttttcttgaactgcattgaatttataggaagatttggagagaatatctagtttaatgatttttttagtttttcagtcatcaaacaagaaatgcttatttagtggagtttcatttcrttactatttttttgttatccttgggtttttcattattactttttttatagtatagtatccctaatgcatttctaggtttgtttgttgctattaatctaggatatgagtgtttttcaatggagtattaatatctgtatcaggatatctagtcaagcatcctaccagaagtagaggatctatgtagagtatttttatatgtagttttctatttaaatctgtggatttctttgagtctggtttctatgccaacctgtttatattatcttataagaaatatacatacatatatataatatatat

SEQ ID NO: 3495 - DNA, 600 bp, Bovine  MMBT05363
catggtggtatatgttttggtgcacatatatatttttccttcaaagaagttccttgaaaaaaataggaagtgagtattttgctgtgttagaacagcatgcactgaatgatacttttttcagtcaaatttgctgtcctgtttgctacactcagtgctcactagtctaatgagacatgcagggcccatgtcagagagaagcacctggcctgaggccaggacacactgccttggcggccagttctcaggacacctctctgagtataggcttagaaactgccagggatcagctgaatggtaaartatttcggatatgttggagaaaaacaataaaccatcgagataaacacaccatcattagggtgcttgatgggcatccttcaataagaagatgttgggctgtgaataccgtgtgtttactttgcccacagtacatacatgaattctgtaatttggtaacaaagtaggagagtagaagagcattgttttactctccagctgttttcctgggggaaataatattatttcaaagtgaaaatattgtgctaaacatatttctttcccgtacccagcacagtttttagcatgtaaactcacacattg

SEQ ID NO: 3496 - DNA, 598 bp, Bovine  MMBT05856
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnttaggtttgtggtgcaaactacttttggcaaagtttctggccctgaagcttgaatctgtgccctcaaagatataatgccagataatgatcaaaattagtgttcataaatctaggttttagagatgataccaattcctgtcattattatttactcaaattctgatagttttagttacatttacttcaagctgccatgaggtcatcatagccccagtcctgytgactgtttaatcacaaaggtctgcatttaattcacaaccaaaaaagaaaagttctctatttttcaaaattgttctytcaaagtcagtgctacacaatatctaaactgggatgagaaaagggagattttataggagaatttctcatagaatatgcacctgatgctatggagaaaaaggattattatggaatttttgttagtttcattttcattttaattttctgatgaaagcatgttgaatactcaaggatattttacatatgcattcacataaaaatgttgtgcataatgtcagggg

SEQ ID NO: 3497 - DNA, 600 bp, Bovine  MMBT06019
tccgcctcccttgaagctaggtgtttgcaatgtgacccagtttgggtcatggagatacaataggaaatttgcttgttaacttcccaggaagatgttcctccctggtaaaaaggaaagttgaaagtgtcaaaaaagtctctttccttccccatccttcctgatttcctatatgttttctggtgaggaaaaatctgagactgttatagtcaatgtgtgtctatcaggagaaatcccacaattttctgctgtaccatcctggaaccattttttattgtatgacacacttaagtgtcttcatcrtgtaagccaccactggctgcatagtctgttgtgtatagcctaaaacagactgcataaatattatttatgtattaaaatatgtaatatatctgtcaygtttacatttgtggattaggaaacatatgattatgttccatttgttcctcccctggaatgattgccagaaagttaaaaagattctgtggaaatctttggcacaattcaatatttcaatgagaaaggaagagaggaacacagagacaattgcaactgctctgtgtattgaagaaacatcattaaagggatccataactaggaatc

SEQ ID NO: 3498 - DNA, 600 bp, Bovine  MMBT06068
acaacttactcttggtacagatgaatgctaaaaaaaycccatacaatccttcgtaagtactaaaaatgaactaaggagaaaagacatatcaggaaaagaaacagcatgggggtaattctgttaagagtgccttaaaagcctgtattgtactattgccacgtaaaaagggggaggctgctgccaaacacattgctgaaatgagaattgtttaaactacaaagaagcatgacagctccatgtgaacaccttaaaggcccaaggtcacttacaagggagaaccaggtggtgaaaccttggagygaaaaaaattacagccatatattgactctagttatcctcagttaggagatgtagcttaccattttcaaaaacagagattcttgttctgcatgtggattgatataaaattgcagaaaacagaaagctaagaattttttgttgttgttgttaatatgcctttttctaccctgattacctttctggggctttgtatcagaatgacctctgtatcagaaacattaatattgccagagttaaaataaataaatagtacaaaatcagaatattcataggcttgttccagcggggcccaatatcagg

SEQ ID NO: 3499 - DNA, 600 bp, Bovine  MMBT06145
agttggttttctgctgcttcaacaagtggtcttggaagatgcacctgcgatgtagagggccwttgacagcccttgaaagagctccctgccttctcccttccccttttcctgcagagactctgttcagaggaggatttctgagacaaactatcagttcacaaacactgggaacagtttctcaaccagcccctagtctcctgtgctgctgcggtccctgtgttgggaaccctctgcctaaagggctgggttgggagagtctctgggtctctgctgttcccacaaagcgaacatctccctaaytgctgtcctaaagacagttccttacagatttcaactcttctcatatcccycctcctttacaacctgtgcattcatctctgttttactgctgaaagaatgcagacttcgtttctctgtcgtctgaacatcattgacaagcattccacccatctgtgaattattccctgactctttgatcagagcggtgttacaggtcctctgccagcaggagggagcagtccaacaaaatctgaagacccaggactttgagaagctgtgccgggcagactaggaagccacaaaacattgcgagctgaggat

SEQ ID NO: 3500 - DNA, 354 bp, Bovine  MMBT06175
ctgaaagaagtttatgtgttataaattccatgacagactacaacatgaccaacatcttaatccagtttttaaaaacagcttccttccctgtcctaactcatgctgacctggagtttgtggacttgaattagtgggggatctatttatttattcctttacttccttttgtatgtatgtgtgtgtatgtttggtaggtttattccacagtctatcagttttgagcttctactaccagcagtccatcttcataaacgaggaacttcaacgtggattcatcctggctctgtcacaccaaactgytgggagttttggmtgtttatggctccctgccttcaggccctgcaaaagaggctg

SEQ ID NO: 3501 - DNA, 600 bp, Bovine  MMBT06189
tgataagtacatttttttctgaaatatatacagatggataatgaaatttctttcttactcatcatctgatgtctgctcagtttttctttaagtggaattataaaatgttttccaaatataagactgtttactgagctaataaagtaattagtctgattaaactgatggtcagctcaggcaaacaaagtctgtcaacacaatctgtgtgttaacacagaagatatttataatttaaaacaaatgtgttcaaataaaatattttatgtagatagatctctggccaaccatggagagctaaayaactttttgaaacatgtttggaaaccaattaaaagataaatttgatgacagcaaaagacaattaatcaaggataagcatcaaattcatatacaacaatttcttttacagaaagtgtgcagtttgacctgaatctgaaaacacaaatgacagaggaaacagaataggcagaataatggcccacccaagatgtccacattctaattcccaactcgaaattcactttggacctatgaatacattaccttatattacaaaaggactttgcagatgtgaycagtttaagaatcttaattaacata

SEQ ID NO: 3502 - DNA, 566 bp, Bovine  MMBT07385
cttagtatttaatttaatttaatttaattttattttatttttttagttaaaagactcattatggagccttggcactaaaaatccttctgtggtttacaaaaaataagagaagattatatattgaagtggagaaagatgaagctaggccaaaggtatagttaaaaaaagtgttttttaattgctcctttctggggtcgcacagagtcggacacgactgaaatgacttagcaatagcagcagtaccatttggaactaagcttcctttaatctgtctcttcttgcttgcttgttgattgctamttcagtatttttttaaaacaccacctccttttaataaatttaatagtaagcatttctaagacttggcatttctaagtgtactctaatgccttcactgtgtggcatgttggccgaggtgatcagcaactttgtactgtctcccttgtgtttcagtttggcatcacaaacaatattagtgctcagcggcagaatgccaaagccaggctgttcagcctagaagaatagatgatgaagaggcctgttaaaattttcttttgcagactaat

SEQ ID NO: 3503 - DNA, 600 bp, Bovine  MMBT07390
aaatatcattgacttactcagcagcatcaaaacccacaaaagcaaataggttagatccatcccagagacttttctgcagcagtaaatggatttgccctttttagagcagggagcacagttctgatacaattattcttattggactagatgaaggaatttacttcaaatgaggttgctagttgtcctgtggaagctgtgtcagaataaatatccagctactcttcagaggcataatttgttcattctcctgtgaaacatgtgcgcctcatgaactgtagatagctgactttgtttagatgrcggaaaaattcttttattctattaacacttgccttgctcaggtaaagtaccattttaatgaaaacaccttgacatccagttctttgcaaaagggctattttcacatgccagatgtcctgaagcaatctctctttgttacttkttcacaatcaattttattaagggaaaaattccaagtgacagatgtcaccagtgaatgtccacttcagtttaaggaagaagtactttgaaatgtatcattgtcgggtaactatttaaatgcaaagcctatattgctacaatttgacaagaggtaaagct

SEQ ID NO: 3504 - DNA, 600 bp, Bovine  MMBT07396
tggtctttacaagccctttgtttactgtgggcctacatctaaacgaagatttttaactcacttcatattttaacaggatttttaacagtcgcactgacattttctctaacagatcaaaaccccatcttagttcctctctctaaatggggtacaagactataggtgggaatttcagatcttttgcctagcttcacagctataaattaaataaattttatctttcaggggcatctctgtttcctacatcccatttcccctatcaagcaactgatttcctcctgttaccttaatttctatatytccttcctactgcccttctcaatggagcactggttgttacagatttttgctgtgccatcttccttctgatccatgtagaattcactttccaagaattctagatttaaaaattggttaaccaaatataaagagacaaagtactaaaagccaaggatactttaggattctctatttacatggaccactgatgtgtgtttatatatatgtgtatatttgtttgtttgcttgatctgatgaacatctaaaattccatggacagaggagcctggtgggctacagtccatggggttgcaaaaagtc

SEQ ID NO: 3505 - DNA, 600 bp, Bovine  MMBT07431
gacgtcaaatcaactttgggaggcaaaccacaggtttgtggaaagttcactaacaattcctaggtatcaaaattaactgccaatcaagtggtacaggaattacaaaaacaaatagcagaaacaaagaacacttcacaaaggaattatgtcccctcaagtgggggacatcttcagacaaaggcgaggaggccaagatgtgcatggcatgattggacagtggggagtaaagcccagacacgacacacacacaccccctcagcaccttgtattcgactcctctcttcacaggcccgggatgcrgggagctgagccrcacacacaggaactctgggggccaggctgcagaagaggctctctaaacctgagtgggaatcactgacactcaagcccccaacccaaacatcatctccagcttcgtgtttgctctaaacaactatttaagcaagctgtcatccacagaagctgcacgtgtgaacccagttcgagatccaacaagcattttgaaagaccccaaatcacactggttaaaattccaaaactgtaaggaytgtgggattatcttgggtaatcttacattctccaacccctcatctctcctct

SEQ ID NO: 3506 - DNA, 600 bp, Bovine  MMBT07661
gctatatagtagatccttgtttgttacctattttaaatatagcagtgtgtacttgtcaatcccaaactctcaagctatccttcatatatgtgtaactgaatcatgttgctgtacatgtgaaattaacacagcattgttaatcaactatgctccaatacaaactaaaacttgaaaattattgtagctaaatattgggggaaaaaagacactcacttggacttgaagacctttctgactacataacctctacaggctgattgccatcttctcaggggtccaatgtataagataagattcatrtgtctttcttttcctaaagagggctaaggaagagaaacaaaaagcagagtttaccagatttccttaagggaactctgacccttgttttctcagaaggaccaggttcaaaataaagtcatgtgttggctcagttagctttcatgacaaacaccaacactttactggctatctaaagtagagtcaggtaaaagaaagctgctatttggggacagattttatccatgcgtcagtcttgtgctatgaaggattcatagtgggttataatgagccattacaaaacatatttggaatttgggaagt

SEQ ID NO: 3507 - DNA, 600 bp, Bovine  MMBT07886
cacaggatatattgactgtagaaacaatttactgtccagttcctacataacattgtattgaatttcagaatatacacatattcatgcatatatagagtgaaatatatgtataattactttcaatttcacatcctaacagaggactgggatcagccacagttcaatctgtacacttgatacctggacaccagatgtctttagaatggaaatattttactcagtgatttctttaagagagagtttatgttaccttactctcaccttcaatatgaataagaagagattgagaacatcaaaggmggtgataactccttttgaaatgcagcacactttgttytaaacyctctgacagrcagccaatccttattaaaatcaagccttcaagatactgtgaagytgtccttctctctaggctgttttatcaaatttggttcaaaatagttctgaaacttttcatggatatagatgtaccctgtatgtggtacagtggtttgggtatggataagatgcacccggctttctgggaaataggccaagcactggcttaaggggaccactstaaggacttttcttgcttggctccttgacaaataggatgcc

SEQ ID NO: 3508 - DNA, 600 bp, Bovine  MMBT07894
tggggaaggaaggaaagaaatagtaggaaaaaagaaaaatcttagtactagaatgtcaactgtataatcgagtttggcaagagaaagttaggacccaaaccatcttcaagagctacttaaataaatgtcaattaaaatggcatatatgctgtgacttgcttaatttctcaaattatattttcttatttccaacatggagacaataatgccttatgttccacttgaaaattaaataaaacataagagaagcacctggagcagtgactggcacaaagtaggcacccaaaatatcaataacaytagcaatatttattcctttatcccagtggttctcaaccaggggcaatttcgtcccctagggaaaactaggagacttttttggttgtcacagttgggagggtgcttaatgctggcatagagtgggtagagaccagraacgctgccaaacatccacaatgtacagggtggtcccacaagaattatctggctcaaaatgtcagcagtgccaaggttaaaaaaaaaagaaaaaaacctgttttactccctagtttctgaaatccattatctcatggtctgagacagtcagggggacttagagag

SEQ ID NO: 3509 - DNA, 600 bp, Bovine  MMBT08080
agatttatttaaaaactagtgataaaactatcatatgacccagaaatcccactactaggcatataccctcaggaaaccataattgaaaaagacacatgtactccaatgctcatcccagcactacttacaatagctaggacatggaagtaacctagatggacattgacagatgaatggataaggaagttatggtatatatacacaatggagtattaataagctataaaaaggaacacatttgaatcagttctaatgaggcagatcaacctataacrtattatacagactgaagcaagtcaygaagagaacgacaaatgtcatatacttaagcatatatatggaatatagaaaggtggtactgatgatcttacttgcatgacagcaaaggagagacagacakaaagaacagacttttggacacattgggggaagaagagtgtgggacaatttgagagaataacattgaaacatatacattactagataatagataaaatagatagctagtgggaatttgctgtatgatgcagggaacccaaatccagtgctctgtgacaatctagaggggttaggtggggaaggaaatgggaggggtttcaa

SEQ ID NO: 3510 - DNA, 600 bp, Bovine  MMBT08098
acacaagcgccaaaaggaaccygttaaaaaaaaaattcattctcctccaagaagcagaaatgattaaattaatcatttcaaacggcctttttagaagaacagacagtacgtgcagtcgagatttgtggatacttgcttatggaggccacaggcggggaagcattttgtgacccggcggaccacaggatgcacgcacgccctgtggcagatgcaggtgaggtggggacgcaaggtgagcgagggcacgggtccctcaagacatcctgctctgcccacgccccagctcagctgcacccagasacgtgtcttctttgttctgattcagtgacgatatttatcactcaaaaggaacatctgtagctgggagacctcccctgatatactataaagctatttctgttcctatttctaaatgcattggcacaaaatgtgtgatgtccaccacacaatcaaagtgcacctggaggtgatttgaaactacgattacggacacggagaggtacagagactaacgagggcagagatttcagaaaaaaaggtcaccaatccctttcagtttgtgaaaatcacacactttcaattatttttaccactactggg

SEQ ID NO: 3511 - DNA, 598 bp, Bovine  MMBT08170
  misc_feature (1)..(9): n is any nucleotide
nnnnnnnnntcgctgggttctgttctgacggctgcctcccaccagtgtgaaacagaaggatgaccttattctgtgagcaggacaactgtgaaaggagctgtgtatgtgaaagtctgtggaaagacagagccacctagaatgtccctcccaaaccagtcagcagaaggtcttctgcagggggctcccaacagatccctgaatgccacagcaactccaggggcttgggacccggggactctccaagccctcaagattgctcttgtcgtgctcctttccatcatcaccctggccacagtcctktccaatgcctttgtgcttaccaccatcttcctgaccaggaagctccacaccccagccaactgtctcattggctccctggccatgacggacctcttggtttccatcttggtcatgcccatcagcatcgcctataccaccacccacacctggagcttcggccaactcctgtgtgacatctggctgtcwtctgacatcacatgctgcacggcctccatcctgcatctctgtgtcattgctctggacaggtactgggccatcacagatgccctggagtacagcaaacgccggactgtgggcc

SEQ ID NO: 3512 - DNA, 600 bp, Bovine  MMBT08852
gcctggcggactatagcccatagagtcacaaaagagtcagacacaacttagtgactgaacaacaactcatgcagaatcacttaaaccggtgcccgcacaagtaagggctcagtgctttttagttattattatatatttcatatttaacatgtagcatggcgcctactacagtaagttgcctcttgggcactttctttgggtcctcataaaggacaaacacaaagctgaacatctgcctctgatcatatcgtacctgacaagctttattgaaaatgctttgacatcttccatttttagcartttttatccagcagagaactgtcccagaatacataagctgaatacttttttttttgtcctgactgcatcaacttttattggctccaattgaatgataattatttgaactctactacatgccagggctctgctaggactagatatgccattataagcaaaacatatatggccctggattcgataaaacttaagggagacaagtactcaatacatttttaaaaatgcacaaatatatgtataataacaagactatggtaagtgcttgaagaaacagggtaggaaggaggcaaaaccagaagc

SEQ ID NO: 3513 - DNA, 600 bp, Bovine  MMBT08859
gcctgctgtccagctactgaagactctgtgrgtggctgtgcttsatgccattgttccctttcctcatctcctccctcaactggtctcacaaatacaagtttggtcactgcctaaaaggcaccctctgagcatttcctaagagcgcagcccacctgcttgtggtttttcatatcattctcaagctcrtgagaggcatgtttcctactttttagtataccagctattcaaaaagttcccackgattccatgagatcctcctgccttttgccaggaaaacatcagagcatacagtacaaggtrcctgtaaaattcctttttttgtgtccagatatttttttttaatgtaaaaacaacttcagcttaaaaaagttaaattccaaagccagcaagttctagcactgaggattctcctctattctcaagaacagggaaatcaagggagtttccattttaaaccatttaagaatcctgtgctttctgagtggaatccttgagagccatgacttatcttgtgtttgtctcagtgtttggttctcagagacaagggtcaaaatgactttcaaaaggctggctttccccgggggctactttttatgtaga

SEQ ID NO: 3514 - DNA, 600 bp, Bovine  MMBT08884
ttttgggaatgagaaaactgatgtttgagatagattcactcaaagtaccaagtgatccagccagaaaacagacccagctctaccactgtccaaaacgtgtgttctcgttcatcacactctgagccctagctcgtatgtggcagagcagcctcttgatcagatgcctttgatatcggctctaagagtgttcagttctgtacacatcaaaaatagacacaagggtcctccggtgatttaactgaatttaatccatttggggggtaatttttgtttggcttcattttactaagttcagccaarctgatttatatgaagcctccaattatcttttcagtgtgcccatgccagaaattttgttagggaaatgttcttttcattattccctctcagggagggatgatgaagaaaaatcaagcgatgtgacagctgtgtctcagaagttttctcctacctgcttatccagttgttttgaggatggcagttcacactgctgagaaagagtctaatatccaaagagtaataattgtaaagaaagttacgtgaggcaaagagccccagtcaaaaccacactgcccaattccccccagctactggagagat

SEQ ID NO: 3515 - DNA, 600 bp, Bovine  MMBT08952
accttgcaaagagacaccaaccacatcttggtgctgttatgatgagccacacctaaaatatcccagaaagccattaaaaaaacagccctgaggtctttagttcttttttctttttttcagggtacgaacatccatgatttaactcagcaatactttttcttctcaaaattcttttcaatgagaggaatctaaatctttcctgtggcagtttatttccctttcctcttttttcctcaatggtatatgtcttctgagagcgacatcgagactcaagccttttaagaatttttggagaagatragagaagaaaagcaygggtactgggggtctctgggctatgacatgcagagttccaaggcagtctgtcttccttgtaaatacaaggtactggaaggggattagggacccagggtaaagccacagggaagcactgttgtgccaaagagagagtccttgggaaggccagctgagctttctgctgtttgaccatgtgcatagcatggctgcccagtccatctcctgtcagatggccactctgtagattagcatagctgccacttggtaattcatcttatttttgtaatggttacaggcaatgac

SEQ ID NO: 3516 - DNA, 600 bp, Bovine  MMBT08957
gcggggtcagagsgaagtcttcaaaatgcagcagacactgaaacatgattctactctgagtcctcaaatctgcaacagtattctgttcacttcaggattcctggtgcaaagcgttctgtaaatgctcacaaattcaggcttccatggccgttacgtgataggccacttcctctaaagtgctctaaagcgcacagcacgtttmagttagacttttctgtgtgtaagagaaaagtggtgctgtcacaagcagaaaacctaacagccactgagggccaagttaaaaaaccaaccacattaacrgtggactaaatagaagagttgcttctcaggataaaagcctccattaaataatcttcatcagytggtttttagccaaacttgacagayaaactactcatttgcagctgtggtgatttcgagtctaygactttttcctttaagggaccaacccatggaaagcactggttgtggagggagcctcggggagaaagtggtaaccttcccctctctaaccaactctgcgctgggggaaggtatactccttaatgggcttccctggtggctcagacggtaaagaagccgcctgcaatgcaggagacc

SEQ ID NO: 3517 - DNA, 600 bp, Bovine  MMBT08993
tattgttaatttagttttattttattttttaactttacaatattgtattgattttgccatatatcaaaatgaatccgccacaggtatacatgtgttccccatcctgaaccctcctccctcctccctccccataccatccctctgggttgtcccagtgcamcagccccaggcatccrtttctagtttataaaccataactagtttatccatagttggattacattattacatataaatcactaattcttttctgttctattagaattagatcggatttaatgcttaatggaactctgctgraaagaccttatgctgtttttccatgcctgttttcccctaacattattgcataaagaaatgagataaaaaggagaacctggacatatctttctattgactgaaattttgtatcactaaaatgtattctggaaaaggacatcctaatcctatggtatattgctgccataataaattacaagagggggtaattttattttattttcaaattatttcctacaaaccagccatctaattcggaaagtggttaagagccaagttttaaaaattatgtaccaggaaatgcctcatttatgaatgtat

SEQ ID NO: 3518 - DNA, 598 bp, Bovine  MMBT09055
  misc_feature (1)..(138): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcctttcttgaactccataaactttacaagacctattcaacatcactcaactaaatcacataatggtaaatttataacccagtggtgctaaatgatctagttgattgtctctactgctggctaactaaatattaaacataaagccagctaacccaacyttgttacttgaactttatcatccccaaacaagagaaaaactcatgcctcaccatatttcccttaattatgtcttcccccaactggtcttgtaaaatgggggagccagtcatgctttttatcccacctcagggggtcgagagaatgggaaacctgtcactaattcctttcacctcacaggcaaaactccttcacccaattaactaagaccaggtgcgccctccactgagtctgcggaatgcagagaactcacaaaccttgcttccatgttggcagaaaggagcccagcctgcacctgat

SEQ ID NO: 3519 - DNA, 600 bp, Bovine  MMBT09191
tcaacgaaaatatacttttcaggcaggcgtctaattgaatctggtttacttgaaaagaacagtgatagaatttgtcacaataggatcttaaaggtcatgcagggaagttcattcaaccctccttctccagccaagtaatttaggttctcaggtcttccagttagaatgatcagactagtgacttaaatgcattgttagcctgaccaagtaacgtctgtattttccttggaggcccgctggcctatgctcaagttcacgaacttctacagacaggtaaayggagtcacgttgccctcattwaccacctgccttagcacctgtttcggcatcaatttcacagtaagggattagagagagaaagccgtattccctttcttactcttttgggtgttaatgggcttatgtgtgtgtctatctcagagaaagtatttcccccttagttagcactgtttggggcagggagatacagggcttacctacttccatgtccttccaccctggcckcaatctccacaccaaatcctcagaaayatccgctatctcaaatctagctctttctctaggctttgggacagtctgaaatttgggagctgagaggca

SEQ ID NO: 3520 - DNA, 600 bp, Bovine  MMBT09283
agggatgggggagcctggtgggctgccgtctacggggtcacacagagtcggacacgactgaagcgacttagcagcagcagcagcatattaaaaaaaaaaaaagccaacccctggtctaaatcaaaaggcagacacgatgccatctttcaatatggtgtgtaaatgttcagagggaagcatgcagagccctgcacaaagacggaagctgaacttgatggctccagtctgcccctgatggccctcatcctgtatcacacrccrctcacttgatttgtctcaatgtrtctcaactstaagatrcaaggtcaagagttaccttccacctcagtcattttctttttcccccttaagcagaaaacgcatacttttcaaacaaaacctcatgcagaaatagagaaatttcaatacataaactgagaaaagcagaattgttctgttgaagaggggctggaagggtttggaagccccatgtcttggcatcctgccagctcttcctccttgtagccagggtttttcaacagcagctctagtgccattttggcccaaatagttcttggttgtgggaactgtcttctgtgctgtgggatggttagcagcagc

SEQ ID NO: 3521 - DNA, 600 bp, Bovine  MMBT09294
aacttggccactccctctgagaggccaagagtcaccactactttggatcgtctgtgaagtcctgtttgctttagtgacaaggctgcgtgtcacagcacaagaaggagcggtcaccccccacgttggccggctcggtcccaggcaaacgaggcgccacggttaaccttggtttctctgagacagcctgagaagccatccaaaggaaacatgacaaaaacatgtgaaaatctgcatctgcgaaagtatccactgcgctggtatttacaacaggggggagaaaagcaggggacaacttaaatrcccagcgacagtgagctccagtgcattttggtacacatcccctcaatggccgaaacagtcactaaaaatcacagttatgaacacagggcagcaatacggaaacagctcggttatacgagtatcaaatgacgattctgtcagaagtactcgtaacacaacacacatcaaaacaatggctgcaaaacactagtagaaacagggatggtttattttgtctttcaaattttctataatgtgattatgttatgtttataataaacaatgtcacgaacctcattccatagttcatcaggcactcta

SEQ ID NO: 3522 - DNA, 600 bp, Bovine  MMBT09367
ctatgttacaggaaacaaaccactcctagtccaagaaaaaagacaatttctctgaacctgaaagagacaacatttaaagaatccaggatcgcccctcctgatagccctctgattctcagttccttctggcgagcttcccaggactttaatttttgttacctttaacctgatttaaatgaagtcttcactttatgaacagtaatcatataaccagctcttctctgaatcctcttcctcctccccctccttttttggatacaactcctgtttttgctctgttgcaaacacttctcaaaaggraagcaacattgttctatatgcttttaaagtagctcaaagaccctaaattgaactctttcaaaactttagaaaacatccagagactatttaatttaggcaactgatattataaaaatcaggaataatcrttcaggcrttcaaacaaaagtttctccgtactaattaggcaaccattattctggggggcttgagtaactcgccagctgttgttaggctaaaacaggaaggaatttttgaacacttaggggtgtcttcttcttttaaaatgaacaagagaagagttggagtcaaaataataat

SEQ ID NO: 3523 - DNA, 600 bp, Bovine  MMBT09595
ctttcatggagtttatattttgtagagtcacacaataaactaatagatataataccaggcagttagagctgcacagagaaacttctatcaggtgaagggtaatgaacttgctattttagaaggacaggcaggagaggcactgtatccagtgggcaattttcagaaagaaaaatctatggttatcttatcaccttggaactccttagcaaccaaggttcagaaatatataatcatttttcattactttatcccttttagtactccctttgggaaaggtaattggactcagaattccaagaygtttctccaggcctggaagcctgtgacatgagacatattgcaggagcagcggaggttcttatcagaaatctggtgaaccccagagagcactcagattttcagatagaaagttacgagtctcatgaaagtgtctccattaatggttccttcaggtcccattgtgggatggtatgtgtgtgcacgtgtgtgtgcatttagatgttaactgtgtgtttaaggtcatgcctgggtgttgactcaacattcctgtcgtttatggctcatttttcaccccgtaaccatggctgatgaggtcatgga

SEQ ID NO: 3524 - DNA, 600 bp, Bovine  MMBT09661
gtcgaggttgctgcaggcagagcgcagcaagccagccctctgctgcctgtattcccctctccaccagccctcacttcctgtgcctgaaaacctaggcgatccagaggagaaaaagaaaaagtcactccctctccccatctcctgatcccaaccatggcgttctgacatgggataagccaagcactccataaactgaagcccgcccttccarcgaaaagagagacgacagcgtctaatgttgttagaaaagtgcagtggagttccgagtctgtccatattgggtgctgctggggaccaggmgagtgtgggcagcagcaggatcccagggcagggctgtgagactggaaccctcacgtccagccttcccagtgctcagagaagggtcagaggtctccctccccgcccctgcctycccactgggcgagccggcaccgagccagcatcattcgtgggcacagatgctcagggaaaacagacacccgggaggttatccggagcagaggacccccgaggcttctcctgagaaacgaaaaaccgcaattagcagcctccagtcatgaatctccttctacacttaggaagatgcaaaagctctactta

SEQ ID NO: 3525 - DNA, 600 bp, Bovine  MMBT09722
gagttattagtgagtcacagcaaactgactttgtgccatttcagactcttcgtcagtgcggaatgaagtgcaaccagatgaatcaacataatggttgaacaaggtcctaaaccaatgatcaccttcactgtgccatgaaggtgaagtaaagacagtttaaagcagacagtactatgctggtatacttgataggcacaacttcgagacagagtttccattggtgaaacttgaacaatatttatagaatatctactatgcacaataagcattctggaatagacagaatccagatttatgatwgaggtttgtaaaacctagtttgaactatggcttgcaaaggcagttatcttactgaaagcaatatgtagtcgacttaagtcattctctaacttcagcctgattccgtgggtaatttgcgataatcagaaaactatgctggggatcagatgttgttcagtggctaagtcacgtccaactctgtgtgacctcatgggctgtagcaggccaggctccagatgagatcaatacaatttataatacctcatgaaatgtagttagatagttctaagttcgagatgatctggctgactctctaggatt

SEQ ID NO: 3526 - DNA, 598 bp, Bovine  MMBT09755
  misc_feature (1)..(13): n is any nucleotide
nnnnnnnnnnnnnttaagtaatgtatctgttttctaaatgtatcccttcattggtgcttttatctacagatttctttcttaggataaatttagtcatgagatggtaatgcactggcagcagtttgcttctaaaaagcaattatatttctactaaggacaagatgttgggtggaggaattacatacttatttggttttaggtttatttagccatacaaaaatgtttttcctcttaagattttggcaagaaaatctaaccaattggaaaaacatctgctgttggttgagtgagggaatggcwtaatcagtaaaaattacttataggaaaaaattgttttaaaaaactctgcagcttcaactctggacttctctatggcagttcatccttaatctctcccagaaattttcttcccagcaaaagattttacctatgttgggctacttctgtatatctctaattttattcaaatctttgaaatttagatcacaagtcatacactttttaaaaggagaacctgttttcacagcttttgctgtctaacaaccactctgaaacttagtggcttgaaacagttatccggcctggcagttcttctgct

SEQ ID NO: 3527 - DNA, 600 bp, Bovine  MMBT09964
tatccatcacatagtctccattcatggaagaatgactatccagtggaaaaggaaaagcattttctttatcaaaggaggcttggggacagattacttcatcttcactttcttcctcaattttcttccttttggtyctgcctcccagtgacttcaggggtaccacatgtttatctctatcagtatctttactgtgaccaatattaccctgctcacttatgggttcacttgtatttttatttataagcatctgcttattagaagatgactgactagggatcttgttcacttcagtcccaagawgatgatgtgtgatgagggttccatcttcagattttgatctaggtttctctggtccaggagcagaagtattgctgaggggcactgttttcagatgggtttttttcccagtctctaaaagagaaggggacaaacttgtattcaaacctaaactacttttcacgttagagggagctccaaatacaggagatgatacccgagtagtcaattcttcttgaaaaggagtctttgaatctgaaaacctaaaaaaataaagagtggtaaaacttttttcctattaaagaaacagggtaaaaattaaaa

SEQ ID NO: 3528 - DNA, 600 bp, Bovine  MMBT10028
ctgaatttcaggttcatagatgagcaagcagaaactgtcatcagctggaacagcagagttaactgtagaatcagatatatactgatgaccccttttattgctctgaggatagttatagcccataataggatagcttagtttgaagcattttgagagacatgtgatttcctctggagggatttctccttgcccctgcagtcataagaagcagaaggatggtctctgctgaaagacgtatctcttgacttcatttctcagaggtgtgagcattacttgtgagacagagtcaagtggcaatgytttcatttactgtttcatttactctgttttcatttactggagccatgtactatgtttctgtcccacggagaagtctttgagcccctttcacacttgatggcttttaaatattatttccctccaaaaggcatttctctgtaaataaaaagctatragtyattctgctttattattctttcctctgaggggaaactctgggagataaacaatacccagataaataaggcttagagattgtgggccaaggyttctattgattcacaatatatttatctctctctctctctctctcaaataaag

SEQ ID NO: 3529 - DNA, 601 bp, Bovine  MMBT10128
  misc_feature (1)..(1): n is any nucleotide
nacttagaatactagttaatgtcatttatgagacagtattaaatattgtcttcaatatcaatcttattggccttaaactcaaataaaacaaaaacaaaaaaatagctgatggttgaagagaaggctagtagtggggaccctactctgagtgtccttcttgaaagtgttttagctcattgctatgagctgtggtttcttaatgtatctttgttgggaaatgatcagacacagacagcagataccagaattttactcaaagattattgtgggtttttaggcactaaaacaaaaaaaggagttragatatgatttccacatttcccagaacgttatgtccacatccttaaggatgaaactgaggacatttcgggtagctttgatgtttaatggagaaggaaatggtaacccactccagtattcttgcctggagaataccatggacagaggagccttgtgggatacagtccatggaatcacaaagagtcggacacgactgagcgactaacatttgatgtttaaagaaaacgtcttaaaagagattgtgttaaagttaagattaatctaaatggaagaacgtcctgaaaaatatatttgcaatgtc

SEQ ID NO: 3530 - DNA, 600 bp, Bovine  MMBT10132
gggttgccatttccttctccagtgcatgaaagtgaaaagtgaaagggaagtcgctcagtcgtgtccgactcttcgcgaccccatggtctgcagcccaccaggctcctccatccatgggattttccaggcaagagtactggggtggggtgccattgccttctccatattcaatgttagtggttgtcaaacagtggtccccaaccagaagtttgttagaaatgcaagttctcagtccttacctcagaactactacagcagaatttctgggaatgagaaaagagactgacatctgaaatttartaattccatctgtgaatctgacatgagctaaagtttgacagctactgggctaagatgtgtatgtgataaataaaggagataaatggcatttatttatctactctgataagttatgtgatgttcttkcaacttaattggtcaactggtactaaagtgtttttcaaaatgaaaaagaaggatcgaagttatcattacagtcacattcaaatcatttgttccagctcagctccaactttgcagaaatataaaagcctaagttatacattaaccctgtataaattcaaaaggtttactttgggg

SEQ ID NO: 3531 - DNA, 600 bp, Bovine  MMBT10394
ataaatgtgaaatttaatctagaaaatagatcatactgtctttggagagtgctttaattttcaggccaatcaccacactacccctgcacagagcatgtatcttaaggaaaactgactgcatgcccactttgggggcatatagtatacacccaaattaattcacataagccaatatcctggcctaaattctcagatcaaggctgggcacacagctcaacttaagcccacaagaagctagattttctggggcatctgggagaggaacagtctctctgcacatgactgaggaaccacgaaacrggttgagctatggcarccatcttgtgatcayagggttggaagtcagcttttactactaactgctaccacagragayratcaaataaatgggaaggaaccttgtccttgataacatcatcaagcccactcaacaaactgaaccacacccacctatgttcccatgtactttcaaggtttcagtaatactttatgggaaaacacaaatgaagtttttgaccaacccagcatctttcctgatttacacgctacagtccagctttcccagcaccacagtcctgaagatactgtcttttccccaat

SEQ ID NO: 3532 - DNA, 600 bp, Bovine  MMBT10449
ttggagcttacttagcaaatatattgagtacaattatgagaacatcataaagattggggaaacataaatagtgaatgaaataaattattytttcatatttatggactgaagcattagtgctcctttatatttactaaaaattcaaaataaatatgaattttgttgttttgtacaaaatrttaccaccccactgacatcctatagtttatgtatgaatagatgaacaaaaaaatgtctgtatagttttaagtaaaatggcattaatttataccatcaatgacaaactgtggccttggaagrtgacatattatctaagcccttaccagtggtaacacatgtaaactccaggaaaaaaaagtatatatatacatcamtatatgtagaatatatttgaaattttgtatataagtgtgtacatatgcattaacaactttactaagatataattgacatacatgtgcatgaccacattcaatttcaggacattttcatcaccctcaaataaaccctctagtactcacctccccaactcctgccaaccttagacaaccactaatctgttttccatctctaaatttttaattaagatatattctaagg

SEQ ID NO: 3533 - DNA, 600 bp, Bovine  MMBT10479
agtaaaaaaaaaaacttgataccgttcatcttggcatcctgtagccccttgcatggtgccaagcattcatgagattaataaatgtttgctgaattaaatggatttgagtgaaaccttcagaacagtattattgtcagaatatcacagatggtaaatggcagtctcctttgttaatagcttccaaggttgatgatgagataaaatcagtcaagcatccatcattcatcaatatgggaaaagctcctaaatacgaaatcctctttttaaaagtcattgtattattgttgcctcattgcaacscattccagtactcttgcctggaaaatcccatggacagaggagactggtaggttgctgtctatgtggtcgcatagagtcggacacgactgagcgacttcactttcacttttcatttttcacgcatcggacaaggaaatgggaacccactccagtgttcttgcctggagaatcccagcaagggcggagcctcttgggctgccctgtatggggtcgcacagagtcggacactactgaagcgacttagccgcagcagcagcatggtcacattaaaattgtgacttatgtacccatccttagagc

SEQ ID NO: 3534 - DNA, 600 bp, Bovine  MMBT10509
tttggccgaactagtctttattgacttagagagtaaattcgaatcacagmaggagacagaaacaaagctcctttctgacccagaaaggccccctgcatctcctggagtgcctgtcctggggtgcccgccatcctgggagcagcaccctgaagccgtggtcttcgccctggaaggcagtcttcttgctccccctctccactcggagctggaccgcctcctgctgtgggggcttctgactggttctgggactgatgctgttcccgaggcatgtcctttttacctcctgggctttgggggagyggaggcccaccwgtctggtctcatctctaagtagaatcacttggttgcctcgctgccccggggccggttgacacgagacacgccaagcctgggccagggcctgtggaccagcaggagcgcctcccgcgacggccagatgggcacgtactctgctgtgttgagagggaggcgttgaattgtctcaagttcgtgccgcggggagagccccattccagctgacctgtgggggacagggaccggcagcacccactgtggtctcacatcttccttccccagcctcctgctttcctgaagaccctc

SEQ ID NO: 3535 - DNA, 429 bp, Bovine  MMBT10526
cgggagtccccccacaggcctgcaggcttccaggcactgctggttccagagtttacaggccagtcactcagaggacattctgagagccagccccagccccacccccctgccagcctgacaacagccaaggaggttgtcaactacactgaggctgaaggtcttataaagagcggctctgtgcctctcagcaaaagtgtttgcttccatttgcccaaagggctgaatacataagacccaggtgacttctgatggcagagttcgttaggctcagaggagccgctggcagcagatcactcatgrccccaccagccgaggtcagcaggttcccagctcattcccctgccccgggrcccttccygccaaactgagaccccattaacctgactttgtttaagcgggctggggggcagccctgcggcttctgctcca

SEQ ID NO: 3536 - DNA, 600 bp, Bovine  MMBT11205
ctgaaagttatgatgactaatgagagtgtatatagatagcagaaaaaatataatgatgatatttattgagccttgctatgtgtcaggcactttcacagtacattaaacccactttattgctagatatacataatgctacttatctgcatcaagattgttgtctcatgttataaagagaaactcagtaccttaagtttctctatagaggatgctgtacctcttgagtgcataccaaattgttactctactctggtactcttgacataaaaggtttgttcagtgcaccccttaaaatgagamtaattccctctaactacatttgcttaacattagacccaaaggagtgtttccttatgcctctgacagaatttttagggaaggcagcttcttctatttctatttgcagctcctctgctcaaaaatcagatatacagccatggatcttagtcactagtgattcaacaaaggtcaccatgttgcacttaaactttcctactttcattcattcagggttgyatctttccaaggagattaccaaacttttacctagaaagacctgtggtagagttccacacttacctgaactagtgattacagcag

SEQ ID NO: 3537 - DNA, 600 bp, Bovine  MMBT11242
gtgatactttactttctatcatagttttctatcaccctggaaaatgggcagacagtactgccttcattctacaaggtgaaataatggagacttgggacagtaagagtgacatgaggaagataagccaattagtgctttatccaacctaaaccagagtgggagggagatttgactccaagggaccacagggcactgccactcagaagaaagttctgctgaaaccagacagccttgtgcctgtgccagacttagttaactccacccaagctttccctcccactagacttaattagtcatggytggtaccatgcacatttaagaatcatgtgtgtggaattcattacaatacaagatacactagctcagagatgcactgcttccctcagaaaggggaaagcattcccacaaatagcagagccttragttgcagatgatggaaacccaagagcagggaggagccaggaatgaggaggtaggagcctcagtgagtgggttggatgtttacttgaactccttgcctcactccatccattttattactaaccggtgcaggacagtgatttttacctgcgcgatatttcccttggagatttagttcat

SEQ ID NO: 3538 - DNA, 600 bp, Bovine  MMBT11314
ttcccaactttcctcacccacatttccatatttctgaggtttctattacccacaaaaaatgctcattagttagcaagaatttgcttttccagggcagctgggttccaaaatgttcccttatttataaactggagccaagactttatcaaactctgccactctttcaaagccagctcaaatccagtctcttttcttaaactgttcttgactgtcttcccttgaactggcctctccatctccaaagttctgaagcagatatagtgtaaacctcggaatttaacacgtaaccacataatacaratcsgaactgcccttactcagtaataactcccactcactcttctttggtcaattctatccccatgggatcctaagagggtcaagaattataggaatacacttctactctcatcccctgaacctccaaatttatctttaattgtcctctctgcttctgtctcctgcctcaaaagaagctattgtcatgattcctttgtaggtaaataactccgctagctttcttgatctccttccttctgcctctttcagaatttcagggcatcagttgtgttccttctcatgtttttagtcccttcttct

SEQ ID NO: 3539 - DNA, 600 bp, Bovine  MMBT11497
atgggattttccaggcaagagtactggagtgggtgccattgccttctccggaaagaggcaggcggaggccctatggtcctggcgttttttgtgatactggggtgggggtactcctacggcttaaaaaagggggagcacggtagcttaaattaacagagggagtactttgtagaaaataaaactcggagcccggtagcggtgcagctgttgtagtctcccagactagagacctgtgggatccaagcctggggtgctcctctggagccctgctttctgctcaagctcttgggggtgaaaggsgagacaggcggatcccactgtagtccctcaggtcacctttcctagatcttcctaggttctggaataggaccagcagtgcctttcatttggttggatttgcgcccccttgtttcccaggtactgccacgtgagagtacctgaggggctcctgaaggacctgttgccaggaccagtgaccctggtgatggaacgctcagaggagctcaacaaggacctgaatcctttcactcctgtgagtcagattttctcttgtgtcctgccattggctttcgctaggatccatgccaggcccattcccca

SEQ ID NO: 3540 - DNA, 600 bp, Bovine  MMBT11899
ttctctagctaacagaagtaaaagcttaaagacaagggtggtgtatcttatttacctgcatagtacctggccatataatgcatataatgtcactcaataactatatatttgaatatgctgttgcttgcaacaacgacaaagcaaaagatttgatacaactatatgaagttatcaaaagatatttcccttaaaactgactatactgagcatatattttcatatcaaattatatttttaaatgtgctatgaaacatgtgctaaagtgaatgtcactttggtaatatgcataagtgtctackwaattttatgttcttaaaattcrtatactcatatattataattttaatatrtctataatttaattgtagataaattagttgggagaagttttctataagtcaaattaaattatatatcaaatttacagcataaatattccaaatatcaaactgaaacagaagtcaaaaaggatatttaaactagaatgtatagtagaaactaattaatattaataatagtgcttgtgaatttagcatactgtttcatttccagtatttttcacaaatatttcaagataatarttctrtacttcaagaggga

SEQ ID NO: 3541 - DNA, 600 bp, Bovine  MMBT12012
cctgactctcaattagctttgccgcttcccggccaggggacgcacacttttctgggttttctgttttcctgggtctgttttctccactataaaaaaaagctggtccgggagcactcaccgtctcccttttgagtttctcccgcttgcgaatcagctccaccagcagccgtgctcgctccaggtcatgccgaagccgctgccaggacttaagctgttctttgagggcccagttcttatcctcggaatctctctgaagaggcaaaagggggatcaggagatgatgagagagccagaggcaaygagagcccaggaaacttgggtcaaaggcaggaaaaccaaagctgggagcagtgatctcttggtaggcttgccagctaaagtggaagctctgcaacccactgtggctgttgagcccagtagagttggtgctcggtatatgcttgttgtgaatgaaaggatgaacacaaggaataatgcatgaaggataatgtgtaaggatttcatccttagcctgatttgaggtctagtttaaaggaacaaacagcccaagccctcaggcattggaaactgcagtcacaaatctgttcttgggacctccct

SEQ ID NO: 3542 - DNA, 600 bp, Bovine  MMBT12029
tgactctccttttcccattttctctctcaggtatttcccctaacaaaatctgtgtatgcttacctgagtgttgatcaatcagtcatgtttgactctgcaacaaccccatggattgtagcccaccaggctcctctgtccatagaattctccaagcatgaacactggagtgggtagccattccattctccaggggatcctcttgactgaaggatcaaacccggatctcctgcatgggaatacctgcttaatcccatcttaccatcttgctctttgagggacatttcattcaaagaggatgtygtggagcagaaactactgtttgctcatccatatcacttggcacgatggagtctttctgcagctgctatggactcttctcacaatcacctgcgacttcctgaccaagccgctgggctcctgtgccatcctggaagaaggctgagcatggagaacccagactggctcccaggcacggttctcaaccacaagcgaggataaatggtggggaaatgttcttctcttgcccctccatgagatcctatattgtggcttcacatagaagatgcccagtttctccatggagcaggctgtcggttgacc

SEQ ID NO: 3543 - DNA, 600 bp, Bovine  MMBT12448
ctgtgtatatgaagatatgtctgcataatgaaagcttagatatctctgccatgaacatttgtaagacaaataaccttttcagaaaacgtgtgtgcatgggggatattttgaaactcacaacacttgtcaagaggaaattaatttccacttgaactaagctaatgtgaatgtcaaaaatgccctttsaaagtttaatcacaagataaaagatcatgtctaagagtaaatttgcatatataaaaccaatctataacactgactaaatgttgttttatgacaacccagttcagtaaacaagcyggctttgtgaccttgggtaagtcatatagtttcatcgtcctcatataaataactgatatgtgaggacatcctgagacatccattcaataacagcaaaaataataaagtacgtctacaatgtattattttaaaaattgtatgagatatttatatatgcatgtatcatatatactcatatatacatgtatagatatgaattatttgcttaactaatgattatacttttcctatttgcatattaatcatatatatatayattcacatacttatgaaaagtttagtgtctagatttgttaatgt

SEQ ID NO: 3544 - DNA, 600 bp, Bovine  MMBT12496
agtcataagatctctatataaaatatgtagacatctgtatctatatagatatacattcataagaaggtaaagagaaacccaaaacccccaaacgctagatgagagggataaaagctgaaaataaagatatacatctatgaatttttatgactaccttgtgagyttacttgctgtcaaactgttctgaagacatttatttgagcagctatagaaactcctacaatgccgttttcatcttgatacttctattttaaccttgaacagtctgtcaggcctcctacatttctctctgtcatagcyatgatgcctcttttggcaataaacatcagtaaacttaagtgccatgagtcatattgtcaatgtttaattaaatcatggtctagctagggtttgatttatttaggcctgaattcatttagaccctggtcctcataaatttacatagcttatttaacaagctcatgattgtataaattgtagactcctttgaaatttcaaacaatataagttgtaaaagccttttcttgtcaagccaagagtggtagaatataatttccaagggtggtgttttatttttaaaccgagcattataaaagaaat

SEQ ID NO: 3545 - DNA, 600 bp, Bovine  MMBT12586
caggaggagggctaaatgggagggttctgaggctaaagcagcactgtccaggctaaaggatggacactcattttcttagtaagcatgtgggatttccagagaaacctagattcaaaaactataaattacagaagttaagagcagactctgattatgagctcatgtacctaagattccctccacagasagaacagcttgcgtggggtaaagaaatagacatgggctatagacaggtaaccctgcattcaaaccccactctctcattaacttagttgagtgacttgcttcaggtaccctttygataaaaccctccaatggaaaagacattgggaggtttcggtaaaagcctactgcatttgcaagtaactgggagaggctgtttactgtgcagcctccattcacacggcaggaatacctgaatagctggaccacaggtgagcaaactcaccttctccacttgtccccctggaaagaagaaatcaaaaggaaatctctctctccagtgttcaaaatcgagctggccaatggctatctgtagcatttctctttctagaacacaactgagaaggaaaccttctgcagggttggaattgagcttag

SEQ ID NO: 3546 - DNA, 600 bp, Bovine  MMBT12625
caactattgtttaccaagtataacacgctttgcatgtctttgtttctctccatcagtttttgccacattctttctgagggaagaattatcctgaaaagccaattcccttcccaaggcctggttgccttctattgatagctaatcctgattcaaatgttgaacttaatatccttgtgagtagtagttgctcaatgggtaaagcccacaaactccatcagcggtgccacaggacagaagatcagaggttctggcctcatttaatccagacacaatgggatttgtggagagaaggtgagtagygggraaaggagagtctaatsttggaagaaatgaataaatagctccaagtctttctaagggaaagattgaattgaacatggcatttgcactttacaaggaagtagatatctaacccaagcaagaataagagtttagggagaattcttggtttaaaaatgaggagatgatcagaatgaggattacaactaacatgcttgcatttattagtgttctaccaacatacacacacaaatcacactcaagtttagggcctcagtacagagctcagcttcataaagaactgactaatgaaaacagaga

SEQ ID NO: 3547 - DNA, 600 bp, Bovine  MMBT12791
tttagacattcaacaagggattaacggttcttttccttgtgttttgcccttgaatcttcatcactatcttgagataagtggggaagatggcaaagagaggaaagcaaagtctttccttttaagaacctatgtgtaaggaaagtgagccaaagtccagtctctggaccaaactatgtctctacaaggatgctcagagaagaaagttctatcctccagcatgttcactcacagcagcacaaggatttatggcagtggaaaatgtaaaaggagggacaggcaaacagcaagttaactaactgytgtgagacaataaggatcagagtaccctttatgtgtacaagttccagcccagtgagtcaaccgatgagagcattcgaaccatctaagtgctctacctaagccacagttagttgcccagtgtattgcataatcttagaccctcacattcagcatgaggagagatgagggaaaggcaaatatatggaacccaagagaagcaaagtgcaattcccgtaaaggtagagaaggaatgtatgagccatgccctcacagtattttccgccatgacagctgttgccccaggatcacatggcctgtaaa

SEQ ID NO: 3548 - DNA, 600 bp, Bovine  MMBT12800
ccttgctattactggatgtgacaactctgccgtctgacacaaatcattttggcaatcccagaccaggaggtccatttattggagggtaaatggtaatgaccatggtgaggtctggcagaatcactgaaattgctgctaacctttcccagtttttgtccttcttttctcttttatatttatgtatttgtttggctgtgtgggtcttcgttgtggcacacaggattcttgatcttcgttgaggcatgtgggagctagctccctgaccagggatcaaacccaggccccctgcattgggagcaygaagtctcagccactggaccaccagagaagtcccatcctccttttcttagccccagagagtacccggattgggagctgaagccctggagaacactgtcatagtgtgtgtacacttggattggaataatctctacctaaagataatccagatgaatccccagccccccaaaatatcttcttctaaaggacaaataaaataagtaatctctgtatwaaagaaaaggtgattaggagataacagtaaagaaaattgagactgcacagcaggctctccttaacttcaaggcagtctttctttat

SEQ ID NO: 3549 - DNA, 600 bp, Bovine  MMBT12835
cctcacagtgggagcccttttctggatggggaagtaagaccttagcgtccattttagtaaacttctctttctcatgtgtaagtgcagatgaaaagtgctgactgcttcttttttggcattgctttttaattatgaccatcaataaatcattctatccctgaacaggacttgagaatggcccgaaggcagagacacgaytcctcaggaactaggccagcagagaacagctttctcactccccacctcttcctttaatcctctgtcagaaacagaaacattctctcttcaagaagctggcarcggacagccacacttgcgttccgtctgggaaccctgttagcacccagttctacccttggcctgccttactggccactgtcacagaaatgggatctgtcctctsttctgcattttttcccaattcattttcccttcttaccggtgcaatggcctgaacggtccccccacccctcctcaaggatacgtccatattcttattctcagaacctatgagtactgccttatttgggaacagggttttttgcagatgtaattcagttcaggattttgagatgaggagattcaaaaaacagatcatgg

SEQ ID NO: 3550 - DNA, 600 bp, Bovine  MMBT13031
tagggcaggcccctttgaagatcaggtgggttgggcgggacaccccgtgctaccatctcattaaaaggcccttcatctctggacaagtcatcagcacatctgactccaggattcccttgtggctcctccaaacgaccttggttcccacgtggtgtcagcttccgcatgccttyctctcctggttttttggtgctgttggggcctctgctcccctgctcatacctgtccgctctccagcacctctccatgaccactgtccctgagctgggatgcctccatggattgacttgcagactgctytctcctacccttctcagagccaggccaggatcactctgccactcactcatctagtgtctcccgaatccattggctcccaggagaaatttcatggtaacagattatatgtgagttctttaccctcaaacatatcagtctcagccagagatagtgatgccataaaggaatccatttgtttgttcagcatatgtttaccatatacctcctggagctagacttaacagctaataagatagctgttgtctctggccttccagaactaattgtccctgaaaaacatagccatggacacaagcagtt

SEQ ID NO: 3551 - DNA, 600 bp, Bovine  MMBT13155
gaggcagtgaggcagggtctccttaagtcagggtggrgtgcggtggggtggatgtgggtattgcagttgggatgcagctggggtaacctgaggcggggtggtgggaagaacaggcaagaatcaatgaagaaatgttcctccatgtttggaacacttaatttaggggaggaggagtttgggggttattttactgttcttagagtamcacgaaggttttccaaagaaaagcagcatattcactcatatgattttgcagaaagctgcagacgtagccagcccaagggagaaaaatgaaatacrcccaccatggatcatccctaagagcaaacagtcaaagaatgctaactgggttttcttgttgctgttgaccaccatgcttgtattcttaaataaacgctgggtctaaggccaggttaggtggacaggtgggtggaaagcccgggaagtgtggatccttgcacctccctcactgggagcagtggggccacccagggaggtgggggcatctcagaaggtaagagggtgcacaggctggaagggcatgatggatccacctgagtcgtttctaygtgtgctggtaaagggggagaaagaacccca

SEQ ID NO: 3552 - DNA, 600 bp, Bovine  MMBT13181
tttcactgatggtagttcgcagcccctgcaaagtagcctttgttacatgaagtccgctgggaaatagatgttctgtctctatgacaatatattttaactgactttctagatgccttaatatttgcatgataagctagttttattggtttagtatcttgttgtttacgcatggaatcactattcctggttatctcaccaacgaaggctaggaggcggcatcagaggtgctgggcgtgacagagccatgagccagccattttataagcactctgatttctaaaagttaaaagaaatatatawgaaatctctgtagcctttagttatcagtacagatttattaaattttggcccttaacccagccttttccagtgtgtaacccagtttgaaatcttaaaaaaaaaaaaaaagaaaaaaagaggaaaaaaagaaaaaaaaaaggaaaaaaagaaaaaagaaaaaaaaaaaacagtttgaacacaaaaggctctatggaagaaatgcctctttgtaggtgaagtgttatctctgcatgcaacagtaaaaattaatataatattttccccacaaaagaaacacttaacagaggcaagtgcaattta

SEQ ID NO: 3553 - DNA, 491 bp, Bovine  MMBT13351
aggatgattaatttgctaagaatgttcatgggaatgtctcaatattggtggagagaaatctccaatgcaacatttcttttcacttggttcatattcttcytgttagaaaaaaaataattctaaaattaaaactatacacagagctcaaaactgttcctaagtacatatgtaaaaatcaaatttaataggaaatattgaaatgaaaacatctgaataatattaaacactagagaactgtagacaatcttcctgaaagttttacatgtttggacacaaaatctgttcttacatcttacactrtaaaatcttcaaactcttactacccacatcactctaaaagaaccctgaggaagtgaaaatagttctcatggcagtactcacattcctgcttaaaggtaaaatattcagtaaggtgtctgcattcatggttgcctctcagaagaaataatgtacttggatacagaatcttcaggacccataaatataagaca

SEQ ID NO: 3554 - DNA, 600 bp, Bovine  MMBT13375
ttctgttatcctttattgcagggcttgatcccccatcaaatagtgattctctgaaagtgcagtacctgaagaattattcaaagtaccctatgtctgcccaggttaatgcattttaaattgatttaaatcttcactcatttcccttttgctttcattttattaggataatgagagctccagagatgttttgaaatagaactcatttaaaattccttctctatatttgagcctaaccaactgagtcctaactactgtaactagcaaggamtacttgagaaattcggacatagttatatctcygcacttttctaatgattttttggggtccccttctgccttattaacaagaagcacagtatcttgtacctgaaattatctaagaaccatgaggggagagtggtgagtaggggttggggcatctcactttagcctaaaaggaactcagtgcagcttccacacttctgctgtagcaaggagtgtgtgtgtgttagtcgatcagtcatgtgcaactcttcgtgacctcatggactgtagcctgccaggctcctctgaccatgggattctccagtcaagaatattagagtgggttgttattccccc

SEQ ID NO: 3555 - DNA, 600 bp, Bovine  MMBT13377
tggttgtctgatttcattgaggaggatatcactcagtaaccatgttctgtccctgcctcatccctacctccctgttatctcctattactgagtcagggttctacagagatcctcttctagtttctgaaggcttttaggtttggccttctaaccctctgtgaaaccttgcttccatctattttctgtattcatgtattatgttmtctctccatttcaatgaagatggagttttgtatytgtttcttattagagtggttttaggatatatagaaagaagayatgcctttacattgccatcckaaaatcaagtctagtagtagctcttgatgagcctatatcctcagtgaatctgaaaaaaacaacccrattcaaagaacttttacaaaaaacatgcaggatttcccagctgtgaaacaccactgtagacttaaatatatattcaagtggatggcttccctgatagctcagttggtaaagaatccaccagtttgattcctgggtagggaagatccactggaaaagggacaggctacccacttcagtattcttgggcttcccttgtggctcagctggtaaagaatccacctgcaatgcaggaga

SEQ ID NO: 3556 - DNA, 600 bp, Bovine  MMBT13394
tcatcattttccctgagtgcagactggccagctctattcttctgagactatcttgataaatatactatttcataggccctgtgcatttacttttaaaatttcttctcagttattttacataggtattttagtaaatgacattttcccaatgtgtatgtatacatttttaacaaataactaaaatgaggtatgaaaaccattatcayataggaatcaccttaaagcattctcattgactctaatatttttcttaattgctttttgattcttgtgatacatacatatttcaaagtatttctycctttggaatctaagtgcctcacttttctatttttgtttgcttttttttctttttatgttgcagattgctccatacactgtatcgcatgtttcctagtgataacktatcagtttgagtagaggtttaggagctcctttaatttgcacaaagtcaaggtttttttcttcttcccctttagttatcttattgtccaaatttgttttactaactactcarttgtctagaggtacaggtggatggagaggagaaagctggagttgtgggcactcatatcaggagaccatactaaaccttgggtt

SEQ ID NO: 3557 - DNA, 600 bp, Bovine  MMBT13556
tgacccagccaagtgcccatgggcaaagccaggccagtgacccaaagatttccacctgaccttgctgcccacggggtagcttaactgcactgggccccagaccccttggagaatatggtaaaatcctcagaccaaattctcccctaagtgcatatgcaggaaaatgtgtatattacttaaaggacccgtggctccccttgaagcctgtctggcggcccactgaggctgttcctggcccctcatcagagtctattgacagggacaagttcagtccctccagcacacgtgggccatacagcygggcccctcgggaatcaacagctcccctctacagctcttaacagaagcctggacacccgactctccatcaggtcccccrctgggccccagggagtcacagggcagccagagagtggagtggggagcaagtgggcgccagggctgagggtgtctgggtacatgtgccagcctgagagggagggcccagcagctgcggccagccagctgtcctgggggcaaaggagcgagggctgggccgcagctgtggggggcagggacagctgggctgatgcaggaggaatggagctgggtgggcagcgg

SEQ ID NO: 3558 - DNA, 600 bp, Bovine  MMBT13622
tttctatttacacataattattcagcaatatcagattattttgttaccattgcctcaatgaatcccctatcaattaattgaactctattcattctttaagatataactgaggattatttccataaaggctttcatgcccaccttccctcagatattccctcaatcttgattcatattttcctataggttttcataacatgctgtgcaaatttttttctaaacacttactgtgttacygtacaatgagactcaagtacagagctagcacataacaggtactcaataaatgaccacagatcyggggacctcctacaatgaccagacctygaacagctccacagtgaatgctccctgcactgcaaaagagacataaaaatactkcctgctgagaatcaccctggtgcatatatacaaatgtatatatacacatccatatgtgtgtgtgtgtgtataggcataggcatataccctgtacctcatgggaaattaagttatcttcagagatttcttggaaattacttgtataaatcactagaggaaagatttagaaatgataactaagtgtttggggaatttgcaataggcagtaatacaaaaata

SEQ ID NO: 3559 - DNA, 598 bp, Bovine  MMBT13788
  misc_feature (1)..(45): n is any nucleotide
nnnnnnnnnnnnnnnnnnnnnnnnnnnnnnnnnnnnnnnnnnnnnaaactatatgttaaaatgaagtgagtccatcttagatttacagtaaattaggaaaacagaagaatttgaacctaaaaatcaggctgtctgagttccaattctgactctatgttagcagcgtgacccggagcaaagtgctcgaacckcgttaagccccagtttactctcctttagagcatgatacacccacctcttaggattgtcatgaaaactgaatgaaaaactcaggtaaagatgtttagcacagagcctggyacccaggatagccctcacctgatttcagctattattatcttcatcatcatttggttatttgaagtaatgaaaagccaatgaaaatagtaaactattaataaacaaccatcaaaaggagaaatttcagttcaatctcttggtaacaaagagtaagttaagacgttttacaatgaacattactactttccaataagaacgcagatttatcttatattttgtttcgcaagagtagagaaacagttaatacttttaactgtacctacatcaagttttattctatcagttctttaaagacaaa

SEQ ID NO: 3560 - DNA, 600 bp, Bovine  MMBT14132
tgagcatggcttggcgtgttggggaacataytcaaattgcacaaagtaacaattatttaaagagtattctaaattcttggcatgtgttgatttaatccctgggtcaaccctttaaagccgatactatctttacccctattttataagtgaggaaatggtgacccagacagcttaagcaacttgcccaaaaygatatggcttgaaagaggcagatctgggatttaaatccatattcagttttggattcaaatccttgctttcaatggtggatacaatctcctgtcctttgcaagtgaagtkgatggtaacccttctacctttggcaggatgtgttccttgaggtgttccttccaaaaataaagatattctcattttttaattaaatactttgctacttttgactgcctcgagtcttagttttcagcaggcagggtctttccttgcggagcatgggctcctctctagctgcggtgcagactctggggcgtgtagtggttgtgggtgtgggctcaggtgcctgaggcatgtgcgatcttagttccccaaccaaggatccaagccatgtcctctatatcggaaggcaggttcttaagcacagga

SEQ ID NO: 3561 - DNA, 600 bp, Bovine  MMBT14148
ggcaagagtactggggtggggtgccattgccttctccatattcaatgttagtggttgtcaaacagtggtccccaaccagaagtttgttagaaatgcaagttctcagtccttacctcagaactactacagcagaatttctgggaatgagaaaagagactgacatctgaaatttartaattccatctgtgaatctgacatgagctaaagtttgacagctactgggctaagatgtgtatgtgataaataaaggagataaatggcatttatttatctactctgataagttatgtgatgttcttkcaacttaattggtcaactggtactaaagtgtttttcaaaatgaaaaagaaggatcgaagttatcattacagtcacattcaaatcatttgttccagctcagctccaactttgcagaaatataaaagcctaagttatacattaaccctgtataaattcaaaaggtttactttgggggaaatttggaggaattttaaatttcaaaaaaaaattattaacattgatttgggttcaaagawtcctatacatatactatttttttaaatacattgagtagttgtaatgaattagcatcaactggtt

SEQ ID NO: 3562 - DNA, 600 bp, Bovine  MMBT14157
gtccatggagccctcccaacgctcccaggcctacagtggtcaccccacggtctccggggtatcgcctgccccctgcccccgcagcagctcgctgaagagaagcctcctccccacattacagccatacaggggctgcaggcagtgcaccctcaatctgcctgtctgtaccgagcagactgggactcaactgggcataaaatattcagctaaactggctgagaggtgaagatttttttaagaacacagaaagagctgttggctgtcgccacagagtggcctctgggctgaactggcacctcyctgagcagggccaggcctggttggagtggagaggtacctgcacgctggggtggcccccggctgatgccttcacggccccgcggctgccctccgtctcgtagtgggcacggtggtgggacttgggctgcacctcgatcctcagctcgtagggtcctgagtgtgacggcagctgccagtcaagagccggcagggacgggctgaaatggacacacagagcgttagaggcatggacggctccccgcgcccacggacccggcctgagacagacaggcggcgtgtccttccggctgggtctgaaac

SEQ ID NO: 3563 - DNA, 600 bp, Bovine  MMBT14218
agttgaagtggtttcaacttggtagctcagtggtttctctgaatgaatgagacacacatgtatctgagagtggaactgctgggttacagagtatacaaatgttcagtttttagaaatcctgaaagtaggtgtcatagcatatatgagagtgaagggcctgactctggtttggcctgttctgaagatggtgagccctcaaaccactctattttcatctaccttaagaatatcatcttcatagacattgccaacatttattttttcctaaagaaaaggctgttaaaactaagaagggcagaygaaattgcactgttgttaaaggcaaattatattataaaggacaagctgtctagtaaaacaaacttataattacaattatcttcaaaataaatcaaattatctgtataaacccaaccactcactggtaaattaatggaaaaacatgacaatgttgagcttttaactgcttctattgcaaaagccccaaatataaacttcagttatcaggcagaaaagaggcaattagtttgcaacagatgtaccactaaaaacctgttacagtggagccccagagttattaattccaaaatttatgaagtc

SEQ ID NO: 3564 - DNA, 600 bp, Bovine  MMBT14713
ttgactataggacagggctgcaacgtcacacttcacctctaggtgtcactgtctgattttacttactctgcctaagacttccttaaattggaattctgtgaaactcatcagcgcccctaattttctaattccatgagtttaatataaagacttgcatcttttggtcatggaattttgctcttaggaagtagagacacaagtaagcaggtgccaacatggcccgccttatttcagtctgggtccctgaaaggagaaagagagaacagccctcttcaggcatagcttgtccccggctcctgytactgtctctgaaaggttggaaggtgccctcttcrtgtttcaggatcaggaaagaaaggcaagcatctctctctccagactgctcccacgtttggccctgaggagaccatgcagcctggcatttctgaaaggacaccaatggccttggtttgccaaatccttcacaaaggaacttgacaaaagtggtcaaatgaattaagtgcaaaygagaatttaatgtccccatttggtagtcagcttgtggggcgtgggggaagcctaggaccaaaattaaggtattccctcatttcagatgcacag

SEQ ID NO: 3565 - DNA, 600 bp, Bovine  MMBT14821
tgggaatgggaggaagaatcatagattaccttaagtttgtgggcttgaacagtggaacgataggttgctgttaaccaaggtaatgtataaagtgcttattagcttgcagtgtggcacctagatgctctgtaaagggtgattctcttctccaaaatttagggtaaaaatgaaagacttttcttttctctaatatgcttctacctgcataagtgagtagaatattgcaccaaataatcaggtaataaattacacatttagctggcactttggagttctataaagtactctatttgttggccragatatttatcctctaactggaggtggaactaatacttttttatatgaccgatacaatagtgacaagagtatcaatggtaataaaactttttttaaaattcaaagaaaaaataattctgtcaatctttcatttaatggatgcatagatctgtgactctatatcccttttcttcttttcaggatgctaccttacggctgcttagcaacaggagaccgctctggcctcattgaagttgtgagcacctctgaaacaattgctgacattcagctgaacagtagcaatgttgctgcagcagcagc

SEQ ID NO: 3566 - DNA, 600 bp, Bovine  MMBT14924
ggaggaaggtaacacaggctcggtggctctccggacaaggaaggctttgttgtggcttctgttcayggcttccccgggagccgtatctcttatgacaactggcaggctcttctctcaccgctaggcactttacagctacagtgccgaaaaccccacaaatccccaactgcaggggacaggtggatgtcaagggcaggggtgtgtgtgcacgtcggagtgtgcactggggtgtccccgtatgtgtaaggagtggaggtggggttgcagagcaagcaggagacaggccagtggttctcaccracctccatggccagaatgcaaggcacacagtggacacagtctctagccggggacagcaaacttcagagacaggaaagaaaagctcatgactcaggtsacctgcctgtacacagagctggtaaatgcagagatgaaaaagcatctgtattcaggggagtcagacccttctccaaagggcagagatgcacggtgcgctgtggctctttcctctctacggtctgatgccacggctgccactgggcaggagaaacacgatgggaacggacatgctgggtgtgaggatctgagtggggtgctggg

SEQ ID NO: 3567 - DNA, 600 bp, Bovine  MMBT14935
ctgcactgaaatgaaaacatcatttttccttccgtccagctcagggaactctgaaactgcctctgataattaatccacagagagaaatcaatactacaactggttgaagatgaaacaacccatagcaaaataaacttttgcagggatgcctcagcggcttctgcggacgcagagtgcctgctgcaggtgtggcaatgtggactctaaataaatgctgctttctctccccagatcatcccaccccaaaggtcaattacccgaaccgttttaagttgtacaacacttttgtataaatacatyctttgttctccaaatgttgaygggtcgggcttctttttcccattaggcccaacaaatgggtctacagtttggtagtcgcaaatagactgaaagaaatcgtttcggggtgaatgatttacgagtgaggaggaaaatccaggtttctcatatgggctgctcgtaagtccagtgtggtctggtggagggggcgtgtttcctttccttactctggttttgggttttggttgaggttttgttttttcagtttaacttacctttgggaagccaagctgagttggcagcatggactgaccctgtgtt

SEQ ID NO: 3568 - DNA, 600 bp, Bovine  MMBT15781
acagatcaagtagaattagctctgaaatatactctatgtaaaataaaagccaaatacacgtttcttatataactctttcaggtggttttactcctaaaacttaaacttgcttatgatgagaaagtttgccactatcacatccattcgctgtttattcagaacatcttggatttacttttcatcatgtaggcatttcattatctagaaaaacacaacaaaaccaagcactaaatatcttccttcttggagatttcccagagatactggggcctggcgagtctctgctttgaatyggtagcygggtagatgacttctaggttttgtcctaatgttcagagtccatgaattagtcaataagggggatgcacacttcctgatcgctgagcaagacccacctctcccayctctgatggatgccaggggccccgggtgctgggaggcctccacggttaatgtgaagtttgtaaatgcacttgcatttatgagcaggatggcagaatgcattattaatgcctgcctgagaaggataacaagaggcttttgtggtttatgcagtaaactgtgtttccactttagaagtggacgatagtaaatagaaat

SEQ ID NO: 3569 - DNA, 598 bp, Bovine  MMBT15794
  misc_feature (1)..(244): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgaatactggtgcacttacgctgtcccagagatgtcctgatgtctgcaagtgcrtgatgttagagggtccccaacataataacctcttgcccctctggctggcctactctttttcatggactccctcagctgtgctgtattagccccctcagagtatcttcaccccagtcttctctctggggtccaacttctgaagcctgagcctcagcacccagactccatttgctgaagtgtgtgtactaacaagtgtctcaggctgggaagtgctggtcagcactgatctctgtggtaaattttctcctctttgccttccatgcacctgttgctgtactcccttctgagggacatacct

SEQ ID NO: 3570 - DNA, 600 bp, Bovine  MMBT15812
ctgcatgtgtagctggagaaaaacaaacaaaaaaaattgtgctaactgcaatcataattaatccatgaacatcaaccagtaagacaacttttaaagaagcccagcacgagtacacatttccatcacccagtcttacctcagctcctttttaaacatccaacagctttctccccatcttccctagaaacagatgacctgttttctataccactgagaaaataagagcaattgaaagttctttcataattttccatttccagattctttgcgcatacaacctacttcagagaaacaagtaayccacacaatgcctctgtatgcttcagatttttcccttaagggaagagcttttggtattgggaagagcttttggtattagttatttattcatttttaatgatacaatcacaattacagtaaataaaaaacattacttttaagttactttgaattacattattaaataaaaataacataaatcaaaattttaatcatatttgaaaaaatttgaagtcattgaagtatattgattgttttttacaaaatatatttatgggtgttgaagtatctgtatttcttaggggaaaaagtaataaaaga

SEQ ID NO: 3571 - DNA, 600 bp, Bovine  MMBT15844
tgtcagagccaacattaaaggagtcaaagtcatcagtcaggatgaaagagaacatcagtgtccactgccatttgaggccgtgcctctttgggatgtaacagactctattacgattctatcacgattctttcatctactcaataaacatttctgaagcatcttcagtgtgggcacacagacacaatctctgtccccatagagacctctgagcaatgactgctcccccgtagggagggttggtctggctaggctctgccaatagccgcatttcaaatcataccagggctcagagctgagagyggattccaatggcaggtcatgtttcagaggccctccaggattcagcacccttgcctgccttcttagccttcagaccaaatgactcttgtcatctccctcctctagccacctttcatctccacctttcatccaacacctgtgtgtgacctatgacaaactttttactccagctgaaataaatgatcttttccttcaatagcttttcactcgacaacctgtttttctgtgaataaattaaaagtattaggctagagatacgtatacttttaaaataaatcccatggataaaaaatatcaccc

SEQ ID NO: 3572 - DNA, 600 bp, Bovine  MMBT15892
agtgctgctctagaataagagagatgcccacagagtgtaaaggcaaattgtccacagagtgtaaaggcaaattgtcaagagctagtaaagaagtttgagtgacaacgacatcatgatgtgaatcttgcaaggtggttgaattggctggctatgactgacaatctaggggcaaactggccaataactgcatctcagtttcttcatctgtaaaatgaagcgaatagtggtggattgtttactgctagaaagctaaatggaataatgcacgtaaagacttcagtgtgaggtttgatgccctgrtcaaagggagcttcaataattatgattgccttgggcaactccagctgctgtaacaaaatactgtcgactgggcggcttacatgacagaaaattatttcttacagttctggcagctggaggtccgtgatcagaatgccagcatggttggattctggtgagaactttcttcctggcttgtattaatacttggctgccttcttgctgtgtgcttatatgacagggagagggagagagaaaggctccagtctctgcttacaagggcattaagtccatcgtgagcaccccacccacatgacctcg

SEQ ID NO: 3573 - DNA, 600 bp, Bovine  MMBT16395
tgctttcactcaatatggaatagcaggtactggatatactctcctgcctgaaacaatcaaaaagtagacaaaacatagaaaagtggtttttaagatcctggacatcaggcaatgaaggacaaagatctctgaaagacaggaaacaaatgaggtgggtcctaagagtatgccagcccatctgcccaggacagttttcaggttacgacacaggaggggacacaggcagcgtctggtggacatcctgggtgaattcaggatagaccactggacagaaaccgaagagagctgcacagagacaaygcygggaaactcgtgagtattcagcggaatagtcatccgggcatgtgtgagagaactgcctatccgagacttttggaaagaaccacccaatgragagagagggacaaatgttcagtgctcataaggagctggggatagtgaaagtttccattcatcacaatggttactcccatattagtgaaatgtttgtgccacagaatggggcaatttaaacatgggagtamtttattaagggcttcccaggtggctcagtggtaaagtacccgcttgcctatgcaggcgatgtgggttcaatccctg

SEQ ID NO: 3574 - DNA, 600 bp, Bovine  MMBT16535
ctagtttgagttcagctttttccaattgctcttggaagcataaattcagctgcattgaatctcttggggttgagctgtatacgtgtgcacataactattatgttctagtttatgacgcgttcactccaaataaccacacgtacctgacctcatgcctgctctgggaaactggggcaacgaggctcagaatacttgcgttacatgtcctggaaatgaaacagatgagagcaggcagtttcatcagtccttttacaaaagatgactctttaaactcctaaatagcaacaattttaaagatcycacattagagtaataccttatcagagttgtggaaaggattttgcaaaggagagctagtatttaatttaagaaatatttgcaccagctagacatatatataggctctcagtaaaatataaactttgctggtgttgcagaaagagcacaaggatgactttagacctgagataaattcyagttctgttatattctctgtagttttgaacaaatatcttaacctgcaccaaacctgttatttctgctataaaatgagaatagtaataattttgaatgcctggaggagatggagtcattaaaaga

SEQ ID NO: 3575 - DNA, 600 bp, Bovine  MMBT16645
gaaatatcacttctatcaacccctgaaaactagtctagcaaaccttgtcagactaatttaaatatgcatgtagatataatcaggttgaagttttacgaagaaaaataattttgcaatatgaaaaataagacaatacattcatttttatacctaaagatatataagcatgttgacttatactataaaagaattctggtggaatgaatttagatctgagtcaatcataggtgaatgcaaaacaatggtatctgagaatgagtcatctacccaagagatttgctccaattaacagaagactgmacacatctctgattcatgtagagatggctatatctctcctctgcccttactaagcccccaagctggaagaggacaaagcatctgcttggtgttttgagaattactgggcacagtcagaccatcctttctcatatcctggatttgttctggtcttttgtctataggagatcatcagcggcctcagccttatttctctgctgagatctagagtgggtgctgtttatggatcttctaaatgcccaaaattggatgatctgggaagcctagagaaattcacagagttcctgtgattgataaaat

SEQ ID NO: 3576 - DNA, 605 bp, Bovine  MMBT16680
  misc_feature (1)..(5): n is any nucleotide
nnnnnagacatcttaaattagcactaggcagagagaagtggctaagcttgaggtrttttgaatgcagtcaatcaraattcttgataggttaatagatttgctgggggcagrtggcaagtgaaggagaggtgagaatccaagatgacactaaggctgacttgaacctttgcatcagcacttttgcataaaacgccttaggctgctgttcatatctgyctctgccaatcctaacaacatattgtgggagccaattctccatgtgtctctcacatttctgtacattttatgagcactaactgcattcrttctggactatcttttcaaaagtacgtagagaaaaagccttcaaacaaagaccatgtgcccctcagaaacaaagcagaggttcgcttgctatttgatatcatagtgatcacgtctgccacagaggggaaagccagacaggtttacttctcactattaaataaattgggtttcctaagctcatggttcccatcttgtaatataacctgtgtgtcacaatcacttcgggctcagagaagcagtataaatgctgtatgctggatactcctattactttgagtaataagcagtcccttttctct

SEQ ID NO: 3577 - DNA, 600 bp, Bovine  MMBT16728
actttgaaaatatgcaagaatacacaccacacacatatgcacacacacatatgtgtgtgtatgtatgtatacatatgtatgaaatacgaatggttctgtatctctggagaaccctgatgaatgcattataagatgaattgtaagatctataattttataaattattagtatgttatttttctcctatggcatcattaagcaaactcagatcaacttttacccaatgattttcagaatgttgcccaaagagtcctcatttgttaaactatgtacctgttcaatgaactttttacatcagastcacgagggagctttgctgaaattcasatttccaggctccacctcagacrttgaatcagaatctcyttgagtggaacttggtgatctgtatctttaactagttctttggattcttgtgcacatgaaagtttgagaaccactgatttctatggtatttgttttaaaatttgcttggacagtgaaattgctggagacgagactattataactaagaccaaaactagtaactgaagaaggattcagcagtgaggaaaatggtagatgataaactctaaatggattatacattttctttaaaat

SEQ ID NO: 3578 - DNA, 598 bp, Bovine  MMBT16932
  misc_feature (1)..(153): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgttgacacagtactcaggctattcgtatgtacactactgtttgagaagtatttcactgcccaagttgtgtttccatgagacaaaaaagaagctacaaaagtgataacaagactctgagagattcagagctctggccagaaatayatacactattaggctgtaatgtgaactacacacacctaaagtgaggtcagttagaaacaaaggtttagctcacaccaccgaataaataaatgcattcacatgatgccatttgatttagtagtatcttgttttattcatctataaaatgcaaataattcttgagatttcatgaaatgggaggattaactcaatgacagtgataaatgtgttgatataagcaactagaggctaataaaagaaaggattatagagaaaaagctcatgaatatcatttcccatccctgagaatgttgttgcc

SEQ ID NO: 3579 - DNA, 600 bp, Bovine  MMBT17232
tgaattccctgaactgaggaacgagtgtcgagacttgttttattggtatttacaaaagtaggttttaaaggatcagcgatttgcagattccttttggatgtgtcacacccatctttcgttcatcacccaaagagagcagggaaatgtgaaggcagagactttgaaagcctggagactgtgagaggggcgacttgagatgccagtggaggttttttcccaggactttgttttgtccaggaagcagccgtgccctgggcaggggtttctttccctctctcatcttccaggcagttaggagcytgtcaattaaccctttcaggctatactcagtcggggttagagcttaacagagatcacctctcttccttggcagatgcaagcagcaacagaaactgctctgttcatctttcacctgcctcagtgcccagcacggcacctagcaccacactgataagagtttgtaggaagcaagggacgggggagagaagaaaaggagggaaggagaaatggaaaccaaggacatctatttgatactttacaaggtagtattaatagaacacactcaagggttctgggttcaaattcaagttttggtagttg

SEQ ID NO: 3580 - DNA, 598 bp, Bovine  MMBT17257
  misc_feature (1)..(4): n is any nucleotide
nnnngatattgtttctggttaaatggattacagtttatgggcttcaaagcaacagggtagtgtgagcaaatagctgaaccatccaggtatttcttcaacaatccctttttggtattgactcacttatttggagcacttggatctgtgagacccaggtttctggggagacagaaagctcagcccaaaataagactttgtgtccaagggcaggtgctgtgcattaatgaccatctccaggtcaaagtcttccagraaaaaagtcagtgtcaccaagaaggggctgggtaagcatcagaaagyggggggccaggttggtacccgcctcatgtcctgaaggcccgcagttgaacttcaggccrgcccctccagggatgggcctggtgttaattatgatgcaatcccccagccatgcagcctcagcaacaatttcgggagtcagggtccgtgtgcaaggccattaacactaaacatgttttaatccataattgtgcgagatttatttaatttaggggctttatttatagttcgattggaattgtaatgtattttcggccctccgcactgggatctgtcaatttttacggcgtcttttaattgt

SEQ ID NO: 3581 - DNA, 600 bp, Bovine  MMBT17456
taatgttktttttttccttctcyatgtcstataaacttcgagtgttgcattgtccatgtttggtactgctatggagggaagacaggtacaactgtgggaaaattctgatttatgaaatcaaagctttaaagaattgtcagtatagtgtcatttaaatatgtaacagcctctcgaacatatgcaagaccaacatgggcttccctggtgtgtaatccttatggagccggtgtagtgaataaataaacgttgtttgcaaytaatataccattgtwaagaggtagagtattccttgaaatttaygtcttccacatttgtggaggatccacagtgtgtaaaaaagtattctggctactgttacaggccccaaatgaagcttgttttcctaagtagttcaaagtattccccccagcaactcatttataccatttatttgcttaacaaacttgttgttgcaaaagagtacaaagttggctcaattctaaattatcccagatgccaaaacagcaggtacgaactaatgaggtttgactgtgtcaaaagcaaaggcaaaacgtgcgtgttctattgatagaagcccagcctctttgaaktgacaaagtc

SEQ ID NO: 3582 - DNA, 600 bp, Bovine  MMBT17566
gtctgcctckcaasttgatctgttcaaagcaatttctttccctcatgctcatatagccctgacacttaagtgtcttgcatctgtcagtcatgtttgtcttataytggaaacctgcagaccctcagccctgctaagggactcagagccaggctgttctctgcaaagtcctggctgctggttgaatcaaggtaggtgggggtggtgcagaagaaattcatttgatggattaattcaggagcccccagcaggtagtaatgccagccaatctaaattcttccaggatttgacctagaaagaatrgagaagcgaatggagaaaaatgtggagagaaactgaaacaagaagagagaactacaagagctgatttttggttccagctccaatccatgcataattattaatatttaattttttaaaaatttaaacaacttttttcccttaggaatktactaaacttcttttcctaaccaatccgtttaaattctcactgtgggttatgaaacacagattgaaaaccataaacactwctccatgaacctctattaacaatgatttcatattaactgtgtgtcacccagaccttgtcaaaagtttagagag

SEQ ID NO: 3583 - DNA, 600 bp, Bovine  MMBT17656
ttaggaagactcatctcacctcactgtgcccaccaatcctaaagttttatttcatgaactttcccagtctcaatctgccgcccactttgaaacatcagccataatacccttgagcccagagtgccgtgcgtgcttatgctcagtcgtgtctatttgcagctcctctgtccacgggactttccaggcaaaaatactggagtgggttgccattttcccctccaaaggattttcccgatgcccagatcaaacccgctcctcagtgtttgcggtatggtaggcgggttctttccccctgagccrcctgggcagccrtccagaccttccagatcctgtataatctttctctgatgcctctctctggattctgctaaggcactgtyctcccaactgcagcaacttcaaatgaactgagttctgctttggtaactgagttacaaactgagttcagtttgtatcttagagttcaagattctttcctatttttactctcttgcttttagagtgttagtcctgtaaataagtgtttacccacatgctctgagacctaccattagcaaaatgagatttttgaagtcaggaggacccttagacttactccaa

SEQ ID NO: 3584 - DNA, 600 bp, Bovine  MMBT17687
cctatgaggcagagagaaactagggtcataaaccctcagagtccagtctacctgcagaccctggcgaggaagactccaggcggtcacgtgatccctctcaacatagcggtgcctgcagctactggggttgattcctgtttttattttttaattactaaaagtgatagctaagaaagggtcctggaagcctcataacctagactggaccttttcaaaagatatttctagcacatattatagacagtaaaaaggagctatttatttatacctgtgatgccaattgtcattaaaacattttcyrtggcttgacaagtcagtgtctygtgggctgtctcttatttcacttaactcttattactacttctcyccatcaaatgtacaaygtgttgaagaaataaacctgtctgctaggctggaaggaaaacaatattctgtttgttggcttgttttcctcttggtttcttggctgatccgcagtaattcctcataagggaaactttcagtcatctgtccactgttgtctacaygaggggttctcaactgagtgtgctcaggatcaccagggggaaatgtgcattcctcaagagttccagagtgatg

SEQ ID NO: 3585 - DNA, 600 bp, Bovine  MMBT17772
ctacatctcctctatttaagaaactatttcagtgctgtgtatataggctcttaagatacacagatcaattgtagaatggctctgttccaaacatgtaacaaagacaggtaatttctgtgttcatcactaccactctggaattgttttctcctgttgccatggtttccattctgaaaatcagaagcattgaacacttccttcctattcatcctcagggacagagtggaaactaacttttgaaaagaaagaaaagcttgtgtgcaagtcactacaaagtttggcccactaatgctcttatcygaagaggtaatttagcccctggtctccaggaagtaataaaaacatgggctccttaagtctgattatccttcaagttctagtttagcctcctcatttcttagaaaaataaaactgaggagtgaaaagtattagctgttgtgttgttcagtcactaaatcatgtacaactatttgcgaccccatcaactgcagcacgccaggcttcccagtcttccactatctcctggagtttgcccaagttcatgtccactgagtcagtgatactatctaaccatctcatcctccgccaccctcttctgct

SEQ ID NO: 3586 - DNA, 600 bp, Bovine  MMBT17805
catgaatttcgcaaattctgccagatagtggaggacaaaggagctggcgtgctacagttcatggggttgcaaagagctgtacatgacttagtacctaaacaagaacagcaatctgtaagttgtgtgtgcaagtgagtttcggggaaaaattcactgaagaccctcaggaacaaaaattctctttattcttagtaattgtgcactttggctagaatgcagtaaaaactcttctgttacttgggctggaatatctaaagaacaagyagagtttcacccacagaaagctgcttgttgcattcrtaggactgaatgagagtgggctgccataatctgctatgttggacacttgtcctagttgtctggcagcatggacatttgcccatgtggatggaatcccattaggtttatgaagcatggactagagaacaaggtttgggattggagggaacttcatctgagggagaagttcagaatgattcagatgaatcttctgatgaggacctcttagccctttccctttgggcgattattctgatgagaatgcaattgaattctggttgaagcaggttatctgattcccgtggttcaagacatctctga

SEQ ID NO: 3587 - DNA, 600 bp, Bovine  MMBT17892
tacatatttttgcgcctgcatctgtttcatgccctctcagccaggagcctggaaggcttgatgtggatgaaatggcggtgggacgtggaagatggtggccaggacatacctggtgcggggaggggtctgtgttgcaggcttctctctccagaggtcgcacgggagctgctaactcctgtctctgttcctttatgactccacttgggaaattaaggttcagataattaacttctgctgcttcttaaacctgtcagacataagccacgtgagcacacagaggctgctttttctggcccagcrtgtgcacaaaacctctcttgctggccaacttggcaggtgttctagaacagaagccctggctgctaagtcmccaataataaaacctcagtgggtaagtattgccaactggctcctgtcccggtgggttctctatgagatgacatccggggcaaggggtgcagggaggactctggccataacaatattcctaggatagaactaggatgctagtgaggttcttctaagcatcgcctccacctatacctgctgtagccgttcctcctgtctccttccttccgtttgctacttaccttgactccg

SEQ ID NO: 3588 - DNA, 600 bp, Bovine  MMBT17980
aggctcgaggggtatggattcatgatgcttacctgcctggctttctggtaaatgaccccaaatttgaatgtgttgttgacgtcatgctcgtcgtaggacacaatcatttgggaggcctggaatacgaggcaatagaagaartcagattactaacctggaggcagagtgaggaggcaggtggaaggggaagtacccatttcagtggaggacgggccccggttgatatgagatgttcacacgtggagraagagaagagatgaagtcaagtacacagtcaggatgcagctccgaaggtctcarstagctyccagcccctgggcttcccccagtgatgaaacctctgggtcacccattccatttccatctagatctatcagccaatgcctgtgcacagagagtccygcagaacacagggaactgacttgaccccagtgtttttatctggggagtaaaagtgaagctggaaccccaaaaccatagtcatcaaggatgatgctagctctaatttcacctctaatcagcaaacttttttttatttggctgtgctggatcttcgcwgctgtgcacgggcattctctagttgaggcaagcggggctact

SEQ ID NO: 3589 - DNA, 600 bp, Bovine  MMBT18068
gtggcagataatttcacaattaagcttttatagtcaagatatcttaatataaatctcaatttatacttctgtgttctttctgaagtttcattttaaaaatatataattcttaatatttaatttctatgtaaaattcaggcatgttctctgaaaatttctcattatgtgtgcattcattcaggtgggtttatctctagataaactgtctgatcagtctaaatacatgcagttacgctgacaccgcctggtttctggatttgctgaggttaagtgtctgtgaggtggtctctcagatccatrcttcagatgctgcattctggagttgaggtgatgctgcctctgagcactgcagaaacctagcagggtaatttatgtcaggggtcaggacgcttgttgttatgttacagttggggaagactgcagttcagggtgggaaaggaagtgaccacagttcaccgctaagcactggtgccgctgtcactcaagtccagggcagaacctgggctgcaagtcattgatgctgatctgtagggtcaaaatcggaatgtcacctgaccccaactaagaaagtacaagaatatatgtaaatggtgtgattgt

SEQ ID NO: 3590 - DNA, 600 bp, Bovine  MMBT18121
gcagtgggtctactgattttccaaggagatggccagtgtagactcacagggtcatatcaatgggagcacagcctgaaatgagggaggtgaggccagtcaagccatgggattagggactctgtattttgttcaagacccatcctgagtcacagatggtagaaattggggtttgtggaacctgaggtcttcttgaacttctcagcactcctgagtagccaaaactttctagatgaacctctgaggcccaattgttgctcaaactggagttattgatcctctatgcctcagatcccaaacttktacttaatatatttcttcaatctactcacctttctagtcaaaccttacagaaataataattgcaatttatctgcaaatacttctcagtctaaaaaaggcaccagggtgtgaagcctccctccccctaagtctggctacctgctttctcctctcagaggcaggtgttgtttctacacacacacacactttacccattttcagttttctcatcacacaaataacactcactacacattttactcctcattttttgtccattttgtagggtatcttacattccttcccaagtagctcattaca

SEQ ID NO: 3591 - DNA, 602 bp, Bovine  MMBT18743
  misc_feature (1)..(2): n is any nucleotide
nnattttaagatttcactgtatttatagcattttataagaaaaaaggaaagaagagaaaaaaaaagcttatacttggggtaagaaggtgcagttttcagacaggagactccagacaaatayggaaattcttgggggccctgaagtgacacgttttagccacatttaggggcctattggattatggattcaattctgaagggaaccratatagaataagtgtgcaaggtcagagactcctcagcgatgattgcatctaagcagtgacgtgaactcaggggctttgaaatgtgttttatcacaraccaatgcagcacatacattgctggacatgaatgtctcatgcagtttcatgttaaagagcgtggtggtctgttgttcacatctcactaccatttttaattttgcagagtctaagtttatctgtctttaggaatgctttatgtgtgggactgggcactgctggtccatttattatttattccctttttttcatttatcaagcattttccaagtaccttccatgtgccaggctgagctgagcacttggggaaaaaaggtacctaggacacaacccctgccctcaggcagctgccaggtgggg

SEQ ID NO: 3592 - DNA, 598 bp, Bovine  MMBT18932
  misc_feature (1)..(2): n is any nucleotide
nnaggattttgtgcgctacctgggtgaccccaaccacaggtggctggatctccagttcggggaccacatcatccactgggtgacatacgtggagctgtgcgcaccctgtgagatcacgtacagcgtcgtcgggcaccacgagaccctggaggacgacgccccccatacatcctcagagaggcgggcatcgaccacctggtggcctaccccaccatccccctgggcatcaccgcgtacaacaggaccaaggtcgagcagtacttcctgggcatcagcaaacgagacatccggcgcctgtaygcgcggtttgagggggactttaagctctttgggtaccagaarccagagtttttgctaaactaatgtgtaggaccatgagttcagatatcttcgttagaccagaggctaaccaggtggagctcaggcacagaaatgacacttcttcatctcactcctcttgaagactgccactccctgaggaccggggtgcatcttgcccagttaagctggaccctgacagttacgaagtagtctgcatataagrtgcatggagggtcctggcccccaccctccagtgccacygagcctctgctctccy

SEQ ID NO: 3593 - DNA, 600 bp, Bovine  MMBT19019
atggcagagccagggtgcttccagaaatgtggtggtctgatcacccatacagatgggctctgaaatcattctaccaagagttttatattagcaaaaggacaggataggaaatgtgtgtgtgtttgtgtgtgtacagagggaatgcacgcagtgttcttgcatgaacaatttcctaaatccaaagctataatcaacctggctacaagtagtatccagagctacttgtaggcctaaggcaccagtggcaaattctaaacacctgcagatattgtaaatgaattaggcattagggagagatgyggactgtgaagaactggagagggtacataccctatccatagccatcatccttgattaccctatgagagaatttgagccttatcttccttttttttaaaagagaagctgaaagtcctgattttttaaatgtgaaatctctcaactttaaaatgttgattcaaaacaagcaaaccaacaaaaactttataaacttccagtttacactggcctaaggtattggcactaggaatcaaaggaaaaattggggattcggacacttgggggaatggaatggatacacacaaggaaaacagtgccaag

SEQ ID NO: 3594 - DNA, 600 bp, Bovine  MMBT19029
taccaaagaacaaatcgaaggaaatggttttctacattagggatcccaagaccacagaatcaatactactgcttaattatatcaaaatgtcataccacagtttataacagaggaaacaaaatgtaaggaaaactttatgactttatgtagcacttcaaaacaaacctattgtaaagtgtggttttaakatataaattgatttgtacatttcagaagggaaaaaagacactccctgacctctcaagtacctaactagaaatcttggcaccatctataatgatttggccccaatcctatctrtaataggaaaactagaggcaccagaagctgggtctgaaactaggggataattagttccatccattagtgaacattttatgagttcagtaaatgaggagtgtctggttgagtgcttagaaggaaaaggggaatttggcaccataaaatcataatatactatttattaggaactttcccaggaatttaaaggtcatctgcctcccagtcccaaagaaatacaaccctgcagaaacctccctggccatttacaacctacctggctaagccttccctcggggcctgaaggactgacctatctrc

SEQ ID NO: 3595 - DNA, 600 bp, Bovine  MMBT19052
tacatataagtttgtttaaagaagttttcattttgataatacttggcagaagagaaattttacttttggaagaaaatatgaagaagttacctgcttctggctacaagatccattttcctatattgtgaagagatttgtttcattcaacttggaataccatccccttcataaaaccttcccaggccatgatagtcagaaggtacctttaattccacacctcactttgtactatcaataaaaatcacagtgtaaaacgttgaactctacaaatctcccatggcacctaaaaatgtcccttasatgtaacaracacctagtaagtctccttaaatgaaagaatagcggggttgttatggaggggaaatgaaaatcaattgcaattctctcccacaacagatttgggctaataatgtaagaattcttctgttaccaagtactaatttccaagtttatggacaaagttatttgacttacacacgatgaacagcacattcccatggcaggatctgctgtgttatcaggctttcagaagtaccagctgcaggtaggttttattttgggattttaaatacacacacagaagggataagtacaacaaca

SEQ ID NO: 3596 - DNA, 598 bp, Bovine  MMBT19109
  misc_feature (1)..(53): n is any nucleotide
nnnnnnnnnnnnnnnnnnnnnnnnnnnnnnnnnnnnnnnnnnnnnnnnnnnnntattaaagagactcttgtaacattctcaattcactcattaaaatgataaatgttagtactgtattcatatgaaataatataaacaagtgttatcacctacagggaaaactgaggaccaaaaatagtaaataccttaacccaggctatacaacctgccactaaattaaaatctgtcccattcccttcagcttgtattctatttagcattaatatagtttagtagtattcttactttgttcactcagcyatcttacaatcaggtattaagtgcccatagatttcaggtgctgtgctatagaataacccagcagttaagataggaagggctgttcagataaggaaggctaaagamagacagggcattaaatgagattagggctcctgtcagtggtcagaagcagcatggatgattctgagatacaaagtcacttttctcctctggaaaggctgttttttattgatgctgttcatcttttaaaattatgccaatgtgataatacattaatttatataaatagaagccctaattcaaggtcaggcatatc

SEQ ID NO: 3597 - DNA, 600 bp, Bovine  MMBT19270
ttatcttagtttaggctgctatagcaaactaccatagattggatggcttaaacaagatttttgtttttcacagttctggaggctgagaaattcaagatcaaggtactagccaattcagtgtctggtgaaggccctcttcttaatatgcagaagaaggccctcttcttatagctacctttttgctatattattacatgttgaagarwgagtgagtgagcatgcacaagcaagcaagctagctctctgatctcttcttataatggcactgatcctgtcatcaaggcttcacatcatgtaaayctaattacctcccaatggccatacctccaattaccatcacattgagggtcagggtttcaatgtaagaattttggagacatgcaagcatgtagtccgtagcacacataatatgagtaagatttgtttcatggaacttatgtttcagtttcatgcttgtgcataaaaatagctatgtaagtgcatttaagtcataatgtaaaatatatttattttggttgtggttagaaagcttggtggtggtggtggttgtggtgtagtcactgagttgtgtccagcccttgtgaccccatggactgtagc

SEQ ID NO: 3598 - DNA, 600 bp, Bovine  MMBT19378
tttaaaaaaaaaaaraaaaagaaaaatgtagcggtttaaaagaaaatgcactttaggaattatgtattatgaaaagtttcggtagattccaatttgaaaattaacccrcagcagcatctttgtgagaatgtagacctctcagataaatgggtgagattctgaccatagtagataccatggccacctccagacttgcccttcttcctgtgtgtcttccagagataaggacattaacagtctcgcctccaaagaggcagtatctatttgaacataattctccaaatttccgactttctgaaygcagatcaaagtaaggacccacactttcttcttctaaacatttgttacatccttgagttarcaaaagcagctcaaaggcttttctttcaaaggctgttgttaatcagttgggagagtgagctaagaaatattttgtatatgcaggagatttaaaactcaacgtcagttacttaaaattcttgacggacccacggtaatattttgcatttgaagcagagttttcaggggtgaagcagagcttctgaacgatgatttctgcactagaaaatatcctgggtctaataccttgtctttcccctg

SEQ ID NO: 3599 - DNA, 600 bp, Bovine  MMBT19387
ctttataggtaattgtgggtttttaagaaaaacattgtattttcctcaaatatggagagaatcattacaagttcgcatgcacgtgtgtgtgtgtatgtgtctgcaagtagaaataagtcttagcaggccttctctgtctttaagaaagccaaaaattactgccagttctattaacatttcacatcttttagttgagtatgatatgacttgcatttttaactttacgattaaaacatattcttctttcccttcaagccatgctcaaattgagtaaactctcccttttttagtttttaagcrttcttcattgtgagttcaactgcaggtcactcttcccagtgaacctctcattcccttcatgttgtgtggtggtctgtcatcttctagcggtttttgatgtggttggtctctgagagccacaggaattccacccagagttcaattatcaatgaggaaataaagggtctgctggtgctcatttgccttgttttgcatggattgtaaaagaaggaaatctctaatgaggtaaatcatgagtttgtagctttgagtgtgttaaagttacattaaagttttataattttagaagtcaattttggt

SEQ ID NO: 3600 - DNA, 600 bp, Bovine  MMBT19396
aagcagaatgagagcagaatgacactatgtaaggagaaggggtacccaaagggcaaagaaaaacaaggtaaatgataatacattatccacctcatattttggcttcaagtcaattctacagcaaacaggaattttcagaaaatcatcatatttcacacttacttctgaaaaccctaagaacaaattrggctaatcctgtaacaaatcacacttggcaaaatcatatagcaataactttacataatgaagaaaacaccaaaraactgaatctcagccctggttccaaattactctgtgtgrtcttggaaactgtcctccagcatcaacaactataaacraacaascttctctatgtatctcatttattagaatgaaatgagtcgacaaatgtaaacatcttatttgcatgtaacaygtgaaaacatgtaaaggactacagttgtcaaatgagccatggtacagctagcagtaaacatccatttacattctgtataacttaagatcattgtgagtccccaaagaaaggtattacataattcccttcaaaagtatttaaacagacattttccataccatagaagtgaataatcctcaagctta

SEQ ID NO: 3601 - DNA, 600 bp, Bovine  MMBT19425
gactgacccagcctaagagagcttgttcaagtgaaaagacacctcctgtgttctatgatgtatatcttcatcaatcctgttgcattttttaatgaaagcttatttaataataagtaataacccatattgtggattcatatagatttcagggtggagtaattgttggagargcctcagttctcttcactctaaggcagtctttgttcttgaatttgaaagatagctgtgatgatgagaatcaccctcctttatctctccactgaaacagtaatcctaattttgtcacttgtactctgcagkgatgaatcatgtgttcggaccttgacagaarcctccttaagctcgttcaaagataacattgagtctcatgtataaaaacccatttgatttctttcaattatgtcatcgcccgtactttgtaacatctgacacctatttgtcccttctctgcaaaaacataaaaattcatttcagacaatgaaattcaatttgtcttgaaagtaattccataaagaaaaattaataatctaagcagcattctaatctccttctacaatgttatgctgagcctgggcagtgttaactggcattgtcctagta

SEQ ID NO: 3602 - DNA, 600 bp, Bovine  MMBT19454
aagattatgaaatatagatccataaatagttttataccaattctgagccataaaaaagtaatatgtccattgaaaattgcagattgttttaactaggcaaaataatgtccctatctcccagatattatatatactgtttttgtaaaactgaagaaaatagagcatatgacatctaaattgaaaatgctaaaatgattttcccctaatgaaaccgtaacaagtgtggtaaaactaaggaacttgagaaaagaaaaacaaaacaaaatagaatgccggcatttctgaaggcagtatattggyggaggggaagtgactagcaatttaagtagggcaaagtactaagtggataaggaaaggaaaaagatgaaattgctcaaatgcagaaataatccttcttcatagaaaattggacaagttacactttttcaatatcaaaaatggattaccctaaaaatggaattattgcagtctttgattgaaatatcagaaagtattaaaatccttaagttaagaaattgaaggggaaaaagaaccatataattgatcatcattttgacaccaaaggaaatagaatgttaaggaaatcttgattcattaaag

SEQ ID NO: 3603 - DNA, 600 bp, Bovine  MMBT19538
acgtttttcattaatgacatatttttatgtagttatttactacatagaatataagcaactctttaattcagaggatgagtagttttttccctatttcatcaaataggcactgaacactcctgataatatactgtgctcattaaggtttatttgggggcttgctgagtttgccgttggttaactgcactgtttggcttaactgtcaggctgtggagcaaggggtcatccctttaatctctcccctgttgctcttcttagcaatatgctacctgtaatggtactgggctccatgtgccttgytctggtccaagagttagttctagttagcattctttttcttgcaaagaccagaaatgtattcaaaccagtkcaagtrttaaaaggcttcatgagagaatataatgacttctcttggacataaaatataggaagtacgaatcatctcagaagaaccagaaaattgtcatttagttactcctattgtcccygtgaaggtgtcatatctttgtgaatggaggtgtaatctgttctgcttttcctgtaggctctttctgtgtgtacttagaatgcacatatgcacgctcagtcacttcagtcatg

SEQ ID NO: 3604 - DNA, 600 bp, Bovine  MMBT19667
ctaaaatagtctaaagagtattcagactcaagtagattctttttttttttctttttgtccatttctctaagactaatttcttcagtgtggttgccaaaaatgtacagctctgtaggagaaaaaaaaatttagagaacgtcagtcagaaagcccaaaagtttatccttcatttgcagcattattaaatttcactaaatttccttgagctatcacccagagtcctctggtttcaggtcagctaacctatttgaaagttgagattaggttgctgattaaagaatcaactttgtgaatgagaasagataatattgatgacaccatgcaatgtcctcaacatgcaaaaaatgcttctttaaaaacaatccattaattgcctcttttggtagcctagaaaatccttagtgtgtgtatttatttttagaagatagggcatttctgttagacaactgaaaaaatatgtaggaaaaatagggaaattcaaggtaccttgtaacgatcttactattcacctcaaatgttcaaatgttctagtttttatttttcaaaagtgttaataaaaaatgagcaaaacaagcttggagactcaatggagatttaaaa

SEQ ID NO: 3605 - DNA, 601 bp, Bovine  MMBT19707
  misc_feature (1)..(1): n is any nucleotide
ntgtggtctccagtccgctgagcaaagccagagaacgttggtcagaaagaaacaacaggggcagatggagggcattggctaaggaatgtctaaytctttgatattaaatgagcaacttgaaatatacatcgattacaaattaacgtgcatttcgatgataatttccgacccactggctgatatcgctaccatccacctgrgatattgctaccccwgtggtgtacatgtttgtttaaaactagtttcttctccttcctgtcaaaagtcagtaaaagggatgggaggagtgggtgggtgaagygtaaagtgtgatgaaatgccaacrtttggttttaactgccaaggcccccagattggcctcagaaaagcaaattaaacccactccaggaatcactgcatattaaggagaaactgcagcctccgggggccaacgtgatccagtctgtgacaatgcagggctttaaggctcttgcgtaggaaagaacaaggcttggggttttccaaggcaggatgtgtgggttgaatggctttttatttgattttttcttaatttcctgactatgcaggcaacagttgtgagccctgagggtcggggatggga

SEQ ID NO: 3606 - DNA, 600 bp, Bovine  MMBT19714
ttttttaaactctcaattcaagtaggaggtgatgctcttccctgtgagaatttacatctcctctctctctccctccatcctgcccactcctggctgggatctatcaagggcacagctgatgaaatataccctgttcagagggaccacaccacaggagcgtgggacagactcggagtgctatgtgggtccctgttgggctccctaagtgaaggctgagagcagacatggccaactgtcatgggtccgccawgtaatagcaccactcaagcagcccagaccacatgtgggaagagtaacacrggtctcacaagtctggatccactggggtggtatccatcctgatttgcggctgaagttaattctctgaggagtcttatcagaatccaccaaatatcatgcccagttggctatgagctgtaagtatagtccactgatatgcttttcatggcatggggccaacattctcaacagatcccttgggtttataaagctccaagtccaggtgtctttttgggtgtcgttaaacacagctatgtacctgggggacccctgcagggctactatcattcgctgtgtgctgtgtgcgcgcagttgctcagt

SEQ ID NO: 3607 - DNA, 505 bp, Bovine  MMBT19762
tgggcggatttttcccagatgtgctatgtagagattcagccaataatgcgtgatttcccacccactagtgtattatcactccttggtctgaggataaaagtgcttaagaaagtttataaagtagaagttccagattgaattacatggaacattgaaatcccatgagcaaatatggcaaaaccaccaaccatgtaattataggttcaaaacaactaaagaaatcaagtgattgaaactggaccccagaatctttaaaagatcacatctggagatgtcactcatattgtacagacagtagcrtggtaatgaagcaagtcaaatgtaatatggaacccaacagtgaaattttgaaagagcattctctttctaagtcagtataaacatccaggacattattgagtccctctttcagttcacatttaggacaggcccaacccagtagactttttggactgctccaatatcagccagcctccagaggagactccaggagaatgaatttctt

SEQ ID NO: 3608 - DNA, 600 bp, Bovine  MMBT19912
ccaatattaaatgtacaycttgatgatggtttagatatgtttacacttgaagagccactacccagatcaaaatataaaatatttgcattactgcagaagttcccctcatgccttcttacaggcaaacctgcccctcccctgaccatgattgttccatgttctcagcctcagggtccctcaatggttggacttagagactcatcagggctaactaggtgaatggattaaagaatcacacacacatacacacggatacacacacatgcacacaygctcataactggtctctctgtaatcttrtaggttaaaaaaaaaacaaacacactttcaatccatcttttcatttgggcttttttggtttcttgtcctctgagatgttttgagaggacacggtgatgctcagcatctcttgagctttttgaggygggaggataggcttggagggccaaaaagtcatctctctgggatggattgtgtatttctgggtctgaaactgtaaagtcggtaagaagtgagccactgagatgaagaagccccacccggtaggaggcaagacgtcacagggccctctcctatagcacgtggtctgtctgcagtggc

SEQ ID NO: 3609 - DNA, 600 bp, Bovine  MMBT19968
ctcagtcgtgtccgactctgtgaccycatggactgtagcctaccgcgtcctctgaccattggattttctaggcaagagtactggaatgggttgccatttccttctccaggggatcttcctgacccaaggaccgaaccctggtcttccgcattgcaggcagacgctttaccttctgagccaccagggaagccattagcaaactggagcgtgctcagagaaccctgctcagccggaccacaggggaccagggcccagacccagatgggactccttcactcagcagygagatgggagggatgrrgcaagactgcagatgagcaaactgaggcccrttccacagagcaccgggagcagaggctggcagtgctctgcctggtccctcctgcctctgacactcctgccccagcccctagcttcagtgtgcttctttctaaacatctcactgtgaagcctcattgaaaagatgacccttgtggtcctggaactactttctttaggcacactgggagccaaagctaatgactgcagagccgtccatcaccagtgactggctggtacgaggttgcagaggaacccttgcctcgaggagatgaatgatgc

SEQ ID NO: 3610 - DNA, 600 bp, Bovine  MMBT20029
acaaagagtcgggcatgactgaatgactgaaatgactgacatatgttaacttgggcttccctgatggctcagcagtaaatatcctggtttggtctgggtcaggaagatatcctggaggagggcatggcaacccattccagaagtattcttgcctggagaatcccatggataggggaacctgggaggmtacagttcatggggtctcaaagaattrgacaggactgaagtgactttgcacacatgcacccataatgtctaacttaatgattagtartctctttagccaggctcagataacarttgctccctatataaccattatggtgtttagtgtcatgatattagtatctaggattctgcaaaagtcttctgaacactacactgtttgttcatagttaaaattgcccctctaaaataattgtttttttttatttagttttgtttgcttttactcttccttataatttttatgctaaaatcctttacaagaataaaaatataagctttctactttctacactatatattgaattatattctgcctcaaagtactgtagaactttatatattcatygctttactatcaaagactcccttgac

SEQ ID NO: 3611 - DNA, 598 bp, Bovine  MMBT20493
  misc_feature (1)..(50): n is any nucleotide
nnnnnnnnnnnnnnnnnnnnnnnnnnnnnnnnnnnnnnnnnnnnnnnnnnacctggggtgaaagttctccaggagaaaataattcatggcctcatattcctcaggggcccttccgctttcaaattccagttacacattcaaatagctgttacccgagatcaggggccagacatgctgagggcctgcccacgtgggcatagccagcctgtcctaaccagggccccgcggtgtggggcrarcacacaggggctcagcagagatctcgtcaccacgtcccaggaattttctcagcccccagayrcaggaggtgaggtcaagaatccagaattggacatcgagctagtcatcttatcattcaataaggaaaattccccataaacaaagaagacatagaataagtggctcatgttaaggacaattatttatatgttatgaaatgtctgaactccgtcccctgagaacaaactatcttgatgtatttcttcagcttcgctgagaaaaattccacaataataaacatgagatgtcggccctttttattctccagcaaaaaagaaatgagactctgctctggctgcctcagcacagacccatgtgt

SEQ ID NO: 3612 - DNA, 598 bp, Bovine  MMBT20498
  misc_feature (1)..(49): n is any nucleotide
nnnnnnnnnnnnnnnnnnnnnnnnnnnnnnnnnnnnnnnnnnnnnnnnnacctggggtgaaagttctccaggagaaaataattcatggcctcatattcctcaggggcccttccgctttcaaattccagttacacattcaaatagctgttacccgagatcaggggccagacatgctgagggcctgcccacgtgggcatagccagcctgtcctaaccagggccccgcggtgtggggcrarcacacaggggctcagcagagatctcgtcaccacgtcccaggaattttctcagcccccagayrcaggaggtgaggtcaagaatccagaattggacatcgagctagtcatcttatcattcaataaggaaaattccccataaacaaagaagacatagaataagtggctcatgttaaggacaattatttatatgttatgaaatgtctgaactccgtcccctgagaacaaactatcttgatgtatttcttcagcttcgctgagaaaaattccacaataataaacatgagatgtcggccctttttattctccagcaaaaaagaaatgagactctgctctggctgcctcagcacagacccatgtgtg

SEQ ID NO: 3613 - DNA, 600 bp, Bovine  MMBT20841
tcagtccttccaatgaatattcaggacaggattcctgcctgaataaattctatggacataggagtctggcagactccagtccatgggggcacagagtcagacgcaactgagtgactgaacacatggatagaagtattaatataattatgcatagaatgcatttttgctgtgtaagttttattccctggaatagtgcaatgcagaggccctagccaggcacagtcctgtccttaggcaattcaaatatattttatttaatagtcatagaagctccatgaaataactattcctattgtagasatatggaaattgaggagtcctgccaarattaagtgatttgttccaaggtcacacagttatcgaatgcctgggctaggatgtaatccatgcttgtttgactccaaaatccagacctttgccttccacccaagttcatgtcttatgtgagcaactgacagagaagaaagtttttcagtattagcaaagcagagctaaaggatctttgagttttctgagcaactgtctatcaggttcattcaagaagcactgatcttagatcaaaaagaaatctgataccaagattgggtttgatgcataaat

SEQ ID NO: 3614 - DNA, 600 bp, Bovine  MMBT20857
gcttggatcttcccgcgtcctcgtggggaagccctctgtgccgttcccacccgtcctcaggccagcctatagggtcccattggcctcccactatggttagtctgctgactagcatccccccactgggcctgactcagtgttttgttcccgagtacttcgctgtgcagttcatttggcagttcatcacgtggtaccttttgcagttggcaaaccattagcttttacccttgatctgtacattttttaaaatttaggtgaatgctttggctctccagcaacaatttaagattgagttcttaygtgatgctcaatacggttaatattttaataaatttcatgcattatctcaggggctatgtgttatgaaggggagataacttgaagatgtcrgagcactgaggttaagtggaagagcaggtacacacagccctccctcttcaggcttcctgctctgccgtgttctttttcgtttattattaacgtgcagttggtttacagtgttgtattaatttctgctgcacagaaaagtaattcagttatacatatayrtacatttttccatattctcttccattacagtttatcacaggatgttgagtg

SEQ ID NO: 3615 - DNA, 600 bp, Bovine  MMBT20859
ctatggttagtctgctgactagcatccccccactgggcctgactcagtgttttgttcccgagtacttcgctgtgcagttcatttggcagttcatcacgtggtaccttttgcagttggcaaaccattagcttttacccttgatctgtacattttttaaaatttaggtgaatgctttggctctccagcaacaatttaagattgagttcttaygtgatgctcaatacggttaatattttaataaatttcatgcattatctcaggggctatgtgttatgaaggggagataacttgaagatgtcrgagcactgaggttaagtggaagagcaggtacacacagccctccctcttcaggcttcctgctctgccgtgttctttttcgtttattattaacgtgcagttggtttacagtgttgtattaatttctgctgcacagaaaagtaattcagttatacatatayrtacatttttccatattctcttccattacagtttatcacaggatgttgagtgtttcctgtgctcarcaacaagaccttgttttgtgtctcctctgtgtataatgttttggcatctactcatcccaaacccccagttcatcct

SEQ ID NO: 3616 - DNA, 600 bp, Bovine  MMBT20909
aaattcactagagtgtcagagactaagtaatagtttcaaatatacacagcatcaacagtaaataygaagagaattaccattttaattaggttaaaaaggaaaacaaaacatatgtcccataaactaagtatcatcacataaattccctctagtgatgacttacatggaatcaatcactgtactgccgagactttaatagctctgcttcaatttctccatttacagatttgaatattgaaaattacttacatttcttatctatactttgtggggcactgaagcaattgataaactgagttratttaggaaaactgaaatatattttgtccttgacctagaacaatttggtgcgggctacaaagaaagtgaactgcatcagtacaattatcattaggatgaaaaagaattaatgtggttgaatgttattaatatacaagctcagcactaccacaaatctcaggttgactactgttctatttcattaaaatttaccttctcggtggtaaccttggagagatctttgtacaagagcttccggacatattcctggagaggaggacgtttctttttcactgttttttcagctggaggggggtagca

SEQ ID NO: 3617 - DNA, 600 bp, Bovine  MMBT20936
gtttaacatacccagacttgtcaaatcaaaagaaatgaagatcgcacctgaaaatactgctttagcggcttgcaacaagaggctcgagacttccagagaaatacattactactttcaggatattttaacagcccatcaatccacttgtcagactgcctcccattatcctctcagtgccagtgcagtgatccttgttaaacagtgggaatggatctgtgtcccaggcattttaacaaataattataaaatacagtgctccattgtatgcttcttgtctcttcccgcctcatcttaagtacmtcagctgacaggtctccagaaatacttcacttaagcaatgcttaatgtttttttttcagctgctttgctgaaaagctaccaacttatggcttgttgtttcagagttgaataactacttgtttttctttaaaacattcatccattggtcgttatgtaatttactatgccttagcctttggactttagaaataaacatttcagaaacctgtcatcattgttgaagtaattttgcatatagcttcaaaaatacatacattaaacccaagggagaattacaagcttcttccaacatagtactga

SEQ ID NO: 3618 - DNA, 600 bp, Bovine  MMBT20965
caccccctcagcaccttgtattcgactcctctcttcacaggcccgggatgcrgggagctgagccrcacacacaggaactctgggggccaggctgcagaagaggctctctaaacctgagtgggaatcactgacactcaagcccccaacccaaacatcatctccagcttcgtgtttgctctaaacaactatttaagcaagctgtcatccacagaagctgcacgtgtgaacccagttcgagatccaacaagcattttgaaagaccccaaatcacactggttaaaattccaaaactgtaaggaytgtgggattatcttgggtaatcttacattctccaacccctcatctctcctctttttaaaatgaaatcctatatgggcttaacagtaaaagtccttcagacaccccctctcagccctgcagcagcacttcctgtttatcaaaagactaacgtgaaaagcaggtcaacaaaactccacaaggaaaacagaaaacccatctgacatgtgctgtgtgagccagagaagcacccccacctttcagtcrccagccccacataccggcggcatcaggcgtgtccagcccagccctctgaccacctcc

SEQ ID NO: 3619 - DNA, 600 bp, Bovine  MMBT20986
cagtttcaatggatcaatgtggtgtcacaaactcagagctgggaaaagatgtattgtaccccacaccattgtatgatattccactgcctagatacaactgatataaacaacctcaagagcatacataacagtaaaatgtggcaaaataactaggaagtgatgagttttgagtattttttacctttgtttttcatgtaacttatttcactataaattgattaatttaatttttaataacaaatatatagaacacccagctaaagaaaaaccctgaaaatttaacaactgactcaccaacargttcaggctggcttcagcacacctctagaatcccttgctccaaattttgttgacttagttcagtaacctgcaatattgtcctcctgggaatatgtaaatattctggagaagggaatggctatccataaaggagtcttggcttcttcacttttattcacaaagtcactggttcttattcttccctgaaaaagatacagcaaacaatagacagaaataaaaatttgggttgcaaatatggttcatctcatcccttccatccagtttggtaacttatatgctgtatttcatctccaagtgtga

SEQ ID NO: 3620 - DNA, 600 bp, Bovine  MMBT21098
cctccctgttatctcctattactgagtcagggttctacagagatcctcttctagtttctgaaggcttttaggtttggccttctaaccctctgtgaaaccttgcttccatctattttctgtattcatgtattatgttmtctctccatttcaatgaagatggagttttgtatytgtttcttattagagtggttttaggatatatagaaagaagayatgcctttacattgccatcckaaaatcaagtctagtagtagctcttgatgagcctatatcctcagtgaatctgaaaaaaacaacccrattcaaagaacttttacaaaaaacatgcaggatttcccagctgtgaaacaccactgtagacttaaatatatattcaagtggatggcttccctgatagctcagttggtaaagaatccaccagtttgattcctgggtagggaagatccactggaaaagggacaggctacccacttcagtattcttgggcttcccttgtggctcagctggtaaagaatccacctgcaatgcaggagacctgggttcgatccctgggttgggaagatcccctggagaagggaaagactatccactcctgtattc

SEQ ID NO: 3621 - DNA, 600 bp, Bovine  MMBT21109
cctgygccctgccctactcagtccactatctgcttttttctgctctattctgtgtaccaggaggctgatccctagggattgtattatcytcttcctctgaactctcccttagaccatgtggcttctggttgggtttggtcaatggaaattagcaagggagaggagaaagragtcarggtatttcttccccgctcctattctgcattagaaccctggttctggtagagattccacccctctgagtctgtggctcccaccagctccctccaagaagtctcttacattccctgatctccactracactggtccctcttcttccccctttaggcccagaggtggtgatgaatgcccactgctgctagtctctggtgcctcaactttcctcatgggctccctcaaccctgattacccttctatagctggtcatctccctaagtctcctaatttaaaccatgcttcctgcctggaccctgagagatcctgtatctaaagtacatagaaattagcttttttttttttaaattgaagaatggcacaaagcatgtaagccaacaacttttcaaagcactattttctccatcttcatgttaagttcttga

SEQ ID NO: 3622 - DNA, 600 bp, Bovine  MMBT21111
agtatttgtgggagggaaaaaaaaacccacaactcttgggaggtttgaccaataaaatgacatttagcaagagtgatggaaaacaatgctctgaataattctgtattctgggtacaagagagaattagtacctgygccctgccctactcagtccactatctgcttttttctgctctattctgtgtaccaggaggctgatccctagggattgtattatcytcttcctctgaactctcccttagaccatgtggcttctggttgggtttggtcaatggaaattagcaagggagaggagaaagragtcarggtatttcttccccgctcctattctgcattagaaccctggttctggtagagattccacccctctgagtctgtggctcccaccagctccctccaagaagtctcttacattccctgatctccactracactggtccctcttcttccccctttaggcccagaggtggtgatgaatgcccactgctgctagtctctggtgcctcaactttcctcatgggctccctcaaccctgattacccttctatagctggtcatctccctaagtctcctaatttaaaccatgcttcctgcctggac

SEQ ID NO: 3623 - DNA, 598 bp, Bovine  MMBT21246
  misc_feature (1)..(6): n is any nucleotide
nnnnnncttaaaatccttcagttactctgctttgtcctgaacaagatcaagttctttatcttgacattcaaggtcctctgtgactccttccccccacctcctcctgttatgttgaggctgggcccaattatcagtggtccacatcatgcttttttattcactccgtggcccctgctcctgctttcccttctttttgtgtgtgtgctgtcctgtccacccctttttgcctggctggatccagcttatcttttaagcatcttatcacttgtcattttcttcaggaagcactctgaagatcckcccrctatgagttaaatgtctctggtctgagttctcctggtcccctgtgttcaccccgtacttagcatttgatgacacttgatgttatctgtgtacgagtcacctgcagcacatccarttgctccctgaggatagagactgttattcatcattatgtaaccagtacctggcaaaacgcctggcacaaagtcagtgtcgaataatttcttgttggatagaattccggtttcttctgtcttacaacttggaaaatgattgctgatttgttagaaagactctggatgtcatattttcaaac

SEQ ID NO: 3624 - DNA, 598 bp, Bovine  MMBT21247
  misc_feature (1)..(2): n is any nucleotide
nncttaaaatccttcagttactctgctttgtcctgaacaagatcaagttctttatcttgacattcaaggtcctctgtgactccttccccccacctcctcctgttatgttgaggctgggcccaattatcagtggtccacatcatgcttttttattcactccgtggcccctgctcctgctttcccttctttttgtgtgtgtgctgtcctgtccacccctttttgcctggctggatccagcttatcttttaagcatcttatcacttgtcattttcttcaggaagcactctgaagatcckcccrctatgagttaaatgtctctggtctgagttctcctggtcccctgtgttcaccccgtacttagcatttgatgacacttgatgttatctgtgtacgagtcacctgcagcacatccarttgctccctgaggatagagactgttattcatcattatgtaaccagtacctggcaaaacgcctggcacaaagtcagtgtcgaataatttcttgttggatagaattccggtttcttctgtcttacaacttggaaaatgattgctgatttgttagaaagactctggatgtcatattttcaaacatac

SEQ ID NO: 3625 - DNA, 600 bp, Bovine  MMBT21248
tgggcccaattatcagtggtccacatcatgcttttttattcactccgtggcccctgctcctgctttcccttctttttgtgtgtgtgctgtcctgtccacccctttttgcctggctggatccagcttatcttttaagcatcttatcacttgtcattttcttcaggaagcactctgaagatcckcccrctatgagttaaatgtctctggtctgagttctcctggtcccctgtgttcaccccgtacttagcatttgatgacacttgatgttatctgtgtacgagtcacctgcagcacatccarttgctccctgaggatagagactgttattcatcattatgtaaccagtacctggcaaaacgcctggcacaaagtcagtgtcgaataatttcttgttggatagaattccggtttcttctgtcttacaacttggaaaatgattgctgatttgttagaaagactctggatgtcatattttcaaacatacaggcatatggttctattaatgtatacaagtaacccagtgctagctctgaaagctgaagaagctccctttttttgaggactaaatgagctctaccttccttccagcacccagttctc

SEQ ID NO: 3626 - DNA, 600 bp, Bovine  MMBT21249
tgttggatagaattccggtttcttctgtcttacaacttggaaaatgattgctgatttgttagaaagactctggatgtcatattttcaaacatacaggcatatggttctattaatgtatacaagtaacccagtgctagctctgaaagctgaagaagctccctttttttgaggactaaatgagctctaccttccttccagcacccagttctccaagtgaaagacggcagccatagagctattcagtgcaggcaagttctcagtcatcgtctcaggtgatatttgtggcaaaacaaaagaacrgacagttctcacaaagatctctgcaaaagaatcacctgagtttaaaagtacaatggaagatccgtgactgtttcctccaggaagctcagaattccttcacccttgtgctcaccatactggctgcttgtctcaacaacctttcaagattctccttgcattcctgcatcatttgttayattgtggcattctgtccaagtaatgatcagtccagctgcctttaaaacaatcactttgagagggaagtgggggactcagtcatttacttattcatcagtgaatattaattgagtgccatactac

SEQ ID NO: 3627 - DNA, 600 bp, Bovine  MMBT21446
acttgagtttttgacattgggttccacacgatgcaccatcgtgctcagcctgcatgcaaattgttttctttaagctctttataaatgatgagatgacattaaaagaatagtttaatcatgttttcgtttttcaatatgtaacgctagaggagaagaggaaaagtagatttcttcatttcataaaacaaagtatttttgcaataaagttctaactaaaacttaacctggcacttttttcatttaccttggttattgcttttcacacgtctcatggttcttgtaaacatgcttttctccctrtggagctagattcaaagcaaaggttatgaaggaaagtcttggtatttgagcatcttgcttctgatgtttagccttaagaaatagatttgagcttaaaagaaaagtaatacgtttgcttgaattttcttacctttcttcacattcgcttttactgcctctatggatagccctaaaacttggtttagatagagatctgatgtaatttcatgaagcagtgctgtcagatgacggcaaagcatgtttatatttrttgacacagttctgtagatttcctttccaaagagcatgtgcagatattac

SEQ ID NO: 3628 - DNA, 600 bp, Bovine  MMBT22131
ggaaatggcaacccactccagtattcttgcctggagaatcccagggatgggggagcctggtgggctgccgtctacggggtcacacagagtcggacacgactgaagcgacttagcagcagcagcagcatattaaaaaaaaaaaaagccaacccctggtctaaatcaaaaggcagacacgatgccatctttcaatatggtgtgtaaatgttcagagggaagcatgcagagccctgcacaaagacggaagctgaacttgatggctccagtctgcccctgatggccctcatcctgtatcacacrccrctcacttgatttgtctcaatgtrtctcaactstaagatrcaaggtcaagagttaccttccacctcagtcattttctttttcccccttaagcagaaaacgcatacttttcaaacaaaacctcatgcagaaatagagaaatttcaatacataaactgagaaaagcagaattgttctgttgaagaggggctggaagggtttggaagccccatgtcttggcatcctgccagctcttcctccttgtagccagggtttttcaacagcagctctagtgccattttggcccaaatagttcttggt

SEQ ID NO: 3629 - DNA, 600 bp, Bovine  MMBT22250
gccttccgtaacttaaaaaggaaggtgtctgtgaagctggacagttttgtaattggccgcgtggcacgtttctcaacaagcagcaaacattttccagtccagatgctgaagtcatctctgagaacagactgattgccttctctcccgacacccygtcccytctcctggtgtccagcrtgtctgaattctctttaagggcctgagattcatttctggtgacacttacattccaggaggagaggtgagagggtcacrtcaacagagacaagcccggactcttggcacttagctcttcagacraggtatttttccttgaggttgatgctacaaataaagcgctgacctgcggtgtcaagcagttgcatgtgggagcaggagtaggaaggagaaagtgcgaagctgggggcagctttcccccgtgtgtatgcgcagagtgccaataagctgtcaaataaaattaaggttcaaaacatacagccttcaatttgattccgctaagatgccggctgctgcagggagggaacacaatcgattctgttttgacaggtctcggtgttcgctaagcagcaaaagtctccactctgtacctgattgataaaa

SEQ ID NO: 3630 - DNA, 598 bp, Bovine  MMBT22358
  misc_feature (1)..(8): n is any nucleotide
nnnnnnnnaatggtcccagtcttggggccctggcgtgtatgtgggtgctgggtcccatcccagggcagaaccatggggtcagacatgaaacacaagccccagaggtggagaatgatgaactttaaacaaaagaggcatccatgatacatgcaggagggcacagtccatcttgcagtgmcctgggggtgacaaaaatcaccctgatccccacgcaggactttcccaaagcgacaattcaggctgaccgcgaggaggactggcccctcctttgtgataaccctactcgagcagagaggaaayggtctcgaattctggtgtatcccatcattgggggatcgagctccacccatacagaacaagggggaagagaagcagctgggtgatggacacagaagctgtaggcagagaggtccatgggggctctggagcgatgcctccagtaggaaacgaagctgacagataaagcratacagcagagccttcagagcagagaaaacgtctactctggcagagggctagccatgaattaatcataggtacctagaaaaccagagaaaacaaaaagttgtacaagaaggtaaatgaaattataaaactc

SEQ ID NO: 3631 - DNA, 600 bp, Bovine  MMBT22405
ttgttctccgtaagagcaggggaagcccagccactttctgctttacacccatctattctgtttgcatttccctcccttctctcaaaaaaacacatataacttgtataggtttttattctgaataaayttaacattttaaaaaggaagaaaatggcacagcacatgggcatgcatgatgctctagtagctttctaatttcctgttaaaatgaatgctctctttactgctaactggaaaaaagatgcaataatggaaaaacatacataaaacacacagaattcagataaataacacagtatygacaaagtaaaacccagtgtaatcaagacacatacctaggcattaagttcctgtttttttcataaaacatccttaggtcttgaggactattagcctgttaaaaaaaagaagaagaaaatggtttaatttcctaaaaaaccaagtgcaaaaactccaaattacatgatggatgctcatattcttgcaatagaatagagactgaatttgaaagccatggactcctgagggagccatcgatgggcacaaggaacttctaacacctctgacactgtacagattctgcacatctgggcataatgt

SEQ ID NO: 3632 - DNA, 600 bp, Bovine  MMBT22425
tcccaggacctggctctccagctctgcctgttcaagatgagttattcccccgtttagctgcatttctgatggcgcctgccccactctggggacagcagagatttaagggccgtggtgtcttgttacagtaccagagattttctctcataaaacccacccggggaaaggtttaggagatttgtggtcttaggctgaggaggcagtcacgaggcaggcagaccagcggtaggggtgagtctggagtaggggtaggctctggagaagctcctaaggctgccctgggcagacyctcctgccccrggatttgcccccatcccgcgtgaaggctgggactccatcctgctcctgggctgtccaggaagcctgctcctttggggcagggaaatrgtaccctaggcaacctccctctgagcctccctctgagcacagcactgtcctacctcctggtcttagccagccagagccttgtcttgctgaagaaggagggggtcctcggctgaagggtccaccctggtttgcccgttgacttttctgtgttcttttggcccccttgcccacccttttctttctgtttccagtttgcaggacatggtgacaaag

SEQ ID NO: 3633 - DNA, 600 bp, Bovine  MMBT22607
catttctcagaggtgtgagcattacttgtgagacagagtcaagtggcaatgytttcatttactgtttcatttactctgttttcatttactggagccatgtactatgtttctgtcccacggagaagtctttgagcccctttcacacttgatggcttttaaatattatttccctccaaaaggcatttctctgtaaataaaaagctatragtyattctgctttattattctttcctctgaggggaaactctgggagataaacaatacccagataaataaggcttagagattgtgggccaaggyttctattgattcacaatatatttatctctctctctctctctctcaaataaagaaataatgatagtaattactttaaaaatgattctcttttttaatcattttaaattgctatttcccactctactcagatagtaattgtttttatggcactattgtaactcatgggaaaaaggaagayggaaaaagcagctgagatcactcctgggcagcatctctaaggcacaaagtagatttgtagtagctcatctatcaaaccttcttcaactctcagtctgaattttacatggagatctgtggtgg

SEQ ID NO: 3634 - DNA, 600 bp, Bovine  MMBT22633
tttaaaagcctgatatctaggtttaacattttttaagagtttaaatactcctggaatagtttttgtggagttaacttttaatgattttacatcattttttgaacatgcctaattttygtttgaggaaaaattgagtgtaagaaaaggaaacaactcaatagtcttcmgtttagttcttactttgtataacttgaatttcttagacttagtagggaacaggaagatagtgaatgtattgaaatatactctttcccccatcttcctcattgtcttctctttcccatctctaratttccccarttaatttttattaatgtgtagtaactttctgttagaattgctttgtgaaaataataaaaggccagactcttgggcattttattaccctttggttgtctgtgagccaaccttttaataattgtgggtgttacttggkctccatttttcagctccatttttcagcttgtcatattttaagagttttatggctaggatgcatatccacctggggttttggatgtgactactaagttgtagtgtttgatttatatttgagttcatgtctttagataaaagcgtccatctccactgtcttcattt

SEQ ID NO: 3635 - DNA, 600 bp, Bovine  MMBT22683
attaattgttggcctcaccatagaaaaactccacaaggatgataacatggtaggctcattgaaagaaaatcctgcagagatcacataattacctgagagagatccttgggggaaatgatgaagactgaaagtacttgcttgcagacgtgatgattgttaagattatgcagcaaaaacaaccatgaagagaaggacgcagatgacgaaactgaggcycagagattcagataactcayscaaagtctagtgtaggatgcagctaagatgagttgaaggcattatcctcctcgttccataacytataacaggatttgcctagagcctccaaaggttttatcatctgcaaaatggggataataacagtccagtccttccaaggaggctgtgagttttaaccgagataatgtgtgtccacgctcagcacaaggtcaagcccaggagagacagatgagtgytgtgactcttactatttacagcatcacgatttgacatgaagwrgctgcataaatgattcaggcttaccaaacataaatacatacttggtgcttcctttgattattttcatgtgagaaggaagtgagcctttctttgccaaataaa

SEQ ID NO: 3636 - DNA, 600 bp, Bovine  MMBT00010
gcgccacctagaaaccacttctggggcacctggtgggcacatgcaaaaaaccatctggaagaacttgcctggaacttccttggtggtccagtggctaaggctccatgcttccaatgcagggggcccggggttcaattcctggtcagggaactagatcccacatgcttcagctaagacccaacacagtcaaataaataaaaacaaatattattaaaaaaaaaaaaaaaawagaacttgcctgcaaagcaggccagccaggagccccacagacagagcctggaagtaggaacaagtcccctrtcccaggtcacaaacacgatcataaagargcgtcagaaaacaacaggatacccatctgcttcaggtactaggtgagtgacacggagactgtaaggatgtttaaactaacaatggaaaagaaggcatcaaaaacagaaggggccatatactcaaaacagacctactgatctgaaaaagaaagatactttgcagaactgaaagacagtgacactaagtacttatgggtttgtgcacatgtgctcaatcatgtccgactctttgcgaccccatggactgtagccccatcaggctcctctgttc

SEQ ID NO: 3637 - DNA, 601 bp, Bovine  MMBT00030
  misc_feature (1)..(1): n is any nucleotide
ntatttttatgagtatgcattaattaacccagcatgtactatctttcagactatcttgccagggactttcatttaaacatgtttattgtgaaatgtttgcattctccacatttgtggcccacacgcagattatttcatactttcctttagagcacttagaaaagttaaaaggagttattgtttttgattaatgccattttggggcagttaaaaaaaaaaagagttccaaatcctagctctgcataaattctttgacattaaaaaaaaggaaaaaaaaaaaccctctgcaagttccactgcrcaaagatatgtgggggtttgttctgggtttatttgaaggtggcctgctaaactgaactttattaactttggtgtttgcatgaactcgtgcaagagcgatggccaatgtggagcagctatcaatcacaaaaggagagccgcgctcggggctgtggtgtggtgccgcacagatgggagttctaaggcyccgcctgtcatcttttgattaagaaaaggaaatgatttcactaaaaagatattccctcttgtgttgttttgttttaactgagtttgtactttccaccaaactggacatatttat

SEQ ID NO: 3638 - DNA, 600 bp, Bovine  MMBT00429
tgtctttactccctagaatggcttcaataagaaaacccagccgtcctgtgcgtgacatctttggcgacctcagtgatatttccttagaagattcaaagttgggggacatgtggaactctgatatcagtagacatcttaccaaaatagcacccggtcccagcagatttttaaaaagaaaccagactctgggtggaaaacacttcctgccaaaagagaacgctgtcctggggagcgagcactggcactcttcaagtagaccgtcaaccactgcctccaaggtcagggccaacgcggcgctcrtgaagctggcacagatagagaccaagatcaggaaccggaaggtgcgggtggatccatcggacgcagaatccgaggactggctccctagcagagctgaagaaactccccctaggaggacggctgacctttcttcacagaacacaggacaactctcccaggaacaggcccttgaaattcctgtccctgagacagacatgccgagtgggaaggtcagtaggtttctaaagaagagagaagcacaggtggaaaagatacccatggaagcccaggttgggaaggagagggatgctcaaagaccca

SEQ ID NO: 3639 - DNA, 600 bp, Bovine  MMBT00433
ccaaggcagatctatcctccaaagaggcccaccccctgtgaactatgtgtccaaatattgagagactttctgtactttgatgaatgtcaagcaatacattcaaagctaaaattacataggtctgggaaacagttgtatgtcagcacaaaccttcatcagcatcagaagcagtgcataggggagaaactcttcagaagagatgtggatagaacttcatttgtgaagaactgcaaattccatgtgtcaggaaagtcattagtcttcagggtggttgagaaggacttcttgaccaggtctcartttctccagcaatgggctactaacacctgggagaggtcaaacagaactgagtgtgagacagcctttcagaggggaaaaacttatcctaactggggagaagttaccaagaagtcacacctcattgtacaccagagagttcacaccagggaaaggccatataaatgcaatgaatgcgggaaatcatttagccaaaactctatgctccttcaacatcagagaatccacactggagaaagaccttatgagtgcagtgaatgcgggaaaactttcaatcaacgttctgcccttcatcagcatcag

SEQ ID NO: 3640 - DNA, 600 bp, Bovine  MMBT21673
ctagttagatccggtttggggacaggcggctcccctttctagaagccaaaccccatctctcyagagcagagctggaggagggaagatactgtttcatgcattgtgacagccttagggaggaaaagatattggagactctttatttgctcttctcccttcccttcttcaactcccacaccagtttctgtaatgytttccaacatctcaagtgtataatcagcatgttcagatgcttttctaaatgcagattaccagcacaatgccccagatatgcataccccttaagtcaagcagcattgsattccacatttttaaggagcatagggattcttacactggtggtcagcaatacacatctttaaaaacactgagttagtgtgatccagtcattgaaatccgaaacagaagaaacatcctctctagggaagcagaatagaagaaagcatgtcattcayagcatacatacatgagaaaaatatttttctgtattttaatttatttaagccctcatctgtgagcaacaaataaaaattgtaacttcatgaagataatgtacatcacttctgcctcaaaactaactcgagtggcttcatagatatt

SEQ ID NO: 3641 - DNA, 600 bp, Bovine  MMBT18173
cgttgcttctttctggaaatgtgtggcaggtttttgctcattgttgcgctgatagccgtgtctgagatggatacccacgatatcctcatgatgctctgacttttgtgggaagagacacattgaacaactgattttcaagaattttgagagacaaatgagaaatacagcatgatgtggaggaggtyttggtccagggtgggagatgctggaacctggaaaataaaggcrttagggytggtgaagaaaggacaaaaccacaaatgtacagaaaatgggtaaaagaagctggaaggcagttcmtaaaacaaacaagcaagcaaaaacatttgcaaatggcctgttgacacaagtaaaaatcctcagccttgatagtaacaggagaagctaaattgtaaaatgacgagttaccattttatagtatcagaccagcaaaaatgaaaacaaagtgttgccaaagatgcaggggagactgcttctcttgtttatggcaagtgaggatgtgccacggtgcccaggatggggggagactgcagcagactgacagggtgctaggcatagacctcctgtgatgcctctgccttttaatgagatcgatgtgcg

SEQ ID NO: 3642 - DNA, 600 bp, Bovine  MMBT11072
atattgttttgttgtttagtagctaagtcctggacgattctttgcagccccatggactgtagcccaccaggctcctctgtccatggaattttccaagcaagaataccagagtgggttgccatttccttctccagggtatcttcccaacccagagacaggtatattatgtagttcttaaagtggttgacaaggactaaattaaacacgamgtgacatttcttatggaagcatctgaagactagttagatccggtttggggacaggcggctcccctttctagaagccaaaccccatctctcyagagcagagctggaggagggaagatactgtttcatgcattgtgacagccttagggaggaaaagatattggagactctttatttgctcttctcccttcccttcttcaactcccacaccagtttctgtaatgytttccaacatctcaagtgtataatcagcatgttcagatgcttttctaaatgcagattaccagcacaatgccccagatatgcataccccttaagtcaagcagcattgsattccacatttttaaggagcatagggattcttacactggtggtcagcaatacacatctttaa

SEQ ID NO: 3643 - DNA, 598 bp, Bovine  MMBT13782
  misc_feature (1)..(51): n is any nucleotide
nnnnnnnnnnnnnnnnnnnnnnnnnnnnnnnnnnnnnnnnnnnnnnnnnnntaggtttctcccatcttttccattggcagggccctacagtctctttcctatgcctggagacattagggtagattgagagagtggcactggtctygaggtttggagtagattatacattgtgtggatcacattttcatgtagttatttcctaaaccctgcaggcagtatcatgtcaaaagacatgattacatgcttttgaacacactatttcctttctctgsaatgttcttcctcttttgcctccactgyatrtatctttgcaaaccttgttaaatgtcattgcttcctgaaacctgtcggaatcccctaggcagatttagtcggtttctgctctgtcctgttgtagtacttctcactttcttctgttagataactcttctgttcaattgtaattttttaatgatttctgtatgtatataaattggtcagacccaataggctgaaaacacaataggctttggccatagagggcaccgctcatagcatccatcttcatatccttagcacatagcctcatgcctcatctatagcagttgctcaattaata

SEQ ID NO: 3644 - DNA, 598 bp, Bovine  MMBT21342
  misc_feature (1)..(116): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgtgacaggaaatccaggctaggttctcaagagcgagccggtccagagtcccgagagcctcccctttacttacatgtcagcgcggccgcccttacttcagcccaacggaaagtccgataatcaacgctaaaatgcccagcaacacaaccactatcacaatgataattaccaatttctggaragagggataagagaaataaaaacaagtcatcattacaaaccaccaaaaagccggagtcagccatccaaaacccacctctgcaccggaagcctcttatsrccccagagagagtgaaatgaamagctgacatcgctacataaagacgttccactgggctctcgtgtttaagttgcctctgcactagcagtgccagcaggtgcaaatacggagcctccatcagctccgagctcacgctgcagccctcacgtgtggacagacgtggccacaaccrtcacggggtgtctaagcagcagtaaac

SEQ ID NO: 3645 - DNA, 598 bp, Bovine  MMBT11915
  misc_feature (1)..(160): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccacagtatctttagattttgccagagcaaattatgtcctattaatacaggaatatgggtctgatttaagaagccagttgtctttctgacatcccatcaacttaaacacagtactcttcagataaccaagacattaasaagcaaacccaaagaacattttgtttaggatacaaaataatcagtaayagagagcatgagcaaagaatgtcttcatctgttgagttttatgcgtcctctgtcattcagctccctccaaagtcacagctggtaaaaccaaatgggtcattttaccacaatcagactaacgtcacagttcaagaagcaccatttgtcctccaaggcaaagccatgcacctaattacaacacactgttaataaatttataatagacaaaaagaaattgactgctatggattttttccccctagtaaagcaa

SEQ ID NO: 3646 - DNA, 600 bp, Bovine  MMBT21339
srccccagagagagtgaaatgaamagctgacatcgctacataaagacgttccactgggctctcgtgtttaagttgcctctgcactagcagtgccagcaggtgcaaatacggagcctccatcagctccgagctcacgctgcagccctcacgtgtggacagacgtggccacaaccrtcacggggtgtctaagcagcagtaaaccaagatacaacgtgactgagattttccttttcaggggggaatatgaagacatatttgacacagtcctcctaaatgcaaactgccatccatctctccccsaaagaacactcccacctgtcaaacccaggacagtgactgagggtctgaaagtacaggtcctgttgtgaacaggacaggattcatcatgtgaaataacttcccagctccctagacacctgcccaagcaacaggtaaagttgggaaaaaargaactgaagaatgaaaatatcagagcacaaagtcagaaaagagcaggctaaaaagcaaaccccaccacagctggctactgcagtgactgagcagagatgctccaagaacaagggcaccagaactagaggtgggggcgggcactggagcagg

SEQ ID NO: 3647 - DNA, 598 bp, Bovine  MMBT21343
  misc_feature (1)..(17): n is any nucleotide
nnnnnnnnnnnnnnnnnagacgtgacaggaaatccaggctaggttctcaagagcgagccggtccagagtcccgagagcctcccctttacttacatgtcagcgcggccgcccttacttcagcccaacggaaagtccgataatcaacgctaaaatgcccagcaacacaaccactatcacaatgataattaccaatttctggaragagggataagagaaataaaaacaagtcatcattacaaaccaccaaaaagccggagtcagccatccaaaacccacctctgcaccggaagcctcttatsrccccagagagagtgaaatgaamagctgacatcgctacataaagacgttccactgggctctcgtgtttaagttgcctctgcactagcagtgccagcaggtgcaaatacggagcctccatcagctccgagctcacgctgcagccctcacgtgtggacagacgtggccacaaccrtcacggggtgtctaagcagcagtaaaccaagatacaacgtgactgagattttccttttcaggggggaatatgaagacatatttgacacagtcctcctaaatgcaaactgccatccatctctccccs

SEQ ID NO: 3648 - DNA, 600 bp, Bovine  MMBT21341
actttccaggcaaaaatattggagtgggtttccatttcctcctccagtgggtctccccaacccagggatcgaacccacgcctcctgtgtttcctgcatwggcagacaattctttatcactgaaccatctggaaatcccagtgggagcacagtaagtttcactctaaagccgtggcctttataagtctgctcgcctttctccgatgtctcccctaacccaatccagcctcaacgttatcagcaattaccctcctgaagtccacgtctgattatattcctttccagctcggaacgtctcccrgcccccttcactctgccatggggtccaaagtcctcaggacaacaggccagttcccaggtgagccctccctccaaccgtcttacccccaccctgctccgcccaagcgcaccctgtccccaggccctggccggcctgccctccctgcctgtgaccgagttcattcagttctcagagcatgttccgcgctgcagggccctgattgctactgattcctaaagttactgactcctaaagttactgattcctaaagggcgaggctgtattaactcctttacacaaacggggcaacctgcaccattc

SEQ ID NO: 3649 - DNA, 600 bp, Bovine  MMBT21048
gcacaggaagcatatcctaattctttaagagagccagaacagagactatatagagctgcataaagtatttcccagaagctaccaaactagaatttcagtgagtaaagactaaatgagggccttccctggtggtccagtggctaagactctgtacttcctattgccggggaccagagtcagtccctgttcagggaattggatcccacatgccgcacctaagagtttgcatgctgcacctaaagatscctgcgtgtacracaaagatcaaagaacacgcatgctgaaactaagacctggtgyggccaaataaataaacatatatttttttaaagactaaatgaaaagactcctgcacatgtcttcagctccgtatagatgctgcaattcagacttttaatttagatgagtgggtctctgtgttttgatcaaaatattcccattttcctaatggatgacagtgtgactataatgattttatggcatctaccctggcttgaattttatgaaaattgatgatatggtggttttcyaataccaagtgacagaagaagggaaactttactgataggtttttggtggttttcacttgaatgaattaat

SEQ ID NO: 3650 - DNA, 603 bp, Bovine  MMBT21345
  misc_feature (1)..(3): n is any nucleotide
nnntatttctgtgggcggatatatcagagaccttgtattccagcaccttgctgaccctgagcaaacgttttaaagccagagtgttcgttaatagttttggacgtttcctgcacgtagcatgtagcgcccttcctggcacactcaaattccacatctgatrtatgtctcagtgtttcctcctgggccagaaaactctcagggaaaactcttgggaaaaaaagaaaccttaggtcaaaaaccactatgcctamaattwaaaaaaaaaactatgccaaagaccttcctcatgtgccaagctccccmatcctgcctgctccaacttcagaattacaacttctgcttccatttgtatatgttgtaagtcctgcccccatcacatttaatctcttaggaaacataatttgcttatacatctagagtgaaatgggaaagagggaacattaagagtcattcacataatttattctcattggactgaagggaatttgaaccctaatggtttaagatgggaacaaagaaatattatttcctcattctccctagccgtatctttcaagtcttccttgtttattactttatttgggcaaatacacctgaccacac

SEQ ID NO: 3651 - DNA, 600 bp, Bovine  MMBT15249
tctctragcctgcttctgtcatcagtggaatatagtgaataacaatagccaacacttactgaatgcttacaatgtaccaggaactaatgcttcatgttcatcaacttatgaataggacttaagttaaacaacctgaccaatgtgggtacaagaaacccagatcttattctaggtagcttgattcaagaacctggtatttaatcactgtataagactgccttttcagcagagttcccagagccatgatgagaattaaataataattcgtattyagctcacatttattgagcactcatatgytcaagaccccagtgtaagctcccctgggagcatattaactcatttatcttcacggcagacctgggagggaatatttgcaatcccatcttacaggtttaaaaataggcacaaacaagttacacagccgaaggtcacaacaccagagcggtcaaggtcggaacccaggcggtttaacagctgagccccgcgctcttctgccatcagccaggagaggaagtggccccggattccggggaccagatcgccgggatgggggcacagccgcgccccttcagggcggactaacctccaggcccgctc

SEQ ID NO: 3652 - DNA, 600 bp, Bovine  MMBT01817
accagtttttagtttggcaacccttaagccgattcattgttaatagccactgaaatttcagtaccctacatataattaggaaacaagtctaaaattttggtcaaagtgaatttttgaccattttaagccacaaatacacatggtcatgattcatatttttccctattattttaacatattccttgccaatttgtgtttaaaaaaaatttagtgatttggagaccactttacatccatatgggatatacaatatattgtagcatatcatattaatgcccaacagagctaacagtgatagtyaawacatacaatgagacttcttgaggttttcccaagaatctggaagagttttatgttgccaagagtagctcagttttcccctgaatttctcaactaggttaataaaatccagaaagtcttcagagttagtgacagaaccatctttatagtttaatgcttccatctatagctaaagcaaagaatagcaattagaaaaacttcttttcaattgcacaattaatacataaatgcttaagtgagcatgggatttccactggtgttaaattcttactacaagcaaaattaaaatatctactggcc

SEQ ID NO: 3653 - DNA, 600 bp, Bovine  MMBT16130
gaatatgcatttctcaagcacttcatgaggaaagtacacacattctttgaaagaggcttatccatgtgtcccacaggacatgaggaaacatacctctctgcatatccccttaccagaagctatttctcctgcaaaactgcaccatctgaaaaatacaaaatgacctcacaaccagcatatataaaaatactttttaagtattactaacaagatcacacatagaaataggtgtcagctttgaccaagtaactcaaaccatgttacagagttttcctcttgaggtaactagcttcactatcsgtatgaggaaactraggaataaagtaaattccataggtcaggaacagagccaaactcgaccctgccctttagaacagatcaactccctcacttgaagttggcatattacactgaaggtaacatcatacaagtatctaataaagactttaagctattatactagagaggcttcagacaaaattcgaattgattgaaactttcctctgaaacttgaatcaaagcaagccccatttttttccctgtacttcttctcttgcactgaaggatccaaagatagcacacaaatggatgtttctcctg

SEQ ID NO: 3654 - DNA, 600 bp, Bovine  MMBT06686
tgtataaccttagacaagtcattttacttctctragcctgcttctgtcatcagtggaatatagtgaataacaatagccaacacttactgaatgcttacaatgtaccaggaactaatgcttcatgttcatcaacttatgaataggacttaagttaaacaacctgaccaatgtgggtacaagaaacccagatcttattctaggtagcttgattcaagaacctggtatttaatcactgtataagactgccttttcagcagagttcccagagccatgatgagaattaaataataattcgtattyagctcacatttattgagcactcatatgytcaagaccccagtgtaagctcccctgggagcatattaactcatttatcttcacggcagacctgggagggaatatttgcaatcccatcttacaggtttaaaaataggcacaaacaagttacacagccgaaggtcacaacaccagagcggtcaaggtcggaacccaggcggtttaacagctgagccccgcgctcttctgccatcagccaggagaggaagtggccccggattccggggaccagatcgccgggatgggggcacagccgcgcccctt

SEQ ID NO: 3655 - DNA, 600 bp, Bovine  MMBT11450
gattggcttacagcacagactaatgggtttggggagggcactggacaggggattcatggagaacctttgggactttaggagctattatgtaggttaggggttagcaaaccaaagtctgagggcagtatcccactgctgcctgattttgtaaataaagttttattggcacatggccacgcccactcatctgcatattgtgactgtttttgtgctgcgaaggacaggattgcatgattgtgccagggagccctgcccagctcagcagcctgaaatacttgctctctggacttttccaggaasagtttgctgacccttggtgggttcagaggtcagagggaaggcagatgtgctggtggtgaagtgaaggactgaagtcagatgcaaggggggactttctgatccagagcacagctggccaggcttttgtacacagcaggcaggagctcttggcccctggggctctggtttgatgagaagcttgtcaagccagtttttgtttgcacagaggacagggcagagtaagcaggctacactcttctctgcctccccgtctctgtattttggggtctctggcagaaagttctgtgcaaacaaaagcct

SEQ ID NO: 3656 - DNA, 600 bp, Bovine  MMBT02070
gccaaagctgtgaatatatattttctgtcagcctcctgtgtgtctgctccaggacccagcctgagcctgaaacttcctttgtgccggggaaacttccagactggccccacactccccactcagcttctccgtgggcaataaagcagcaatttctggcaccaatgtccaaacagcaaatgagaagtgatggtttgcgtggaaagtactgtctgggagacaagagaaagaggcagcgcttgtgacagagctgttcacactttccctgcacagctgggagacattagctgatctctccagacyggtctgctttctggcaccggtgagttaaaaccccccagagcctccaaggtaagctggacttctatcatatgcatttagcagctaaatcagcaaaagtcattttcaaatattcatgcaaagctgaatctttacccaaggtcagaagttcaatagaagttagcacacacacacgcgcacacacacaaaaaggatttgcaggcaggaggcaagaaaagaaacagaaaatatggatagattatctcagttcaaaatctgctttttcttggagggggcttgtgctctgggaaagtagataaaaaa

SEQ ID NO: 3657 - DNA, 600 bp, Bovine  MMBT07676
aaacactggttcaggctataaaatagttttaaatcctggtcccatcttttagtagttcatgactttgagcaagttatctctctgaacctttgttctattcatttgtaagaggatgatgtcttgttttataggttgtagtaaagattttttaaataaataaatatatatatataagtaactttataagtcacttctttatttaaattcaaagaaaaggagaaatactggaataactggaaaagcagaagacaattgaaagtgagtgaaatcttaaaggatgaaaaaccattttaaatactyagagaagcagaagaaaacattctggattgctgtaaggcagctctccaaccttttcattctaaggtcatactgtgaagctttgaggttgctgaccattgctgcagagtcaaacacatctgggttcccatctcagatcttctacttaccagccttgtaagcttcagtgaattaatcaatcaatatatctctcactatattcccagaaaaaaatatttcagggtgacacatgtggccaaaaacatgacttctcaagtcttatttctttatttgatgagaccactccaataatcagtaggatta

SEQ ID NO: 3658 - DNA, 600 bp, Bovine  MMBT02218
tgtccctcccttctgatcatgaggcgcggaactgcctcgtgtcttgactcccagaaggaagtgcgccttacagtgtgcattgtaggtacttagtgagtatttgtgtccttgtgtttttgatcacaactgtgggccctctctacgtcgcccactgactccaccccgtcacggtttaactgcacccagtcagttgaaatgcaggccctcaccctgccctagacctactccatcagacctggcgtggcatgtgcatttggaaccatggaccctcatgtgcatttgtaacggatgcattaggckcctaacgtgccagttactgttgtccttattgatcaaattacttaagcatatcagctgccagttactgttgtagctgctgagaatgcaaagatgacagcatgggcctgggcctcctaggagttccaggaggagctctgtctgcctcagtagcatcgatgaagagtttgatgagggacctgccttccagggtgaaaatgtgtccaagggcattccggtggtggctccatagtaacaggcatgatgggggcagggtgggaccaggcttgacacagaggacccccagaatgtccttcctcatcc

SEQ ID NO: 3659 - DNA, 598 bp, Bovine  MMBT14794
  misc_feature (1)..(122): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaagattatggtgttttcaggacattgagatgccagggaaaaaagcaaaaggactttgtgtgtagctttttaaaaaaattatcacacacctaaaaatgcagatccccaacaatgtaggcactgttgtggtttcttttttgttctctttataaaaacatgtttgtgcttacacctcscggcacttgttcagtgttaaataaaaacaactctggtaaattgctgacaaacaggtaatacaagtagaaagaattccctaactttcaaactctctgctcaagggaaaagcaaaagctgaagtaaaagatgtccccaaagtcatctggtaaacatgctttcccraagagaacgtgaaacgcatagcaaaacagacactaactaattttaaacacctaattatatactgcctaaacagaattatcaagagacttgattgacttctacagagccgtgattgccatcaagcaaacccagaga

SEQ ID NO: 3660 - DNA, 598 bp, Bovine  MMBT01166
  misc_feature (1)..(49): n is any nucleotide
nnnnnnnnnnnnnnnnnnnnnnnnnnnnnnnnnnnnnnnnnnnnnnnnnctactctgccagttgcctgctggaggtctgacaatattggttttattgctacaatattggttttattgctacaatgcctggaatttcttgaggttagctcttgaaaagtgggttagcaaatccggtttttgctcccttgaccagggaagtaccaagaagataacatctggaaggagaccctgaattcatgtaaggaatctcttgtatggaatcacggggcttccgtcagctccacttctgtgctgctctgygttcactgcctctgagcaagacactgccctactcacaccacactgcccacaccttagccgcaggcgccagctgccaacccatctggggttcctgctgccgaatgccagagggtcagaggcagggagggacctgcatcttctgcattcccttccattttaagtcrgggcgagcctccatctgttgggttcttgggtgtggagctagtcttaaacattaatcattttacgagagtggtgaagagggcttccctggtggctcagatggtaaagaatctgcctgcaatgcaggagatgcagg

SEQ ID NO: 3661 - DNA, 600 bp, Bovine  MMBT11684
tccttctccccatcctgtcatccaagttcatacatggagaattaaatataatattgttgccatactgttaagaaaggcagaaaatccacttttaagaaacaaactattgtcttgctgtcaaattcctctacccaaggyttgagaagcctcatcaccatcatgcttcaaggaaggaaaaawaacctcatatactttagtcacagagagcacaaaaggggatttgctttagatgtttccatctctgtgtccacatatcatccaaggccaaacaacaggcatgtttagtgtttgtaattagawgaaaacagcaatacttttttataagaagcatcttatcttccccgtatgtatgtgcacacactgacagccatgagctgggtgatgtatctaacacagcctggcaagacaagatgacctttctaattgtcatsatgagaagcacaattgcaagtgactttgaaacatatggtaaacttcattatgctaaaatataatagcttcttctttggggctcatgatgaatattaatgtcagggctcctgaggaaaatgtgctctaaatattatattgtataaaaccctttcaataccaaagagagca

SEQ ID NO: 3662 - DNA, 601 bp, Bovine  MMBT08121
  misc_feature (1)..(1): n is any nucleotide
ntggtcatgtcactgctaccagccaggagccsgaagactttatcttcttggcctcatgtcaggtctccttgatgggtcttcttgcccatgatggaaatattctgtatctgagctggtcagggtgtccatgagccgtctgtgggggttgagcrcttgaaatgtggttaggatgaccgaagaattgaagttattttcctttcgttgaattttaatcaagttaaatttaagtttgaatggctgcatgtggcccacggacagcatagctttcccgggtggtgtgtggttccctttcccactgtgstcgctgcctcacccagggagcagctgtaggcaccgctaggcttgtctttgtttccaccatgagcaggggaaggaaagcgagggttgagggctgctgtctgaacctgaggctttggtggctgctggctgccagggagagtgtcaggagaccctggcctttctttccgtggtaggggtgcggcagccggctgtgctggagggtgccctgggtgtcctgttcaccttagtggcagcctgtgtgcagatgcttcctcccactggggacctgggcgctgaaggcggacccgtgtgtcttcgcttt

SEQ ID NO: 3663 - DNA, 600 bp, Bovine  MMBT17068
cggtggttttccctcatataaataaacattgctgcattcaaaaacaccctgtctgcttgttgagagcttccaaaagagcatatctggatagttytgattaggtcataatcttcaaaacatggcatgatttcagtgacaagtttaaattttttgtgccctattctaaaatgcagttaaaatcctgtgctttagagctattttttactatcataatttcagaggtgaaaatggtcaggcacataaactgttactgggctgtctactggctcgtgaaagggcactggcccggaagccagaagrtctgggctctgggttctggacctggctggctgatgctgcagtcagcaacgtctggatgggagtagagtctcagacatgtgctggaaacacgtacagcatgttcacatccagaccgctggcaccagcctcacctcaagaagagattcccttccctttgacaaatgatcctcgtgggtctgtctggtcaacatgagatgcatggcccatgtcccacccagtcctcccctaatagttagtccagggagaaaagcaycccaaagctcccagaccctggcctcccacttttttcatgacacggta

SEQ ID NO: 3664 - DNA, 600 bp, Bovine  MMBT02674
taaataagtcatttcagtgaagcatctgggtaattttgacagctaccttttaatagccacatgacaatgtggaattctaaagtacccaaataacacaacaacaaaatcaatatgcttttcagaacatgcttcaatccatatcttttggggrraaaaaatgacctgcctgaaattccaaataaggtgattgaaaacatacacctttctcattattggaacatattttgagatagactctatcaaaaaggcacggaaacatacggctgtaagtaaggaatagttgtgttgaaattagcatcrtgctgatcctgctgcccgcttcattggttactaagtggatgttcagcatcctggccacgtcttaaaaagacaggttcccagtctccacaatagttaagtcctgcttgcccrttccatgtctgaatttgacctttcctttggtggcacaagtctccttgtttaagtgtaaagctgaactctgtgtttcaaaagcctattaagtaagttcaagcaacgacaagttcttcagtgaagtttcattttcacaagttccactttgggtcacggaggaattttggaaagacttcaaaaaaaggaaga

SEQ ID NO: 3665 - DNA, 600 bp, Bovine  MMBT20681
gtattagcagtatctttggttgggcaatggaaaacaaaatagtcatggtctctgacctaaggatctcataaagcaggtataaaaaattatgttcttagatgggcatttcaataatatttgtagtagtagctgtgattagaaatgaggccaatattcaaaaatacatgcaataagtaataataaataaaagattgtacggcatattgtggattactctacagtcagtaaaatatgcttctgaggcttaatttcctcatctggcagatggggataccacagagtcatcaagaggatcagaayagtcataaatattaaaaggttttagaaataacaaaataataaatgctaattattattatttgttagggtctgtagaagctcaattatgaaaacaatcttaatgaacatttactatgtgtcagatactgtacacatactacctcacctaatttccatctcaagctgcaaagtttggagataaaaatacacaatgacaaattctaatttcagataaaacatttttagcatgtccaaaatatctgaaatatttgggcatagtcatactaaaaattattcattgtttatctgacacattggaat

SEQ ID NO: 3666 - DNA, 600 bp, Bovine  MMBT18732
ccaaggyttgagaagcctcatcaccatcatgcttcaaggaaggaaaaawaacctcatatactttagtcacagagagcacaaaaggggatttgctttagatgtttccatctctgtgtccacatatcatccaaggccaaacaacaggcatgtttagtgtttgtaattagawgaaaacagcaatacttttttataagaagcatcttatcttccccgtatgtatgtgcacacactgacagccatgagctgggtgatgtatctaacacagcctggcaagacaagatgacctttctaattgtcatsatgagaagcacaattgcaagtgactttgaaacatatggtaaacttcattatgctaaaatataatagcttcttctttggggctcatgatgaatattaatgtcagggctcctgaggaaaatgtgctctaaatattatattgtataaaaccctttcaataccaaagagagcatttatttatagtcttcaaccttcttcatagatgctgttaaatattccattaaacatggcaaaatggaatgaataatcatggaacattggaggtgggtggggacaatgatccctttccgagtatcaagccaa

SEQ ID NO: 3667 - DNA, 600 bp, Bovine  MMBT11369
taagtatgagtcataggtctacatgtaggtgacacagcaccattactaacatcagttaaacgcctctatttatgtgattccaaattttccattcagcttagagaaaaaattatgtaaacctgcacaggtgcagaagcagttggtagcaccaggttgcaaattagcaggccagaaaggccaggaccaagaaagtataaacatggatttctcagaagcagtttccctccaggagtaatgagaacagacaaagaaagaggcagtttccatggcagattgcatggaaagttataaaggactatygttacccttgagacaatagaacacctttaaagttcaaggctagaactttaatcctacttcagtgcacaattgtaggcaaatctgttatattttctggggttctgtttcttctgcaaaatatttaaaagaatacataatttagaagactggtgtgaggttttaatgagataacatacttgatgcaactgggacataaattcacagaatatcaactcaatgagtatatttaagtgccagatactctgttggataatggaacacagtactggacatctccctccccttattctttagtagaat

SEQ ID NO: 3668 - DNA, 600 bp, Bovine  MMBT17212
taacttgcagttttggccacatactaactcagttaactttggctaagtctttcaacaactctgtattattttctctttagtaaaaaaggaggtagtacaacctcacaacagctcaaggatttaaatcatatatgtaaaagtatttatttagaaaaataacagtgctgagaataatgtaagaacttataaagtagatacactaagtactaactctttgatacattttaaaatcattagtatgtggtaagtttataatacctgcttcatagatttcattaacttaataatccaaagtggggraaaatggtaatagcaagatgttcgtgagcaaaataagcatagaatacttaatttatctgattacttttcttcactgcctttacagaagagccttgaatttaggaattcttcgagaccctgggtcagagattgaagaccgacaataccaaatagatctgcagtcgatcaatattggtactgctcagtgggatcaactgaaaccagaaaaggaaaatggcacaggaggagtgctaacagagactgaaagaaattcacagaatccagcccttgagtggaatatggccagcaggtaggaaatgc

SEQ ID NO: 3669 - DNA, 600 bp, Bovine  MMBT01503
ctctttttaaaatcttttctatcatatgcttcccaagcagattgtctattctgaagggcagagcttgcattttatgtctctgcatgtctcctgcagtcatgccctacacctacttggagctcaataaatatttcagaaaaaaaaaagtgcttcttaaaccctattctgcagggctcaaagggattattttatgtgcaaagttcagaaataaaaaagccaaactccagcaaaattgcttctttttgcattcttcattttgatgatgtctctaaggtgtggttttccatattctttatgctyctaatatactccaaattaccttatatttctgttgtacctaatagaaaggaggtgacatgtaagggtacagggcccccggtcacctagagtcatataccaaaacctgtctgagtgatctccaaaacagactgygccagacattttattaaaggcttttaccttgtgccataaagttaatccacactggaaggaagcaacaggaattttgagtgggttgaatgtaaatcagccagttgggacaatggtgattgggactactgtgggtgaaacaacactacgtcattctgatccaggcattat

SEQ ID NO: 3670 - DNA, 600 bp, Bovine  MMBT16950
aaaacaatttatgcaaacaggaaaatttcagtgtagaaaaagatgagatagaaacgcatacctcgcttctattgaygctcamaaacacactgtatgtgaatgtataacaagtattttcatcatcatacatagcttctggctcttttccatttacagtaattaaagggtgaaatatatcaacaatgatttggttttccttctttctgatacccagtttaggtggtccaactttccctggggggtagggaacaaaaaagaatttgcatcagccttggaactgtgatccacagcatattacayaacattaccaaactcaatccatcaacctactcttttcgttgctgttgttctaaagcaggactgcatttaaatcgttccacaaacatctagaatatattttaactgtctttaatgaatcttggtaaaaagccttgacataaaagaagctcaatgaatttatctttcctttatctttgattctgtagattaaaaatcattaaacagaacatggtttttaaaatacatttcagaaaaggcattgtaattatctttgagtcctcatcaaaacccttcgtatttccagtgcctatggacacgggg

SEQ ID NO: 3671 - DNA, 600 bp, Bovine  MMBT00491
aacaaagatgttgtccaataaaattgttaggggactcagagccctgaagcaatccttgaaaataatttgtaatattatattaattgtatgcaaatgatgctgccaaaatgctggaaaacaattgatttttttaataattaaatgatgcccctgaaatcctgtgcaacataatttgcttagcaaaacacttcctcctaaatcgttcccaggaaggctttgatcacatcataaattgtatcatcaccaactctgcaccactgcagccacgctgcaggagtcagggatgttctcccatacctraatctgaacccagctttcttgctstcctgtatctcccccttgggggcctttttgctcctaagcaaagtttgttaagttagcaaaacatagggctcacttcagacttctaaattcgtcatagtgcacaaaccagaaaggtgtgtagcactttcctaaaggtgccctgtgggcactgaattctgctgtatatgtgtctttatgtgcatgtatgtatgcatatrtgtgtgcatgtgtatgtgtgtccacatatgtccctgtttgggggtacacatgtacacatgtatttaagtgtgcttgtgt

SEQ ID NO: 3672 - DNA, 601 bp, Bovine  MMBT18525
  misc_feature (1)..(1): n is any nucleotide
nttaccacctaggagcattgtgataaaaaaaaaaaaagtgaatagctgtgatatctgtcagtgtgaggtggatttttatgttctgacagggagatgtgtctctcagatattacgtggaagagcaaattatgaacagcaggtaacatcccatttttattaaaaaggaaaaacaagattgtaaacagaagaaatcttagtggctcttatgcaaactgaatagtggttaactttggatgatggggttatatgtgactttattttttctaaaaattaggaattacatatttctgttaatgttttyaatttatgaaagtaagcaggtatatctttcctaatcagaagaaacaaaggtaacaaaataaccagcttaaggaggcagagaagtatataaacattttagaaaaatctggttcttatttaatgggtaagtgaattttaaacrtatgtggaatatctcccaccttgacaatgcacacaaatgatttgaatgtcagacactctttacaacaatgcttgggtgtcagtagctctttttctgactcctgatcartttcccccaaccatcgaggtgaacttatatatgtatattactattggggtt

SEQ ID NO: 3673 - DNA, 600 bp, Bovine  MMBT14792
tgggtgtcacactggcggtgtgttttggatgggtcctttttgcacaaattaaggaagttttaaaaataaaaccttgttttctggtgcagacaccttgtagttacactgggattgcagtgctccatgtaataaggcgacatcagatgactccaaacaaaccttagataagctcctttcctccaataagtcttacaagaggatgcttacatagcacaattgagtaaatatgtgcagagctcataaaaagtcaaacgtgattgaacctaaagaaaaagccaatgcttaatgaaattgcaatgwgaagatatactgcttaatctagcctcagagcaaaatgccaggcaaaatacacagaawttgcctaagactttatatgatttctttgagttctcggcatgtaaaagaagtaaggcatttcattttagagaaagtartccgtactctgtttctcaaatcatggtcttccagtttctattaatagtaaactagtaatattttttattaataaaatgttttgtattaatagtttttattaataaaatgttttgagaggtttgtttaactttattcttgtgctttaagatgagggtccaagtctga

SEQ ID NO: 3674 - DNA, 601 bp, Bovine  MMBT18947
  misc_feature (1)..(1): n is any nucleotide
nagcatgctcgctgttgaccttcagcccagagcctctgcctgcccgcagcacacctgggtggccgagccttcctraacccacgcctgtctaccccctgacagcccaccctcctccaactgctgtccttgttgtgttgttgcgtggtgaaagtcgctcagtcgtgtccagttcttttgagaccctatggactgtaacccgccaggctcctctgtccgtgggattctycaggcgagaatactggggtgggttgccattcctgtctccattttgcaaaktacctttttgttcaaaggaatgagygyggttaaggtgactactttaataaattgccaaatgctttgatgtcccttgcaccttgcccrttctccccaacctctggcacaggtgtgtggtcccagacactggtgggtgtcactcccagctacagcaaaacagggggtggggaggggcctggcacttgtgttaccatcagatgagtcagccaggtggaactgtaaagcatttaatcacatgggtgtcagcgttgtttctcgaaagaacatttttccaggacctggtatgcaggatgggcacacgctgttacgtctgcggttttcacat

SEQ ID NO: 3675 - DNA, 598 bp, Bovine  MMBT06450
  misc_feature (1)..(91): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgtaccagccttcagcatgaaacaaaaataagactacgtgttcgcaaagcaagtattgcctttacgctaattaatatctatttatcatacaaatattctaggtcccatcatacttagaacactgactgaattaaaatatcaacagccttttatcttcctaaagcaacccagagctgggtacttgagatggtgggaggaggaagackgaacaggagtgatggagacggcacggaaacgctgactcagcaacacacacgcccacgactgaggggatacagggcagcgtgagttttcaaaaccacgtacctgattttctttagcagatgattccaaaaacgctgcgttccaagactctgctaacgctttcccttcttcataactgatcaccctaatggaaacagaaaattttaatcgaagtactttgctctttaccacrtaaggtgtgtgtaactaactgatgaggcagttggctcagtctcatccagagcgcacgcagagtctctc

SEQ ID NO: 3676 - DNA, 600 bp, Bovine  MMBT11147
ttcctggtttgtttgttcttttttctgttcttttttctatttgttcttttttctgcttcctttatataaatgtgatgacaagtgctggattctttatatttcccatatagaaaaccagtagagtctaagtacataaacaaggaagatgaaaaagcctaggtatctggggactccaaaaaggaaaattgccacaccagtcctgacatgcatatctttagactttacatgaaacagaaaaaaatacttgtaagagctcttatttatgacactttgaccttggtgctcccacaaaatctaatyccaacagatacagtggcatatcagttcaattcagtcactcagtcatgtctgactccttgtgatcccatggactgcagcttgcaaagcttccctgtccttcaccaacccccaaagcttgctcaaactcatatccatccagttgttgatgccatccaaccatcttatcctatgttgtccccttttcctccagccttcaatctttcccagccatcagggttttctctaatgagtcaattcttcgcatcaagtggccaaagtgttagagcttcagcatcagtcctttcaatgaatattcaggac

SEQ ID NO: 3677 - DNA, 561 bp, Bovine  MMBT18945
  misc_feature (1)..(1): n is any nucleotide
ncgagccttcctraacccacgcctgtctaccccctgacagcccaccctcctccaactgctgtccttgttgtgttgttgcgtggtgaaagtcgctcagtcgtgtccagttcttttgagaccctatggactgtaacccgccaggctcctctgtccgtgggattctycaggcgagaatactggggtgggttgccattcctgtctccattttgcaaaktacctttttgttcaaaggaatgagygyggttaaggtgactactttaataaattgccaaatgctttgatgtcccttgcaccttgcccrttctccccaacctctggcacaggtgtgtggtcccagacactggtgggtgtcactcccagctacagcaaaacagggggtggggaggggcctggcacttgtgttaccatcagatgagtcagccaggtggaactgtaaagcatttaatcacatgggtgtcagcgttgtttctcgaaagaacatttttccaggacctggtatgcaggatgggcacacgctgttacgtctgcggttttcacattgtcatgtgaggtgcatgcgag

SEQ ID NO: 3678 - DNA, 600 bp, Bovine  MMBT08229
gactctctgaagccacaactttgtatccacctatctctccagtcttgagggcagcgattttccctgtgaacttgtcttatggatccaagaagagttgttgactttcagtattttcagttttccacctcttgttaagagggagtagcaacttccaagcttctatcatgtcaaactggacatgggaatataaaggataaaaaaaaaataagaatggctgcattaaattttatgattcaaattgctgttagtagatttaaggaaaactgaagacatctgtattgtttatagtgtatctaactrttttgcaccgatgttagtttcttggtttagataatgtactacagttaatataagatgttatcagtgcacgaagcttgatggagggttcccgcactctgtactatcttttacaacttcttgagaatctctaaccatttaaaaatagaggcttttcttaagtaaatgaaactagaaaaaacatttgcaacataagaaggaaaaaaaaaaaagcctcaatgtatagaaagctaaccaatcaataaaaaatacatcctagcagagaagtaggtaaaagacataaataggtactttgcaaatcat

SEQ ID NO: 3679 - DNA, 600 bp, Bovine  MMBT08706
cggctgatttcaatgtctgtgagggaggaaatagagatgttgggttttgtagctcttctgcattacctgtaatctggtgacctgtaattagctggctgaaaatcagaagccctcaattctctttttttcacccatcactgaagataggtgccaggtatctaattatattttaaaaaatcacattgcttatacatttgagaaatgtaggctaatgataacaaaattattaacttcagctcwtattttatccaaagtcatgtatatgaaagattacgggacattgtgtggacatagctgatrgcagtatttgactcactcttacttccaacagggccacatagaattattttactttgtttggaaatattttcagtgaggtatttggacatttggataagattgtttcatcaagatatgctcataaagttgcttggcggccacaccatcttatagtttaatagcttctatccttcctttcttgtggccatttatggatctttttatctgttcttgagaggtaagaaggttaggtttgaaaccttcaaatcatttatgtccttccatgttaagtacctgctaagctctttcacttccacttgt

SEQ ID NO: 3680 - DNA, 600 bp, Bovine  MMBT13523
agcccaccaggctcctccgtccctgggattctccaggcaagaacactggagtggattgccatttccttctccaatgcatgaaagtgaagttgctcagtcgtgtctgactcttggagaccgcatggaccgccacctaccaggctcctccatccctgggattctccaggcaaagtactggaatggttgccatttccttctccaagaaatatggcagttttacatattatcctacttcttcaacagtatatacattgtgatttaacacttctgtaatgattggggacaacatcatgaaacttyactagagcactgggttccagaaagcagaactgcttatgccatctggctttggggaaggtttgggtatgattctttgttaaaagaatattttgaagtttgaaatgagaaaaagagactaagtggctggaagaatatgagcastgtttttgcagcatagcctcaggagagataaagtgaattgattcagagtacagttaggctttkgggactgcatttctgcttctgagaaggaggaaacaaagatgaaagagaagaggctgacatgggtgctgctctcctatgaatggcattttcctgtaa

SEQ ID NO: 3681 - DNA, 600 bp, Bovine  MMBT01533
cggcccggagccacagcgggggtctctcttggggggccatccctggcctgggaagggtagggggaagaagactgtctgtacctggcattcgcccagctgaatgagcagggggtcygagcagcaggttaggtgctggtgtgaccctggcccacctgagacagagctgggccgagtgggcacagccrggtcaccccccgaggtgcaggtggcagacaggagaggcatcagcatgctcgctgttgaccttcagcccagagcctctgcctgcccgcagcacacctgggtggccgagccttcctraacccacgcctgtctaccccctgacagcccaccctcctccaactgctgtccttgttgtgttgttgcgtggtgaaagtcgctcagtcgtgtccagttcttttgagaccctatggactgtaacccgccaggctcctctgtccgtgggattctycaggcgagaatactggggtgggttgccattcctgtctccattttgcaaaktacctttttgttcaaaggaatgagygyggttaaggtgactactttaataaattgccaaatgctttgatgtcccttgcaccttgcccrttctccccaacc

SEQ ID NO: 3682 - DNA, 601 bp, Bovine  MMBT17373
  misc_feature (1)..(1): n is any nucleotide
ncagagggatccccttgggtctccacatcagggtgcaagaaagaagtaaacttccagtggagatggtgagcccaaggaccaagaaggagactgaagggcctgtacctgagatgctttcartctcagaatctggtttgtccaaagacaaagggaaaacctcagtcacaagataataaaacttcagaatatagcatcaggaggaaaacaaaacaatatatcggtttcaatgcactcatgataacttgggggraaaaaaaaagagcaaatccacagtcaggccaggatccagactaagtgacasgttgaagtttaattaaactagtcaagcctatataaaagcagaaagaatttcaaaggagaaggggacactgggaaaatcaatacrgtttcattgcagcaggaagaggcacccaaactcaaggtcagacccagggggcttgtccagtctctccaacrctctttccatccttctaaagcatttcttactggtggaaaataaactgtcactgaacttgcagatgattatctctacgcaaaaactctgacaagactttgtcagtaattctagaccagttgcatctggagaggagactatggcaga

SEQ ID NO: 3683 - DNA, 601 bp, Bovine  MMBT20348
  misc_feature (1)..(1): n is any nucleotide
ncctctagactcaagcatgtcacgtgttcacctgcagacccagttgctggaatcaagggataagaaagaaggtagatttcagaactggcccacaccctgtgtccaagcccctgccatgcgatrgtcacttctgatgtgttctgtgggccaaaagaatccacaggcccagacccaaggggagagcacataggttctaccccagggtgggaggagctacagagccccaattctgagtccggcctcargaagccttggatagacctccctgtcgtggggagccccatcacggtcatgagagcaygcccagtctacccgactgcaggaggagaccgcatggaacagacacaagctgttctggccraggccactctggtccagccagtccccaagtgacctgctaagtgaccacagatgggtgagtaagcacastcggggccagaagaatgcccggcccaaattgctggcccacaggatggtgagctaaatcaatggctattgtcttaagtgtgggggaggtttgttatgcagcggtgggaagactgacgcaggacccaaccttgctggccatgggaatcgagcaggcgggagaggaggcatcaga

SEQ ID NO: 3684 - DNA, 600 bp, Bovine  MMBT06668
gatcaaaccccttgtcatcctccgctttgtcaactagattctttaccactgagccaccagggaagtcggctggactattcctcatgagagcagtagaaatgaatattgaaaatcttgcatttccttccacatcactggtctattgctgtgtaataagccagtcccaaacttaatggtgtctattaacaataatcattttataattaatcactgtttctgagggtcaggaagacttctcagggttgacatgccatagtgtctactgaatggttttgttagccagtaactggagctggagcrgtgtggggctggaagatggggctytgcaggcatgtatgcacaccctccctttctctctctgtccttgttgtctcagggcctctcatgtggtcttcccatgcaggctaacttgggcttcctcacagaatggcagcctctcggtggtaggacctctcttcctatgcagagactacgcagagacttggagcttcactttgactgtttcatctattgttgtttagttgctaagtcgtgtctgactcttgggaccccatgggctatagcccgmaaggctcctctgtccaccggatgtcctaggca

SEQ ID NO: 3685 - DNA, 600 bp, Bovine  MMBT13069
gtgaattaaaatctatagctgagtctacattgttatgagtcaccattttcacacaatatcatgaatcttcagtttgttaatactttcatatagaattgggctgaagaaaggattgttttgtgtaggtgtttaatactactatacagttatatctcattgaaaataaaataattggggatttttacccctaattcagatagaaagcacaagaagctgcagattcattaatatgcaacagattctctgttaatgaatatttcttatggattaaaatagaaaaagctcaaattgttttttttyctttgaaattttaatwacagtttcaccagctagtagagaatatggatatatgacggttgcattgtaatttctgtgtgtgtgtgtattgtttcgttttggtttgtttttataaagagacgtgtgtttgtacctatgggttcaacatttctgccatcttgctaatcagtttcacttgccctgtggatggtgcatgggttctgtcctttccctcctgacccaaatttaatctttaacttctaaggtttgtattaagatttcagggcttaacgttagaattttggtactttttctcattagggg

SEQ ID NO: 3686 - DNA, 600 bp, Bovine  MMBT14704
gaagttcagcataaccagtgttgaatgtattctgctcattctagcccrgaagtcccagaaacagtcatcaactacaagtgacattcaaataccttatgaactcagtgtgttggtatttgaacggtttccctctaaagtcactacaaagtattactgtgttatagccaaatgttttctaacagtttgcacaattctgtcatctacccagggaagcaaatatagatagtattcagtctgcagagtaccaaaatctagatggaaagggtcaagcttccatcacggcattatacyacgttayayggctatttcagccataatgtcagttattatatattggcgacgtgcctaaaggctggttcaaatctataatttaagcacatatcatgctaaatagtgttgtgccatagccaagaggcatttggtacgtgatgcctttccccttcctgagacacaaagaagcttattctgttctccagtcataggtgtgacgtaggaaaatgcctcgaaaattccacccacgcatttgcctgggaaaataactgatttttctgagctataaaaatgtactgtcttttccttctgagtgggttcatggaaatg

SEQ ID NO: 3687 - DNA, 600 bp, Bovine  MMBT18399
agacacatgacaaggttagcaacagaggagctgataatgctttacttttatataatgagggctgcatttaagatttgaaacacagcatgatgtgtgtactttgaaaagactggagtgcaaatatgaagtatggagctttgaaaagatagttaaggagaaatgtcagcatcatggtggcatgagtagttccctcttgctttcctctttgatttacaacaaattgaacatctaaaactaaaaaaaaaaaaaaaagttatctacacagcataccagaacacctgaaatcatccatctatgcartccaagtgagtagattggacccccaaggaggttgcagagcaagggaagtgttggcagagagggtaatggagcactgtcagccagtacatcagtgagccagcatgatctttccggcagaggaattggaggtgaaggtggttggtgtagttctgcctggccacttgggctgcagctggagggaccagtttctctctgaagagagaccttactgactagggggaaggaaaggaaaggaaaataggcagacaaaaaggactgaaggaaagtgtctcctggtgtctgacctaggaaggcaagcga

SEQ ID NO: 3688 - DNA, 600 bp, Bovine  MMBT01319
ggtgagcaaaactcagaggacctgtaggcaggcgggagggtccacatgaaggacccttagattggctgccacaggcacagggcccattactgttgcatttacctagagctgacctgcctggagtcagtcttcttttgtgaacgtatcagaycacgcatcctgatttccagaaaacttggcgaggcgaccactaggaagacttgcctgcaagggacccacgatcacacctgtgtgtcctggactcattgagtagccctggggtttcagctgagagggagggagcactggcccagggaagcrggctctgctacttggcagagggtgtaccttttaaagccggggtgtacaggatgcccagtgggttgatgaaggaaaccccgtcctccccgtccatctcggggtcattgtttgaggctgcattgccacctgtggcaaaccagagaagagtttaacgcagagaggtgggtgcctaagtctggatacacgtgcgcatcagcggggtgagcagcagggtcagggaggggccttgagggcggggcggtgggagggaagggagctcatggcacacaggatgcagttggggctcggttctgtagcttc

SEQ ID NO: 3689 - DNA, 600 bp, Bovine  MMBT08325
actcccatccatctcaagtcttcataccagactcatccgaacaaatctgccaaggagaggaaagaacccaaaagaaaccctcccccgactcccactccttcccacacatggctatttccacagtggtgatcaaacttaaaaaatcctttttttctccaggtttcaagaccatctccatggctcagtggtctttacctgctgtgttatttttcaggctgaagccacgtcacctataactatttctcactccaccaggaactgttccttattggrctttctaactatgatgagtgcttcttmttctgtctgatcactgaagcttttttcttctagtcaaatcagcatttgaatgagaatgaatgggaatttcaggagcagggacaaaggtggcttcacttccttctgagggtggagaaggggagtgtttggcggctgggttggtccttttaaaataggtttcattggtgaactgcctacggagcccctctgggctggcacgaagcagcacagaagtcagaggcaccaggcactccgcaccagggtgatctctgctgggttaatgcactcctttcccaacacagcatcctctactccttccga

SEQ ID NO: 3690 - DNA, 578 bp, Bovine  MMBT17601
ttgccatcttccctctccaaaaaaaccccttgttataataaagtcattagtcatttcaactaattttacaaagttcacagtcactgaattcttcaaaaagccttgatacttaaaatccacctttaagcatttattccaatgtattaaaaatattttatctttaaattactcaaagcctgttctgaaacttgcatayctttactcaaatatgccaatggagtattaaagtgagaagaaaaaattactcccagaactcagtaatattctgaggctcaccagtccatctctgcatatttgttrggaatatgctttaaaaacattttttaccttgtctcgtgatacagctgaaggcaattctcttgctagcctgtttctcctttgttcctatgaaacacaagcaagcaaaagattcatgattatcagaacataagagatgtaagctactaaaaaaaatgtgcagcttaactgaaaagtatggaataactaacagtgtatcctcccactgttgagactcatgccataattatattttaaaacaaacaagaaatcatttaacctaatgcttctcagtctttttt

SEQ ID NO: 3691 - DNA, 601 bp, Bovine  MMBT20347
  misc_feature (1)..(1): n is any nucleotide
naagaaagaaggtagatttcagaactggcccacaccctgtgtccaagcccctgccatgcgatrgtcacttctgatgtgttctgtgggccaaaagaatccacaggcccagacccaaggggagagcacataggttctaccccagggtgggaggagctacagagccccaattctgagtccggcctcargaagccttggatagacctccctgtcgtggggagccccatcacggtcatgagagcaygcccagtctacccgactgcaggaggagaccgcatggaacagacacaagctgttctggccraggccactctggtccagccagtccccaagtgacctgctaagtgaccacagatgggtgagtaagcacastcggggccagaagaatgcccggcccaaattgctggcccacaggatggtgagctaaatcaatggctattgtcttaagtgtgggggaggtttgttatgcagcggtgggaagactgacgcaggacccaaccttgctggccatgggaatcgagcaggcgggagaggaggcatcagagactccaggctgcggcaggcgccctggggttcttgtcactggcgggctgggactccaggc

SEQ ID NO: 3692 - DNA, 600 bp, Bovine  MMBT00576
ccagccctgttggggggtccttggctgtcaccctgttggccccctgctcagacctatgcccatccccaccatttccggtctttctggtcctcctggctctaagacacacagaccttgtgggggatagacgtgtgagagaccctgaagaccacagagaggggacttcccttttccaaatgggaaactgaggcttcacccaccactctcacacccaacagtgtgctgagtgcctgccacctgccagactctgttccgggcactgggatgagctgatgttccctttggggagacagcagtgcygggtgcagagaytggaagtgggcagcaggagagactgatgggagggggcagcaggggcccaggaagacctcgctgagcaggtgaccttgagctgagcggctgacaattgaaagaagtgagggctgagccatgctggctccggggagattagagtgtgtaggagcttggtagggtggggagaccccgcccacccaggaaggatgtccctccacctactctagggtttttgcaaaccttcaagtctctaggtcacaggtgggaccctcatcctgagggcaaggggaacagagaggagcaagg

SEQ ID NO: 3693 - DNA, 600 bp, Bovine  MMBT12558
ttcagaagaaaaagctgtgttttaagtaatatgtggatttctttccagcgcctagtggaactcaaaaagctttcagttagatatcaggttggctttctaaaaaggcatgtcactatttgagaaagagtcagaagatttctactgaaatctttgaatgaatgaaacaaaagcaccctggctgtctttctctagacggcagacacctctgggaggagtgagacattcaagtgtaataaatccatgggctttyccttaagggaactgagttgtcatttttctacaaagtggcaggtgagaacwgcagcataagaccactgggtgtctgtggcagataagtgaacggcgaagaaaagataagtaaagactgaaaataaatctgcactcacatggcaattttgccttgagccagctaggtagaccagtagccttttagagtcagaagattatgtagtaaaagtgacagcaaggttaaccaatcctcacctagaatactgaggcaagccttctccagggcaggtctgtctgagcattttctcttaataggaacgatatcattggtagttctatagtaactttatttgaaaacacatttgtctcttg

SEQ ID NO: 3694 - DNA, 600 bp, Bovine  MMBT13071
acctgcccatctgttcatctgtcgtctgtcttcttggtaagtcccctgctgtgttgccaaggcaacactacctgctacatcaccgcaaggaatggctatctctttgctggacttctgatatcaaatacaacacttgactttcaaaaccacggcttttcatccttagggtaaaggtttcttccgtgggaggtgaggcaacaggcattctcaggggttacctcaactattctcttagtcaagagctccttccacaatcaggaagccaagacccctaagcccacagcctcctgtctttcaccstaccagactccatctcccacaaaggcatctgaaagtgctggggataggaaatctctggcaagaagactgacagaaacagttttcaatattcagcatgactcagaatagaccctgactctttggaaaagatcctgatgctgggaaaattggaggcaggaagagaaggagacgacagaggatgagatggttggatggcatcacagactcgatagacatgagtttaagcaagctccaggagctggtgtggcagggggagggcctggcgtgctgcagtccacggggtcacaaagagtcggacac

SEQ ID NO: 3695 - DNA, 457 bp, Bovine  MMBT17285
ctgcctgaagagaattgtgaaatgctctgtgtctggatttgaaagaggtttgcatcctgaatgctcatctctctattcatctttcatgtaatctcctttttgcatatttaagctaagtgttttttcctacttttcttagaggtatattaatttaaaaggcctatagaactcagactatccaccctggcttggtacactttactcattcttaactagattttagtattataattaaagtaggaaatgtacatgcaaaatagcagaacaggtaaacagcaaaaataaatttcacttccattscacaacatcccacagggagttactatttaaacattctttagtatattttctggaattttctatgcagattattgtgccctgttaccatctttgacagattttttttttcctcctaataatatatcttagagttctatgtcagtatatcagtacataa

SEQ ID NO: 3696 - DNA, 601 bp, Bovine  MMBT20640
  misc_feature (1)..(1): n is any nucleotide
nattttggcttggctcaagtgtaaactccttcaggaagtcttggatgtcttcacctcccccttggcccttagctgctctgtctttgaaatcccattatacctcatgcatgtctccatcaacaamctttccacactgaattaaaattrttgttttatttctctatgtttccccrtcagactattgacaatagctggcatctatttgctgttcttcagcagcagtgcccatattttccttgagaagtcccctctcccttcctcctagtgtgtggttccagtgaacagactgatttccctcccrgcctttgatgcgctccaatccacttggagcttcacatgcatgcatgtgtgctatgtcactccagtcatgtccgactctttgcagccctatggaccatagataggcctgccaggctcctctgtctacgggattctccaggcaagaatactggagtgggttgccatgccctcctccaggggatcttcccaacccacggatctaatccacatctcttacatctcctgcactggcaggcaggttttttaccactagcatcacctggcaatcccctggatcttcatatacttagtgacaaaggga

SEQ ID NO: 3697 - DNA, 598 bp, Bovine  MMBT00520
  misc_feature (1)..(1): n is any nucleotide
naaacccccctactaaatacttaacctatggtgccaggcatggggaaaaggggatggtatgtgctgtgattagtactgtactgcctggaggaaaattaagagtgcgttcatccctgtggaatgctgagtggtggggccaagccctcttggagttgcctagattttccttgtccaaactttgatccactaagcaatttaccaggatccttgsaaggggtggaggtgggtgggaaacccattgaccatatcagtgattgtactgaccacaaccctgggtctgccaggagttgacgatcagakgtagggccctggattagcaaatggctttaaggctggctgtacaaggtctggatgtgggccagcctgtgagaccagaggggtcactcaagatgtgataaataaaagcgaagtccaaataccttttattccggttgcagaaacccaattcatggtaatttaagggagcactatcaaacagctatttgggacgytctgaaygaagatgacagatagtataaagatctgagttatcttggagatcacggtgggtggtctgcagaaagttggaaaacattggagattggcacctccctgcagt

SEQ ID NO: 3698 - DNA, 600 bp, Bovine  MMBT04301
gatgcgtcagtgaaaaatgaggtatagtgggtgccaactcaacagcgagtttcagaagaaaaagctgtgttttaagtaatatgtggatttctttccagcgcctagtggaactcaaaaagctttcagttagatatcaggttggctttctaaaaaggcatgtcactatttgagaaagagtcagaagatttctactgaaatctttgaatgaatgaaacaaaagcaccctggctgtctttctctagacggcagacacctctgggaggagtgagacattcaagtgtaataaatccatgggctttyccttaagggaactgagttgtcatttttctacaaagtggcaggtgagaacwgcagcataagaccactgggtgtctgtggcagataagtgaacggcgaagaaaagataagtaaagactgaaaataaatctgcactcacatggcaattttgccttgagccagctaggtagaccagtagccttttagagtcagaagattatgtagtaaaagtgacagcaaggttaaccaatcctcacctagaatactgaggcaagccttctccagggcaggtctgtctgagcattttctcttaataggaacgat

SEQ ID NO: 3699 - DNA, 600 bp, Bovine  MMBT04586
tgtgatcccgatcttttaccttgaaagtcgcaagatggatttaagactgaaaatacatggtcagaaattaataagaccagcctgctgagaatgggggcctgcattcatyatctcttcattcattcagcaaacagaagttttttcctgcctgtcctctccatacccccagccctytaccagattcactagcaaatactattcattttcctgagaattttcagaaattscctaatcaaatgcaaatacgttgccaggacattaccttaaactctgtcagatgcaaatctgaagtggggagakgaggcttacatggaaccccaggacaaggaggactcctagggtggcctgggttaggctgtgtgacatcctgtttctatttcgatgtcccctcttcactcacatccctgrgaacatgagtgtctctctcagtaaatgcctgatctgtgcttctgaagaaatgaagggcttacaaggaacaaaatgtcctgagtcacttaagtaaacaaatccrgtaagtcccctataaaatcctttgtcattttaaacactctagactgctttcaactgtggaggagtatttatgaacacggcatgttgaag

SEQ ID NO: 3700 - DNA, 600 bp, Bovine  MMBT06695
aggtggccaaagtattggagcttcagcttcaggatcagtccttgcaatcaatattcaggactgatttcctttaggatggactggttggatctccttgcagtccaagggactctcaagaatcttctccagcatgacaatttgaaagcatttattcttyagcactcaggcttatttatggtccattttagacaagttatttaatcttatgtatcttaactttcatcatccataaatgggtctaatgttaggagttactttgtakagctatcatgcctgacacataacaaattctcagtaaamtagtaactcattggcttgaattcaagctcgtcatcttccagatggggaagctgatccagaggatgaactgagttggcagagcaaggactgtgtgtgtgtgtgtgtgtgtgtgtatgttatttgctcagtcatgtccaactctttgtgaccccatagactgtagcctaccaggctcctctgtccatggaattatccaggcaagaatactggagtgaattgccrytcctttctccaggggatcttcccaacccaggaaatgcacctgggtctcctgcattgcagacagattctttactgtct

SEQ ID NO: 3701 - DNA, 598 bp, Bovine  MMBT10514
  misc_feature (1)..(93): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgaatgaagtggggagagtttggggcagtggtgtgacgtgatgtgactcagcctctagtaggatcactctgactcttttgggggattgagttgcttactcactggtgcccaggacaaggggaaaccagggagaccagtaaatgagaacatcttggaccaggtgatcacagaggaggtggtgagctgaaggatttctcccaatgmcttggaagagagatgggagatgagataatgtgaaggttggttgtagagctagagagaatctgggtgaataaaaacaagatggatcaaggaatgttgagaggagatacagrcttacaagagggatgctgtgtattcacacacagcagagagaaaaagctggagtcctagggaaaggatttcagctgtccatctaccataaaattacagaattaatccagttgctgagttcattataactgatggtacaaagcagcataagtaatttgagaggatagaattgctttgctggctttatttt

SEQ ID NO: 3702 - DNA, 600 bp, Bovine  MMBT15248
gtctgattctttgccacctcatgaactatagccagtcaggctcctctgtccatgggatttcctgggcaagaatactggagcaggttataatttccttctccaggggatctttctgacccagggatcaaacccaagtctcctgagttacaggcaggttctttaactctgagccaccagggaagggccatgttacaagtttccarcactaaccctaagtctcagttccagctccyacttgccttttcgagtatgtgacccaayaaatctcctcagcagtttaggtcattttgagctggggtstctattactggaaacttgaagactcctaacagatgtaagatccgtggctgtatcaaatgtatccctcagtgatccctgaaggaagacagagaggaattaggaagtcatcagcagcaccagagggagagagatgctagcacaccttcctgaaataccacagtttgtgtgcaaaaagtaaaaaataaaaccctttcttaaggaatatcatggcttgcccacattttccaaaccagaaatccataaacataatctagcaaaaaaaatttttttctgatatgccaattcattacagaaaatctc

SEQ ID NO: 3703 - DNA, 600 bp, Bovine  MMBT15512
gcgagtgatggaaccaaatagagtactttctggatcttcaactctaccatgctgaatgggttcaggagcgccacagtccacggctacatgaggaagacaggagagagatggtcaggatagacacttcttcccaggaagagtccctgggccagtccatcctcccagctctgatcctcactccttccctgcctcccccatccataagcacatctggggtgaatcccccacatcagcttctgtggccatgatcatctccccagcctactgagtcctgccacttcaaatggcccttagaacackgcaagaactaacctgcttcccagtgrttggtgaggcctctgtagaaatggacccatagaatgctattaactctactaatctcatagcccctttctttctaagaaagctgctagtctggcaggcctggggtcagatcaggactaggattctacgactgatttcccttcaaaacccaatccactatctcacaagcctaagaagaaaccatgcatttgtatctcagtgccttaatctttccatttcctttgggagaggggaaattattcccttctttattcttaagggaaagaaggtttattc

SEQ ID NO: 3704 - DNA, 600 bp, Bovine  MMBT20088
gacccccggaatggggctggaggctaggaatcctttagcccaccycscctccccactccttggaggcctgggagaaggactttgctgcagtgaggcccccaagtcttccctggccctggataagcactgcttctcaaaatgcggtccaaggagccatgccagctcataagctgcttgctactagtccatgaggagataaggcagaaactgagagtaagactttagaaacttagatggtaatttcgcatggctctgattatttagttaatttatttatttgattttgggctgtgctgggtmtttgttgttgtgtgtggtctttctctagctgcaatgagggggactgctctgtagttttggggcacaggcttctcactgcagtggcttctcttgttgcagaccacaagctctaggatacgtgggctcagtagctgtggcacacaggcttagttgtgggatcttcccagaccagggatggaatccttctccactgcattggcaggtggattctttaccgctgaaccacccgggaggtccctggttattttttaagcaactcatttttgttatggttgacaaaagcatcaatctgagatggac

SEQ ID NO: 3705 - DNA, 555 bp, Bovine  MMBT20242
ggcagttccccagggttctaaggacatagggaytggaggaagaagtaaattgttgaatcactaggtagggtttctgtttctgcttttacagctttgtaaacgatatccaggctttatgcgtgtggcgttatcggagccccagccggagaggaggtgaggaaggtgggaggtgtgaccctggacaccttggggaaaagctttagggaagatgagtggccagcatcacctccatcccaggattatgtgggcattttcttgttcaggtttttccgccgtggttgggtgacctttgaccgcagygtgaacattaaggagatctgttggaacctgcagaatatccgagtgagtgctgggagtggggctgttgaggaagagaaagtagggccttgcatgctccgcacagtcttgttcctttgttcattgacggctccatccatccagtctttatttcatccattttgcctgctcacgtggactgcatgcagttgtctctgggtgtggccctaagactgttggagtgagcaagacatcctggtccctgtacacgggctcggt

SEQ ID NO: 3706 - DNA, 600 bp, Bovine  MMBT20522
gctgccatttccttctccgggggatcttcccaacccagggattgaacctgggtctcctgcattgcagacagacgctttaccgtctgagccactaaacaacaatataaatgctttcaaggttcttgggcttgagttaaatgatggaggtagaactgttttatcatccagaaagagttaaagagatgttacttgctgccatgattataacaacaactttgattttcccacttttactgcagttttgttgttgctcagtcgctaagcactgtctttttgtgacccatggactgcagcatgccmcaacttcgttacggtgaaggggcttgtgtaagccaatgaagctgtgagccatgctgttcggggccacccaagatggatggctggttcatagtgaagagttctgacaaaacacggtccactggaggaggaaatggcaacccactccaatattcctgcccggaaaatgccatggacagtattgcagctttactcacacataactgcgtgttctttgacttttggtactttttatacccccaaagctcaagaaatgtcttgattcccctgaattacaagatgatttatctgacctccatattg

SEQ ID NO: 3707 - DNA, 598 bp, Bovine  MMBT21348
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggactgcttgcccgtcgtcccaagggcagttgactccggggcaccaccaggaaggagccccttccagtggcttgttctacaagggagtccacggaaatgtctgcacctctctcacacaacaacaacaaagcctatccagtaaattagtctctagcactcgggacacaggcaaagcattttgtgaaygataycactatgtaaatgtgattggtgtttgttacgtcaggagatgaaggatgacctggattattataccaayacttaccacatcttcaccaaagctcctgacaagttagaggaagtcctagcgtgcccgcaggtcatcaactgggaacaagccttccagattcaaggtgaccggtctaaattaaagccaaagatgtcccgtttaatttacagtagatatgaaagggggggaggaatgatgcttgcttttctcctctctacaggatgtcaagagagcttgggcgaggcaatacaaaaa

SEQ ID NO: 3708 - DNA, 600 bp, Bovine  MMBT21560
ttaatccatgatgggaaagaactgacctaaaaatgagactcagattctctctctgctgtttttcagagaagaatctcaattattactctgcatacacaattctatcacagattttattgttactatcattttcagcatccaaatcttaagtcttcttagattcagtgattgctactgtaaaaaaggtaaacaccagacagactatacacattacctttatcatgcatatttaaagcttttaagaggtcttcccggattggatacttggctttataacacagcctttgaatgttggaagcygtgtcatcacctgaaagtgtagtaagatctatacaggtaacagccttcaggagccatgcagcctggtttgaagaaaagtaaaaacaaggcttaaaaaaaaataattaatctccaatacagttagttagtagaaaaccattaggtacataagggtgctaaaatctcatgtctagggacttccctggtagtctggtggttaaaacttcaccttctaagggaagaaggggttctagttcaatccctggttggagagctaagatcccatatgccttggggtcaaaaaaccaaaacattaaaaaa

SEQ ID NO: 3709 - DNA, 601 bp, Bovine  MMBT03892
  misc_feature (1)..(1): n is any nucleotide
natacagattttcaaaactattgatccactgttgctttcatgttaaagagagaattgaaacctcagggctaaaacaaaatgactccagggctgaggaggccagctggccgattggggtggttgatttcagatgggtttcagagcgttgcctctgtggatgatcagttgcatgcttgcacctgggcatccctgccttggggctgaaggatgtgtgggtcctcaggtcagcctggctggagggtgacttagttatccttgcagaagtgctcccagcatccccacaggtctgtgcctttgcccrctggtcagactgaaggcatcctcttgtccctccaaagccagatgagagaggagaactcagggtgatccatatgtgaatctcatagctatgttgtgacttaaacaagtcacaacgtgtatgattaattttacttgtatgtaaaattattttactcctctgatgcaatgacttgctctgagcaccaacgaggggatcccagctttgacagcagaggctatgtggtttcacgaacctccactcccatcagtagagatcaaaatatttgtgtgaattttctgcacttgtccagtgtatgtgtta

SEQ ID NO: 3710 - DNA, 475 bp, Bovine  MMBT03909
ttcttacaacagttgcatagccatttagagacatgcacggagctgcaaaaaactggagtttgctgatgcgagcattcaacctgtggttgattaggtggttcttgtcttcttgttttctgctctcataaacaaatgtcctcttkgcactctacttaatgccacattttttgcatttcggtgctttttgttggtgataatattgtttaaaatggcccccaaacatagtgctgaagttttgtctataatgttctgaaatgcaaaaargctgtgatgtgcattatggagaaaatatacatagtrtttttgctcaggcatgaattacagtgcttttggcagtgaacttagtgttaatgaattatcaatatatatcaaataatgtgtctttaaatagaaacacacagaaaacaaggttagatattgatcagttgttgaaaatgttgtgatcagaggcttataggaacttaaccctttgttt

SEQ ID NO: 3711 - DNA, 600 bp, Bovine  MMBT06656
gttccaatgcagaaaatgcttcatcaattatatgcgatttttaagaaaatgaatactaaatgatacacattaagcatggtgcacagccctccaagatattttgcatactctttctgccagaataatcaactctgatgagaactggctcttcctgttgtcattttcattctgaatagtttcttatgggaagcattctagtgcaacaacagtttataaaaagtgcttcataagctctaaaatagaatcgctgtctcaattaatgtgatatctctgccagttccaaaagattcacctgaatcrttatgttcacacaggaattgctgaggctaaatggatctgctgtattttctgtattttccaggactatataactatactcttctctctgtcccattttcagatagaatgccactgtaacaacaataatgtccttaaaattgtcaagataaaagagaagaatgaaagaattttggaaatgtgtttccccacattgaatatccaattcattaatttgggtaaactttctttttcccaataagcaacatgactcagcttaggtaggagtcgaatacacttgggtctggattctgattagttccc

SEQ ID NO: 3712 - DNA, 600 bp, Bovine  MMBT06658
aggcaaaaatgctgggagtaggttgtcattccattctccaggccatcttcccaacccagggatcgaactcaagtctcccatactgcagacagattctttaccatctgggccaccagtgaagccttaattccctgacctgggatcaaactcatgcccccagcattggaaacatggagtcttaaccactggacctccagggaaatcactgtgacatcgactgtactgaagatgaccttgaagagaatactgactttcattcactcagcatcacatatcaagcctttccatgaattcagaatrgcaggacctactgagttwgacagggcagtccctggtcttaaagaacttcccccagcagttgaaagagcttattgcagtttaacatccacacagaaaaagaagtttttgcagagtgcagtagcagcttgggacatctgagcacacagtcctgagtattcaggaaaggtttcaccaagctggtatcatgtttggtgtatggaggatatggaagaattccccaggcagggaacagagaaaagagaggaaaggagtaatcttggtgcaaagataaatatgtataagagagcccatgtacctaaa

SEQ ID NO: 3713 - DNA, 600 bp, Bovine  MMBT06674
aaaactaccaggaaacacatattgcaaagaaaattaaacaatactaaaggtgttgtagactcagattgcttcaaattatttagctaaatactcacatccatgttttctgtttgtttacttagagtttcttcttcacggattgttacagctccctaatatagtagtcttccattaaagcatatcctcagatctcacctactccaggaagcatttttgaaattgatattgctttcttgtaattctccccctcacctctactggctggtttttaacctgcccctccttcattcccaccttaawatgtgggctcaccagagttctgcctttgatcaggtcttcttgttttacatgttctccctggtcatgtaataacctttcacgccaactaacctctggtccgaagcggtcatcctgcatgctgccggatggcttgtggaccctctcagcgagcatgtctaatatcacacacctgacgcactccctccccaacctgttccaagttccgcatcctctcctctaccttgctaatgatgttactgtcaagtgagtcattcttctccctccctttcctttcactgagactccaaatcttaattaaat

SEQ ID NO: 3714 - DNA, 600 bp, Bovine  MMBT06682
actgacattgctgttgttgctgcttagtctctaagtcatgtctgattctttgccacctcatgaactatagccagtcaggctcctctgtccatgggatttcctgggcaagaatactggagcaggttataatttccttctccaggggatctttctgacccagggatcaaacccaagtctcctgagttacaggcaggttctttaactctgagccaccagggaagggccatgttacaagtttccarcactaaccctaagtctcagttccagctccyacttgccttttcgagtatgtgacccaayaaatctcctcagcagtttaggtcattttgagctggggtstctattactggaaacttgaagactcctaacagatgtaagatccgtggctgtatcaaatgtatccctcagtgatccctgaaggaagacagagaggaattaggaagtcatcagcagcaccagagggagagagatgctagcacaccttcctgaaataccacagtttgtgtgcaaaaagtaaaaaataaaaccctttcttaaggaatatcatggcttgcccacattttccaaaccagaaatccataaacataatctagcaaaaaa

SEQ ID NO: 3715 - DNA, 600 bp, Bovine  MMBT06692
catataaagtgcctctaaatatatgaaaatcacaggatatgctggacattttgccattctgtatacacattatgaagtaacctaatgctattgcaatctgaaamgacataatctattcctcataattgaagataacagttttagacatgtttttaaagycttgaatagtacaatatataaaattggactgattccaaaacagtggtgacagcaaaaaatcatgtgagtgaatgaataaggacaactcttcaacaccactatgtacctctgtgtgacggtgggcattcaactgacctgcakcttttatatgagctcgggcatgttcagggtggtgtgaccctagattggccttgatgtgaccatagactggccttgagtttttagaatgggtttacctaaatgctcacatactgttctgaaaccagtgtacctttaaacgttacaaaagcctgctaacagttcttccaggttctcccaacttttgcagtttaagtgtggacctctgcctctctccacctaaaacagaaggtcacgcctagaaatgttggttcttaatatggggctgaatcataaatacttgttaactagtaattcatagtc

SEQ ID NO: 3716 - DNA, 600 bp, Bovine  MMBT07066
cagagactcaagtgaaaacaaatcaataatttctattactgtctgacaagaaattctccccagctcagagcatgcaggattcagagaagagggcctgctgatcccaaaactgtcactgttcctgagactggccagggggccacggatgggcaaagcctcagctgaggccagtggacctgcaatgcagatcagcaactgcactggggctcctcttccctgtatcatagaaaagtgcaaagccccaggcagaattagrtcaaaattagatgtgccctttctaacttcctgggcacaaatgcmttttctgcattatgttacagcacagagatatgggaagagagccggggataatcccccacaagaagcccaagtcctttcttgtttcccaatcagcccctacctgctgtgacggacaccactgtgaggggaaggctctcggagatgtgaaatccatagtcctggaggagggtgtctttgtctatttttactgtgtatttcacagggatgatggtctgggttgggaccccggggggcccatcagctgtggcaactttagccctggaagagaagcagtatgtaaaagagacagcaaggggagtc

SEQ ID NO: 3717 - DNA, 600 bp, Bovine  MMBT08717
tttggtgagtggagactataaatatacttgaaaataaaygattggttcaggcatagattacacagatcaccaaatctgggtacaaagtatttatgagtcatataggaaaattcaccacatcttaaataaccccttcagaggaatcttttggttttgagctcgctggctaggcttgaggatgggcaggagtggccccttagggtatgcaagatacaggcagagttctagaaaagatgtgctcccaccatgtatcggagactggggcaaagatttcctcatcattacaggccttcagctctyctcacagacttcctgcagagaccacaaacatacttctgacaaattctcgacagtttatttgtcagatattttattcaaattgcttccttctccttgcagagtacgcaaaagaacagcaatatcacgcccccctgtaccttctaactgctatttcaagggataatgagcaaatttagatcttcattacaatgttagtttgtacagcagcccctagttattttctctaccttgctattgtaatcaccagaacaagaagactgactctggataaaagtagttatttggggccagcgttgcaaa

SEQ ID NO: 3718 - DNA, 600 bp, Bovine  MMBT09635
ggctttgaggatgcagaattgacctcagttgctgctgttgatgggctcgcccagcctgtaatttttttaattaaagtttcttagtttttttgtgatygttcttgtgtttttttagtatttatttattccttccttttggttgcaccaggtcttagttgcaccttgagggaagtcttggttgcagcatgcaggatccggttccctgactggggactgaaccccagcctcctgcgtagggagcgcggaggtgcggaccaccagggaggtacctctgttttgtttttaactggcaggtggtgyggtgtgaaccaagccttggcttgtgtccaggggagcccscaggtcccctcatgacccagctccagctcttagtgcagtgcctagacctcacctcgtgtccctgtcctacctgaatgggacctgtgacaggcagagtcccctgraagcctccagcttcctcgcctggaggggtttctgggtgggacatggttctactctggactcccagagcttctcacttgctcacttgggacactcattcccacagtgcctgtgaaataactgtcctagggccagacttgtagagtttctccatattat

SEQ ID NO: 3719 - DNA, 600 bp, Bovine  MMBT12715
catttcttacaactaattgaattaagaaaaagctacatatgagagcagaggcttttgagaaatcagatactttattgacagccaccagaagtacttacttgtttaactttgctggttgaaaaaatgatacattccacagaaacctgagktgttgtagaagaaaacctttctctggcagagcctgcagaatgtgataaaatgctttgacrgtatgttsgagttacatgaccttcaatgaaaatagccaagtaataaattagtcttcccagctgctagtgaataatcataacagccaatagyatgtgaaaactaacaccatgacagatagtaatcatgtaatgtaacatattgatcccaagyrctgaaggatatgagtgcagaggcctgaaaggagctcagttaagaaaacatgtatttcatcaaaaatttcttgtgaaattagcactgtgttatgcaaagacattgtggaaaccgttttaagtcatgctctaatctgggaggatacaagggcattgtctggtgccgtggttttactgttactgtctttgagtagattttgaacaactatactttgctcaacatcatttatcccaaaaggag

SEQ ID NO: 3720 - DNA, 598 bp, Bovine  MMBT13078
  misc_feature (1)..(65): n is any nucleotide
nnnnnnnnnnnnnnnnnnnnnnnnnnnnnnnnnnnnnnnnnnnnnnnnnnnnnnnnnnnnnnnnnattcaaaactaccactaggaagttatataatatagatcctttcttctactaattcatagaagatttaatttggagatagttttggtaaattaaaaaaaacactgccactaaagtaatgtttatgcccagagctttctaaagagtcaatcctgtctgtgctgaattagcaacctataaaaacaatagtgagttgctggaggaactccaaatttttggaataatttatttccgaggytactcaggatttgggggattaccaaggagaatttatcaatatgtcaagcctcgatagattcttcctttttctgttaatgtactgtaagtatgctgggctcatcctgcctgtggggcatgctttgttcagactgttgttggaatcgccagcatcgctatccctctgggcctgacgtaatgcctactcaggcttgcgacccataggaccagtccagccctgccctgacttgcattttcctgtaacaccactgattttaagatcaataaactctctactctgacaagtaaaaggagcacac

SEQ ID NO: 3721 - DNA, 600 bp, Bovine  MMBT13130
acagttttacaaatggaaatgccagaagtggaagatatggtgtgtcactaaaaatggcagaccagtgagctaatgcagagagggttctgtgaataaaataaggaaataaagaccagaaaagcttgataaatttgactaaataatatattcagattataaaaaaygatacagaagataaatttggtgaaacttggatttgcttgttttcccacaatgagacagaggatataaacctttggcaagaataccacaaaagtgctgtgcagtgatacagagggaagcttttattactggtaattktaaatttgattacttgctgaagaaggtgtctgctaagtttctctactataaatcactgttttccccatttgtaagtaataagtaccytgggggagatacacaccgctgcaaatactgaacatacctctgtaatactctgagtagcttcctgcttttgatggggtatttcttctgaaggttgagaaatgccacatgaatgcctttatctataaggttactaaatgctgtttgattttcaggcagctgtagcagtgagcgccaaatgaacattctgaaattaaaacatagttttaaccaaga

SEQ ID NO: 3722 - DNA, 600 bp, Bovine  MMBT13211
ctcctagaggcagttcttgttacctttttcttgtagactcttccagaatcctaaggcatatacaagcataccctatataaaccttttattttgcttcttatatggtctttttttgggttcacccaaaaaggttaaattttaaaaagataatgcatttgacgacatgaataatttttacacaacttgatgaaatggttattttactagattcaaccagacatttaaaaagtagtagcatgttattaaatgactccccaaactaaaaatgatttaagaaacaatgtatgtatccaatattcrtaccagataaattccartgggagacttyctcttgttccttttactgttcatgggattgtgtctctcatcaagggaagtttccctcttattccagtttattatgatctttaaacattctcactgattcycatttatctcagccattccttaaaattattcctaaaaataatttttcaaagttttctagatagagatggcaaaagccatgatttttaaaattagccaacagaaatcaaagtccttactgctggccacagatggccgaacactggcaagaatgagagaagtagtgttacactg

SEQ ID NO: 3723 - DNA, 600 bp, Bovine  MMBT17517
agaagtgttttccaagactgaatgtacctcttgatcagggtaagtgatgaaacttgtacttaacagaggaaggggatggtggaatagcttgtattatgcatgctgtggctcatctcccccactgtgctaatggcttggcctctgaagttttgataatcaggaaaaggatcagggatgccagtttctaaaagtgtaaaggaggactagtcaacccaaatgcagatttgctactgttctcaccttcaaagagccttctaggtaaactggactggggagttcctaactcctccctggtaccayccacaggacttccttaatggagggggcaacatggttggctgtagcagcctgaatggacagaaagttccctgcatcttcacttcacactggctggcttcagacagatcccttgagttttggatgaagctgaaccagctggaactttccggtagagagatttggagagggaggtctcttctcataggcagatagccttgtggcgaggtagggagagggagggagtggtggtgtgctatattggctcaagggactcttaggagaaataaatcaatttcattgttcaggttactgctgaaaaag

SEQ ID NO: 3724 - DNA, 598 bp, Bovine  MMBT17767
  misc_feature (1)..(119): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattcccacaaacagtgaagctggcagataatatttaaatgcagaaagcaagaagaaaatagcagagtggacatgactcttcctctctgctattttcttcttgctttctgtatttgcattttaaatattatcagccagcttcattctctttgcgggaattttttttaagacacaggtgrtgcagtkgtaaagaatcagccwttttacaaaggaaagcaaaataatccaggcatatttcaaaagaaacagatcaraagtgtttcagttayacaaaagaaaattttaaacatgaattcacagaaccattattgaaacactccgtaaaaacttatttccctatgtacttttagtatatatggtgctgtgctgtgctgtgcttatttactccgtcgtgtccaactctttgcaaccccatggactgtaaccctccaggcgccttgctccatgaggattctccaggtgagagtactggagttc

SEQ ID NO: 3725 - DNA, 600 bp, Bovine  MMBT17888
cgtggaaggtctccccattgctggcgtgcatgcggtggacaaccactttctggtagtggtacttagagtggaacagtggtgccttcagaggccccatgggctccaccctctgcaccacctcagggtgactgtcggccacctggaaggtctctgtgggtatcggctgccggtctgggaggcactgggcgaggagaacaggtccagatcagtggggtggctgggagatggggtcgcggcctgggccatggcgggtgtcactgctcaccttgccaggccgtgggttggggaggctcgagtggwagcccttgagtgaggaagtgcagaagaccttgtcaatgtcaccgagggagtacacgcagacagccgagtagttcctggggggacatagagaccacctcagtgggaggcccaggaccgcccacctccactcactcaggccagccccgcaccagatggagtataactatagccttgcgaccaagccacctkgycttcgagctctgtgacagcagggactttcctggaggccaaygccagtgcctgagtgttagcaaataccactgaaggaaggagagaggcaggacagaaagagggagggac

SEQ ID NO: 3726 - DNA, 554 bp, Bovine  MMBT18230
cgtggaaggtctccccattgctggcgtgcatgcggtggacaaccactttctggtagtggtacttagagtggaacagtggtgccttcagaggccccatgggctccaccctctgcaccacctcagggtgactgtcggccacctggaaggtctctgtgggtatcggctgccggtctgggaggcactgggcgaggagaacaggtccagatcagtggggtggctgggagatggggtcgcggcctgggccatggcgggtgtcactgctcaccttgccaggccgtgggttggggaggctcgagtggrcttacaagagggatgctgtgtattcacacacagcagagagaaaaagctggagtcctagggaaaggatttcagctgtccatctaccataaaattacagaattaatccagttgctgagttcattataactgatggtacaaagcagcataagtaatttgagaggatagaattgctttgctggctttattttcaaattatggaaagaaaagcagcacatcagcttagtgaacaagcacacagaggtgcttctgaacca

SEQ ID NO: 3727 - DNA, 600 bp, Bovine  MMBT18323
gaatgttcaagcgcaagcccacacccgccacagcccaggaaggcgacgagaaccgcgggcgcctgggcggagaaggggaagagactcccaaaggcaaacgacccaattcgaaagcacatcccaccgggagagggaacaagtgcagtgacgacggcaccaccgatacctcagcactatcccggactcgccgccaggcagttctcctgcctctctgccgccgagactggtccctgcagttccacacaccacacaccccagaccaagagggctctgccgcccgcccgcccgtctgaccttgtrtttcccgtcctctggagctgccgaggctcttggatgaagtttccccagcgtctttgttttgctttctgtattggaagttgtgctgaaggagttaggtgttctgcctctagkaaaaatcccagtttattgaaaaaaaatctgaaatctcccagggcacttaaggcagggcaatcgggcgatcacctttcaggctacccggagggagcggcgcgcagcgccctgcgctccttctcgagccccagagctcagccgcggcttcctgtgcctgcgaacaatgctgctgcgtcacccacatgcagc

SEQ ID NO: 3728 - DNA, 600 bp, Bovine  MMBT18733
agaggaacctgatgggttacagtccatgaggtggcaaagaattggacacgactgagtgagtcatgcatgcaaagagatgctgggcatatttacagagtcagaaggaaaagaaagtcagcagcattggcttgtctttaagcttcttaaggagaaaacaatttgggggtcttttgtggagctcggaaaatcatacttctggaaggtacaaacacttgagaataagaggtgtgacaatctcataggctttttaactattcaggaaagtgcacgatatttcaaaggtgatcttcagcataaaakatttctttttgtctcctgttctcagataagtttgaaaaccagtttttggtagggggccagggaagaatttgataagcaaaaggcatcccctttgaactggagggggtgatgttcagtcactaagttgtgtctgattctttgcaaccccatggactgcagcacaccaggctcccctgtccttcactatctcctggagtttgctcaaattcctgtctgtccattgagtcagggatgctatctaaccatctcattctctacccccttctttttttaccttcagtttttcccagcatcaggtct

SEQ ID NO: 3729 - DNA, 600 bp, Bovine  MMBT18790
tggtgacaaggaggaagggtcagcctcaggcggaggccaccctgcaccccaccctgggctctgcgcttcatctccagctgccggtccctgttcctacatcccactgccactggaagcactgcctgtgcaggcaagcccctgatgcatctggtgagcaaaactcagaggacctgtaggcaggcgggagggtccacatgaaggacccttagattggctgccacaggcacagggcccattactgttgcatttacctagagctgacctgcctggagtcagtcttcttttgtgaacgtatcagaycacgcatcctgatttccagaaaacttggcgaggcgaccactaggaagacttgcctgcaagggacccacgatcacacctgtgtgtcctggactcattgagtagccctggggtttcagctgagagggagggagcactggcccagggaagcrggctctgctacttggcagagggtgtaccttttaaagccggggtgtacaggatgcccagtgggttgatgaaggaaaccccgtcctccccgtccatctcggggtcattgtttgaggctgcattgccacctgtggcaaaccagagaagagttta

SEQ ID NO: 3730 - DNA, 600 bp, Bovine  MMBT19397
aagtggttctccatgagccagatctgggccactgctggcyaacctttgaaggagaccaccagaacaatatcatacaacatgyractgctccccacaccagaatgatggagatgatrgtcccrttcttttccactttttccacctttggcttcyctctctgggrtttcttctgtatctctgagaggacaatactgatggagtcatagaaccagtccgccactttggttggagagaaaaagtagttggtggaaccgttgatgtgatctacgatggtgcagcggtctttccatttactgatcrtcccctcgtcgaagagctgaaggctcagccaagacataaggctgagtggcgcatatccagtgtcacaggctgattayggtcatgcagcttaagtgctgrcaccaggagagtgaagtccatatcatagtcggtcccttgggcatagacattaagctcatctaagtacaggtctaccacgccttctcggactcctccagaaagcagcaggtactcattggccactggcagtttggggtccagcttttgcaccattcccggcacggaaaagatgaaatccttagctgtgtgaatctccagtgc

SEQ ID NO: 3731 - DNA, 600 bp, Bovine  MMBT19612
taaagccaggctagggaacagtccagaagccagcaagccagtgctcaccctttggggtaagacacactggatgtaatgaaggagggcctcctgatgtacaaacggccaactcctccccgcctgcagtgatcgaacrcgccagtttctggctttagaggaaaatcatatcacaaacacccacaagagatctcagcttggggttcctcttggcctctggcatccatctcctgggtcccagacaggaggccttctccagcaccaaacaaggggcctctgtactatttttaaaagctctccagkaaatacccttgtgcctacacttcctcaccacccactcaccttcaccagcttctgatctgccttccgccccacctctctctccacccgctggagcctcaggaaggacccgggaccacctcctcagcagccccagcccagtcctcatccttgaccagttcagtatttgtcaggaaatctcctggcttctgggacaggaaactcaggatttcctatcctttttttttttttttttaaatttggccgcaaggggtgttagttgcggcgtgagagatcttttttagctgtggcatgtgagctcta

SEQ ID NO: 3732 - DNA, 600 bp, Bovine  MMBT19613
tcctccaggaaacaggtttccctctgacctcccgaggattgatgaagggactcggaggcatgctgacctaaacggagtgccaggaagcggtcctccggataaggctgcaggaggggcagtcagggaccaggaggagagagggcgggagggggtggcaggagccccccgacacagtggaagctgcccaggaatcaaagccctgactccactctcctcctactgtgcccacactggacaaacccagagggagggcaagggcaggccgcctggagggtgcagagtgatccggagggcaaaagragagaagccacaattcgtatcatcatatatgctgtaagtacactttcaaaataagaatgcctagtattcctctataggaaagtatcataaattatttatcacagtccctgtggattctttctgaattttttttttttactattacaactagaaccacagtaaccattcttatacatacatttctggctgcatctctgagtattttctcaggataaactcccaggggtggaattactgagtcaggggaatctatatgtttaaggctttttatatatattgccaaatagccctcccaaaggc

SEQ ID NO: 3733 - DNA, 601 bp, Bovine  MMBT20519
  misc_feature (1)..(1): n is any nucleotide
ncattttttctaccatctgaagatttttttttgcaaattgaatgtttgtggcaatcctgccttgagcaactcttaayggcacccttctttcgacagcatttgctcacttcgtgtctcagcatcacattgtttctcatgatacttcacacttccattattatatttgttctggtgagctgtcatcagtgatctttgttactacagatcagtcaaggcttaaatgatggttggcatttttagcaaaaaaaaacatttttcattaaggcaacttgttttttaaacctaaagctcttgcacgctyaatagaygacagtatagtgtaaacataccttttatatgcaccaggaaaccaaaacatttgtatgactcaatatgttgtagtgtcagctttactgcgaggggggtctggcactgaacctgtgtatctccagggtctgcctgcgctgccctggtggtgctgatttccttattcaattcaggtgaagaaagaagttggtgatgcttccatcctgatcaacaatgccggaatcgtaacaggcagaaagttcatggactgcccggatgagcttatagaaaagtctcttgacgtgaatttcaaatc

SEQ ID NO: 3734 - DNA, 598 bp, Bovine  MMBT20524
  misc_feature (1)..(50): n is any nucleotide
nnnnnnnnnnnnnnnnnnnnnnnnnnnnnnnnnnnnnnnnnnnnnnnnnnactgaattgctccttttatcacttacaattgaccattaaaatgaaatttatctcagagagacactggaaaaaagaaaccacagaagaaacctattgtctatctcaaaaaatatctcagcagcccatttccagtcattgcaggaagaaccactcaatattcaacttctcatttctcaatgccagcttttttcaaatgttatgataaacactctaaagtgacctatttcccctgatacctgagaaaagtgaygtgtcattccaaaatctatttctccyacgtgcacgggaagcgatgatacttctacagtcaccctgctctgacaggtgggaaartctcttctaagtaaaaatctcaagaaaagagttactctgaaaaagatcacatcttctcttcaagttcggcaatytggaacagtgttcgtcttcgcctctttaacctgaaccagaatgttagactgggagcacccaggacagaccctcgaggggaactaggcagtgaagtgatggaaggattatagggattgtcaaagaacaggattatctcagag

SEQ ID NO: 3735 - DNA, 600 bp, Bovine  MMBT20526
cattaaaatgaaatttatctcagagagacactggaaaaaagaaaccacagaagaaacctattgtctatctcaaaaaatatctcagcagcccatttccagtcattgcaggaagaaccactcaatattcaacttctcatttctcaatgccagcttttttcaaatgttatgataaacactctaaagtgacctatttcccctgatacctgagaaaagtgaygtgtcattccaaaatctatttctccyacgtgcacgggaagcgatgatacttctacagtcaccctgctctgacaggtgggaaartctcttctaagtaaaaatctcaagaaaagagttactctgaaaaagatcacatcttctcttcaagttcggcaatytggaacagtgttcgtcttcgcctctttaacctgaaccagaatgttagactgggagcacccaggacagaccctcgaggggaactaggcagtgaagtgatggaaggattatagggattgtcaaagaacaggattatctcagagggacgtggcctgagacccccagaggggcaggaacacagggtgcagatcaggttttagactctaggggggtcggcgtttgaatcct

SEQ ID NO: 3736 - DNA, 600 bp, Bovine  MMBT20566
aaatagagaatggactaacaacaaagtcaatatatgcaaaagctggctctttgagaatagccaaagtggtaaactgctagtcagactggttaaaaaatagataacacactgaccaacatcagaaatgagagagggaacattactgtagattctcaacatttttttaaaaggcaatattatgaacagctacatgctgtttaacaattttacatgtcatggataaattctttgaaagacacatattaccaaaattgactcaaaaacaaacgtgaaacctgaatagcactagagttgaccctrgaacaatgtgagggttaatcggcatataacttacagttggccctcggtatccatgatccctccacatcttcagattcagccgaggaccatgtagtgctatagcatctaccattgaaaaagatctgcatttaagtgaacttgtacagctcaaacctgtgttgttcaagggtgaaccgtatacaaatcttataaattgaatctgtaattaaaaaaacacttccataaagaaaactccaggtccatttggctttaccagtagacctaccttttaaggaaaaaaataccacaaaacaaattcag

SEQ ID NO: 3737 - DNA, 600 bp, Bovine  MMBT22092
cctgaggcctgttctatcaggcaatgaaggactctaaaggtccacaaccaccttccactttcaacacagcaggatttgctgtgttgaaaagtagaaaatttctgttacaagtctctttaaaaggagtcattatattgcagagactrtaaaaatggttcccaaactttagcatgcatcatcacctactgactcagcgggtccaggtgggacctgatcatatttgcatttttatcyagttcccaggtgatgctgatgctgctggtcaggggactacacttttgacatccattagtctagatyaggcttagcaaacatttcctatcaaagaccagacaaayattttaggctttgtgatgccatgcagtctctaagtgcaaaagctgccataagcaatatgtaactgaatcagtgtggccatgttctgataaatcattatttatggacactgaaatatgaatttcatgtaattttcaaacgaatattattctcatttttttcaactacttaaaaatgtgaaaccattcttactttgtgagccatataaaaataggccgtgggctgaatttggctcatgagccatagtttgccaacctctgctct

SEQ ID NO: 3738 - DNA, 601 bp, Bovine  MMBT04602
  misc_feature (1)..(1): n is any nucleotide
nagaacttcactcgcagaacctccactcatgacgacrgatgattcaaggtcagtctcggcagaaagtgaaatgtatctgaacttcctttccttcacagtgggcagcgctgctttgggttctggcacttaaagaagggtgaggctcctgacctcattttctcagtgactaaagaagcacaccacacacactggaaagcaggattagccgggggagaacttggcagaaattaagcacccccacatgaggttccccctgcacaagaatccttcgaaaygaaaggctttagtcccatcaggtgasgtgtgaacatccccaaagacagctccgtaacacattctggagcatctgaggttgtggagatgacgcgtattgtaagcagaagcatcstgttcrtaactacacacacgaacccatacccttgagtgtgggtacagacctttccttactgcagtaacattcagagatcccaatttaaatcaattccccaaggctgtggaagtatcccatttgggaagcaattccgtcaacagaatgactcatttaataaatattttagcttgcatctcatkctctaytatagtagacagtaaaagaccggct

SEQ ID NO: 3739 - DNA, 600 bp, Bovine  MMBT06549
ggagttggacatcctgcttcaggacaccaccaaagaaccttcggatctgccctacaacccccaggagacgttttatatcaacagtgtgcctaacactaggatctcagatgccgaacttgaagctgaacttgagaaactgtccttatcagagggaggtagggagctgtgttccaagggtggctggtgggcttgtgaccctctggctcatggttaatgggtcccaacacgcttgctccatctgccagggtaccaaatgggggaagggagtcctgggctccttatttatattaagactcagtyccttaaacactgggttgctttcatctgagagatctgccatagagttcagccatttcttctccctgcaggtttggtcccaagcaggaaatctccaaaaagacaattggaaccaactctctaaagccattgtaggaccctcaagtgaaggaccctcacatcagagagagaccaggcttgcgtgtatgtgtgtgtgtgtacatagttatttaaacgagaaacttggaatgtgttgggaagaggaggaaggacaagcactgctgcgtctggatgccgccacttaccacgggcactgagagtttc

SEQ ID NO: 3740 - DNA, 600 bp, Bovine  MMBT06660
ggtaagagttttggagctgttctagagaaaatagccactaagaaactttgtgatagggacttcccctggcagtccagtggttaggactcccccatctctactgcaggaggcatgggattggattctggttggggaactaagatcccacatgccatgcagccaaaaaaagaagatataaactctgcaataaacagaattacataccaagaaaagactggaatctctaacttggctgaagagatatttgaaacaagggtaatatgtcagctaaaataaaacctcaagtcaagaaacattctrtattcctgtagtttttataaagtataacatcaatgtagataaccagagaaaacaatttttatctgtataatttctcagctgccttgtcaccactagctgggtcatggccatggtgacaaataacagcccttaaactgacaatctgtaatacagagagttcacatatggagaactgggaattcatttcaggtaatttaatttcccctctctatccagcagggaaaatatctcagatattttccagagtaaatgatcacattcccctgaagatgattctagaggtacagtattttaatgcta

SEQ ID NO: 3741 - DNA, 600 bp, Bovine  MMBT06672
cactgattcaatggacatgagtttgaacaaattccgggagttggtgaggacagggaagcctggcatgctgcagtccatgggattacaaagagtcagacacaacttagtgactcaccaacaattcagtgttttatctattgcaaggattacatcatagaaagtttgtcttcccccaaacattagtgcactctttgttttttactttaaaaagttattttgtatcaaattggaaagtagactaaagaaaaaatgcccataaatcaattcttattatttacactcttctagaatgttttaatmaaagcctctaacctgaaaattattttgctgaggctctttgtctgaaccagtaactgtgatgtcagaatttggtgcaagctgttgaaacctgtttccagtttaaagtcaagtgcattgagaatataatctaaagaaaattaactctgaaatttataacttttacaaagtaaaaaccgcacaaaaattaaaatctattttggtgtatataaaatagaacaaacttcctgcagttcacacttcaaggacaaatggtgggaaaacatacagccaggtccaaggttgcaggtacattctccagcc

SEQ ID NO: 3742 - DNA, 600 bp, Bovine  MMBT06977
atctccatgacttatattatagctcaaagtttgtgcctcttaatcccagcctagtttgtcagtcctccagaaatggtgcagstactgtggaaaacagtayggtgtttcctgaaaaaattaaaaatagattttccaactctgtagcccgccaggctcctctgtccaaggattttccagggaagaatwctggagtggtttgcyttgccctcctgcagggaatcttcccaacctagggatcaaacctgcatctcaggtctcatgcattggcagatgggttctttaccagcggtcccacctggmaagcaccactgttaccatatgatctaccaattccacttctggatatttacttgaagaaaattaaaatgcttaattcaaacaaacatgtggttaccaaaggggaaagtggaatagagtgatacattgagtgtttggaattaacacatattactgtatataaaatagataaccagaaagaacctactgtataacacagggaactagattcaatattttataaaaacctataggggaaagaaatctgaaaaagaatggatttatagcctgtatatatatagctgaatcactatgctgtaaacc

SEQ ID NO: 3743 - DNA, 600 bp, Bovine  MMBT08313
cctcacctgcacacgcccatgtacttcttccttggtcatttgtctttcctagacatatgccactcttcaatcaccatacccaagatgctgcagaatttcctgtctcagaggaaaaccatttcagtgtggggatgcattacccagagtttctttttcattttctctggaggcacagagagctgcctgctctctgctatggcctacgaccgctatgctgccatctgtcaccctctgctctacactatgatcatgaatggacctctgtgcactgcaatggtcagtgcagcatgggtgatgggrtttctgaactcactagtgaataatctttgtacccagaacttacagttctgtggtcccaatatcatctcccacttcagttgtgaactgccttcactcttccctctgtcctgcagtgacaccatgcctaacaccatcctgctggctgggtccactgcatttctaggacttgtgacacttcctccratcctcttctcttactcaaaaattattcttgccattttaagtatctcctcctctaaaggccaaggcaaagccttctccacctgctcctcccacctcaccgtggtgctctcgttctat

SEQ ID NO: 3744 - DNA, 600 bp, Bovine  MMBT09272
ggggccacggtcttggagaacctgaagttrgagttgacccgtgaacacatccctgtggtgtagtaggaactcccacactcgtgcgaccagagggggctgcaggcctgtggagcacagaacggacccccagtcagtggaggccgcagggtccgagcccaacagcctttggcccagccccaccctccaagacacaagacagaatcctccatctgagtgctggtatcctaaatttctcttgtggtaacatgtaccagtttccttggtttcaggcggaagggagactaactaaccttggagtcygctgttgtattttcaaggatccccttctccaccccatcatccggggtgtgactctctttcccctgcttgtccacccctcccaccacacaggaggcaggaaaaccttgtcatccatgggagggaacctttcaaaagtcttcctgaagaggtcacctgaaggtcattactgggcaaacttccaggacagggtcccaacaacatgcccatggctccttgctagggaaaggaaaaagtgtgtttctgctttttctctgaaatttgttaccaaaacatggatgtcagcccctcgtttaaagactg

SEQ ID NO: 3745 - DNA, 600 bp, Bovine  MMBT11019
tcttgaaaccaggatacggacaaaaagggagcctgcaatgctttgaccatttggggttgttttgttttggccgcaccatgcagcttgagggatcagtccccccaccagggactgaacccaagcccacagcagggaaaggccaggtcctaatcagtggaccactagggatttcccaagtggtttttaaactgtgttccctggagttctgagggtgctctccctcctttaacacacccttttagctcacataggagttctgctatagtatcttattgaaatgaatttgaaagcctctggttyggtctgcgtggatgcagcgggattctgggcagcaaaataattagagtcctggtgcccacattcctgtctcagaccgtgcataagtcaccttcctctgcacctttctctgcttacctgtaggatggattgcaggaagactaggtaaggtaatctctttaaagtccctggcaaaggttaaccaccccaaaggtgatgatgatggcccagagagggacagcgactttcacagagatgctcagcttcctctctctccttttcagtcattcatgccttcattgattcaccaggtgcccactccat

SEQ ID NO: 3746 - DNA, 600 bp, Bovine  MMBT13229
ggtgaggaagaaccttcgctgaatgtaygctgacwtgagtcttggggcttttcctctggaccacactgctcctgtgttagccagactctggtattggaaacttcagtatcattattttaaaagctgtactttttaaatgaaatgcttattcagccgtagtaaaacaccaagcgcttctttaccataagataacttcttgtaaataacagcactacactcatctctcctataattacttccttagggcaaagtcctcaaagtagaagactaggggcaaacggaagttaggaccattttcakggacttttggaacaagctgccagattgccctgcaaaattaaacgctaytggagaatccctatagctttaccagcatagagttttatccttttacatttatttctgctaattttataggaataaatagagtgctttcatttactatatggtatgtgttttcagacacacacacacwcaagtcctggaatcaagatccctgggcttggttgcttgtctgctgtgtgatctttgacaagtcacatcccctccagggacagaggatatctatctgtaaaatgatggggttgaatgagatgattt

SEQ ID NO: 3747 - DNA, 600 bp, Bovine  MMBT14697
tgagaaaaggtgggcaaatgarcgctgttaggtattagatggtaaacagatcaggaatggaggtggaaggtctagctcttgtgtgaagttgggtggtgaatattagaagggaaatataggaggaagaggagggctggtggcaggctttttgttttatttttcagagctrgatcactctgtgcagcaggtgggagggcaaactcaaagagtccatgtgcttgttttaaaaataattcacctcctctgaatgcagacggagatttttgaagatatgcagataggatgtgaaggacgctggayggggatgygccacaggatggatggggccatcagcaaggatttgaaacactgaaagagggcttccctggtggctcagtctaaagaatccaccagccagtgcaggagacttgagttcaatcccaggtctgggaagattccacgtgcctcggaacractaagtttctgtgccacaactcctgagcctgcaccctagagctcagaagctgcaactactgaagcccgaatgctctgagagcctgtgttctgcaacaggagaagccactgccatgagaagcctgaacaccacagcttaagagtagc

SEQ ID NO: 3748 - DNA, 600 bp, Bovine  MMBT18286
gcatggcacagtggtaaagaatctgcctgccagtgcaggagatgcaggtttgatccctgggtcaggaagatcccctggaagagagcatggcaacccactccagtatctacccagggaagacagcccctcctccccgctcccatgcaggttcaatgttacagtcctcagtcattactgatcttttgtttaaaaactcagggctttctctgaacactgacagttattagttgaccttgggaaagttgtttgaccttgacactcattcctttcattgtaaagtggggaagttcatagtttcaycacagtatcactgtgaggactgataaagcaaccagcacagagacgaccgcacacacgctcagtaactaggagtttgcaccccagtctgcccctccctatgtcctggggctctctctgacccccattcattctacactgacccccactcattcttcccatctctgtcattatcatttccaatttctgtgcccaaagataactgaccatatgacctttctgactaggagaatacatacacataaaaagcagtagtaacaaggcttttcatgtattaactcatttgattctcctgacagttct

SEQ ID NO: 3749 - DNA, 598 bp, Bovine  MMBT20525
  misc_feature (1)..(24): n is any nucleotide
nnnnnnnnnnnnnnnnnnnnnnnnactgaattgctccttttatcacttacaattgaccattaaaatgaaatttatctcagagagacactggaaaaaagaaaccacagaagaaacctattgtctatctcaaaaaatatctcagcagcccatttccagtcattgcaggaagaaccactcaatattcaacttctcatttctcaatgccagcttttttcaaatgttatgataaacactctaaagtgacctatttcccctgatacctgagaaaagtgaygtgtcattccaaaatctatttctccyacgtgcacgggaagcgatgatacttctacagtcaccctgctctgacaggtgggaaartctcttctaagtaaaaatctcaagaaaagagttactctgaaaaagatcacatcttctcttcaagttcggcaatytggaacagtgttcgtcttcgcctctttaacctgaaccagaatgttagactgggagcacccaggacagaccctcgaggggaactaggcagtgaagtgatggaaggattatagggattgtcaaagaacaggattatctcagagggacgtggcctgagacccccagaggg

SEQ ID NO: 3750 - DNA, 600 bp, Bovine  MMBT20562
tttaatcatcaagtgcatggacttcctaagtgtagccaagactcttcttatcagcaaggtcagcttccggtgtgaggaaattgaagtgcaagtgcaggaaatgacctgcaacagatctggcatcgggaaggccctgctgatgactgtgtttgcatygagctccgtgggacccgaatcactacaaaagtgaggaagggcgtggcatgggtgctgtagggctatatattgcaaagcaatgtgcgttcctctctgtgtattaggtttcagtggccttaagaggctgaaagtgtattgaggagmgcataaatakatagtaagcaaatagaatagactaggtcctctaggtccatttgtgaatctttatggtaagcacctcaggggctccaggcttkcttgcaatcaaagtcaagaaatatttcacattcagaaatactttttaaactaaaggttttgattgtccccacataaaattttaatagcatattagacctaaaatttaaactccaagatgaagtattgggttggccaaaaagttcattcaagattttctatgagacagaaaaaccagaactaccttttttttttttttgctaacctaat

SEQ ID NO: 3751 - DNA, 600 bp, Bovine  MMBT21426
ggtcctatcagtactgagatgccacagctcctggaattgactgcaatgctccagggctgtcttctgtatgccctgacatcccactrctgtcatgggatgccttttctggcaccycatggcacttctgaccagttcgcacaatatctggggtgcctccagagctgctctcaatggcttcaaaatgtttgccagtaagcattagatttttyccccatttcttactgcaaatgtgttagacaagccgcaaggttaaaagtaaactggattcatgatgacatagaatgttaacaagctcctgakctgtctcaccacacatccctccaacccacactcagcaaccaaactctaaatcaacytgccagaagaaagaaatgttaaaggaagtctttgtcagcccctataactatcatgtgaataaagttaagtcaaccaaaaataagacttttagaatttattttagcttctatttgtgatactgcatttaatccttgactgagactgaagtgacaaatgttataatatttctagcatttgagataagccaagatcttccaactgctgaggatttgaaaccaagtcaattaagagtgtcatatttca

SEQ ID NO: 3752 - DNA, 600 bp, Bovine  MMBT22415
atgtgatacaaagttctaaacatcaacaaaagcaaattcactgtgcatttaaatcctccatatactcttcattttctttttgatctatgtcatctgtccatttctagaggaactgtattaaaaactcttcccaggaccatagtttgtcaaattatccttatactctatttctgcctactattttcatgctgttattggggtttatctgctcaaaaaggagaccgggcccagggaggatgggatctggccagggcagggaagggtactsattgggctcagggagaccctcaggtctgagcmgggctgagactcaccactgtgcagtaaagtccacaaactcaggggagaaacggtcagctgggagctggggggacggctcctctaccacctgcttcagctgctggaagggggtcccccaggactcgtaaggaaatcgcagaatggccatctcgatctgcagtggagatagcactgctgggtcagagacacccacgctcccacacggaagcaaagcctccaaagatcctgcctgtcctagtccagcagccagagctggactgtgaggcagggtaaggggctgacaggtgacatcagtccaaa

SEQ ID NO: 3753 - DNA, 600 bp, Bovine  MMBT04561
tgtttatggagtttcttgtcccacagtcacacgcgcaggatggagcccggcctctgagtgtgagccccagtgagaggcagcagggggcgcttctccctgtatgcgcgtcagagtgctgctgtctttctgcccacaggccttgcagttggcttttttgggcctccttcggctgcaaaaggccttcatggttctaggcttttaactgatgttttgcacacgcagtgccttgaaacttataaaaatgttactaattacttggaaaaaaataacttcactttgaactgagactaagatttgctygtaaaaagtctgtatttctaatttattatactgattgtcacaaatgggcattttttacactgcttaaattatgatggagacaaaccatttaaactgaaaaagaagataaaaacaggttcatattaataagtaaaagccttccctaggttttatttcttaaaagtcctctctatctagtaggagagtatttgtaagtgaaacttttggaggtggtacatatatggatgaagcacaagctggaatcaagattgccgggagaaataccaataacctcagatatgcagatgacagcacccttat

SEQ ID NO: 3754 - DNA, 600 bp, Bovine  MMBT10964
aaccaaccacgcagctggcttatcacagtcttcagctgaggaagggagtttggaagcattttctaggtgagaagaaatcagtagagagtctagagaggagaagggaggcaggcagccctccaggcaaggggccctggggttttgtgactcccaaatctcaatgaggtcacacatgcatcttctaggagtagactgggctttgtctagtatttcaggcagggttctttgaaggagataaatcaggcaggtggaaagtgggggatggaaaggcctcacaggagggaggccatgctgtcagcygggtgagagagactgagccttacacacagacggacgggaggggatggctcctctcaggccccacctctctctggaggcatgatgctgtgggctcttcaaggagccaaggcaccgtctgagcaggctagtcccctcctcccaactctggtattttctcccaccttcctggctcagtttcctcatctgcccaggtgtccaaaccaagtgtctgtgtttctcagtgaagtgtgggaacacaaggaaggccctggcctcaggataaccctcttgcccccaaatatgttgaaatgagaggaaagc

SEQ ID NO: 3755 - DNA, 600 bp, Bovine  MMBT23093
taatacgaggttcatacactcatcaaaaccaatgatagagccctctgtccgcatattcacttgttcataaagccacacccgaatccgtgatctattttgcaagtrtctgaagatgagattgatgggctgcaccatcaccttctgcaccttctggccctggccccggtacgccatgctggacgctcacaagcaccacagtgctccacactcaactttctagattttaattcgtcttgatttactatggctttctttccaaggtctcttttctttttctttttggctaccctggctcttctrcgggtcatgtgggaactcagktcctcgagcagcgatagaacccgcggcctagcttacattgggagcgcagggtcttcaccactgtactgccagagaagtccctgcagtcactcttttctatttccctcagactctctcggtatttttatgtggctttgctggacagggagccaagatatccgcgacacaatttggctgctcttccgtcagctgctcgccagaaggcttccacgtaggcctcctcggcttgatgggacgctccaggagagagagtgggaggatttctcccagtccagatcg

SEQ ID NO: 3756 - DNA, 600 bp, Bovine  MMBT14336
ggtgactcttgcttatatcacttgaacagtttctctaaatgtgacctttgatttcagcagtggttggaatattataagaaaaatccatcacacaagaaacaatatctcaaacatgctgttaacattttattcaccaacggtacaatgtctagaatgctacctaaagcatgcaacaatgtcgaacaattttgtgttgcartgttgctgatttccctttccaggtttctgagcagctgacagaagagggatagggtttacactttaaaaccccttggtaattggaaatgagcgctttgttgytsttgtcattggaacaagcagttttggagtcatttggggtgccacatcaatgtatttgacaacaaattgctggaaggamattcccagccgtgttactcctgaacttctcttttgttgccctaggctgtcgtcaaactttctcagcactcgacgggtagaaacttccccagtattgacatttgtgatgtcatcatttatttatatgaaacaagaaccagtttcttactttaagactgctcaggtaaaatgagcaagtcaaatgttagactgttaccttaaatgatggggaatgacactgga

SEQ ID NO: 3757 - DNA, 600 bp, Bovine  MMBT03197
ttaacattcagagatggagtgtttgtgctccttaaaaaaggctttcctgaatgggaaaagagaaacacattactttttgatttgtggtggtacagaataatgattttgtgagtttgaagatacttctgttttcaaatttaaagctgaaagagcattcttattcattgaatggtttctgttggtactggtagaattgrcctttgagagaggaaggagaaactagcttctggtcaggggacaagctcctgagcttgcttagttctaccaggaaggagtaaatgcagtggttctggccctatsgcccatgtgtacccttggttagyactctgtagagcagaacccacaaactgggagtgtatgacatacacattgattcgcacrtgtaactckgtcaattacaacaccactaaaggcagcctgatagaacattatgccatagattactctaatcggcacaacatattggtttttgagcattctcagtttgtttatcagaacaaagttgattcttttttaatgactttgccaatttatcgttgtgttccatggcttttgcaatattttcttctacatggttttaccttgtgtgggaaaggccct

SEQ ID NO: 3758 - DNA, 598 bp, Bovine  MMBT00013
  misc_feature (1)..(53): n is any nucleotide
nnnnnnnnnnnnnnnnnnnnnnnnnnnnnnnnnnnnnnnnnnnnnnnnnnnnncctcctcctcctccccctcctaagatccttctatggtcatcctggctcctttaacattggttctgatccagccgtggaactggagattccttcatagratccaccactggagatatgaatcatacccatttgacagatgtggaaactgaggctcagaaaaatgaagtcacatgcctgagaaataacctagccaggatcagaaatggtggctcagagtttgaatattatgtacatgtgcaagtgttcrcatgcatgtgcaaagccctgagcacccgtgttgacaggcacacgtatggtagcccccacactctgctgggctttgcctgccccayctcaccctctctagggtgggcgggggacttgggttaggcacctgaggccggctgtgtttggtgccagcagctggggcaggcgctgggtgagcaaaggctgcagagcctcccgcaggcgggaatagttgcgctccaattcccgatggtactccttctggtccggcccaatcagggctttgttcttcctcagcgcatcctcacacctgaggatca

SEQ ID NO: 3759 - DNA, 598 bp, Bovine  MMBT10675
  misc_feature (1)..(7): n is any nucleotide
nnnnnnntttttctacatatgatttataattacagaagttccttcctctctaccaacaagatattttaaacgtacctttatccaagtttaaaaatatgttgggtgactcttgcttatatcacttgaacagtttctctaaatgtgacctttgatttcagcagtggttggaatattataagaaaaatccatcacacaagaaacaatatctcaaacatgctgttaacattttattcaccaacggtacaatgtctagaatgctacctaaagcatgcaacaatgtcgaacaattttgtgttgcartgttgctgatttccctttccaggtttctgagcagctgacagaagagggatagggtttacactttaaaaccccttggtaattggaaatgagcgctttgttgytsttgtcattggaacaagcagttttggagtcatttggggtgccacatcaatgtatttgacaacaaattgctggaaggamattcccagccgtgttactcctgaacttctcttttgttgccctaggctgtcgtcaaactttctcagcactcgacgggtagaaacttccccagtattgacatttgtgatgtcatcattta

SEQ ID NO: 3760 - DNA, 600 bp, Bovine  MMBT05333
aaatcaggatgtatgagatgaactcagaaggaacatgataactatctcaattactggaggagttataaagtagaaggaaggaatgaagaaaggtattacatgagggaatactggtatgtcaggcacttccaaagggcatccatatttaattttctttaatgtgaaaatgttgcctgattttataaccccagaaagtaaaagagggacaaacagaaaagacatgagacagaaggggaagtacggatagaaggaggtcggtatggaagtgcagtagaggagaaagggaaccaaagacagaaytggtgacctccraagacaacagactggcagaccctggcaatgctctagtcctgactggatgactacttgccttggagcctgtctgaaagaatggggtacgagtttcacactcttcccaactgcaaaatcttrgtctatgaagtgaggaggtttacagggtgggtgagaaccactggcgccatctgtggtggaaatcggggcagtgggggctgtgtcgggtctctttaaccaaagacacctgcagcacctacacttacactgtgtctgccacgactcccctcctaagtgccagcctcggga

SEQ ID NO: 3761 - DNA, 600 bp, Bovine  MMBT08255
gggggatggtcctcattgtggcaagttccgaggtatttccaagtgtaattccatccttcctactgacttagaatctgaacccagtttaaacgtaactctccttatcaatttcaagtaaaagaccaattgcacattgtatactatgcacatataggtgagagtaagtaatttttctacttgctttcatttctctaaaaaaattgggggcgtaatattgcaaatttttataatctcttcaaaaatcgacatgagttaggaactgagagcaggaatacctgctgttcactaacttaacttacrtaacaaatactcattttatgcccactgtgtactagtactctcctaggtactgtggatacaaagacaaaaagatatattcctcattgtaaaaatgcttataagttagaaacataaattatcactgtactagaagcagtgacggaagaatggtcacaaaatgagactgttcagctcagggaagaaaggatattaaggcaaggaggtctacaaaggaaaactagtttacctgagctaagttttgagaactaagaggagtgtttcatgtgactgaagagaatactatcatccaagcaggggagg

SEQ ID NO: 3762 - DNA, 600 bp, Bovine  MMBT11328
atattcttttaaaactagtaataattcagatagtcaaagatatcttttactattcattgtataatatatactggaaaatataatttagttatcaaattttagagctacaaagaatcttgccatctctccaatcctttcattttataggtgaggacactgagaaacaggattctagctcaaataaagaagctgggtaggaagctagtgaacattttgtagccaaataacaggtcaggagagtggtacagggggcaccaaatgatgagtcagctaggggaggagtatattggagccacatawagaaataccttctttattgagacaggtcaaaaatcaggagaactaaagagtgaaaatgaagatttgtggctcagatgactaaatgtagaaaagtatccaaacctagagatcatatcaagacagtttctaaaaagactgaggagttcctcaaactggaaactgttcaaattgaataattttttgtttagcatccattccatacagagttgaaacaagggggaaaattgattctaatttaagacagttccaagtttggaataaaaattagctctggtcaacttgtgtctttctgtgttactg

SEQ ID NO: 3763 - DNA, 600 bp, Bovine  MMBT15296
cgaaatgaggtttgagttttcagaactgaaggtttgcagtccaggccggctcactaatgaaggacctgctcctctaacctggtgcacaacacaaaacattaatcaggacattgtttgcattaaagggctgtgttttccagagggtaatcatcagggaaatccagtcaagggcgaacaaggayggcagccctgattaattaaacatctgcactggggctaaaagcaagacttaccctgttggttgttataagagctattgctattaatgccacccgtggaattgggagatgttgtttgctraaatctactctgtacagagggctcggtgttcaaggcatatcaagttatgtcctgatgttattttggcttctccctgtggcactgggtggaagggactgtgggcagggtaayggtgtacatagcttcttttcaaggagaaagcgtttgagctagccatgaagcacaggccgtagttggaaatgtggatttgggagaagactaccctgggaagggcattccggggagggggactagtgtgarcaaaggcaggatgtctggaattgtacagagcatgtctttataactatacagtctggtctg

SEQ ID NO: 3764 - DNA, 600 bp, Bovine  MMBT06764
tcaaaaaagcttatctgcatccttgtgtttaatagttttaaagacttcttagttaatttttctaccttgccaatttaatgtctctgccttttccatgkcccctaattcagtgccacttcttcctgctgcagtgggttagttattcctagactacagatattcataaaagtatggttcagatacaaagtcattatattcttaatttaaattgttaagtatacctttatttactttttattttgaaattattagagattcttaggtggttgcagagtaaagaagtctcatgtacccttcacscagtttctaccagtggttacgtcacatataactatagtaccatttcaargccaggaatttgacattggtacagtacacatatgtagtttgtagttctgtttcactttatcttgtgtaaatttctgtggctatgatagcagtcaagatacagcactattctatcacaacaaagataccacttatactatccctgcatagtcatgttcaccttccctccatcgtccctaaccgctgtcaaccagtaatctgtttttcttttctataattttgttgttttgacaatggactcatacaatgtat

SEQ ID NO: 3765 - DNA, 600 bp, Bovine  MMBT06801
gacagtaaatattttaggcttcgtgggctatacagtctctgtcacaattactcagctctgctgtagcagcaagggagcagccgtgggtgatatgtaaatagatgtggccgtgctccaataaaattttattgataaaaacaggcagcgggccagatctgtctcacaggcttaagtctgctgacctctggattgtagcctattaaactgaggtaaatatggatgcagtccttagatatcacgatgtctaaatacataggaatagatttgcttctccctggggaaacagacaaatgcaaaacygtattaatatctatgttctcaaccatttctatctatttacttagccgaaagtgttaagacaattaggaaaatgaaagttctaccttgatcaattaaggaattaacctttttttttttttttccaaatctttcttcttttatcacacgactaacaaatgtgtactgagggttaaacaataaaactatagacaagttcacacaagaatataacaagagcttttaacattctcagcactatcttccaaactttgtttttacaaacatgagaccaaaatgtgyacagctttattttatattttc

SEQ ID NO: 3766 - DNA, 600 bp, Bovine  MMBT16844
gttcagtccctggctagggaattagatcccacatggtgcagctaaaagagctcacatgccacaactaagacctcatgcagccagataaataaatattaaatatatatatgtatggtaagaagaaagagaaatsggacaagaagaaattaatagaaaaagttcataagaacaacagtcaagataaccaaatggactaaactcaaaggttcaagggaaaaagagtcacattggatttaataagtatgtgaatcctaaaggactcagcccaattgtaatcaattcacaagggcttcccaggcracgcaaataaagaatctgcctgccgaacaggagatgcaggtttgatcctaggtctggaagatcccctagagaaggaaatgacaacccactccagtattcttgcgtggaaaatcccatggacagaagagcctggtgggctacaggccatgggggtcacaaaagagttggacaygacttggcaactaaacaacaatcgactcacaaacaatattacccgaatcactgctgttagcatcagcaaacaaaaacaagaaataacagatttagactcataaaaactgcagatgtttaactcagtgg

SEQ ID NO: 3767 - DNA, 600 bp, Bovine  MMBT04419
ttgagatgaacagaactggtgactggaccagagagacttagtatattatagtctgtacttttcagtgtgcttgagaaattgctttaaaaaaaaaatcaaaggataatgacttcagggaatcagttgggatgtacaaccggcaggcttgggggcgggggcggggttagagcaagtgcttgggatccggtgaaggagagatgagcaggcagactcaagctcctgaaggtggcaggggacgtgaaaggaggggcctaggagtaagatcaaagcactgtcagagttgagggccgggcccagggyagtccagatgttcaaggaagtgaaagcgcgggagagagcrgtgagggtgtgtgcrcagagggtgtgtgccctgtaagccccatagacgtggcagctccgggtagggacccagctgaggcaaccggctctcctttgcccggctggccgccagtcccaagagagccttgcacagccggacaatgcatcaggtagattctcagctcacccccttctgccaggctggtgagactcccgcaatcaagggctccaagtcttgcaccagcctctgcttcccttttccccctgtacatccggaactgc

SEQ ID NO: 3768 - DNA, 600 bp, Bovine  MMBT07724
gtgggcatcccagctcccctaggagcaagggatggccctggagcgagggctggaaaataacctgagttcacrgtccygggcgtgacattagtctggagaagaggtgagygtaggtttggtcagataggtcagtgcgtgagctgagcctgtttagatgcggataacacaggtggtcatttcagagtccctgccatcgggggacagagggacccagatgacatttttcctgcatggacggtaggctctgttagcaggtccaggcatgtggatttcacagtctagcttgatcaggaacacaaratcctgggcactgaacttgagtcatcagctcttcctttctttgagtcaggaagacatctaaaaaccaccttctccacttagcatcactttcggaaaccgaggacttcccaccattatgagggaggaaggaacagcgcccagaggcaaggccagtgctttacttttagtaagaacacatgtcttctttacttttctcattttgcttcaaaccaacgcaaactccgtggagcggcagctgcccagagcctgtggcttcaaggcggcaattaacccgaggcccggcaacgctcacctgttggc

SEQ ID NO: 3769 - DNA, 600 bp, Bovine  MMBT15810
accatgccgagaaaataagcatgtaacttcccgagttcacggccactgcttacaaggaacactgctcagagtgatcatccacaaacccagcttctcctgtgacactgttcgggggtaaaactgattgcttaacacacttgtctaaatctcggtaggagtaggtgccttcataatataccacatctcactaatcagagaagtatctagaggggactgttatagacaattttaatgaaaagaaaccacaatgtgggaaacctgggcttggaaaaatgtcaggtttttattcactcctgtttkaaaatgaataagaattaagggcagagtttctgattagaaacagaagactaagcttaggtcaatttcaccaacctcgtaacttgctaggagtttcagaagcagactttggacttaccttacttacatgctcaaaaggcatacrctgtcttgctaccacttctgatttctgaggttccacccatgtttgtttttaatgagcataatcacacataacttttaataactaaaataattccagcatctctctcccacctttatctacagagcaaaatatactctatggattccgaagaaagaaca

SEQ ID NO: 3770 - DNA, 600 bp, Bovine  MMBT02256
aattgccattctggaacaattactcaatcttttagacttttcctgcttgcattccatgaccctgttcattaagacatatgggtatttgattttgatctggaactttcaattatggtaataatgccagttctgtttttatatctgtaaatcatttttagttctcaactctatttggaagcatgctcctctrcctgcctgtaaacacttgaccctattcccaaatcagacccctggttatatactcactcctgttttagtccatctgccaactgtcataaaaccctgagctttatattcaarcagatctggcatagggtttcctaatgtttactaattcaagaggctttttccaagtgaagagacaacgattttgtgaaagataaaggatgggtagaaaactaggcaagtaattggcttatatatctttgtttcagtatgtgcttactgaaaaggactgcttacccatttacagaataataggccatagatttagtaacaataaattggcaagaggttggtttataaatcaggaagtctgtattgcagacattaccaggatattaatatgacatttgtgatcaaaagaaaggacaactagaa

SEQ ID NO: 3771 - DNA, 600 bp, Bovine  MMBT03012
tcttgtctgccacagacacctcccagtagtgacagccagctatgaagtactcggagcccaggacgctgacaacgaagtcaaatcgctcgggattgtcgggcacgggctgccttgtgtctccaagcttcacacacttgcggtcctcagacaggatgagtttgggatgcgctgtatctgggtccagggtcacagtcactgcagagagtcacagagagatgaggtttaggaagctaagtctccagcgacctctgagtagctgtggagggaataatcatctctaggtctgcaaccatggtgccstcatccccacatgtcctggaactaaaaaaaaatacattgtccagtcttctagatctactcgtggattaagtaaaagagggcaaagtttttcatctgtctgtgaagctgtcttaatccttaagaaatattgcctttgtctttgctggtccaaaggactctcacatatgaaaataaacaagttttgatgttagacccagtagcgtgatagcatattggagccccagctatgtcttacactagttatgtgatactgggcttgttattcatctctaaaccttcatctgtaaagtgggaataata

SEQ ID NO: 3772 - DNA, 598 bp, Bovine  MMBT04166
  misc_feature (1)..(84): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnntactcttatgtaaaaatactgtatctaatttaaattttaggaacaaaaatgtcagattataaaggagtttaaaaattcaaaattttcctttgtattgatcaacttggactggttcttgtttcttaatatgcgtttttttagagaatttacatgttgcatywttgttttcaagcactgtctccagagtaattgcctcccattggcccaatgtttaayaggattttatatcattatgatttattaataataatagaattaaccctttatgatgactatagccttgaccaagcaactccatgcccagaattcatttyaggacagcatttaagasatgtgtgcaaagatgtgaatataaagacactcatgcaaagacaatcatcacagaattattttatkattggtagtaaatgtacaacaatcgaggactggttaaacaaattatccatacgatggaatactatataatcattaaaaatgtaatacaaagcaggagacacaaccctcacacacttca

SEQ ID NO: 3773 - DNA, 598 bp, Bovine  MMBT06987
  misc_feature (1)..(149): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagttctttagacataatttctttaaaaataaagtgcatataattttccacattcaagacttctctatttgtggaagattctgaaaatagaagcatctgccataatatcaggggctttggagctgaagcgtctgtccaaactcacagacrggtatttcaaaatattgaggtagtctccrgcatagccgtgatgaattttgtcaggagaagggggccattttcagtcttggacccccacctggttttgcctcactgttgactcacatacctgcctacagcaatacacactrgttttggcctgtgctaggccacgcaccatcaatggagtccattgttttccagcaaggcacctgcacaacaggctcaaacaatgaggccatacctcaagcccctcctttctcctcagggcacccaaggtgaaagaaaacttgttgaggcccggaagccc

SEQ ID NO: 3774 - DNA, 600 bp, Bovine  MMBT11350
gacactaagcaaaatgttaatttacatgctttatttttcccttttccctttctaaaaacaacagggcctttaaattcctatggtaatgatgcaaccctaaagtagattgttttgaaggcacagttttcaggaaattctattcgtgccacattcttaagaatcagcaactatgtgaaatgaatattcaaagaaggtacaaatctctgtacactacttctgcaaggctagttgagtgccctgttaaagcaggcagagttcccattgctagagtatatattcaagccatctaacaaatcttayacagatgaggcccactcacttcagggaaatctaggcaaaataagattcaagacagtaaaacatttaaatagttacatttcaatagcatctctctcatggcagagtggttgttttaaactgaaactattctaggcattttgagttagagaaaatcatagcttaagaccagattcttctgaggcttaggaagatatttttgattccatattatatgttataaagagaagtactagataaataaaatgaaagattagcctgaatttcacagacctcataaatcagaaatttgagcattttata

SEQ ID NO: 3775 - DNA, 600 bp, Bovine  MMBT15809
gcgggagacctggcttcgattcctgggttgggaagaccttctggagaagggaaaggctccccactcccgtattcttgcctggagaatcccatggactayccatggacttgcaaagagtcggacgtggctgcctgacgctcacattcacgttcatactcaccaggggggccctggcccccaggcaggccaggaggacctggaaggtaggcgtttgaggccagtgccttgtgaccagtgatgtacttgcccaggtcggcagcgctgttggggagcagggcaacctgcaaagagaagagggasctgggtcaggagacggtgccgggcccactgcaggcagccccactgcaggcggtgtgcggcagaggcttcacagcctgccctggcttctttccccttatccraacccgtcagagccagaagggctggagagaccctccttctaaacccagaggccttccagtcaacacaacttgcctgagagtgctcagctacttagtgggcgaccctggatcggctgcagtctgcctgaatatcattagactcatgaatgccataattaacacagtcgatctgcctcaggctttccgttaagctctttat

SEQ ID NO: 3776 - DNA, 600 bp, Bovine  MMBT17567
ctgctccactgctctgtttcttggctcatgagactcctttgttgcttcactcatctcgcttctgaactcggatctsacggttagccaccttaacgctgatcccactggccactggaacgtgtgcgggcctctggcctcgtcccctcccggcacccagcctggctcattcacggtgtccactgtttcccctcccgggttggaaagcactgctcattgggagtctaccatgaaggcrctcccacagagctaatgatcgacactttcattcatcccctggctgtcatatgaacaccaccagckgctctgaacccttccccacaccacagtcttatgggttgttctttccctgatgtctcacttgctacactacagaattaagtctattctatacaaacaaactcatcttccttctatgtcccccaaagtgcctttgtagccatgtccttggtccragctttaattctcactgagcgcgcacccctgcacaccttctcagaggaggaggaattcctctcctctaagccgaccattccctctgtgctcctcatcccgctgttycttgtctaacctgggaccttgtttcaccaactgtttcttctt

SEQ ID NO: 3777 - DNA, 600 bp, Bovine  MMBT18397
gaaaaattgaactttgaatgactcaagcctgacatattacactgcaaattcaagattctacatttcattaaataaaataaatgacagtttaaagttggagcataatggaactttgataacttttttctaaactatacttttatatctcataatcacttgcaaatatcttctttaaaaatatcattttcataatgagttaatttttattgtaaagttgtgttgaaaactcaactggcaagacttgaaagaaaagcccacttataattgattgtatccagtaggacaccattaccaaaagayaaattataggtatgaacccctaggagagattaactacactagaggcttgccttaaaatatcaattttattcaagagaaaacaaaaayaaacacttccagtacaaagtttgaagttcaaatattctactgcatttttatgtaagaagatcagaaattatgttgcataactttaaataaaaatatataataataaaatagtgcttccattgttgcttattcatctgatatattcatccatatagtgacactaagcaaaatgttaatttacatgctttatttttcccttttccctttctaaaa

SEQ ID NO: 3778 - DNA, 600 bp, Bovine  MMBT04691
agctggcatgtttgtgctagggagagatgagctgaactaatgggtaattgctactttatgggtggaaattagaattctgcatatctcagcaattctcatctttgcaactcaaaatgtaagcagtatacagtggagaaattttggaaacactgttacactgacccagttaggccattcgttacacagaagtgatacaaccaaagaagtgcgggaactagcagagatgccagagattgtctagtacaatgcagtccctattttcagaggagaactgaaacctagataattgaagtgactcaytgtgtaggatttgtttaaaaacagccagcaaaatgaagccggcctcattgtcagttttctcagttttaaaatggggatagagagacctacactgtaagttgtgttaaatcttgataaagaaacagatacttgggggacatagttttttgaggcagcaacccgctgtgtccccctttgcctagcaaaagtaataaagctaccctttgctacttcaaaaaaagaaaaaagaaacaggcatttggaactatacaataaatgatgcatatactatagaaaggaaactcttcttcataacaatat

SEQ ID NO: 3779 - DNA, 600 bp, Bovine  MMBT12975
gggggtccaggatttgacagtacctcccatagtgttgctgtgaacaaaatagataatgagggctgaatgctgatttccatactggttgaacagttgtccctaagacgtgttgattgatgaacacatgtcaactgggaagtccccagtactgggtcatgagaggcttgtccatttccttaaagaaccatatgatgtgtctgtattctttgacattttatccttagatacatgaagacttagaaggcatgattagcaaattgatagatggagcaaagctagatgggaaagctcatatgttgratgacaaagaagattaaaaaagagtctgggcagaccagaacaatggactgaatctaacaagatagaaagtaggagggataaatcaaagtcctgcctttagttcaaaaaaggaactacaagagggctggatgagggaggctcagtgcaatagcagcttatatgtgaaagtcctggggctctcattgtctgttagcctgatataagtcaagagaatgacacagattctcttaaaatgcaggacaccttaggttgcactgatggaagcattatgcccagacttcagtcattcgctcagcaagt

SEQ ID NO: 3780 - DNA, 600 bp, Bovine  MMBT22651
atggacttgcaaagagtcggacgtggctgcctgacgctcacattcacgttcatactcaccaggggggccctggcccccaggcaggccaggaggacctggaaggtaggcgtttgaggccagtgccttgtgaccagtgatgtacttgcccaggtcggcagcgctgttggggagcagggcaacctgcaaagagaagagggasctgggtcaggagacggtgccgggcccactgcaggcagccccactgcaggcggtgtgcggcagaggcttcacagcctgccctggcttctttccccttatccraacccgtcagagccagaagggctggagagaccctccttctaaacccagaggccttccagtcaacacaacttgcctgagagtgctcagctacttagtgggcgaccctggatcggctgcagtctgcctgaatatcattagactcatgaatgccataattaacacagtcgatctgcctcaggctttccgttaagctctttatgtatcaaatatttgagaaactactacatgccaggtaccgtgctcggttctaaggcgaccacggtgaccaacacatggtctcggctctgaaagatctcagcc

SEQ ID NO: 3781 - DNA, 600 bp, Bovine  MMBT00746
atgttgactctattgggaatcatcccttctaatagttctccctagtcttcagggaatgaatccttattctgtactctttttgcatattgcatatatgtttattattagataccacaatttttgtatttgttcatttcaagcagaaactcaatcttatctgtcttttcatctcctagagctagtacacctaacagaatcagaactccacaaatatttattaagcagaaatgaactgaatatttttttccaggaacgatagagataaactaaaaggctgatgttggtcaggtgatgttagcyrtttttacatagccacaaagcccagaaaattttgttctgattcctcatgtgttggttttactatgcagaaagaaaagtacaaatggaacagggacaaaaaaaaaaagattctcttataaaggtttggaaatatatacccaagtcagaaccaatcatcaattgaatttactctattagctttagaccatgcaatagaccatttagatgattgaccatgtggaaaatttgagtagattatctagtcaacctttttaaattatcaatattttttcattagatactatagcaataaagatgcat

SEQ ID NO: 3782 - DNA, 598 bp, Bovine  MMBT04291
  misc_feature (1)..(131): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtacttaccagtatgtggctcataccgttattatcctttttcttgtttccattatctctgacaagtgactctttactggaactctaaatgagagctgatttctaccaaaaaatttgcagtagcctgttgagttactattgaaatgcaacagactgtggctaaatctrctgtctttgtgtctgtgggaaatggagtttcctgaagctcataaagttaacattactcgcagtaagatgatttccccagagattatgcttcaatatggaatacyctagatttatggcacagttccaatctaggttttggattctttctacagataccctcataaatttatgaatcaaaacacacatttagaaattaatggaagcatgaatctgaagataacaattccaaaagtcagcttggcttttagtgtygtgcagaaaaaataaattactctcaatkggaatttagtttaattta

SEQ ID NO: 3783 - DNA, 600 bp, Bovine  MMBT04703
tggccctggcaggcttcttgacctcacagtttgcctcctctctgaagggacttacttcctggagttgtgctgaggattaaatgtaatgaagtatataaagggcccctttcttgtgcttccctctcctgtggtgtgctgccagcatacctttccagctttacagtcacccccaacaataaacattttccacttactctccrtttcaacccagctagtctctttcccatccccgaaaacaccccgggggttcgcagaccttgctctcctctctggcccatctggtatgtgcccgtccccacstccacttcctccccgaagctgtccccccatctctcctgctagaaggtgaatgcttggagaacctctggacctttaagccgtcttccatatttttgcccccccttgggtttttaacatactgaagggatttacttactgtagaattcattaccgtatcttatttataatagactcttatctaggtttattaaaaagtgaatgaagcttttgggtacagggcagagtgaccattggcagaggtaagaagccccatttcctgctaggctgtgtgttgggggggtggtctttgtgccttttccc

SEQ ID NO: 3784 - DNA, 600 bp, Bovine  MMBT04855
tgtcttaaattctgtaattataataccagtttacttgaattctgaaaatatccttcttctaaacccacgctgcactgaaaatgacgtgcctttctcatccctcctcccgaccccagcagaccagatgagcagaagtgcacttccacagtgttcctctgcggtggtaatgtggacaaacatatgcagcaaggttcttttcaagaagattaagtgaagggggaagtttaacacagaagctcagcagttctgccaggatctcacttgcaaacagtcattaaaaaaaaaaaaaaaaaaaactaygtaggagggaaygggttgatgcttgctgtttgctacagggcatctcagaaatagcaaaggaaaccacagaccaggccaaggattgctgtgtcttaactagcttccctggggaaagcagcccccgatattatctgggaactggatggaaaatggcaagcacatgacactcctttctaggtatagagtgtttttcatattcaaagctctttaatgcttccctcaggagccttgtgagataagaggggaagtgattatatcctcagtttgtgaaagggagaatcaaagctgaagggtcaagca

SEQ ID NO: 3785 - DNA, 600 bp, Bovine  MMBT12609
ccccaggagccagccgtggaggtgagatccagcacgctcctaattgataaggtatcagctccacctaccgccaccagcaccttctctagagaagttactcccatctccagctccaggcccctgggcccagatttcatgtccagctccctgctcattgatgtccagcttggagccccagtggtgtccacagagcaagagatgtccgggcggacaactgccaccacgcccaccaaactgtacagcgaggtccacctcacgctggccaagcctccatccgtggtcaataggacggccaggccytttgggatccaggcgccgggcagcacyggtcagatggagcgaagccccatggtagagagacgacatcgtggggagaagacccccgtcccccagccccccagtgtggcagacaggagcccccggccacagagacacgtaatatcccacagccccatgctggagaggaggcccgtggcacagcgaagccccgccttggagagacgccccctgggaaacttcacccccacccacccacctatgctgagaccttgtccacagcccctctgacttccggggttaggtctcccccatcttattctg

SEQ ID NO: 3786 - DNA, 600 bp, Bovine  MMBT19113
gttccagtttccaaggagcccaactcatattccccttcaggagcttaactggctttaaaacctgcctcagaatttatgcgtctcggtcttcctcatggtcagagccaactcactgggagccacccacagctactgctgtttctcctggatgwggctattcctgtaacaggcagacttttcttcttgaacaacccacccagagggtaagtcattcctttrctgagcttggggaaagctgtggcagttacaaggcacattttggtcactgatggaccgtgacattaaagtcagtaaattccrtttggagacagagattcccagaccttactttcactaggattgargaaatcatagccccwgtccaaaaagaaaaaagaaaaaaagaaactacacaggtctctttcctgaagagtgatattctgaagggagtgggaaggaactaaatcaactaattatgtgtcagatatttattaagcatgtagtgtatgtaggtgcctgagacatgaaaatgaayggtgaataatatattggaggtcttgtccacaaggactgaaatcctcagaccccatgtacatgtctcataagtgccagcacctaatt

SEQ ID NO: 3787 - DNA, 600 bp, Bovine  MMBT21449
agggaaattttattaagcagtttgagctccacactccatatgatctgatgagatraaaaaggagcatcccacccyatcccaggaagatatcccttcccttgcagccacgttcaactaggtcagtccttttgagccctgacagcttgtgctccctacrccccagggaagggttaacagatttgggggcagggcccccctggggaaagtcccctgggaggtgtcccttctttgcttcttcarttgcatcaggcctccaktcgcctttcttctcagagaacatcatggcaagcgtggctgcakttctgacctgggctctggccctcctctcacgtgagtctccaacactgacttctccatggaggtgtgggtggactgttcttcctggaggtgtgggtggactgaggggttcctgagggaggaaacccagcccctgttcacctcctcttcacagtgctttcacccacggaggcacggagaggcttctgggactacttcagccagagcagcggggacaaaggcaaggtggagcagcagcagaagctggcaagggagcccacgtgagtggccagggcaagggctgcaggagaagggagaagacac

SEQ ID NO: 3788 - DNA, 600 bp, Bovine  MMBT23308
cacccccaagccccaaccaaagcactttccatggaggcaggcccagggcaggggtgcacagggccgtgggcattactgtcacctgcacaggccctgcccttaagagcaaatggttgctagtgcacaggtgcaatgtggaagcagagccaggactggaggggcgggagaagagggttgggggaggggcggagctaatggccataaggaggcgggatcagaaatgaggggcagggcctaggtttccccaggcaggcggtgggtgaggggcaggggccagggcccagggggcgagcccagaastctgtgtcttacaagatggaggtgaggcccgttgcacttggagcagaggagtcagcyaggtgcccaccctccctgccgagttygccacgcactcgtccttctgaattccttggcttgcatgaggttctgtgaacacattttcctgcttattcatgcatctctcagacagattattggcacctacgctgcagatgttgcctgmaacattaatgggaaagccccaaatactagccagcataatccagagcagcatgttcaaagagtgcaccgtgaccagggaatgtaaggaaggtttaatgc

SEQ ID NO: 3789 - DNA, 600 bp, Bovine  MMBT00963
tcatctttatttaaggtacctttttctgggattgtacatcttcattttctagtgcacaattgtcatcttgagagtaatacgatgaagctgaagaactctctttacaacacacatgccaactgggaagcctgtaaaacatccaccgacaccatcaaaaaaaaaaaaaagtaaggctgttaaaacaacatattccataccatgaactagaatttgaggcaatagaccaatagatggttcttatcctaatgttcttgacaatttgacaatttaatgatgaagacaaatgtacataagacaaargtttttttatttaataccctaagaaaaatatagtgttatcagcactccaagttaggcatcattaatctcacaaaggtaaaacaggaaatacttcacaataataagagtatctgacaattatcacagaaagaacagagaaagctracaaacagctaacctcctcaaaagctccagatgccactgatattctaaattctaccaaatatttaagaacagataatgctgaagctacctaaactatytcaaagtatagaagtaaagcttccaaattattttatagggaacgtaacaatgatatca

SEQ ID NO: 3790 - DNA, 600 bp, Bovine  MMBT02581
tccaaaaaacttactttattagcctgtttgaactatttctctgtccccttttccccaccacctcacatctcctgcaggacagtacgtccccaggaatcctctatatggttctcatgatggaagaataaaagggtagcccttctgagctggtcctggacactcagcagagcgctgttcttttgaggggaagggcaggacaaccaccttctcctccatgggctcctggaagaggaaggagacatccaggggttctccttggggattggtggttagatcgagctgcacagggaaggtctcaayagggtccttttcctgggaaccttcacgcttcttatcccagtcaggaaggtactggacagaccctttgggcacagctttggtgggtgagttggtgggagctgtgttttgctgttggagctcttctgtcttggaggggtttgcaggtctctggtttacagtagcgttttcacctctaggcgtgggagcctgaaaagagaatgctttcaaataagggaaagtcctccaagaaagtccttgatatgcttgatactagattattctggttggtacctttctgatggaattctcaaaagaagatta

SEQ ID NO: 3791 - DNA, 600 bp, Bovine  MMBT03259
taaatacatgatatgttttcataactataatcagctaaactgcttaagtgagtgattctgcttaaattaggaaattaaaaatttgaattatttttctgcaaatttgctgctgcttctagaagaagctaaaggcttgttggatgccaaaattcagcatagccactgattgtgtgctgtttatagtcaatctataatttgcctagctgcttccagtaaaatattaatgcaatcaaactaaaactgttttctttcacattcatttatcatcctgggtcagggtgtaaagctcttaaaaaaaawaataataatattaagccaagctgtttaattgtctaaatgtaagtttgaaatcctatcctagggtggtcaagagatttttttgggggagggttgggacttcctcatctgtatgatttacagcaaagtatgtttgttgatatacttttatgttctagcacactcgtactaggcaagtgtagataaagggtacagattaaagtctctgacacttacactatgattggggagacaataacacacttacaaagaataataatatgaaacagcacactctttaaaaagtactaccagccatcattt

SEQ ID NO: 3792 - DNA, 600 bp, Bovine  MMBT08546
gaaacaagctggtctctcctagtgaagactttcccacattcacagcattcatagggattctcctgtgtgtgaattctctgatgtaaaacaagttgtgaattgaaactaaaagttttcaaatcactacattcatgtagttgctctcctttgtgagttctctgatgtgcaacgaggtaggacttgttgctggagtctttcccacatccatcacacttgtagggttttgcttcttcatgagtttcctgatgcaccacaaagttcgacttgctgctgaaggccttcccacaggaattgcattcwaacgattttcctcccatatgcatttgttggcaaataagcagtggctttctgttggcagtttttccagattcatcactttcacagtattttatgccaataacagcttgttcatgtttagaaaggaaggatgattccctcaatgcatgaatgtcattaggattctttccagcgtaattattactgagacctatattacatttcaaactcttcccatttgtgacacatttatgaagtctctgtcttgaagaagcattatttgcagtaataagacacagttttccaaaagcagtacagggatag

SEQ ID NO: 3793 - DNA, 600 bp, Bovine  MMBT06517
acttcttcctttgctgcctaaagtctctcagctacccattatggccataaattgtctggaaacttttgatgcaagaagttgccctccttgatcctatgctatacaccattagtagtaattgttggctacatactgattttactggaaaatctgataggtcctaagaccatgacccttcctcctcrgatgcctattatgccttaggtcatggaagtacttcagtacgtcatcaaggcttccttcccaaaacaaaagcagtacagtatagttaaacctgagcctctggcatattccacctasaggrgggattggtctccctcgtcctcagtcctttgctagatgccatagtgctggagratgtcgcccttctattggaccttttagatacttggggagccccgagratcaactgagtgratgttaaaaggagtttgtacartttggatggcatcacagttgatggagcccatgggaaagctgttgctattaattccttaagcaggatgtttcctgatcaagggcaggatctgagggttggcactcctggccaaactccacacagttatcttagcactatatgctctactcaacagtcaattc

SEQ ID NO: 3794 - DNA, 598 bp, Bovine  MMBT07579
  misc_feature (1)..(12): n is any nucleotide
nnnnnnnnnnnnctgaaaagagaaatctatcttgattggcagatggatccctttgtttcatgttttattgtttttgaagaaaggggctttgatttcctgccagggagctttcataaaaggaccttagcatgctgagtcctgattaaacatcagggaaaggggatgattcttttgtatagctctttcctgaaaggtgaggaagccaaaattacagtgactctaggacagttatctgctgaaggaccacattcagctacaggaaaaataaaaaatcaaccattgcatagacagcagtaatastgggatgcaaatatcatttgyscctattttatgaatmctttaaaaaggtctgtacaataaagggtcatactgatactttagtggagagaatatcaggttagttttatttattgctgtagagtcttgacctatatagagagctttttataaagttaaatagattttcatttaaggattctgctaattttagcaagtaaaagagatttactttagtgacaagtgtttgtctaaattaaaccactcacgttgttttggatttacaaaggttgtttttaaatcttctgttgtggcaatcctg

SEQ ID NO: 3795 - DNA, 600 bp, Bovine  MMBT04402
tgtgggaggaaaagcttgtccttggcaacagttcaagacagggaagacttcctcagccctccaggagcctaggacttgagggcgtcagaggctccccctgcccctgcagagacttctgggcttgaacccagggctgtgcacagccagtccccattcagcacccgtgcaatggttcgattctatttttaggtggagaaaggttcaaaggccctgcgcaggaaaatccaagagggaggggaattctcagcgccatgcaaatcacactttcccctcagcctctgcttgacacctgtttccccytagccagctggcctatcctgggtattgatagcagcctggtccccaggatctccacccagagcagaggcccctcctcctcctgctgcttaaagtgagagctaggggaaagaactaagccagccccaggggctccccggaacttcccctccattctccaatctgaatagcccatgaaggcagtgaggaggtgagattctcagaggcgggttcctcagtttcaaaacagcaggatgactactgcctttcaggaccagggagacacaaaaagtggctagggttttactaatccagcccaagtag

SEQ ID NO: 3796 - DNA, 598 bp, Bovine  MMBT03195
  misc_feature (1)..(46): n is any nucleotide
nnnnnnnnnnnnnnnnnnnnnnnnnnnnnnnnnnnnnnnnnnnnnntttgcaatgaatgacaatgtggtgctactttaagggttgaggaagttggtcagatgtggggatggtgttggaggaaagacagccattttgctttccctttccatcttccataaattgcattatatgtttttaattatatcacagaaatttccaatccaattgctcaagaacaatattctgtcagcactatgttagaaaagaatgaatttgaaacaattcttaaacaatacacagagcactgtgcaacatcctayggtgactttctccagcaaaatcttgaggcatttctttagcattgtctttatcttcccatggtgacttatgaggcatgcttaagaaaaatttttattaaaggtcagagattccaaaagatccagccaaaattttgggaagttaatagtgtgattaattcttggagtccttcattttccagtcctttaatttgtgcaatcacaatgaatgttcaaagtatatactgctttttaaagtcttttaattgggaattcataaaaataactgattaacattccccaccacaaggagccttgaagg

SEQ ID NO: 3797 - DNA, 598 bp, Bovine  MMBT06252
  misc_feature (1)..(36): n is any nucleotide
nnnnnnnnnnnnnnnnnnnnnnnnnnnnnnnnnnnngggcggaaaaatagatcgcatgagtcaaattggcaataaacccattataaagaagagagtggcactaaagtgaaatttcagagtatactgctttctatatacctaactgtgatcttacttaaaaacaagtatttacaaagtttctagaaaactagaaccaacttgataactagggtttcaatctttattttgtctccataatattcagctgtcagcagtttcagctacacatttaaacatctaatgtgattttatgtcctactyacactactcggtatctttatataaatttataaatattataagtgacattatgcacaatattacttataatattttccagattaacaattttgactttaaataaaaactggagcatttgggctttaaaattttttcaatttctaaattctttttaagaagtcactgatggagactgaatttaaagttaaaaaaaatgctaccttttgtaaattttaacaaaaagggatcattatgaacaaatwtattaataagtaaatacctgttctaaacaaataatcaagtagcacttgacactggc

SEQ ID NO: 3798 - DNA, 600 bp, Bovine  MMBT07712
tttgtaagaatcagagaatgtgaaataactttgccagtgcagtgtgctgtccccatagatggtacaactgcctttattttgactccatccaggtctgttttcgctggagagaactgctgttctttttacagattcgctttctattaggaggacaggtgcggctgaaaagtgataaaggtctaccctcttttattctctgaagacaaatctgaggccttgtcatatttcctttgccagaggaaattcagcacgtggtcccctccccacctttggtgagagcagagctctgcctcctgattyttctgttatttgcatctgtctgagctgttagatacatcagtgtctttccagaattactttaaattacccttgatcatggaataaaaagcaggagatttatctgttcaattatttgcagataatgtggtgattgaaagggaaacctggctgcagaaggtatttggagctgagacctgtatgacagttagacaagcaggaattgggttagagttttaaaaattcaggaccctgatatgaaaatgtcattcactctgtattatgattctggagtcatcatagtaaaaattgtaaagcaggcac

SEQ ID NO: 3799 - DNA, 600 bp, Bovine  MMBT07923
cagcttcccagtttcttcagattgatttgctttgtgctgtaaatgggtggtagaggctgtgccatagaataagaccgctaatgtgaggtgagacgagcaagtggagaaggctttagccctccctctggcggatcgcggtttcagaatgttggagatgattttgccataggagacaccaatcaacagaaatgaaaccatgatgaataccactacaactgcatagactgctatctcattcacaaatgggttcccacagcaagcttgaatactcaggggaggtcacagaaaaaaatgattaaytgtggtagacccacaaaaaggcagagaggaaacctgccatgtttgcccattacaacaggaactccactgacccaggaggcagtaaccagctggcacagactaggggctcatgatcagaccatagtgaagagggttaaaatggccatgtagcagtcataggccatcatggccaggaggagacactctaaacctccaaacagaaggaaacacgtttgtgtagcacaggcaatgaaacaaatgtgccctttctggctcaggaggtttgtgagcattcttgggatagtaacagttacataacag

SEQ ID NO: 3800 - DNA, 600 bp, Bovine  MMBT11096
agaaagaggattagtgttttctttttgtttgttaataagacaaaccatccaggaaaagagcttgtttcttaaagtgagatgtatacaaaatgcccaacagagaaactggcacattttactgtgatctctaaatgatacttttctcttctcctccttaagagaacaattaaacattcattaaaacagtaacattttctgagattgtgaaaatgtaaatacttttacataaatgggattaattgcatagcacccttgccttaagtagatgttctccatcacattctgcaaattaaatttcayaactcgttaagcagaaaaaatgtgtacaatgctctattttaatttcatttccaatgctgtgacagctcatggatattaaaaatgacttctaaaaaatcatcctgccaaatttctcctatagctggaatttagggtcaaaaaaggattaaaagttgaataagtcaagataaaatggaacgtgaggcccttaaaatctgaaagcccctaaaatcagcatttctctttcagcatgttttcaaagatgtctttctccttcaatactgttccctctcccttttctatcatcattatctgaccagt

SEQ ID NO: 3801 - DNA, 600 bp, Bovine  MMBT06741
cagacagtgagacaaagtaattgaagtctgggctttgtgtgatttttctggacaacataattggacatgaattgggatgtgcagtattatttacaaaagtaccatgcaacacattccacgaattaatagttgggttatactgccagggaggatgcagtgtttgtggagccatgaatagacaataattacataaactctacatttgccgagatgcacttgttctctagaagactcatgagtttgcaaatttaataacgttagacccctccagagaatcatcacgcagaaacttataaggayaacatgtattttcaaattaattttgatgccagagggaaagataataggtgtggcccaatgtgytgatggggcaagaattcactgtttctgttttgaggacatcatcttacccattttgtggctccttcaatactttaaaaaaaaaaatttatttatttggctgtgatgagtcttagttgcagcccatgggacccttgttgtatcataggggatcttttgttgtggcactcaggcttctctctaattgtggcacgcaggctcagttgctccacagcaggtgggatcttcctttcctggcca

SEQ ID NO: 3802 - DNA, 600 bp, Bovine  MMBT04984
attcattgccagacgcagagacttttcctgatatacagataagcactgctttttaagaacttattttcaaccagaacccaattttttttttccctagctcaaatgaatgatgtattttcgaaagtaaagtttagtttctctttacgtatttacttttcttaaacaagaataatctggaagggaaaagaagtcagttctcttaagcatcactagagaaaaccacagctaaatgataaagtttattttwwwaaaaaattactcttcaaattaacccacaatcactgtacactgaaaaatatrtttactgctgtggaagttcagtaaaatttcttcaagtataaacactgacattacaaacagtgactgtatgcaaattccagccctcattaatactgctaaatgatgtagaaaaacagttgattaaaaatgataagaaggattttttccccctaagatatttctggaaaatcaatcccaggataaatgcagtaaagactgggtcagaagcattagtatattttcaagaaaagtctatgcaaagagggtccaaggaaacaggaakgtgaaatctggaggggttgtgaagaktcttgagaattt

SEQ ID NO: 3803 - DNA, 598 bp, Bovine  MMBT11020
  misc_feature (1)..(25): n is any nucleotide
nnnnnnnnnnnnnnnnnnnnnnnnncggggtgcggtgccacgtgggaccaggctccgtcccgctcccaatctccctggggtgagaaattcaggtccattcaaaatgtgtgctaggcagtgcgagttcccctcccccacttcgcactgctgccgcggagtaggactctgcccatttcctccgcccctagagcactgaactgtccacaaacagggactttccactttcagcaaaacagactgcacagaaagatccacaattgttcaagagtagaacagggacctaactatcaccaaaagcartctacctgctagatttctgtgggggacaaggaagggtaggtgggtaaattgtgtctgtgttggggcgggggtggagggtgtggggtgtgggggcagctgttcacagaggcacgactcagttactagggtctgcgtgggtgtggagggaaatgcagatttccttccaagccctatttcactggggccatacaaccaagcacgccctgctttcatcaaaaaaggcagactccagctgaggcccttcaagaaaccatataaagaagccaccacccttcaccagagggggtttgggacaggg

SEQ ID NO: 3804 - DNA, 600 bp, Bovine  MMBT06794
tagaaccaggaaacgtgtgttacagcaatccaaccataaaatacctgaaagctctgtgacccaggaaagactcctttaacaccaaatgtcaaacccccaaaatacccttagctaagtttaagatatgtgttattgggttggttcaaatacaggaagatttgtcctctgtatatcccaacatctgttgttacatcttttcaaagaataagaaggtaggggaaacattcatctaaaatacttctgttttactaataagcagcaatcttccaaaaactgaaagtagaaattttagaacaaaaracactttctggcatgtctttacctagatggtcagggaatcaatgaataagtaagggaatacagagcctataatggaatcaagaacatgctgcccaactgaaagtaacacattaccaactccttgtaacatacgagtcaagcaaatctgctcctctttgtccttcacttacctcctttctcctacactgctcgatttacagcctcgctcttcaaaggcatctggaggcaggaaagatttagatgcctttcacatgagagaagaaataactcactgatgaaatggagagatgttcagagaag

SEQ ID NO: 3805 - DNA, 600 bp, Bovine  MMBT09173
agccctacaatgcttcaaggttcccccttcctctccaggaaaacacagacactgagcttccaaatgtctccctagagagacaataaacctcatgctcttgtttcttccaaaagagactcaatttcttcttggaaaaaaaattaatctctttcatcaaaagattagatttaacccatatcctttccctgtccaggtttcctttcagtttgtttccctcttaagcaaaagccagggaacatgccccttccagcccccactgagggccatcagtggaccttaatcctacccttccttcctccrtaccggggctgtgcagccccatcggccagcctactcaggcacaggtgggccaggggtctctcacccaacagaaggggcaaagcagcagctctgagaatttcacttaaggccagatgcaaagagagacgcggtgacacaagggtgaagagtggtgggagacaccaggactccaagattacagcccaaggctcctactcaagagtccctctcagagcttcaaatgtccacttggccggaggttgtggccaccaaaggggaccctgaaggctcactcagacccactggggtgggaaactcgaa

SEQ ID NO: 3806 - DNA, 600 bp, Bovine  MMBT08784
tggcactaaacatattttggatacttcggttctaaaaaagttttctgtaatgccattttgggggtttgtacatgatttttttttttatgttatctgttaatactttaagttgtgaaatatggcatatttgcaaatgaagctataaaacgagcacatgtaatttaataaataatgacacaaacatccaagcttatagtacaaccttcctggtatgggccctcccccattgcttcactctctctcccagaaataatcacagcctggatttcctgttaatcattcctttgcttctctctatgrtttggygcacatgtgtgagattstaaacaatagcgtgtttgagtcgtaaattactcatttcatgtctgtctgcccagttaactctgagaagaggaattgtgtggattctggtctctggtctgttcctagcctcaagcatggcccttagcacatggcaggggtttaataggcatttatggattaaattaatgaatagagatgttttattcttgtaaaaaaaatagtttctcatatatggctaagatacataaatgtgtatttgaataaccataaaagatagagaatatcgaaaggttttat

SEQ ID NO: 3807 - DNA, 600 bp, Bovine  MMBT09424
tcagctctgaccacagtcccctcgggtccccggttgcacactgtggtctgtgatttatttgggccctggctttcttccaacaggcctgtgtgtcatgatcgcagcttccatttacacagaccggcgcaaagacattcacgagaagaacgaagaactgtatgcccagacctcgggcggcagcttcggctactccttcatcctcgcctgggtggcctttgctttcaccttcatcagcggcctcatgtatctgatactgaggaagcgcaaatagagtccaggagctgggtggctttcgccgcrgttcagaatccacataaccgttttgtatataatcagtttttttgtgtgtgtggtttttctagcaaacacattgtttcctttaaaagccaaaagaagagtttttatgttcttgagatcagagaatagactatgaagtctggaattcrgaactcctgcccatccgaaagcctcaacatgacaaagccaaaaatcttgcaatgctcaaatccaagtgttcagcaggataaccacagggatgtaatgggatggacaagactccgaaaaakccaggtcttgggggcatcttcccctaggtttggg

SEQ ID NO: 3808 - DNA, 600 bp, Bovine  MMBT09893
atgcaatgaagagaaccatctctaacccaagacaggagcaagcaacatgaccccaaagagagcagcacaagcttcccaagaactggtcttctacatctgggctcctgaattcaggtgctttgaaaatacatgtgtgcacgtgtgtgtgtgtctgtactcattcactcatccctggatcctaccctggaggatcctggttcacaagccatggctagagcagggccgcagagtaaactgctttttgaaatgacacatgagattctgtagataagccaggtatgggaagcactattctacccyctgtttactagattcccagcttcaggtgggcaggtcaacaagccactttttaagcttcagtctgacccctgcaggagcgccaagtacacattcttcctctcgtggtctctgatatgggagatcccctgacctttgcaaccaaggggttctgaggttcttattttctccaagctgcacacctccaagagcaattcagtctcacaagggctgttttcttcacttctgctgcacaggcaggaatcggggatgatgtgcaacatatctttgtgtggaaatcaactgaccttggaggtaacacag

SEQ ID NO: 3809 - DNA, 600 bp, Bovine  MMBT03481
ccatatgactacaatacgcctgttaatgcaatgctcctcaaattgtttccatacttcctccactgcctcacaggataaagaagctcatctttaggagtgacactgtgcagatggaacagcaagaaaaagacgtgatatgttcagaggagaaataaaactcagggaaagagaaaccacgtgaaacctaggtcaattctgagcacaaagtatatataataataggaaactggtatcattggatcaaggtaataaaggccacacacacacacacacacacaaagccaataaaactagggcaakagaaaatagaacttaaaaacaggccawatttggtgaaatggrttggattccttgtcacaagaaatgaatagcctgaaatgttttattatgacagcaaagctgtgactttaggtttgttaaatayttcaagttcattacaaaatgttacaatggtgcaatttgattcttgctttgcatttkgggaaataaccaggaagaaaagaaagctactagaaatctcagcaccaccatccatggacagagactttctacctgtattttacagctttgaccaacacaaactagaactcctaaaatctc

SEQ ID NO: 3810 - DNA, 600 bp, Bovine  MMBT08574
atactgatatcatacaaatcttattcatcaaatgcttagattaattctggaaagtacttactcttgtacttgtcttactgactcatatccaaactcatcacgagacaaaagaacacgaagtataataaaaatacagtaatttctcagctattaacctgcagatattatacatgacttaagctacaaataaagtcaaataaaagattcttcgatgtcacttaataaactaacatttaaaaatcatccccttttagactaataaccttgggaaaattcaatactcaatatactcaataaackattgattagcatgtgaaaataaccattcttttttaattctcctttagctattctttaacaggagaaaactcttctccatttgcattttgaacaattagtaaggtgaactttcagtccaaattaagctatctttccccatgaaattctgtcatacatttttatgctcctctgcttcttgaataatcgatctcaccatctttttaattgagagccacatatgaaagtgtgactcatgagtataaatcctacacattgtaactttgaaccartattgcaaattagattctctgagccattttt

SEQ ID NO: 3811 - DNA, 600 bp, Bovine  MMBT00779
tatggtagcaggagattgggctgggtttcttctctcagtttattgcagagatttatttatggttcactgatccatttagaagtgccagagcagctgggtttatcatggcatcctgccagtttcacatgcatgccagacaggctcctttccagataaaaaattaccaaaatttatagcataattaaaaaaatatatactttgacttattcctaagaaatgcattacagaaaaacaaaggaaagttaacatagccatggactcatttgggtgttgttaaaaaaaaagaaagccaaatcttamgactaatgagcctggtggttatgaaggttgattgtgtgtgtgtgtgtgtgtgtgtgtgtgtgtgtaaacaaaagaaggcagccaggagaggaaaggacagattccaacattacagagaaaaaagactaaatgtttatgtagtcctatgcaagaaaagatctgagaacttattcctttctccaatcctgccaagactagtgcttctcaaatcacatttgtgtggtgaaggatatggttttgttctttagtctttgctttttcatttcttgtcacagaccaataccacacaagctataaaat

SEQ ID NO: 3812 - DNA, 600 bp, Bovine  MMBT12980
cctgtcttaatggtggttcagttttctcgctcgcctgagagtgatcctagtgttgagatgcacttttcaaacaggtggctaaacatgaagccacctactttatttgggttcagctaaataagagatctactctgacagtggaggaaaaaactagccattttttacttactaaaatggcacacgagtctttgtttcatgtgaattctaacataaaaggttgtatactgtgtacttcatgggtgacttaaaggaatttcygagacaactttaagcaaaatttgatgtataatcaagaataasaggcaactctacttgggtttttgtttctcagtttcatcagctataaaatgagctgrtatcaggtgatcatttacagcttttccacccatatagagttgtgatatgagaagagaagaatcagatttaatgtatttgcaaaagacagcactaccaagcagagctgttaggtcctgtccagcagcagagcgattctagaagacaaggagttgtgagtcacagctgatgctygttagtcacatctggaatgagcaggctgctttggactgaatctatggtctggggacagaacagtgctgttcg

SEQ ID NO: 3813 - DNA, 600 bp, Bovine  MMBT12730
aaaacctcatcctgccaaaagtgtagtgccacrctgttcccacaaataaagaggataattaaagcgagaaaagaaaaggatggagatttgtaacatcttatcaaggctgttagagcatttatactttacctggacaatctttagcttgcaatgagactacataaggagtgacattattctgaaggacttctgttagacttctgagtgttaaatcatgatctgttacattcacacctatgggataataaaccawtattatascatcatttttatcattaataatttaacrataagaaaagsaactttacatgccaagtgaattactaagtaaaacattttcaaaacatgattaataatagaaaataagaaaatatactgcataaatgaaaagatctccattacaaacacatacaaagaggcaggcactatacctgtcagggaaggtatttaacacaacttttctttaagaaaaaaaaaactactggggatgtgtaatgacccgtgaaaacatcttaggaggaatttcaaactcataaagagcttttaaaataatcattcaaaaataaggcccttagtgtgaccctaacttaacaactgagg

SEQ ID NO: 3814 - DNA, 600 bp, Bovine  MMBT12889
gtagacctgagcagccaggttattttgtgtgtaattttgagctactcacctcgggaatggcacgctcagattggagtcataatttcacttcactgacgagggtgtgacatacaatagaagattgttgcctggagttcattccttaagaatgctgctctgctagctctgctcattttaacaayataaactgtacattatactccatggggttgattattgtttgaaagtatttgggtgtttggatactttgtcttgttatatttaacactggaactctgccactaattctctgtgtgacaytsacattcattttggaggcagtgtatttcatgctatgaaagtcagtgaaacatgtatacagtctttgattaaacttatagtatcttcataacatgtaaagtcaaggactaaaagaggacataaaaagagcacctgttaaaagaaaaaaagatgtcggagaaaatgaacaaagaacaggaacagtttaattcttcagagaaagcatgctaatgaccaataagtatctataaagatggttaatttaaggacatatgtgttaaaacaagaaatgcttctccttttttgcctctcagatcggca

SEQ ID NO: 3815 - DNA, 600 bp, Bovine  MMBT11812
ctaaatgtgttgttgctctaaaaagtcttagaatctagagaaattgtatttcaaacataaaaggctagtttttagcttgttgcaacaacttgcctgagtttctcattatcactaaaatacttgtccctgcttcagtaagattattagcctcttaatgaaaactgtgccttgagatcaatgaataaaccatattacaaaagcatgctgattaggcatgaatgcattttctctaggcactaaaatcccagaggtttagttctagttattattcaatattacaaacttcatcttagaatttaygaatacttcatgttattttatatggtaatattgtaatcattggttaaaatattagtgactatatcactgaaaataaatcaggagatatttggacatgactcatttgaaagagatatagaaattaaaagtgcttcttactatcacaaagtcctccaaccacaccaccctcgccttatctccatgccagccacagactttgacagttccatggttacaggcgtttctttcttttatgactttgatccaaaagttattatcaacatctttgaatatacacttcctgacaccttgtaggcacct

SEQ ID NO: 3816 - DNA, 600 bp, Bovine  MMBT13971
tagacattacaaccaaactgtaaactccatagggacagaaattttcatcgtctctttgaactaaattcacagcccctaagtcagtgctcttaaaaaacaagaactcagtgaatacttggcaaaggaatgaatgaaggtataaaaggttcttaactttatgccttgagtcttgtgagcattcagtaaatactaagccactttcccaaagtattacagtgctagataagtgatttcaggatgatgcaaataatatttaactcatttgaatgtaaccttcatgaggcagggaacggttttgtycagttctgaatcctcacctcctagaaccatgyscagcattcagtagacactcagaaaatgtctactgaataaatgatttgggtctttcttcccagacaggccatgtgctacttgaagggaagaattttcttatattctcaccccgactgtgtgtacacaaaagatattcaaacattcaaagcagatgagttcagtggactatcaggggctcaaggtttcttagaaccaccacgatctgccaattacatgtaagtgtcatgagggttatacagtacttttgactccaaagtaatggaaaca

SEQ ID NO: 3817 - DNA, 600 bp, Bovine  MMBT13362
gaaatctatcttgattggcagatggatccctttgtttcatgttttattgtttttgaagaaaggggctttgatttcctgccagggagctttcataaaaggaccttagcatgctgagtcctgattaaacatcagggaaaggggatgattcttttgtatagctctttcctgaaaggtgaggaagccaaaattacagtgactctaggacagttatctgctgaaggaccacattcagctacaggaaaaataaaaaatcaaccattgcatagacagcagtaatastgggatgcaaatatcatttgyscctattttatgaatmctttaaaaaggtctgtacaataaagggtcatactgatactttagtggagagaatatcaggttagttttatttattgctgtagagtcttgacctatatagagagctttttataaagttaaatagattttcatttaaggattctgctaattttagcaagtaaaagagatttactttagtgacaagtgtttgtctaaattaaaccactcacgttgttttggatttacaaaggttgtttttaaatcttctgttgtggcaatcctgttaactaagtctgtctccccact

SEQ ID NO: 3818 - DNA, 601 bp, Bovine  MMBT13892
  misc_feature (1)..(1): n is any nucleotide
nattcaggttgatggaagattgactayagataaaaagtaaacactctcatggtgatgtaacaggttcccagatcatacagcacatcatattttaaattgtttatacagcaaactaggttgccagtgtaaatgacaaatctcttaactttcttgtttctggcagcaatctgtgaaaaagcagaaaactgcttccaagttatatcaagacttgttttttttttccagttgtaaaccaacctgaattttgttcccagaggaaggcacaaccaagaactacaagcatctggactatctgccttargtgggctgtgacaccaccaccaccacctagaacagagcacttggaactcacacagtaaaaacaaaaaacccatgaccaaactgctcttgaacagatattcaaccctgcccaactccttctccgataccacttgcatccgcttacaaataaaaatatctaatagccaatttagtccatatggttgcaatatggccacatgagtatgacctttttatatagacatccatagaaatttgtggccgctataccattccccaccccaaaaccagaagagcatactgaagagtttccaacatgtct

SEQ ID NO: 3819 - DNA, 598 bp, Bovine  MMBT12659
  misc_feature (1)..(55): n is any nucleotide
nnnnnnnnnnnnnnnnnnnnnnnnnnnnnnnnnnnnnnnnnnnnnnnnnnnnnnnaattatgttttcaagtccaaggaacctgaaaatagtatccctaatattaactgttaccaatttgggataacagtgttttctccttaaagcagagaaactcctaatattccatgtctccttgagtttgacatcaagtttggcattttgagtttggcgctaactaatccattttacagaagaggcttagagaaatgaaggaacttgtccaaggtccaaaccaggactaagcaggggcagatgaggtrycttgggtgcaaaatttaaggaggcaccagttctcaggtttgtgtcagttgccattggagagtgagttcctccttraattttacaccccagatgttttaaataaggagcacctctttaatttattaattcaatcttgaaagatataatcaccaaatacaaattatggtttctattttcttggaagtattttagartatataaaaagatttmtcctkcaggttaaattgaccaataatgtrgattattgaaactgtatgttctagattatgtgtatgtatataaacatatatatacaca

SEQ ID NO: 3820 - DNA, 500 bp, Bovine  MMBT17006
agctgtcagcagtttcagctacacatttaaacatctaatgtgattttatgtcctactyacactactcggtatctttatataaatttataaatattataagtgacattatgcacaatattacttataatattttccagattaacaattttgactttaaataaaaactggagcatttgggctttaaaattttttcaatttctaaattctttttaagaagtcactgatggagactgaatttaaagttaaaaaaaatgctaccttttgtaaattttaacaaaaagggatcattatgaacaaatwtattaataagtaaatacctgttctaaacaaataatcaagtagcacttgacactggcaaacaatgaactttctttccaaccacaggagcttctattgtaggagctgcagcatagaaccttatgacaaacaaaggctacatgaataagactgtgagagtatggtactggataaagaaggacaagggaattcaggccaataaa

SEQ ID NO: 3821 - DNA, 600 bp, Bovine  MMBT17802
ctttctatactgaaatgatccccattctacagtctctgaaacttccaactcctttgacaaatggcaagagttgacattcccatcaccatactgcttgccttctggtatacccagggaaaagcacaattataagcttgatttgaacaaacaaattaaaacataatacaaattggggccagttcctgggaaaataaaagggcctgttctgcatatgccctaatctctgttactgatttactggctgaatggcccactccagaaagcatttggagaagcccacatgccagaaagcactctaaygcttttcagttttcaatcaagtgacttggaatcttcctttgacaaaacacacttattgtaagctggccacttatcccaacctaggayacaacttatctgcagcataagggctataataaaatccagcttgagtgacagagaaaacatgagctaagggagctcaacttggaatccagatgttgttaactcatgtaaagtatctgagtcttttatattttatacttttgcaaacagtagggtacctagtatttccccccttacctttcaagtgctgtgcctataggaatgcaatctgcagag

SEQ ID NO: 3822 - DNA, 600 bp, Bovine  MMBT15263
tttgcgaccctatggactgtagacttccagacttctctgtccacaggattctccargctagaatactggaatgggttcwatttcctcctycaaggaamctttctgacccagggattgaacccacgtctcctgcatctcctgcattgcaagcggcttctttaccactgagctaccagggaaggccagtcactacaytaccacttactaattgtgcaaatttgaggcaaggtaattaattatctctattgtagagggctattatgaggtttcagtgaaagaaggtgaataagccctcagtayagttcataccacctaggtggagcttcatgaatgtccttttctgtctggcctcagtggttaaagaaaaggactccgtcctcactccagggtgtgattctaaattatatcttctccctcagcactaatcagaaaggtctctgagctgaaattcaaagagatctctcgaattttaattctttattcacttaatgagtaactaagttttctgtttggtgagtaaaaaattggatctgggttctgttaatttaagctactataaatgtgtgtgcttaacaaaggagaaaattacaattttccatg

SEQ ID NO: 3823 - DNA, 600 bp, Bovine  MMBT15082
aggaagacctctgtgaccttaggatagtcattgaattcattacctgggattgcacatgtttctgacattttatcattattatgcatttcatgatctaacagtctctaggtttttaatttatatagaaacatttccatgattttctgtcctaggatgtaatccgagagttctgagatgcttatcattggaaggctaagtgcttgggaataaaacttaaatctggcatcttgcacttagataagggaatggctgaatttacaaagatgaatttacaagatcaagaggaagaagagcatctaytcatctttgactctcatcgcttgccatggtcctcagcctagacatttcctcaaacattagacttagatgattgctctgtggctttgctttctgagcctcattcatctttcagccctcatttaaaatctctcttgttctctgtagttttctctgactgtcccctcccaaggtggtcttttcctccttgaatttccacagcagatagtttgtgggactttttggtcacttagttattttgtcatattgcacatgaaatatgttatttgcatttataatatccctggtacaatacttagatat

SEQ ID NO: 3824 - DNA, 600 bp, Bovine  MMBT16433
aaaaattcatcttttcagtgcagagatgtactcttgcttcaattctgccttgcttttcctgcttccaggccactttgctcctctccatctgatagatttgccccagtttactggggtgcatttggacagcttctctcaagcttccccaagactcctgttttgtgagatatatggcatcttagtctggagtaaaaagccactccaagaacatgtaagtaaattcaaagtgcagcatacatacagtgggatactatacacctataaaatgaataagaaatgctttgtgtgaaaataagaaaygatgcccaactygtattaatgaaaacagaaaggagaagattatataagtgagcttttacataaagagcataaaaatacacactagtctgcttatattttcaaatggatgaatgaaagggaaacaaaagaatagtaaaagtgatcattatgttagggaacaagatgatcatgggatacaatgaggatttcaatgtttcactgaatatcttttaatattattttactttgtttttttttaactacgtgaatatatcaccttttaagtgtcagattttggtgatggtcatgaatctgtgtcct

SEQ ID NO: 3825 - DNA, 600 bp, Bovine  MMBT17035
ccattctgttgttttcctctatttctttgcattgatcgctgaagaaggctttcttatctcttcttgctattctttggaactctgcatcagatgtttatatctttccttttctcctttgcttttcgcttctcttcttttcacagctatttgtaaggcctccccatacagccatttagtcagccttttaccaatattacagttctggtaacatttctatcttgctaaagcatcttcaactaggtgctttcaaatcctgatcctgactttcatagccctcttcaaaatgatggtgtttatttytttcatgtatcatcaatgccctattaagcttcccagaaaaacgttcattgaattcagccagtatgacttgagagtaagatggacatttgaatggactttcacctgatgcaaatttttttccaaaaaataggcggagtagactattagccttttaggttttctgtagtaatgttcccatctgcttacaatgtttaattcactaactcgaggggaatcagaactgtttttttttaacctgctcctgacctattgtactctcatgggggaagtctgccttttgttgtttgcttgcctataaaa

SEQ ID NO: 3826 - DNA, 600 bp, Bovine  MMBT14433
ataaagtgctgtgggacagttaaagagcaagtaaaatgtctttgcacatcacaggcttacagaggtgatagtgcttaaattgcctctaaaaagatgggtaggaattttgtcaagttgacagttattagaagagtgttctaagcaaaggaaacttcatgtagtaaaacccagagaatatgagtatgttggggaaattataattgatacgaagggtggatatggaataattttaaagaataagccttgaaaggataggatagatctagaccagtggtccccaacctttttggcaccaaggarcaatttagtggaagaccgtttttccatggacaggattggggggatggttcatggggtaatgtgagagatggggagcggtagatgaagctttacttgcctgccgctcacctcctgctgtgcagccgctcacttcctgctgtgcagccgctcacttcctgctgtggggctgggttcctcacaggttggggacccctgctgttgactgtaaaaagcttcaggtgtcaggccaatgagtttggacttcatcccatgtaaaaagaaggacctcagagacatttatttaaacaagagctgacataa

SEQ ID NO: 3827 - DNA, 600 bp, Bovine  MMBT16786
cttcctagtagatgctttgtgttatgtccaacagggtgcatatcttttgttatttgcagacacagcattctattaatcttttttttttttttaatcctttcttgtttgttccacaggcattgttctctgttcttggaagaaaaagaatgggctgttcttgggctggttctcttctgtcttcaagttattttttccctatctctaagcctaatgaccattgctatcttattaacaatttttattttttgctctttgagtggagactgagaactggagatcatactagtccctactcctagrtggtcagtggtggtagtcttgggtttctttgygccttcattgtttytgggtggttamacttttccatatatttgaaaactccaaatatggtgaggaagcttatatagtaaacacctgatcttctgtgtatcacatatatagctgggtttttggaagtgtgctgagattaggatagatagcgtagtgttaagagttcgtattgctcaggaccaaaagtatttgcaggttggtggtgcacagggccagagataccacagtcctggccagtatttggttgcgctaagtcttagttgcagcatg

SEQ ID NO: 3828 - DNA, 600 bp, Bovine  MMBT17210
aatatttactgttgtcttcttggcttattgagtagagtttgaggtattggragcttatacagtgcccaggggagtttattgccagctgggggaggttgttgaaagcttttacgcccttgcttatggctgctgagatgacttctgcagcctctactggaaacaatatggaaataatgagcccacgaggacagagagacatgtggactctsttttctaacctcaggtcatattgtgatatacagatgttttctacttcattttcactatactcagtaatggaaactgtgattcacaagagartagaatgagttttttctggagcagagaattcagagagtcagtggaccccccagaattgcatttaaatattgttttttgggcagatgtccarcttttggtgagaaagttcacagttttcatcaatgaaaatacaagtttcttgatccccaaagaccgagaactgtggctctcaataatagtattggagaccctcaaaagagtttcttattatattgtatatttaatatgtggttttgttcattatttactttattacagcatatcactcttctgtgttttaatctggaaccaggaactata

SEQ ID NO: 3829 - DNA, 600 bp, Bovine  MMBT15491
tggctgacggagctgctcctggggtctgggggcagtggaatggagggaaattttattaagcagtttgagctccacactccatatgatctgatgagatraaaaaggagcatcccacccyatcccaggaagatatcccttcccttgcagccacgttcaactaggtcagtccttttgagccctgacagcttgtgctccctacrccccagggaagggttaacagatttgggggcagggcccccctggggaaagtcccctgggaggtgtcccttctttgcttcttcarttgcatcaggcctccaktcgcctttcttctcagagaacatcatggcaagcgtggctgcakttctgacctgggctctggccctcctctcacgtgagtctccaacactgacttctccatggaggtgtgggtggactgttcttcctggaggtgtgggtggactgaggggttcctgagggaggaaacccagcccctgttcacctcctcttcacagtgctttcacccacggaggcacggagaggcttctgggactacttcagccagagcagcggggacaaaggcaaggtggagcagcagcagaagctggcaagggagcccac

SEQ ID NO: 3830 - DNA, 600 bp, Bovine  MMBT19353
ctctcggtgcgsagcacaggctctagggtgtgtgggctttcgtagttgctgcaggtgggctcagtagttgtggccacgggcttagttgctctgaggcatgtggaatcttgtcagaccaggggtcaaacctgtgtcccctgcattggcaggtggattcttatccattgtaccaccagggaagtccctatattcatatacaatttgattcacgtcaaaatatgagttgttctctacaagataygattacgtgttcttgagacttcatatagaaaaagatggtatccctgagccatgtctaamttgtctcttttctttcttaattgttatagttccactttacaactatgatacattcagcattaaaattcatttttttcttaataaacctgccccattttataaagaaatatgactatctgattagtgactttcactgagactattacagaaatattttattaatagaagtaaagaaacttattattacctggcctaatttttaaccattttgtaacatttgcattctcctttttctgcctctaccctctctgttcctgccagcaatccccatttcgttttaaacacaagtgaagaccactg

SEQ ID NO: 3831 - DNA, 600 bp, Bovine  MMBT20419
agttaaaagaaaaagtcatcttacattcctcatttttctgttcttagaggtactttattgcagttccccagatactgacaataggctatattactactcttcagagagtgttgctcaacatatgcacccatattttcagattgattgctgaatcatgccagtcttattcagacacattcaagcccttatatcttctaactgtgaaaaataaagcattatttacaatgaagaatcgttataatgcagtaatatttcactagtattcacagaatatacaaaaagtgattcacaacattgcaktcaaaatacttgtactgttcccttgactcactaaatctagactatttaagtgtcagcaaaggatccattttcaaagatataaaacagagcctctgaatgaagatgcaagcaacattcttaaaatgtggctatattctttgaagaagtgaaatataattactttattcttccattttaaacatgtaacaaccaggatgtggagtgaaacagggttcgttgctcctaaactgtcaaacaaggttaaaaaaaaaacaaaacaagaaaacaccacaaagtacctcacagcctaagtcaagcctc

SEQ ID NO: 3832 - DNA, 598 bp, Bovine  MMBT22855
  misc_feature (1)..(147): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaatcgtaaacaaatctccaatgccaagatgaaggggctttcctctgattcatgctcaggaagcagatggtcactactctcatgggataacagcaatattcctggtctttccagacccaggaggtcagtgatgattccactgattctcatstcttcaaaaagacttttttttcttgaccacatttatcagctataaatgggctctaggactcaataataccaaytcaagtcatgaaacagaattcttctattytgcttcatatggtttgttgctggagagacaaagatgccaccccacctggaatggcttcctcttggtaaaggagggttctctttgttgcaagccaaataaagtaagatgtayrctctgaaagacaagccacattctctggaatttcccaagagaamcttgctgtgcatttctgcctgtatatacatctgctgtgact

SEQ ID NO: 3833 - DNA, 600 bp, Bovine  MMBT20147
gagtgtgtgtgtgtgtgtatgtgtgcacatgcttatatataagtatgtattataatattgctactgcagattatattacagtatactcatatgattctattgtgaattccctgagcgtaggatacacattacaatcatcactattccccctattatttgttgaatcaaaacaacaaatacaagatgaaaaattaagcaaacataatgaatgcttccatttcaacttaaaatttaaaaatattmttatggagacaatactgaaggacaagttttaaaattcagatatttctaccatgcacracttttgtcatttccctatttcaatttaaggatttagccatgctcctacaacatatttgtttatgtaacagaatgttaaaaataggatttgtcatctctagttttggctaaagccccactagactggaacaaaacaagaggtgatgaatactcccacattccaaaaatgagatgctaacacttaacacctattcagagcctactcaccctctgctccctgcacttctgacttccgcgtcacaatctgggccaggtgccctctttgcaggtctctgttatggatattatcacactgtactg

SEQ ID NO: 3834 - DNA, 600 bp, Bovine  MMBT20195
ggggttctccctcctgctggccctcctgcaggggtcaggctgggtgtgggcagggtggaggcatcgccagtcacctcccccacgtggtcccgctctctcggcagctgcgcaccaagctgtcgtcgcaggagatccagcagtttgcagcgctgctgcacgaataccgtgacggcgcctcagtgcacgagttctgcatcaacctgcggcagctctatggggacagccgcaagttcctgctgctcggtgagcgcggggtgggtgggctcccttaggggtggaggccagccagccagcaagccragtggttcttccratggcgcttcccagtggctctggggaccctgcccccagggaagcaggaggggccccttgggagccagactcggggtgaggtggccactgtactgcccggtaagggctgagggaggctcttcagaggaagttggtgcagggacaggtttggaggagtgggcaggaacttgctgggcggaggagtgatgacaccattcccagggaaaagcagctttagctgaggccccgagagcagagcctgcagagtcagcagggcggccgggtactcagtgcctgccacagccagcc

SEQ ID NO: 3835 - DNA, 600 bp, Bovine  MMBT22917
aggctcctctgtccatggaactttccaggcaagaatactggagtgggtggccatttcctcctccagaggatcttcctgacttctgtgtatatgaagggtgtttgaatattccttgctcatttttatgaaataccacctttaatcactttccttccattattcaagatattatttcactaacttgtttttactacctagaatatacttttgaattttccaaaggtggaagattaattgccagactcctgccttaagttccagctttacattttttgagtgacggaaattcagtgtactttyggctgtttggcttagctgaataaactcttgctgttaatacccaggtcttgccaagcatcgtatagaaaagcattttcaggaaggaaatggggaaattgggaagatttgactttttaaagaaataactttggaaggcagtttgggtggaatgagcaacggtggggctgttttatggattagctgcaaagcgtttccaatctaaaagtagggtaacatctcctgaaaaataaaagttatataccatgggcccttgacatttgtaaaggatatattccacagccttcaaaaccctctaaattt

SEQ ID NO: 3836 - DNA, 600 bp, Bovine  MMBT20686
gcgtgcaagacacactgcgaagaaaaggaaaacattcaatgaatcaaaaattcctagcttggtaaatggaagcatggtagcagcaactagaaaaagtggaaacagcaatgttggaagaaaagtaatactggaaatgaatttaaagtgatgttgggatgtccatgtaaaaatgttgagaaggtcattggaaatattggcttatatgttgagaaaactgccagggtgtccttctttaatatagaaaattgaactggttggctgaagtcctttgatttccaaattccatttggcaaagaatayatttgaggtcatggatcaaaagagatttttttttttaatgtacaaaagctaagaactacttttttgtccccatcctagccctatctcagaaatttaatatctactttcatgccattttcatttttaagagactttttggtaaattaaaaaccagactttttccttttaatataataaactgtattggaagaatccattttagaagaagtttaaaagaaaatatattagcttagagaatgctttttttatttactagaggtgttaatatcttctttttgctgaggcagttttgtgttcatt

SEQ ID NO: 3837 - DNA, 598 bp, Bovine  MMBT18929
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacttgccagcctggggtgctgtgaggttgcctagaagcctcttagccccgggtgctctggtgctgggagcgatggagcagatcagccggtgcttcctggtcctgcttctytgatgtttgccccggtttcagaggacmggaagtgttcaggtttcaggcatcctgcttgcaggccgtgagctttygtacatggcagattgagcctcattcaggtgctcctgcctgtaggcctaactccctctgcctgactcctcygtttcctcccgttggctcctggatcaccaaaagcttctcttcagtctcaccctgccacaggagcagttgaagttckgagttgagacctaaacatggatacggggggatggtttgtggggagtgtggacctgcattctgagatgggcatctctctttaagggcmgcrgtggccaacttaagaggcgaccagaccaacacacctcccccaaccccaccccctgtttgctt

SEQ ID NO: 3838 - DNA, 600 bp, Bovine  MMBT20128
cggcgtcgccctcgctgaccctctgagacggcggctgcccggtgacgagcgtccgcctcctgctgctcctgtccacgccccgtggcccggggcccccctgagaggggcgtccgcgaggtggagaagctgcgtgccaagtgccattactactgtacacggacccctgccgccatgcccgccgcgtccccgccgacggagaaccgtggcatcagggtaacaccgtggacctctctaggtccaaagcagccgtggtgtyatcaggcgtcccaggcctcgctgtcagtctcctgtctgccgagygcactgactgtgaaacagtaccttttttgttgttggcaagccacaggtttgttctgcaaaaggccgattaatgaaattttaagaaaaaaggttcttttttcaataaatggtttattttaggaaagctgttatgttgtctctcaatggttttcagcttcagagccaacacggtatccgtacagaggtctgcccttgtcactgcggtgtccctcaacagaacgggcaccgtcaggccttcaggctctagagttgcctcgctgcagagcaggagagaaatgaaacagcactaaggatgtcgga

SEQ ID NO: 3839 - DNA, 600 bp, Bovine  MMBT14707
accccatggactgcagcacgccaggcttccctgtccttcactatctgccgaaggttgctcaaattcatgtccattgagtcagtgatgccatccagccatctcatcctctgttgcccccttgtcctcctgccctcaatcttccccagcatcagggccttttacagtgagtcggctcaaatggccaaagacctggagcttcagcttcagcatcatgagtattcagggttgatttcctttrggactgactggtttgatctccttgctgtccaaggggctctcaagagtcttttctagcaccaymgttccaaagcatcagttctgcactcagccttccgtatggattgtaatccagaatgatgtctaaatgcttgtgggccttcctttcttccttacagtttcctgccccgctctgaatgcccctctggatggcagaaagtttggaagcaagtacttagtggatcatgaagtccattttatgtgcaatcccggcttccggctggttgggcccagcagtgtggtgtgtcttcccaacggcacctggacgggggagcagccccgctgtaaaggtacggtccctccttcccaggggcctgctggatg

SEQ ID NO: 3840 - DNA, 601 bp, Bovine  MMBT20553
  misc_feature (1)..(1): n is any nucleotide
ntggctcaggcagattaaggcagaggggagagtaacattttgctagtgaattcaagatggttgccaaaagggaaaaagagactcctgactagaatgcggactgttctttctctcccttaaaattcagcttcttctccagctgctggtttttcctcttcagtcagagatgtaaagagcgttcagaaggaaatagatgagaaacttttttttttgtttttttttaagaaaattttgttctttaatgacagtgctcttgcctttttcaggagttgctgctcgctccccgaccaattttctgaaytaaaaatttagagaactgcccctagtaactatgtaaatataacggttaatcagacttgagaattaatttttaacactttcataatataaatagtggggagctttcctttgaaagctggcagttaatagttatgtggatggtgctcaataggaaaagaatattttgaagaaaaaaggtttatggcttaagtgttgaagtcataatctccaccttctttcaaaatctacagttgtttatcttttgaatggtagcttttctcttgttccctagaacttgggtccttttaagacctgccactgt

SEQ ID NO: 3841 - DNA, 600 bp, Bovine  MMBT18720
tgcccatggcacccggtgattgaatctgctgtcaccagcatcctgataataatgaacacccaggctcaacgaccgtgattatgattatcataattgatgtgcaggagcagtgtgtggggatcattacagctgaactgtacatcagagaaacaggcctcagttatgggtaattttactcttatgcattgattgggataaaatatgcctttctctttaaacagaccagcttcatataattttaagaatctttctgtacacgctgatggatgattatgtrtctgctgaaaacagcccccgacygttgttagttttgtgttgtttcgtttcattagcaaatgtaaacaattaaataattmagtgtaattgagggaaaatattttgcttaggaggatggtcttcaataatcaaatattcagttyaagtgctttttctgtctctctgacgatctatctgggactgaagttcttcagtgttctccctctgattatccttgtacctgaattccagaggtcagcaaccatcagggaaaatataagcgtatacagttttttattataaagtattgtgcatttgaatatgcatacatttttgcatatactc

SEQ ID NO: 3842 - DNA, 600 bp, Bovine  MMBT20393
accattagtagtaattgttggctacatactgattttactggaaaatctgataggtcctaagaccatgacccttcctcctcrgatgcctattatgccttaggtcatggaagtacttcagtacgtcatcaaggcttccttcccaaaacaaaagcagtacagtatagttaaacctgagcctctggcatattccacctasaggrgggattggtctccctcgtcctcagtcctttgctagatgccatagtgctggagratgtcgcccttctattggaccttttagatacttggggagccccgagratcaactgagtgratgttaaaaggagtttgtacartttggatggcatcacagttgatggagcccatgggaaagctgttgctattaattccttaagcaggatgtttcctgatcaagggcaggatctgagggttggcactcctggccaaactccacacagttatcttagcactatatgctctactcaacagtcaattctctctcacattttttctgactcttgagccatggccaatagttggttgtctggtcctgccagtgacagcaacaacaacttacccaaggttaatcctttaggtaaa

SEQ ID NO: 3843 - DNA, 600 bp, Bovine  MMBT20392
ggaaacttttgatgcaagaagttgccctccttgatcctatgctatacaccattagtagtaattgttggctacatactgattttactggaaaatctgataggtcctaagaccatgacccttcctcctcrgatgcctattatgccttaggtcatggaagtacttcagtacgtcatcaaggcttccttcccaaaacaaaagcagtacagtatagttaaacctgagcctctggcatattccacctasaggrgggattggtctccctcgtcctcagtcctttgctagatgccatagtgctggagratgtcgcccttctattggaccttttagatacttggggagccccgagratcaactgagtgratgttaaaaggagtttgtacartttggatggcatcacagttgatggagcccatgggaaagctgttgctattaattccttaagcaggatgtttcctgatcaagggcaggatctgagggttggcactcctggccaaactccacacagttatcttagcactatatgctctactcaacagtcaattctctctcacattttttctgactcttgagccatggccaatagttggttgtctggtcctg

SEQ ID NO: 3844 - DNA, 600 bp, Bovine  MMBT19518
ggctcagatggtaaagaatccacctgtaatacaggagtcctgggtttgattcctggtttgggaagatcccctgggggagggcatggcaacccactctagtattcttgcctggagaatcccatggacagaagccctggtgggctacagtccataggatcgcaaagaatcaaacatggctgagtgcctaagcacagcacagcacagccatcattgtcttgaaaattacatgggaatctctgtcactcaatctatagttttttctaatacttacagaggcttgaagaactgtattttgtcctrtatgggaaaatatggttctaaataatggggatcttaaccatggaccacgactgagtaacytcactttcacttttcactttcatgcattggagaaggaaatggcaacccactccagtgttcttgcctggagaatcccagggacagggaagcctggtgggctgccatctatggggtcacacagagtcggacacgactgaagcgacttagcagcaacagcagcagccatggaccatagatcttaaccttaatccaaacaaaatgtcatttaggcataataacctattgtatcctgtctgctct

SEQ ID NO: 3845 - DNA, 598 bp, Bovine  MMBT22593
  misc_feature (1)..(37): n is any nucleotide
nnnnnnnnnnnnnnnnnnnnnnnnnnnnnnnnnnnnnctgcctgatttcttatctgtgaaaaagaagcatgattaacagtagtctgctcatgaagctgtgaggacagaatgaggcataacacatgaaagcttccaacagcgaccaggcccaggctaaacattccataacaccatctgttattattttccaatttctctagttttcactgagtgctccttcatctgttttccccattacaggaacttcaacgtgtagaacaatttgcctagaagtcacttatttatgtttcttccactgcraggcagagaggtggtatttattttttgtatcccccaaagccctttcataaatctttatgtaactcaatattcaaagtgttcatctctgaayacctctgattttctcttcaatataatcaacaaatatttaagcgaagaatgggaactaccttgtaagtcctcagggtgaccatatggggcaccaccatcaccctggcagggaggctctgggaccttgagaactggccaggcctctgactgctcagccagacacgcatgcctcacttcagaacgcctccacatcatggccgttcccaac

SEQ ID NO: 3846 - DNA, 600 bp, Bovine  MMBT18904
ataatatattcagatcattctccagtaatcagggatgctcaacactgccttaagacacagtaaaatcgccatcactggaggtcaggtgtaaagtgtgcatgatccttaaaaagacagtatttcttgaatgtcttaggaggtagacttaatggtcttgaagacctgctctagtcataacatcctgattctatgggttttttggtaagaacttttaatggcttatacaaatagagttacagatgrtggaatctcaggatggcagggaatatatcttggagcatgaatgsctccaaccaactrcatctttttaarttttacttggawaaactatcaaaatatgacacctgcagccccagagatatgtttattttacagttaacaaaagagaaggcaactgtttctgaaagtgactgttttgcttcaagaatctcaatctaaatgtatgtgtctcatgggaaatggagaaagaatatatgctatggacatctgttttatttttattgcatttttgccttttttcaaaataaaacacatcattggaggagtttaccattcccatttccatgtagcttctgataggctgtatttaagtattttgac

SEQ ID NO: 3847 - DNA, 600 bp, Bovine  MMBT18917
catttgattattttggactgcctttaatataaaattgttagtttggcttattctgtgsaatcagtatctaaatgggatttgacttttaaacattttgaggggaaagtaaaaggagtttatactaccttcayttacttgctttttagttcatagtttatggcttattgtacaatgtaagtcaattgaaagtattgtcrttatagaggctgacaggatagttctggctgggacccacagaatggttgtaccttgtgaagaactgagatctggggttctcactctyaactttgcacatttagraactgaaaaatgattaggctttttggggagatgatttatattaatcagactcacaaaagacttactcattcactgtcagtccatttgacatactttcactgaactgtgtgctggcagctcttatgggataagttattctaagccccaaatgattttatttggccttagtaagaattataatcgaaatcctaggccacaactttcaaaaatacttagttagaagactattgacactatgatacactcagaatgcagagtttgttatttttattttattttgttttttattattttattttg

SEQ ID NO: 3848 - DNA, 600 bp, Bovine  MMBT19430
cttcagaaatctattcctagaagaagtgttatgttcccatttaaatggaaaaccggaatcacttgttataaaaagaaggatatctaataaagagtaagagaacatcaataattaatatgtttagtagttgctattgcctggtgaaggctatgagcctgaacctgtttttcttttgttaaaaagaaatcttagtctaggagagctaagagaggtggtaaaggttttttatctccaacccaagactttctctttgatggaatcacagtgattgaaaacaggattgaaaaggaacttagcacrttgtttaatgctgtgcttgctggactaacaacatcagctgtctggtgtggtgggtaccttgagccataagatgtggtcgtgacttgctcagcccctgctaattcggtaggtgggtgggcacgaaagatgcaagtcttcgctgctttttttcattgtaactgaatcgaaggtgttgacagggcacttgtaccttcttgaataattatgcaacagcaaatatgccaaaattcttcctgctgcatttatagctacagctttgcagggtgttaaaaaagcatggcgtgctaccagttatggtgt

SEQ ID NO: 3849 - DNA, 598 bp, Bovine  MMBT20778
  misc_feature (1)..(82): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnntcctaatatacttttaatactgaaattggcttctcctattgctgctgggatacttccaagcaagctccccttgccaaacggccagtacgtttataggaatagttagctgaattctcatactctcactcttcaaggagaaaaagcacacctttcaaactgtgtggggagaaaccctcccagtggcctcttttttcttatcctgaattaagcattcctgrtcctacagaagccattaaaggcctgcttctgctaattcctatcagactstaataataatgaggataataataatgctgttcataatagcattgtaattagatctctggctccccagcaaactcagacttttgtttacaagtgaatactggcttcctttaacccattttccaagattgcattaactgttgtattaatgagatatgtttcatgatgcggttaggtgctaacccaagatttgataagagttaataaatcttttggagaaggcaatggcactctactccagtactcttgcct

SEQ ID NO: 3850 - DNA, 600 bp, Bovine  MMBT19233
agaacaaaagatacataacatgcctttgtttctgaaaaaaaaaaaatacattcagtaatttcctagtgtaacacatgtccagagaacacactgattatctttcaagtgtgttgtacttcaaatggcatgacctttagcctgtgaacctgaaatgatcactcttttgaacatcatgggcactratatcatgttctcctacttgaaggcacattaaccagaatgattcatccattcatttcattattatttatgcatgtgtgtgttcaaacttttgtcagttgtttccttcccattgactakgacccagacagtactgtcagtatgaatattttcatgaacaaaacaaaacagaatgcaatcactytgtttctgctttaagtaaagtcattcttggttttgttttgttattttatcaacaaaatgaataaatatatgatttataaaaaagaagttgatccaacatcttcatgcagttattctgtacatgagtttgtttcagtttcaacctctgcttattcaaatattaaactcttaagtctctggtcttatcactgtgaatcatgaaattatttcatactataaacatcaggaggatgaaaa

SEQ ID NO: 3851 - DNA, 600 bp, Bovine  MMBT21838
tactttggycacctgatgtgaagaactgactcattggaaaagaccctgatgctgggaaagagattgaagatgggaggagaaggggacaacagaggatgagatggttggatggcatcactgatacaatggacatgagtttcagtagattctgggagttagtaaaggacagagaagcctggcatgctgcagtctatggggtcataaatagtcggacagcactgagtgacagaactgaactgaactttctacagcagacactttaacacacataaagtaagaaaggaagtatgagaatatttrtataatgaggagatgttaataaaaccatttgaaacattcaaatacagaatgtactgatttgtaawctgtagagtgccttcacaattaacatacattcatcataatatacaatcattcagtaatattagtcatagctactgtaatactttggtactacttatattaatattaatatactaattactaataaactgtcataaatgaccattgtgtaaaatgatattagggaatattacctagattttgcatttgaatcattatttcacatcatctctggtattttaagtagatcctgactta

SEQ ID NO: 3852 - DNA, 600 bp, Bovine  MMBT22261
atacggcacaatgtggctacttgtgaaattttagggtaaagtttaacacaagccaagacttcctcactgatggatatgccttctattttcacagagctattacagaattacatgcaattctgtctgtaaattatttagttcagggcctggmacacagtgaatgctcaataaatggtagttttaaagaggggggcagygcagaacaagatggcaccaggtaccacctgcagtttaggggtgctggcctcagcatcagagcgtttgtacaacaaatgaccatctgygttgtgctggggatasggtggtacatggaataycaaacaaatcaaaaggtccccatggacctttttcttyaataagttgggtcttaactcagaaaagcagaagaaaaagcagctccacttacgtgcagagaatggactggtcctcccgatctgagaacaaaaacaaamaagagccacgagttagaatcagctctgagttgagggtcaggacatgctgccgcccagggctcccatttaagctcacacaccctggcccctctgggggtgacaaggggccagctgagctcattgcccagggcataggggacaagrccaa

SEQ ID NO: 3853 - DNA, 600 bp, Bovine  MMBT22259
gagagattttcctgaatactgaaaatcctctgagtgattctaaactgaatgtcttctgactatgtatccaggtcttcaaaaaaataatgatacctaccaccaaatacggcacaatgtggctacttgtgaaattttagggtaaagtttaacacaagccaagacttcctcactgatggatatgccttctattttcacagagctattacagaattacatgcaattctgtctgtaaattatttagttcagggcctggmacacagtgaatgctcaataaatggtagttttaaagaggggggcagygcagaacaagatggcaccaggtaccacctgcagtttaggggtgctggcctcagcatcagagcgtttgtacaacaaatgaccatctgygttgtgctggggatasggtggtacatggaataycaaacaaatcaaaaggtccccatggacctttttcttyaataagttgggtcttaactcagaaaagcagaagaaaaagcagctccacttacgtgcagagaatggactggtcctcccgatctgagaacaaaaacaaamaagagccacgagttagaatcagctctgagttgagggtcaggacat

SEQ ID NO: 3854 - DNA, 600 bp, Bovine  MMBT16644
aaaatataaggccaaagttaataatgcaggcaaaaattattagagtcctgcagagcaatcctaatatttgcttcagtagccaaaggaaacccaatatgatcagcacaggaattttgacctggtctgttttccaacctggatcagttcaccaccccctcccaactttagacaacaggtggttcccagctcyccagaggtcatcatattactgctgaacttaatgccaacacctaatcacacctatagcccagaactcctaggttcaagcgttccttctgcctcagcctcctgagtagctcygtatacaggctgtaccattctgcctaacagtgaaagagaaaaccagataccagttattaacaagttcatggaatctagaaaaatggtatggatgaacttattagcagggcaggaatagatatgcagacatagagaaaaatgacttgtggacacaggggagaaaggaaagggtgggaccaactgagagagcagcactgacatatatgcactaccatgtgtgaaatagatagctagagggaacctgctgtatagcacagggagctcagctcagtgctctgtgatgatctagagggaagatag

SEQ ID NO: 3855 - DNA, 600 bp, Bovine  MMBT05218
ctgattttaggactggtgttgccctaggctcccctgagcagccacccacatggtgagcagttgtcctacttttcaggattctaggcatcctgtgcctttgcccaggtaatcctgcaggaccagtagggctctgggattctagatctctacactggtacagccactcacagagagggcaggcctcccaccccagcctccctgagatgtgtggtgactcaccagattgtaggtaaacactgtcccaccccactggctaaacactaactttaacaattagattcctgcttcacaaactaccartggggttaggctagggatcacaatgtcaatcactttctttctcaatttgagaagaaaggggaaattccttgcaaaaggaatgcaggtataattcagacaktgtaacgttctcttcaagacaacagcagccactctctagatgcacagaacattttatgatttatcaggaactttcaaagacaggatacaatttgattgttacaggatttatcattattcccactttatatataaagaaatcsagaggcccattcattaatataataaaaatcatggctctcatctgggcacatcgccacg

SEQ ID NO: 3856 - DNA, 598 bp, Bovine  MMBT09575
  misc_feature (1)..(96): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagttctgcacgtaatttttctgctagtgcttgtggtgtttcattgtggagaccctgaggtgtttcacatctgtgtgaacaagctgcctcatttcagcctttcctgcacctccgtcatgtaggagtgacccttgacacattccagattatataggctttagaaaacaaagttcaagtctctgacctcaactgtccaaatacayggaggcatgaaggcttgttgttggtgactagtgtgctggtttactatttttagaatccttttcatttctttatagttttttttttagccacaggcacccaggttttttgtttttttacctacatagttgatcagttactattcagtgaggctactagaacaagatttgtttaccttttgraaagtgcttggctaaagttgcttctatcagaaaggagaaggtagctcrttgctagaaacgatrgtgttttataaatatgaagtgatagtctgcatgctgggaattgctgattatctgg

SEQ ID NO: 3857 - DNA, 600 bp, Bovine  MMBT03270
ttgagatgaaaattgggcagggcagggggttggggggaggaggaagaggctgtctcttccaagaggttgagattaaaaggcatgtaacagtacaaatgttgcgatccatttttttcactatgtaaagagagcttggctgaagatgaaatcaacagagagggacacagaaatagagtgacaaacaaatagactgaccacaggacctcatttaagtacttggataaagctattcctaaagcatgaaaagaataacagaaattacataataaggtaaaatggttgatttcattaatattcagytattttggaaacaaacctatttgcagaatacagctgtaaacctaaattttgtaacaccacacatcaatagtccttgtatctttttttgtatgccatattcattggaattaaatttatgtactttacctagtagctcagcttgtaaagaatccrtctgcaatgcaggagaccccattcaatcaggggtcgatcaggagtcagaaagatcccctggagaagggakaggttacccaccccagtattctcatctggagaattccatggacagaggagcttggcaggctacagttcatggggttg

SEQ ID NO: 3858 - DNA, 600 bp, Bovine  MMBT07367
ctcccttataagccagtgttagctgggtcttttgcagtctgcatcttatctaatccctggttcttatggtcttgggagtattagctttgtaaatgtttttctacttttcagtcttaaagaggaatttctgagagaatcgttttaaaacttgtccactagaggtcactgttgggatacttttttccccccttcctcctcatctcatgctaaaagattaaaaaccaaattggtgttgttagaggacgaaawttttttgcaagcttctctcagggtatgatgttgctgccatttacataggcyagttttgccacaattaatgttgatccttccataaggaggtatgttatttttcttttgactcccaaacttaaagtacatgttcagtttcacgtgtcatgtttagtgtttattatggtttctttctcatgttagaaactttccttccaatctctttaaagtgagagaattctcttgccttttatgtattttttttgtatggagtatacataaaatttttttctcccttggaagaaagtttaaaatatatatgtatggaaccagattttaattaagaaaaaaagtgtaatactcaggaaaata

SEQ ID NO: 3859 - DNA, 587 bp, Bovine  MMBT07774
ctgtgcagagcccgtttggtggcagccagacaatcctctggactcaaacggaaaagtggtagtaagttctgcagtgagctaagagcctttatgatggtcatgccatgccagaccacacgccgatagggtgcccacagtgccacctccttcagcttcagctcttctaggtcctctaaatgggcatgcagctgacacagctccgcctgggccctcaccacgtctcgcaggaacttggctggtttctgacgccgtgggccctggagcagtagcatcgtcagcagccgctcctacaaacagttmcttattgcatggayctggtccttctccacgtagatccccgctcagtgacattcatctccacccccatactgggccccatcccaacccacagactgaatctccaagcacctcaacagcccctgcagcttcccaggagtccaggaatctgacggtcaggtcccaccagtgggtctcaagctcaggacgctccgtgcataagatttcccgcagcatccgttcttctaggatttctgtattcacacccaggtccagcacattcagccccttcagcaattcacagcctagca

SEQ ID NO: 3860 - DNA, 573 bp, Bovine  MMBT15427
tttggtggcagccagacaatcctctggactcaaacggaaaagtggtagtaagttctgcagtgagctaagagcctttatgatggtcatgccatgccagaccacacgccgatagggtgcccacagtgccacctccttcagcttcagctcttctaggtcctctaaatgggcatgcagctgacacagctccgcctgggccctcaccacgtctcgcaggaacttggctggtttctgacgccgtgggccctggagcagtagcatcgtcagcagccgctcctacaaacagttmcttattgcatggayctggtccttctccacgtagatccccgctcagtgacattcatctccacccccatactgggccccatcccaacccacagactgaatctccaagcacctcaacagcccctgcagcttcccaggagtccaggaatctgacggtcaggtcccaccagtgggtctcaagctcaggacgctccgtgcataagatttcccgcagcatccgttcttctaggatttctgtattcacacccaggtccagcacattcagccccttcagcaattcacagcctagca

SEQ ID NO: 3861 - DNA, 600 bp, Bovine  MMBT07369
gcttttttatatggatttactagcctgtagggcccttttgggaccgcaccgccatctccaaagctcatttcaatcagacccacgaacgagaggtgaaatgataatgtttcaggccatgcaggtcttcagctcaatcttgccatcaagagattttcttcaatatgttatttgacttcatccactcagcacagaacaaatatttgagggatgaaggaagagaacacagtcatattttcttaagggtgattatcttttagctgagaatagctatcaggggaccgacatttcataatcaccacratctcctaataacttgcactgtggctaaatcagatttgctctgaaatgaaggattagcagagtttcaggtgctgagatagcaatttgatgtaagctgctattttctgcagtttaaaagaggtgagagtggccagtcgaatgcagaatgctgacagctgcttggaaatggatctcttctattggatgattctttcttgtatgcagaatgctactcacaagctacagacttagaaggtctaacggtttgcacagctccttagactgccatattgggactcatgtagaatttaaaccacactc

SEQ ID NO: 3862 - DNA, 600 bp, Bovine  MMBT13021
ttacaccagtacacatcagaattacctggggagctttctgaaagtacagatttataggcccctacaacctgaagtcctcaagtgattctgaagtatagccaggtcaggtgtagataacgaacaaagagtgtagctgaaaattgtcactaaaaacagagtattaactgaattatagtgacctggcaactgtattgtttttaaataaggttttaagcaaatgaaacaaaaattgaacctccctaaagaaaaacatacttttgattttaaattataaactgccagttaacatgcatttcactsattcgcttctttcttcctcatctttaaagattcagaaagttgtgaacaagaagttgagagagcggttctgccacagacagaaggaagtgtccgaggagaaccacaaccaccacaacgagcgcatgttgtttcacggtgagcacccgctgtcatcagctctgtgtttgcgaactccaggaaggtgaaaagcctgtggcattgattgtgttcgtgttgtgttaaaaatggtttttatttatctttttcattacatgttggtaccagctttctaaagcattacatgtatgggctttccaaggc

SEQ ID NO: 3863 - DNA, 600 bp, Bovine  MMBT20107
tatgaattttttcttggagcatcctttctgcttttaagatcatcattaataaatataaagttgattaaacttatgttccatagacttgaatgcagagaagaatgaaattgcttaaaatgtgcaagttctatggacaaaggattgtcttcagaggctgagagcagacytgtctctatatcaccagagaacctccagagccagggagaaatactataggactgttccattcttgattcctgcccayagcctgattatttgtgaaattcactaggattcattcacactgacaattctgaaaaraaaagagaagaatcttgcagacatgcagagtgggtgttgcagggagaagggggggcggatatcacatgttacagtgaaagtgaagtcgctcagtcgtgtccaactctttgcgaccccgtggactgtagcccaccaggttccaccgtccatgggattctccaggcaagaatactggagtgggttgctagttccttctccaggggatcttcctgacccagggatcgaacccaggtctcccacatttcaggcagacgctttaacctctgagccacacatgttaagggggtaccaaatgccata

SEQ ID NO: 3864 - DNA, 600 bp, Bovine  MMBT20109
ctattcatgtgtatatatttgaaatctctcataatttaaaaaattaattctaggtttatgaattttttcttggagcatcctttctgcttttaagatcatcattaataaatataaagttgattaaacttatgttccatagacttgaatgcagagaagaatgaaattgcttaaaatgtgcaagttctatggacaaaggattgtcttcagaggctgagagcagacytgtctctatatcaccagagaacctccagagccagggagaaatactataggactgttccattcttgattcctgcccayagcctgattatttgtgaaattcactaggattcattcacactgacaattctgaaaaraaaagagaagaatcttgcagacatgcagagtgggtgttgcagggagaagggggggcggatatcacatgttacagtgaaagtgaagtcgctcagtcgtgtccaactctttgcgaccccgtggactgtagcccaccaggttccaccgtccatgggattctccaggcaagaatactggagtgggttgctagttccttctccaggggatcttcctgacccagggatcgaacccaggtctcccacattt

SEQ ID NO: 3865 - DNA, 598 bp, Bovine  MMBT20110
  misc_feature (1)..(20): n is any nucleotide
nnnnnnnnnnnnnnnnnnnnagttggacatgatgaccacacacctgttaggtatatatgtgttctttacggtaacttctattcatgtgtatatatttgaaatctctcataatttaaaaaattaattctaggtttatgaattttttcttggagcatcctttctgcttttaagatcatcattaataaatataaagttgattaaacttatgttccatagacttgaatgcagagaagaatgaaattgcttaaaatgtgcaagttctatggacaaaggattgtcttcagaggctgagagcagacytgtctctatatcaccagagaacctccagagccagggagaaatactataggactgttccattcttgattcctgcccayagcctgattatttgtgaaattcactaggattcattcacactgacaattctgaaaaraaaagagaagaatcttgcagacatgcagagtgggtgttgcagggagaagggggggcggatatcacatgttacagtgaaagtgaagtcgctcagtcgtgtccaactctttgcgaccccgtggactgtagcccaccaggttccaccgtccatgggattctccaggca

SEQ ID NO: 3866 - DNA, 598 bp, Bovine  MMBT20925
  misc_feature (1)..(145): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccgcagttctggataaagcccttgaatgattaaaccgttccgtaggacatggtctttaaacatttttaaatttgtttcaagattcttttcccaagaaatgattttttttttccgtttcgtgtttgcaacacgttgatattttgattttgaaragttacagtttgatttaggttgcggttttgccaaagttgactaccttttataaggccacaaaaagcacaattctgccctgtagttttagatgtgaaatggatgggaggatcggaaacttagtgtaactgaacttcagccagaaattttcttttcttgccggcaagttctattgtggccccaaggttagacagagtattgctatgcacaactaatttgtgatctaataaggatgaaaaggagccatctgtccccttggctgaaaggtattaatggtttctatgggcttcactatggaat

SEQ ID NO: 3867 - DNA, 600 bp, Bovine  MMBT20927
cttctattggatgattctttcttgtatgcagaatgctactcacaagctacagacttagaaggtctaacggtttgcacagctccttagactgccatattgggactcatgtagaatttaaaccacactcttcagatctttaacctggtgatttgggctagtagaaatttgcagtttctgattttcagagatttccgaagatgtttgagttttctctggatgcagtactccttggttcataggaaaattaatttctcgcctatatgagatggagacaactttacacactcaaataaacatgcrgtagaagagatttcttccatatacttgcttttgcttatagagcctccaggattcataaacctcagctcactttttattgtagacaactaagaaaattttagcctctatctcttgaatgaaatgggtcttctgtgttataaatgatttagtgagaactaaaaaatatttatttattcttgactttgtgatatgatgcaagtgatggggagaaatgaaagaataaatgcttcttttaaaataaaataaccctcaataaaaagagttttgagttttccttcccacttttcacatgctagacat

SEQ ID NO: 3868 - DNA, 600 bp, Bovine  MMBT13818
tgtattttcacttatatctgagaccaatgactgatgaaaaatactttcatgaaaatagaagttcttttgctttatttcttgcacagtggtagtcataatattgtataacatataattaaattcacttttaaaacaaacagtagctgttattggggtaaatgtagcccatgctgctcttcttggtaaggggggtgtttaacggctgaaaaacttttgttttgaaatgtgcatgtgaaawgttaatccaaacctctgaataaggtgtttgcagatgtagctagacactataakacacatgcyacatacatgaagacctgtggtctccatttataggcttgcatgcatacttccaaaacactggtttgaagaacaygaggagcaaagaaaggaggtgaaagaaaaaaaaaagctcatacaaaattcttgagtttcctggaggcaacagcagctccttaaataaagcaacagatcatgggcagaagtttctacaacttcccagtgatagagagatacaatggcttagcagtaaaactcacaaattaaccgcatatgcagaaggggaacacatcctcaagagtattaggattaatgatccgcaag

SEQ ID NO: 3869 - DNA, 600 bp, Bovine  MMBT14352
agagaacagggtttctggggctgcccgggaaagatctgagatactcgggacaggcccctggggacggggggtgggggggtgtcacctggccctggagcaaaatctccaggtttggtttccagcagcagaagaggcctcctcaccctggcctggggctgtgggctttccaccctggagaagcttggaggacggggcattgtctccaaggggtcccatttgggggaggggctgggcaggacggcttgaagctgtaggccagactagggatctgcaaaaaaggtctgggatagagatgggcaytggggtgaagtgagagaggctgcagraaggaggggagcagggctgtcttttcccgtagggcctgtaatacagctggaattgagaggcctgtgggtgtaggcytcagcggagggagagcacatcctcggagagggtgggaaagacaggaagaaagccgtggagcttgcactgcccttctcccagcacagcaggcagcaagagagcaggcggagttcacttgagagggggagagagagagagagagagagagcgaaaacgacaaggagacaaaggagagcagggaggacccaggccactgtg

SEQ ID NO: 3870 - DNA, 600 bp, Bovine  MMBT09233
gtcagcaagtccatgtaccttcaaagatagtcaagtagcatatggaaagtgctaaaggaattcaagggaggaatgattactaaaggatgatgtatatagtaaaactttagagtgaaggtcgcctttgagctgtgctttgaagatagggtagcatttagataaaagatgaaggaaggagaagacattttaaataggagaaatgactaagagggtaggaaacacatgtgttatatggggaacctgagcttaaagaacagaaggctcctttgtggagtagtacaaggaaaggttgaaaataasattggtggtaagtctgtgagaagatagaatttcaggctgaagaatttgatcttattctgaaatcagaagacacctattaaaaaatcttgttgggtagtgttggtatgtaaatgatattttagaaaggttcrttagcrttgttgtggagtttcactgcaaggtggagggatccatatggttgtcatgcaagtgtatgtgcctcggtttttgtctcatcacaacaaagatttggagtgacrgacattaaagccccctcgacgtgtcacagctctcaggtcttggatagaccatgttatagct

SEQ ID NO: 3871 - DNA, 600 bp, Bovine  MMBT02520
cttgataggcgtgcagggctcggcttcttgtggcaggaaggcagatgtggaaggcagaacagctgcggactggtgccgycagcgggtattgttttcgtcacaatttagtcaggccactaaggctgtgaggaggcctttgtatattaggctctggttaatgaaaaggtgaactcactggsttgattccctggagggcgattaggagggagatggttctccttgcctttacgtagtcctgagggaacagaggaaccaggagcaaatccaagttcccatggagccaagggacttcctgttttrtaagtaagggaaagatgccctcctgcaaacagtgaattagaacattgaggataatgcagtttttgttctcctgttgattctctaaaatcccactaagaaactaggaatttccttgtggttccaggtaataacagtaacaacggttatattttattcagcaccagttgtgtagcaactgattggcaaacattatttttattttttaagattttatcgaagtatggttgatttacactttgtacagcaaagtgattcaatatatgtatatatatgtatattattttatatttgtttccatta

SEQ ID NO: 3872 - DNA, 600 bp, Bovine  MMBT21366
gaggttgcctctatgagaagtgttcaaaggaattgggagagttcacccagggaaaaaagcagatttgggagggtacaatccatatgttccagactccacagggatagagaaagagatttctatataatgtaagcctgactaaaatgtcccctttgaaccaggctggggacttccagagccttgctcctgcgatgcaggcaagcactcttttacagtcagacctcttgagattctttgggggaaatgccataatacattcctgtggccctggagaccgaactggtacaggtctcagctgcrtctcaagaaggaggttttccaggcagagtggcccctggagggagtgagctcctccatccctgtgactgtgcaaccaggtgctggctcccttccatcgaggaggccacagatgggattcttaccctgggaaggaattaataatagccaccatttatttcrcctcttccatgtttcaagctctgaactaagcatattattttcattgcttctaaccctcaccacaaaccctagcagtacatrtgacccatttcacagatttcacaatctgaggcccagaagtaaaatgacctacccaaggtc

SEQ ID NO: 3873 - DNA, 600 bp, Bovine  MMBT01018
tttttttctacatgacagcaccactcagtagggacctagtaattctagtcatgcagttcatcctcttgtaatatgaagttaaaatcaaattcaggcaatattttgatacagcaaatcttggtgtagttgtaaaaacagctgcaaaattagcctaccaagaatattttaactttatttctctttcaaattctcagttattcctttcttccattttattgaataaaactattccatttgagaaatacctgaatgcagatttaatgtttacacatgcactgccttgaatgatatattgacacrttttaaagatattttttcagtgttctaaaaactgcatatttgaaaatgtgattgaattttattcaactatttgagtttctaattgtggcatatttagtttgcatattatgcatttgctaatttctttttggggagttttctctactctattgtatacaatattggtaggaaaataactggtttatggggttcatttttcctccctccagaatccccagtacaggtgagctgaackgaccaatatttgcttgactaggcagactgtctcctaggacttcataacttgtgaaagtaacataa

SEQ ID NO: 3874 - DNA, 600 bp, Bovine  MMBT10721
tacatagaaatcctcaggctttcccttcctctccttcctcacactgtctcccagtccactaaatgtagtacaaacttgtattactctctcttccagactagggtggggagtgtggagggtggttgtacaaacatctatagaacatactgtcttcccttgtgttgtctaagaagaagactcccttccacacacacaagtcaagaatttgagtgccagtttatttgggaggtaaacctagaaaatatcagtgtgggtatgtggaagtgacaggaaggggcaggaagtcaataaagggtatgstcttgccaagaagttatcagggtcatttattcatttatttaaaataataaatgcttccyggagaaattccagaaaaaaatatatagtgacaaaatgtgaagggtctgaggttctgccctacttgtacgctaytaagttagcctgccacagattcatactcatggaagctggcagaagacagggctggaggcaaaggaatgtrtcatttgtggcacagctggcagcccctrtatctcacaggacaagggagaatggcccaggtggatgctgcttatacagtatttatcaccaagtcccatc

SEQ ID NO: 3875 - DNA, 600 bp, Bovine  MMBT14310
ctttcaagtacttttgtactgaaatttggacttggagactaaaattcacactgctgctgctgctgctaagtcacttcagtcgtgtccgactctgtgcgaccccatggatggcagcctaccaggctcccccgtccctgggattctccaggcaagaacactggagtgggttgccatttccttctccaaaattcacactagtgatacacatttgagctgacttccactgacatgggcttgggggtcattggaaagtgtccaggcaggggttgaatgcccttcctcagaaatgctgccaggagyttcctgtccagggtgaatgctggatgagatggcctcaaggtctccatccatctccaagttgctgataaatctctcctcatgtatcactggcttgtccgtcctgcggcacatatcttccagatgttgggagagaagaattgagtagtcattaataaaaccacagctgccaactctcagttttatttgatggatgacagagatatttccaactcatctttcttcccagttttaagagaagagggataatgaggtacaggctaatgtggggaggacaaagatgggaacagggtgagagccagg

SEQ ID NO: 3876 - DNA, 600 bp, Bovine  MMBT19726
agttaggagactgaggaaaagactaaggcaagaatacaaggatgttcaatcacaatgtacacacgtatctttgcttttctatgccttgtgttatatatctacaaaattagaaatgtagatgtgttggactgaggtcccatctcgtcaaatattggaagatttcagcattcagagaagggagaggatcaaaatataaaaaatgcagatactgttctggctatggcccaatgcctggatmtcctatgatagcatacttcttaaacctggccctttatgatcaggccaacctgtgttcaaatyatgactctattattctgttactaactgagtttgaaaaagttaccaatatctctcagctgggatttcctcatcatggagatgatagtagtccattccttatggtattttttgaatactcaattacataatacacttaagtgttagtcactcagtagtgtcagactctttcgaccccatgaactgtagcctgccaggctcctctgtccatggaattttccaaacaagaatactggagtggatttccatttcctcctccaggggattttcccaacacagggatagaacccaagtcccctgcat

SEQ ID NO: 3877 - DNA, 600 bp, Bovine  MMBT22450
tcctgtgtgactctggaccagttccttcaactctcaggacctcaatttccrtatctatagaatggggatattaaaagatagtcttcaagctcctttccatctcggggaaagctgtgaccctataattcaactctgcctactctgggtacccagaagcctcgcctggagataaacacacaaagaagtaaataagcactaggatgcctcyagctggaggcaggctagcraatgtaatttctctggccccagcttgtcctagtggtcccagtcatccctgtcctaaagaagggtaagagtaaycaggtgtggcagagaggtactgtccgatgcactgtcctctgagagctgacatccagccttttttccaggctctcgtgtcctagctctaggctcaggcagggtggggaggtgcacagctggcttgcttccctccagccagtccatggatagtggaccctatttcctgccctgtgtagcccccataccatctgatcttgccatccagagaagacagtgtcagatagcccaaacccaagtgggaaaggatgaggactgctggtggagagcaagcccacagaccaggcactgccctgtctcaga

SEQ ID NO: 3878 - DNA, 600 bp, Bovine  MMBT23202
agcacatcctcggagagggtgggaaagacaggaagaaagccgtggagcttgcactgcccttctcccagcacagcaggcagcaagagagcaggcggagttcacttgagagggggagagagagagagagagagagagcgaaaacgacaaggagacaaaggagagcagggaggacccaggccactgtggaccagataagacaccacggccaaagcatgggcttagcaccaacaccatgagggttagaggcctggtactcctgctcgttagccaagtggcgttggggtaaactgcttgarcctrcacctcagtttccccatctgtaaaatggagctaatgatgctggtgttaccagcctccccaggcagttgtgatctcataatatatgtgagagaggataaaaaccctaagcaggacatcaccattagatgttttattattcttacaaaatattatcagctacctcttcccacttcaatttcacaaaagtctcaggatgtgggcacagccagggttattatgcttgttttatgaatgagaaaacaaaagcttagagaagtgaagtgatgtgcccaaggtcacactacgaacaagtggtagaga

SEQ ID NO: 3879 - DNA, 600 bp, Bovine  MMBT07217
tctaaaccctactgttcattctaggtccttcctcaaattttagccttgtattttaaaccactcaattgtcattctataataagcacactgctataaaacttcttctcttggtggtctagatgttaagtttagccttccaccctgagatttcaagcccactgatgcccacttgaggtccctaccatggatattctcaagtcatctgcccatctcagtcaatcagtgcctgtatatgcccttaacagaaattatcagcatcctatcccggtgtattcagtgtaggaagagctgtattttagrtactgtcacaaaggaatgagtggaaacaaaagaagctaacattttatcaacccctaaactaacccacttgtgatctgagttcatatgtaagttgtagttcattttagttaagcccatcttcatggtaactggttaattttttgctaaagtgatttatatccatttcctcttataaaatcatctgcccctcccataagtccttttaggcaattttaatccccawtgttttctcttgggacctatttccttcggctttcatactttctggtatactgaaatagtaagtaaagcttccaaaag

SEQ ID NO: 3880 - DNA, 598 bp, Bovine  MMBT13972
  misc_feature (1)..(54): n is any nucleotide
nnnnnnnnnnnnnnnnnnnnnnnnnnnnnnnnnnnnnnnnnnnnnnnnnnnnnntcagaacggtatatacatcttgaaatgtatatacaccttgacctagcagattcctcttcaaggtttattctttggatagaaatttggtaatatcgatcaaagtttaaagtatacataagttttaacacagtaattctactttataggaatttatcctagaaaaaaatatatgtactcatacttgaatagaatgccatatgaataatactatttgttccagctggcttagtgaaagtttaaagattstaaacaccttaaatatccatcactgggagactggttgaataaattacttcccacagtattctgcaatagttaaagagaacttaaaagatccatatgacctgatatggaaagatgtttatgatgcaagttgtctgatttctttgtataaaaaaatacaaggtatatatgtgcttatatagtcagtagaagcttctgaaaagatacacaattaaccattaacagcagtttcttctctagggaatgtaactgaaccattgctatataaacattgcttccaaatgacaaatgtgctcattta

SEQ ID NO: 3881 - DNA, 600 bp, Bovine  MMBT18196
ttattcattgttatgctgcagcatcaagatctgtgctgrcacacaggaagagctcagtgaactcagtactggctgaatcattattagggttaatctttatcatctaatatagatcagaaactgtttgccagcctcctcatcaagtgtgtggtccagttggaactgatacagaccatcgacaacatcgtgttctaccccgcgacaagcaagagggaggacgcagagcacatggctgccgcccaggtgagggcgggccggagaagagcgtccttgcccgtggggaggttgtccgggtgcggygatgtgctggagccaccttgggttggccgccagagcccctcacgctcacttccccagccctgtgttcagcgacaagggtactggtcacttaatactggccgtgacgggagtgtgtaccccacagaaatcaccaagcactgaaaatcagcctttcccagagagccggtttaccagcattgcactgctgagattccaccccttgccttggtgcttcaaaaaaaatgtgttattaatcatagggactgctccttatcattgatacacagttaacccgtaactgagaaggaaaacttaagtggc

SEQ ID NO: 3882 - DNA, 598 bp, Bovine  MMBT20177
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgaataatggaatgcactaatgtgagagattgtgaaattttcttcagtagagatctaaaaaattaattgctaaactacttcctgggctcttccttaaagagtgtccaagttcatgaattggccaccaggggtcaccagaagaattgaaagggcttctgaggcaaagccataatttcctgttcasgaagaagagggcaatttgtaattctattgttaaagagacttctcacttaaatatttaggattcttttgtcccttcttttatatttaaartttccttgtcccttatttttgatcgtcagttcttgctgcactactctgacctatatgtcattggtagatatttttctttttaattaaatatataaatgcttttttgtaaggtattattcacatttcaaatattagcccatcaccaaaggctgcctttaagtattcagtctaacatcttcctgttgttcttttatattacccatttcttt

SEQ ID NO: 3883 - DNA, 600 bp, Bovine  MMBT20920
aactgcatctcygtagggtcagatgggatggggacggggagtrggggagaaagtgtgttgggtcagatatggggtcaatgcagaggaagtgagcatttcagaagcagtcccaaccagaacatttcctgccgattgatgccaagttatttggaagaaaggactccggctattttagtttataaacccttgataaaggtccttgaagggrgtggctaaatcttttagccattcctgagtagagttggaatttattaattcatgtatctaaaaactaaagtmcatacaaataatggaattgtyctaaaataatgtttaaataactgtttaactttgctcaaatatctaccttcccaagagcagtttgcttaactaagtaaattgaccctggtgccttatgaagagcctgagcagctcatcatctgattccaggaatagttttccagccactgaattatgcatatttatattcagaaaagccattcccagcccctctccgtggtgactcactatcttctgttctcagtcatccccagcttgttagaggagatggtgtttctgaatggtggaaacgtgggagattaagggtrgatgagtgaccgg

SEQ ID NO: 3884 - DNA, 600 bp, Bovine  MMBT22122
tgggacatatgaatctacctcacgggattctttgaaggatagatgatgtgacattttgaaagcatttggtaaactataaagcattatataaacgtaacttttccttgtactggtcaaatgacagaattaggcagggtgtctctccagcacaaatactatataacttagttatcatttgtgatcacctagaatgttccttgccagactaaaaagtttaattatacactaaatggtaaccagctgctttaattaygccatttccttacctctcagcagtgctccttctcatttatttccttkctttttaaaaattgttttattgtaaaagtagtgcatagtccattaaataagatttagcataatggagaaaaggaaatgtcagccagggtctcatcacccaaacgcaaatactgtgttaacattcctgtgcatttacttccagtttttttccccccaatgcagactttaaaaaattggtaattgcatttccaatatatatacaatttttatcctgatattttataatagttttaacattttatatatagcatgttatatttttattttacatataaaaattcaaatattgtatctgaaata

SEQ ID NO: 3885 - DNA, 600 bp, Bovine  MMBT22313
acaaaagatactttctaatttagatgaaggaagtaaaataaaacctactttcaccacgagcaataaatgccgcctcttgcgttttatcttcttttcacagcgaggcctgcctagtggcctctgaactggaaggaggtaaggaaaggaagttgatactttctgaggccacctatcttattatccatgtttgtcagaagctggactgaggagggggttgcttcctggaagaccttgacaggctaaggcagtgacaggcagattgccagggaggttgggaggccttgccccaaattgaccacstctctttctcctttgatcctagtttgagagcctagagaaaggttttgggaggtttcctactctttaactgctcatatctctggttaattgcacccatccccactccactcttttcttccagtgaatttgtatctatagtgcttaaaacttaatgaagaagaaaaatcataattcactaagaaattaattcaatttgwttttaaagctctggcagcttgtgatatgaccgtacttgcttttcttctttgaggattgaactttgctcttgggcatagctctatttagactcttctcaccact

SEQ ID NO: 3886 - DNA, 600 bp, Bovine  MMBT02165
tccactgagcttcaggttatactgtatgttagtgtgtttgaaggagaggagagggccagaaaaaatgctctcatgtgggatgtggagaaaggtaagtaaaaccgtatattcatccagctttcatgtaggcttgtaaataagtagcccacatttaccagcccacatatatcttacgacttgtcagatgctatgtaacaactttatagcaagattgaccacataagccagtttttctgttttcttagttatttcatgccctaagtatggatttcaaaggacttctttacataaccctggccrctgtaggattaaactgaaagggaagagtagaggatctgattcatgcttcagaaggtaaaaataaagaaaagtgcagcatagtacagtaaaaactctttcagacttgacagcaggaaatcttagtttgatcctaaatctccaataatttgcaagtttgagttatcttggtttctcacctgcaagatgagcacacgattattagctttgtgtaccttgcaggcttgtcaaaaaaaatgaaaaagaaaaaaatggacatgacatgatcctgtttgattatgcatgtctaacaaccagtaggca

SEQ ID NO: 3887 - DNA, 600 bp, Bovine  MMBT07468
aacctcaataatgatggtgaagcaatattaatcacagatacaatagaatttaggcaaatggcatttgggggtaatgggaattcactatcctaaaataattgtctgcaattatgagctggatgttcttgaatagcatagccctggagtatcaaaaccaatattgtatcaayatgcataaggcaaaagcgaacagaatgataaaaaattgcaaagctataaccataatgtaagattttaattcacttctatataaacagataagaaaattagtagacagagaatccaaacactatccccctkcataatctgataaataaatataccaccttggaatcattgttggggcagttctctgaaaactctggtgsacagccaggctggcacttctttctgatggagatggctttcttggtaacagaagacaaaartcactgtccttcaaaacctaagaagtaatggcactgacatgaagtaactagaaacctgtctgggtggcaggctaagtgtcatgttctgggttagtgctctgagcctcaggattcccatctggaaaatgggcatgggaaccgtgtgtggtctgctaactgggagtacasactg

SEQ ID NO: 3888 - DNA, 600 bp, Bovine  MMBT08283
aagctcttgccgcactacagcaaggaagaggggaaataaacagaagaccacagaatcagagttgaaaagacagtaataaaaatctgggaagtgtgaaatagctgtaatttgtaaaaccaaatagagaagaggggagagctacgctaaaaggaatatggagttatagggraaaayattccatcagtctacatacataggggtcccctaacgtctttgactgaaggctaagctgcacatgagtagagtcagatatacggccagaccaaaacacagctgtgagagtcaagttctgaccagtaragtagagaatagcatcaaacattcaagacattcagtaaaaacacaagagttgaagtctcaaaaagatgagctgaaccacaagtaacttacataactttaagtaaaacccactgtctttaaaggaataaaacagaatccagatactcaaaacacaacacaayagtgttcrgcattcaataaaatattatatgacataaaatcagaaaaaataagacctatatcataagaaaaatcaatcaatgcaacagatccagaaatcatatatgacagaattacttacacatggactgtgaattataa

SEQ ID NO: 3889 - DNA, 600 bp, Bovine  MMBT12536
ccaactctctgctgaccccacacaacaatatatgagttatgccaacagactttctactaagttatttacaaaatagattttaattttagtaactaattttatcaaaattgttagaaaaataaaagaatatatttcataacacaaggaaattatataaaattcaaacttcagtgtccataaataaagttctattgaaacacagtcacatccattcgtttacttattgtctatgactgcctctgtgctacaatggcagagttgatttgttccaacagaaacctatgatcatcaaaacctgartatttactatcgtgccctttatacaaaaaatttgctgatgcctggcctgaaagtaaaagtcagtcgtgtccaactctttgcaaccccgtgggctgtaacccgccaggctcctctgtctgtggaattctccaggcaagaatactagagtgggtagccattcccttctccaggggattttcccaaccaagggatcgaacccaggtctctcacattacaggcagattctttatgatctgagccatcagggaagcctggcttaataggtttaaatcttgtaaccaaaacaaataacaaacmaac

SEQ ID NO: 3890 - DNA, 532 bp, Bovine  MMBT14243
ctgttattcctaagcagctagtcttgctgatgggtggaaggtggaaataaccttgcctctgttgctaaggttattttgagctgacttgtgttaggctggcacccatcatttgctttgtctgcaagggacaactggaatcccagagagagagagagagagtgtgtgtgaatgtgagtgggaggaagcgaaacatttagttttggtattggcttgatttttctgtttcgctgttgacttggcatgcctggctttttcattctgcttttaagtatccagaaatcttcaggtctgtgtgaattrgaaggtttggatttaattgaatttcatttggcactgtgggaaattaactttaggtaagagttactttttrggttggcttaatgggaaatagatggggaaacaggggaaacagtgtcagactttattttggggggctccaaaatcactgcagatggtgattgcagccatgaaattaaaagacgcttactccttggaaggaaagttaggaccaatctgtgtgtgtgtgaagttg

SEQ ID NO: 3891 - DNA, 427 bp, Bovine  MMBT17069
aggagaagagaagactgtaaatgctaaaccattttgtttgtttcttaagttgttgattatcccacaaggttggtgtgacttggaaaaacaaaaggaaatctagaacaatgacttcttatagaagtgtccattgtatcatagatgtrgttcagaagaacagaacattttaaagtcttggcaagtgccatgggctttaattaaattggattactttaattaaataacataaagagacatgctgctcagttttcagagtagcacccctgttcattcttactgagtctagatgaatttgaagarcagatcaatttccttttatgcaactgagagtatgaaatatctgtggggaattcagtccatacacccaattcagaattttaggttttagagcagatcacaatgaaaaatggggacagactctttggga

SEQ ID NO: 3892 - DNA, 600 bp, Bovine  MMBT17801
tagagaaagacaaatttttacttaccttgataattctgtcttttgcttgtgctcggtttaatttagcctgcttcctggattccatggcaactctggggcttgcagcctatggctatggcatccgatatgaatatggaatcttcaatcagaagattcgagatggatggcaggtatgtgactcatatttttaattttgtcagtaaaattttgccttgatgttctggatgatttataatttacagaatttaacagagggcgttactaatgtctgtagcatttgattgacatctgtgaattctrtcagtcttcccactttgcgatataagctccrtaagagccgagagcctgccagtgtcaccagtatcattcaccaccagatctatagcatcttttacagtgccagactcataaggatgctagagagtcatgaagatactygtcaccgagtacctgaatgcagaccacctgtaatgggcagtgtcctatctctgcagcatgcaaaatggaggagcatgtcttttgactcatgatctttgccagtagcccttgcaggtaggaagcatgtcaccatttttgtaggtgagaaaactgaggctctta

SEQ ID NO: 3893 - DNA, 600 bp, Bovine  MMBT18514
caaacgtctctggtaaccagacaactgggcatatatacacagaaggcatgtctgggcttatacacatcgggcagctgagtggacgtagctcctgcccttttggaggtgacagtccgcctgtgtcctgaacggctccctccagctctccagccatcacctttccagtctagcccagccttcaccttgatcgccagtggcttcctgtctccaaccccacgaatgttcctcacgtgctcttctctacactgaaacaaggagcacagtttaaagatacaactctgcatttcttacgtctgagtygtcctgcggctgttcatgtctcggtcttgtgtttgtttcctctgtagcatcacagtctgtaattattatcttttaaatatttatttatttggctgcaccaggtcttcattgcagcaggcatactcttagttgaggcatgtgggatctagttccctgaccagggatgaaacttgggcccccttgtattgagagcacagagtcttagccactggaccaccacagaaatccctcagtctttattcatctgtttactggcttaggtaaaaacagaagctctgaaaattatggcaaattgaacat

SEQ ID NO: 3894 - DNA, 600 bp, Bovine  MMBT20948
tgtattatgataaatgcttcattatagtgtgataaatggtcttgtggatggatgcacagaatagggatacccaagggcacacagcagagagaactaatgcttgtcaagggttgaagatagcaggggcttataaactaagagaaggcaagttccctcaaaaagtgggacagtcatcttgaaaactatgaacgaatccattttcgagaggcattgcaggatcagtattaggaatatgggttttgaaatctggatgagtctgactctgtcacttgttgactgatgaatttcaaagcccctaamgtccttctactcccctttacaacgtgactttgcaactcctccagtcgagaggtaagagtctgcttctttactccttgcatctgattttgccatgtcgttttctttgtgacacaagcagaagcttgagcactgggctgtcctctccttgggttcctgggaccaccacaggcatgtcccagcagcctgttgttrgatcagagactattagatgcggcagagcgctcaggtttttttgtgagcccagcaagactcacggtagaatctcccagctcagtccacccagttgcttgcccacagact

SEQ ID NO: 3895 - DNA, 600 bp, Bovine  MMBT21668
ttcattatctctcctcctcccatcctgaacctccattccatccatcctgtatctactgcagctaacctgttcgtggttcaactacaaatgcactaaatgataacattgagggcatgaatctgccataccttctttaaattcccagttgttagaggttgtactataatactcattttrcatttcgctccagagaaaagaacatggaagctctccccttatgagatatcattgtcgtttcagagtgtggaaggagaacaccatgaaaaagccgtagaactgcttaaggctgccaaggacagygtcaagctggtggtgcgatacaccccraaagtcctagaagaaatggaggctcgctttgaaaagctacggacagcccggcgtcggcaacagcaacagttgctaattcagcagcagcaacagcagcagcagcaacaaacacagcaaaaccacatgtcataggtaagaggtgccctctacacaaggaagccccatatgcacagaatttggtttttttaaaagtatagtttcttagacagctggaatgtaatcattagatttaataatccaaaaaaattaatcaaacaaaaaacagtgacctca

SEQ ID NO: 3896 - DNA, 600 bp, Bovine  MMBT23126
aatttgagtgccagtttatttgggaggtaaacctagaaaatatcagtgtgggtatgtggaagtgacaggaaggggcaggaagtcaataaagggtatgstcttgccaagaagttatcagggtcatttattcatttatttaaaataataaatgcttccyggagaaattccagaaaaaaatatatagtgacaaaatgtgaagggtctgaggttctgccctacttgtacgctaytaagttagcctgccacagattcatactcatggaagctggcagaagacagggctggaggcaaaggaatgtrtcatttgtggcacagctggcagcccctrtatctcacaggacaagggagaatggcccaggtggatgctgcttatacagtatttatcaccaagtcccatcccccattggctggggctgttcctggggcattcattctgtggcatttccagcccactgatcatccaccatacttagttgccagagccagtcctgatcaaaatgtggagttggctttgattgacaacctccccttcctcaaactttccctaaggtgattctgtctccatcttccccaggagaagatgggtccacaccttcatgt

SEQ ID NO: 3897 - DNA, 600 bp, Bovine  MMBT03350
ggagaaatagtgactcaacaaaattaaatgacttacagaactcagaagtaattcccaataccttactttcccaacatataattaatttttctacaaaaatattacttaatccaaagtaatatagactttaaagacacctcaaatgggtttaattcctcaaggaccagtctgaaagggttccatcagatagtctgaacaatcttagttcaaccaaacagcaaaacaatttccaaaaccataggtaggtgatggatactgctttcatttcagttaattaaaaatatttgatccactatggtrcatctcagtgtaagatctttaaaagacaaaaattgattaatccatgcaagcttcagacaacacctaatccaaatgccagagcctgtgctcagatttaatcaagctctggatgttatttattgatctacccaaaaaaaggtgtttttttgttttccttctacaaaggtacttgagtaatgggtaagctatcaaaactagcattaattcctattatataatgcattgattttttgcaaacactaggtaggaagagactaagaatagtttatgctattcaaaatgtcaaattaaaagaattag

SEQ ID NO: 3898 - DNA, 601 bp, Bovine  MMBT05251
  misc_feature (1)..(1): n is any nucleotide
naatccagaaggattatcttctgaacattctagcttattcctccaagccctcctgtcaccctgctgtgctaaaaagcaagacatcagcacaggctttaagttgtgtgactgttgggatcaagtcagtgctatgtatttatttatttacgtaaggctgcrtcttacattttaagttcatgaaatcttcctatcttgcctagtaaatcaaatcaaaataaaattttcagcttgcaaaatacattcacaagatggcyctttttcacytgtctgatggggccagcctgaaattatttacatgtgygccactcacttcctgggtatctgtaacctgcttttaaataccaygctggctattcagttcaatatagcaaatttctggaccagctgcttcttctttcagtggctatttatttcaaagtaaacacattaacattctttgaggacaaggaatkaataagatgaaaattggaggaaaaaatcggtgcctttcaacaccagagtcagtcagtatgggttgaagtttatttctttacatatggcggtacagtagttgaagaatctagctttattctacttaattgcctttgtacctttgtggaaa

SEQ ID NO: 3899 - DNA, 600 bp, Bovine  MMBT01310
aaggatgtgtgggtccttccatggcctcttgacacccccccatagctgcatgcagcatcccttaccattctcgtcctcgatctcagagggccctgtgaagatgcggttggacaccttcactctcccggggggcccgaagtgggggccgtccactttgccctccttgcagaggcgggtcaggatctggctgggcttcatagggtcccgccagatattgtagccgtgtctgtgggaggagacgcatggcctgggtggggcttggggtgtggctggggcatccccaggtagtaagtggcccckgccagattccttaggttggctgttgccccatgtgagcaagtgagccctgcctyatgctccaggatcagctgagacacgagggctgctggaggctgatccctcctgccctgggctcgggccccacatgctccatgctcctcaaggacgagcatccagtctccccgagtgcagccgcaccatccccctgactatgtccactcctctggaacttcaaagactccctgaagaaactgacaaccagagaggttaaggggctggcccaggggtcacacagcctggaattggcaccagctggccaga

SEQ ID NO: 3900 - DNA, 600 bp, Bovine  MMBT11152
tttaagtattctttaacatctattccagtattcattcgatcatggagaaagcaaggtaattccaggaaaatatctacttctgcttcattgactaggttaaagcttttgactagcaaactgcagaaaactcttaaagagatggaggtaccaaaccacattacctttctcctgagaaacctgtattcaggtcaagaagcaacagttagtactggacatggaacatttgaatggttcaaaattgggaaaggagtatgacaagtctgaatattgccattctgcttatttaacttctatgcatastgcatgctaagtcgcttcagtcatgttcgattctgcgacactatggrctgcagcccaccaggcttccctggggttctccaggcaagaatattagagtgggttgccatgctctcttccaggtatcttcccagccagggatacatcatgtgaaatgccaggctggatgaagcacaagctggaatcaagattgctggagaaatatcaacarcctcagatatgtagatgataccattgtaatgacaaaatgaaaagagaacctaaagagyctcttgattagggtgaaaggggagagtgaaaaag

SEQ ID NO: 3901 - DNA, 600 bp, Bovine  MMBT19897
agaaagcctaagggaactgggcgtagtgcaggggctggcacaaccggaattcctatcctgcctttggaaggattaccataagcatctctcctcacactcacctccgaccttcatcctcactgttatctcatttcttccagaggcgccaaagaccagatcagcctcccaaaccagagcctcaggaactgggtcccctcaatggtgacacaggtgagtagtcagccctataaatgtcctctctgacatctgtgaggcttcctactttataatcaacaaacacgatatggctatttaattatytcctgrgattttacttcggttrctttaataggagtatcatttctaagatcagggaggtgatagttcttccctgatcctggctattgctaccacacctggagtgctgagtttatttctgaaaagtacattttcagaaaaatctggaaaaggagagactacagtgragaagaatcaggttgatgaggaatctggaaaccatgtcctttaaggaacaggtaaagaaacagaagatgttgcgataaaacacaacagttctctccaagtgactcacagagaagaaagatgagccttgttcagtgt

SEQ ID NO: 3902 - DNA, 598 bp, Bovine  MMBT04406
  misc_feature (1)..(210): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctatgtgcatatcaaagctctttgctatgcgttttgtcactcggtcctcatgtcatgttgtaagggacacatttagaggacaaaatgygccccaaacttttagtagtttggtccatgtcccatggtggtgtctgagctgactgatggtggttcagaaagacagccctgactccctgttctctgagcagaagctcacagagtcgagatctgggcattcctcacacaygtgtgttatcatggacagatgtgttatcatggacagatacactgtatggggtgtttcctggaatgcacccaaaatggggtccagcatgatcaagacctggaccctgccaactcatcttccacacagaaaccagggtgactgttttcttccaaaaaactaa

SEQ ID NO: 3903 - DNA, 600 bp, Bovine  MMBT04525
cctaaaggactcacagactcaggtgcccagatagtgctaagttattattctcttttatttatgttcttttttattaatttgttaaatagatgtcagggaaacaggatggggtcctgccaaaacaggatgaggtccctcatgggtcattatgattttaaggacattctccgtgagtacacttctttttgcaataagcttctttttctttttataaaagtgggaagagacatcttctactgtttttcactatgaaggtagaatcttcacttaacatatggataygcacaattgacaatttayattctatccttcacaagagyrggttccttcaaatgagaaagtttactcmttcatcctatgccacagggaattgtgagccccactttacagatgaagaaacaagcagagaaatgttaagtgacttgctcaaggtagcatacttagctggaggtggaactatactgtctagatcttgtgatttctgtgytatcattttttaaatagagaattagagaggaaacaagatctcagagaagaagccagtggttctcaaagtttggtccctgccctagcagcatcagcatcacctgggaattcgtt

SEQ ID NO: 3904 - DNA, 600 bp, Bovine  MMBT03299
tgggcacatgcgtgcatgcatacgtgtgcacatgtgcatgtgtgcatgcagtatgtatatgtgtgcactaggtgcacacacatgtaacggaatgtgtatgtatgtgttcgtgcattcatgtatgtgttgtccatatgcatgtaaygtgagtgcacatgtgtgcatgcatgtaacataaacacgtgtgtttgtgacatatgtgtataatgcatgcatgcatgaacgtgtgtatatatgtgatgctcatgtgtaatggacatttaaactgtttcaggtttttactgctatactgttgtcctkaactcaccatcatctgtctctttgtatatatgtcagaggactgttagaagtgggatcctgggatgtaasgtcgtgagcctgaayggaggtgaatgtgtttatttcatttatgggaagtttggcttcctcttctgtgtcacctcatcttttggcccattactctctggagatttctatttttccttattaacatcagggaatttcttatgttttctgtacccaaatcttttctcaggaatgtgcattacaaaaatattttttcaatctgtgccttacccttcagtttgttttggtgtcttt

SEQ ID NO: 3905 - DNA, 600 bp, Bovine  MMBT09960
gttgaaagcaatggtggggaagcctatagaaggggaaaacgggtggagaagatgttagagagggacaaatgagaaataagtgaaaattaactagctattgcagcctgaactgtaagtcatttcagagtggtctgatttctatataaatctcagctttgcctcttgagtgagtgaataagcctgggcaagctgtttaatctcttgtgtgcatgctaagtcatttcagtcatgtccaactctttgcgaccctttggactgtagcccgccaggctcctcctgtccatgggattctccaggtamgaatactggagtgggttgtctcattttactcatcagtaagaatgggaataataagacttttcctctaaaatttcgatgagaagatacagaaaatgcacatggtagggtctctgttaatgtccacattctttctttccttctgtccttcttgtcctcctattgaaaccaagatgttggcaagatgaggttcttttcacctgcccagtaagaggagagattatggaaagacacagtaagattgccttcagggacactgattgctttgatttgattgatttattgagctattcagtacttttt

SEQ ID NO: 3906 - DNA, 600 bp, Bovine  MMBT18256
ataagatattgcatatagttccttatgatacatagtaggtccttgttggtaatccattttctatacagtagtgtgtatattttaatcccaaactcctgatttatccctgcccccttcccctttggtaaccataagtttgtgttctatgcctgygagtctgtttttgtgtgtgtgctgtacagtatcatgtgtgtggaattcaccrgtgttgacaagtgtagctgtaatctactcccattcattgctgagtcatatctcattatattaatatgctccaagttcttatcattcttctgatgmgaaaaatgcaagttgttcccagggttgtgttgtttcaagcactgctgttaggaacattctcatatacacctccttatgtatacaggcaagggcttcccaaggcgaatttctaagggaaattgctggggtttgggatatacacatactttgagactgtcaaataggcttttaaaatatttatttatttatttggctgtgccaagtcttagttgtagcacatgggatcgatcttcgatactcattgtttcaggtgggatctaattacccaaccagggatcaaacccaggcactctgcattgg

SEQ ID NO: 3907 - DNA, 600 bp, Bovine  MMBT20929
ttgtcatctaatgtgtcagaaatgactagacaagcagtaaacataagtgttatagcaaaacttgtttctttttcttaacagactatttcttactagttttaacttatatatgaattcaaaattatagtgaacaagtaaatgccaggatatttgctttagtgatttcaataatttctttggtcaaaacattaaaacaaatgtaatgtttaaagattttatgcagatgtatatattgataggctctctactgaaagtgttattrtaaaggaattaaggaggatgttttgcatgaaaatattrcaatctcataatatgcaggcccaattataataaagaaaattaagcagttttttaaaaagcataataaatggaaacccttttctagagacataattgattgtgagatgaatgagaaaaattaactgtcccaacttgtaagaatgaccttcaccagtcttccaacacctttctgttgccaagtctctagttatttcctctttcatagattacttgtcgtgccttatgcaaaagttctagtgcatggcttgtacaaaattaaactatgaggggagaatatgcaaaataaattgtctctgtgtc

SEQ ID NO: 3908 - DNA, 600 bp, Bovine  MMBT02004
atggactggggtctgtaaatacaataggaacaagagacaagccactgctagctgggaaggtaaacagcacgacagtggaaggatggggtaagtggtgggtgggagccacgagctcagcttaagtgaggggggaggaatagcaaagcctcagaaggcttctggaggaggatatgcctgagctgaggcttgaagagtaagagccaggggaagaggggaaagggcattccggaccaaggaaacagcatgtgcagagcccacagagcaagaggtatcctcccggataggactggaagttcctcrtttccctgagctcctctcagcatcgcccgccagcccagccagggtttggttaggactggaagttcctcgtttccctgagctcccctgggcattgccggccagcccagccagggtttggtttctttatttgctttgactccttagcacccctgctgccctgtgttcattgtaagtgagcagagctggaccctctggaccctttgctggttcctgggagcatcccactgtacagaactccttgtatctcatgagtaaacttactgcctggtgcctcagcctgttgactgcccccagccccct

SEQ ID NO: 3909 - DNA, 600 bp, Bovine  MMBT02223
tatctatgaaatagaaagagactcacagacatacaaaacaaacttgtggcggccagggttgcaggggagagggatggcttaggagtttgggattagcagatgccaactattatatggagaatggagaaacaacaaggtccgactgtgtaacacaaggaactatattcaacatcctgtgatgaaccataatggaaaagaaaacaagaaggaaaaccaaacatacattgtctcttaaaagactctcataagaaatgacacacacagttgaccartgaaatagacaaagcaagtcacaaggcyaagcccgaggtctcagcggcaggagtgggagaggatattatacacagctcccctctaaggaggggcagcgactgtgtgtgtactttgaattaacaacccaatctccaactttaagaaaggacttatgaacattatgttaactaatatccattattattgcccttgtgatacttcaacaccgcaaaaatagaaagaactcatatcattcttaatttctcttttcaccagaaatcagagagaactccccctcagatgggtagcagggtatgactggggaatcactgatttcgtaacaacatc

SEQ ID NO: 3910 - DNA, 600 bp, Bovine  MMBT02365
ctggcatgcaatgcagggtcgttcctatgaagccagtgagctgagctgctggcatcaccctgcctgcagagtagaatgagccctacatcgctcaayctctggggcagccccgggttctctatgattgctgtttccatccactcaggatatgaagaggcaaatgggaaaagacacaaaccccatcccctacattttgccagtatgtagtcttgcctttcagcttggtttactcctttcctgaaggctcggcccagagtactaaacagagaggttattagctcagttcaaacatcagtcagktgagtggaaacaccyagcaaaccacttggatttatgaagcaactggcagagtcactgatgacagtggaaaagccattggccttagacacagcctcactctcttctccactgtgactccctcggtgtctatgtttgtttatrcagatggggtcttcatgtactggcttctgggccccagcaaggacccacacaatgaagcttggggacactgtggacacggcacagtcccagaacagtctgtcctttcactggccgcggtggaatgagcacagctctgtgagcgggcatgcagggcatcct

SEQ ID NO: 3911 - DNA, 598 bp, Bovine  MMBT06047
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnttgcgctcttgtctgctctgagagcttccaggttgccgtaaagccagactgtggctgcaagctatcgtgtagaattcccttttcttagcacaagcttaagtaaatctaaaatgtggaaaagttggggtattatatgttcataaaatattggaaatttcccaatcattgaatattgggtttagttgttttctctattctcagtgaaaatgtgttgctgaygtagataactactttcggtttctcaacactgtacaatggtgctgtacatactctggagttctttgaatgaagggaaatgagagagatctatgctggtattatggaatcatcatttacagtcactttatgattacaccattctgctgttttagggtctaccaatttccatgtatggaggcaccataataccctcccatcctcagcttgctgatgttccaggaggccctctgtttaatggacttcacaacccagatccttcttggaaccctatgataaaagttattcaaaattcaactga

SEQ ID NO: 3912 - DNA, 600 bp, Bovine  MMBT06361
ctacccccactttctttagaaactaactgactagtatattaaggagtatatataggagcaaactaaccaagtccattaaaagacagagctcatacacacatcttttatatgccaataaaattgattttaattagtgttctagatgtgctcaccgaaaacattgaactattgtatgatacatatatctccccactatgccatggtatttgaagcaaggaacaaaaatagccttgggtcttatcataattcatttccttattttactataggtttgaattcatttgccatagccaccttccktgtttgcttctttgccctagtagttcaaaatgcatgatattaaaataaattaatttgagactgaaattagaaagaataaaattgttttgttttcctcctaggagattcaggtatatatgtattataatttctttcccttccttttctttccaacagtctcctgtatatgcagcattttagtgattgttttattttgaactaataaacaaagacctaatttggcacaggttagtgtctccccggtggaaagagtgttagatcatgtcagtcatgatttcattttctgaaaacaactttaca

SEQ ID NO: 3913 - DNA, 600 bp, Bovine  MMBT06799
gatttgcaaaagcaggcagctgagtcttccagaaaattccgcatcctcaagcactaatgttcaattacagtgatcatatcatcctactaacttctggctcaattttttctgttttactattttgtgtcacattttctatttgttattgtaaaaaaaaaaaagctcacttttaagtactttatcaattttataggttttcctgggctggtttgtatccctaaacaccacagagaacatgatttcaacggaaaactaatgcatcaacttgcaaccatttgaggacacatttgaaaaaagggracttgttactgcacctaagactgaacaatgaggtaaataatctctcctctataaattatttgtaggtatgtacagtacaacagtctctcttccccttctacttcaaagtatctgaatagttttgtttttagcaaaaccttgctttggacaactctataaaaaaattaaaatctgttattatgtttgggactttaacaattaagtttagttacttaaaaccttctgaaataaacatttggtctgtaaatatctctgtytggcctcagtttcaagctaattaaaaaataacatgtactatta

SEQ ID NO: 3914 - DNA, 600 bp, Bovine  MMBT08016
gtccttcataggaaatagyttcattatttagctgggaagaccaaccacttagagaattatatcttagtataattattctgtaaatagtatacaaactagtgtttgtacaayctagtataacaacttagaggataacatcttcatatatcataaatagcattaaaaactagaatatatgacacgtaccttaacagaagggcaatggaaacctgcaaaaaaatgctttctcttaaaaacagtcactaagagataatgcacttattctaaaatcgaaatacaaattctaatgtagaaacataytcagaacttaagctaaactttaaaaaaaattgagtatgtgtatgtgtgtatgcatctcattcatgtgtgtgctcagtcatgtctgactctgcagccccatggactgtagcccatcaggctcctctgcccatggaattttccaggcaacaacactggggtgaggtgccatttcctactccaagggatcttccagacccagggatgcaatccacatstcctgtttcttctgcattagcaggggtattctttactactatcatctcctgggaagcaccattacaaagactttaaaaaccacaa

SEQ ID NO: 3915 - DNA, 600 bp, Bovine  MMBT10401
gacagagatgggtctgtgtagggagaagcaaggaggccagtggggctgaaactgagtgaaccagaggagacaagagatgagtctggagaggtcatggggccggatttgtggtgaagggtttggactttattctgtaatgggaaaactctctggagcattttgagcggatgaataatgtgatccaattacacctagaaaagctcactctggctgctgaatggggaatggattgcaggaggcaaaggtggaagcagggagactgggaaggagactacggtacttaatcactgtggaaagaasagtaattcaaaatcacacttgagtctgaatttctggctactctcatttgcctgctgtgtgatcttaggcaagttacttaacctctctgatcttccctctttttgaaaggtgggatataataataggtataaggctaaatgtgttttccatatacagtggatatgtgatcaatggcaggatttctatgctgagggccaatgagcctgcctgccacactatttcagccttggctgcaaatatcctagaccaaccatctgccaggactagccatcagccccagcccatgatcacagagaggtc

SEQ ID NO: 3916 - DNA, 600 bp, Bovine  MMBT12535
tgtctgtcacaatccccttgtcatactgaaacagtgcttgatccccctggagctgtgtgttccccatctgtcattcccaaagagtcctcctgagtggagacggaggaacttgctatgaggggagtggaatgtcttccttaaacacacggccgcgcctgcctttgacttgttccacatccatggaacaggaggctctgccactgcaaaagagaagccccccctgaattccctgagcctgggcacarctttgaaggagccacaggtcacctggggagcttattaaatgcaggttctaattcygagaactgacaggcttccagtgatccccacgctgctgccccgcactaggctccacggagctcaggtacttacgaatttgccagtcatgttctgctcggggccttcctgcacttcctttgactatcccctggtccaggctcttgtcggtggtcctctgctcacaccacatccccaccagacctgcttttctcctcactccagcagcttttaacttcctaggcctccccctcccgcctccaccaccaagtcaaggtccagggaggtaagctaagggctttgacttcattgccgcccccatcc

SEQ ID NO: 3917 - DNA, 600 bp, Bovine  MMBT13588
gcctgaatcaaacttaaagctcttacattcaataaataagcataaaatatgttcttaggatatttcttcaatctttgcacatctcaataatattaaatttttgcttccttttttggagctattaatatgaacagtaaaatttcactaattttttgaataaataaaaaagagaaaagtaccaagaatatattgtcrggtctagtggttaggattcagcactcccaccactgcggcccgggttcratcaccaggcaaggaactggccaatttagatccagaggctcatgccacagttgctaygggccttggtcagttacagagatttttattctgtgatcttggtacagggatccacactgtgaccttggtatagggctccacatacatgatcaaattatggacacaggtttgagacaaatattcatcttaatgatcccacaaagttcagctaaatacacttcctctttgaaccctcttcggatcatactactcaaagaatccgctttggtttcactgtgatctctgtttttaatcatcttcatttgaaaagaactgctttatgttgtagttattcaataccaatcttatctccatgactaa

SEQ ID NO: 3918 - DNA, 600 bp, Bovine  MMBT13871
tgcgtgaccaacacaattaaaatggttaggtgatgagaagtccttctaagaaaagacttttaaaagatcatgcccctttttaaaacatgtggatggtacataaattcatctgttcatcaaatttcacatatcagaaccaaaggtagtttcagaacaatcagaagccttctcttcaaggtctaactcaagaattattttcttcctttaggaagacttcctaattgtccagcacttggtcaccatttttccctttcctctcctgacacttgaattcaactgccttgtcagttagttaccatragatacagagtaacaatttcagttgctaaacataaacatcataaatatcctctctccagatggaaaggaagttttkttgttctagtaactctgaagccctgatacaagataggcaacatatctgatgatgatgatttctgtttaattcctcaacccaccttacaaayaatctgttaacattcaggaggaatttaagtgtaccgaagatatattcctaacctattcttaatggaagcctagaccgtgcctgcagtgtggatggractgttctgccgtatataacgagaacmccagcccaca

SEQ ID NO: 3919 - DNA, 602 bp, Bovine  MMBT15816
  misc_feature (1)..(2): n is any nucleotide
nngattatgcatattaactatgtttaatatgaactggaaaagaccctgatgctggggaagattgagggcaggagaagaaggggaccacagaggacgagatggttggatggcatcatcgactcaatggacatgggtttgagcaaactccaggagatggtgaaggacagggaagcctggcatgctgcagtccrtggggtcacagagagtcagacacgattgagcgaatgaacaacaatctgagtcgtctraagaaaagtgaagatttggagtctggctggataccctttccatgggctcttccygtrgacaactctgtctcatgaatcatattccatccagaacctatctcctcccctgtatcctctctcaagttgttgtctgcaaggaggcatggatcttagctatttgaaactacccaattaatgaagaatgttggactctactcaacactaaatctactttataactttttgatgttttttatctggtgtctcaaacttctttaaaaggaaaagaatttcaaccttgaaaatggcatcagtaactactgaggacttttcttgagaacacaaagccacctcttattcataattagtttttcc

SEQ ID NO: 3920 - DNA, 600 bp, Bovine  MMBT17107
acacacatcgaatttctaaagatactcatcaagtatctagatttgtgctgatcagacagcagccacattaaatacaaataaaaatccactcccccagccacatttcaaatgctcaggggtgacacgtggctcacggctatgacactggactcacatgctatataacawttccgccaccacctactggacagagctgatctggaatataccatttgatataggccagcagctttcagggatcactcacaaagcttattactattattgaagaaaagtcctatgttttgagagccatcctasgtgacaacagattcagtatgaggatatgaactrggggcgtgttcatatgtgaaacttgactcgctgccttgacagaattaattgcttggctcacacaaccgggcaattccrtgcagaaaaaaaatcagcaagactggctgttcgccttcaytggctagtgagttatatcatagaggcggcctaggccagtctggcaataaaaggttccttctatcagcctggggtggggaactgaaggctgaccagggccgtggttaactctaagccccggcaaagcatccctgacaagcagaatcatca

SEQ ID NO: 3921 - DNA, 600 bp, Bovine  MMBT17558
tgcatattgtacaaaagcacattttgtatctgtgattacaaaagatcaagaagaagcctatttccaaagaaaattctgtttgttagctaccaagaatttagctgactcacttcattccttttctccttttgggaaaacttgcccagccaaccacaaaatggctctgggagacacaggtcccagcaggacaagagacaagtattctcctcttcacaagaaagccccttccttcaaaggtatttatttgaaatttctctttgctattttcacatcaatcctgaagttattttccagcagagygtatatacattytaatcagcattatctcaagaggaaatgctatactgtaattaatggctcaagaattgtgataaatacaattgcctgacagtcatagttttgtgttaactgtatgattgctgttcgtgctttgtttattcaaaagtcatgttattatcatctgcagataattagcatttactgccagtattcagagcataagcaaggcagtgccatgctggccagtgattttgtttaacatgctgcattacagccctcactgcaaggaggtcgtgcctactcagtattactctgtgtgat

SEQ ID NO: 3922 - DNA, 600 bp, Bovine  MMBT17948
cccccgcggacccaccaacatttcctcccaaccacgcagcggaccagggtcaccaggaagcctgggacccgctgatcttgccttgtgacccccagggtgcgccaattgaaggcagaagcaccgccggacagaggcagagcatgcccccgcctccccgcggacctcgcggtcccctgagtcctcactcaccccatcccagcactccggcatcttgccgagggaggccacccgcctcgaccaggaagggcaaacaaaggcctgagtcacccgagtccagagggagactggacgtctgcgcargtgggagaccagcggctctatggtggggccccagctcacgggccatttatatgaggagctgcccggcctggactggcccctcctccctgcggggtttgtgagcagccactcgctcacccggagcccctgctcttggattggctttcaggagacaaatcttggttccgattggcttccaaggtcctcggtcaccccggcttctgctcctcccacccccagcaacacatcagtcaggatggtccccagctcctgcaacccactcacctcccccacccccgccccgccccactgcacagaggc

SEQ ID NO: 3923 - DNA, 602 bp, Bovine  MMBT18187
  misc_feature (1)..(2): n is any nucleotide
nngaggacttccctggtggtccagtggctaagactcagcgctcccagtgcagtggggaatgcagggggcccaggttcaattcctgatggaagaacagaccccacatgttgcaacttagagttcacatgctgcaactaaaaaaaaaaaaagaytccatatggccacaatgaagatggaagatcccacgtgccacaactaagaactggtgcagccaaataaataaataatattttttaaaaagaaacaaaactgtagatgggaagagcattaatacagcttcttaaggtcttttytcttcattkgctcacttggtgttcaagataatcttctgaggatgggcggcagtttccatgtgacttagagacgagcgtgtacgtgcactctctacaggacatgcttgtgggctccatagatgcacggatgttttcttcattttccaattaatgccacagatatttcccggtcctctaatttctagctggtcagtgaaaatactcatctttacttttccaaccttcagattcattgtctgaacttcttcatccaagctactttcagattctcttgcccttttaaagtttatctcctttttttttttaaga

SEQ ID NO: 3924 - DNA, 600 bp, Bovine  MMBT18529
tgtattcatctatagttagttcacagcttacctgaacaccatagaatcatttgccttcacactatagtgaggttcaaaatctttgagaacctaaaacttattctgcagagttacaggctatgtttacttagctgactgatactatgtctcaaaaagcacatcctgagagcacctgctgtagtcaattggtactacaggttatacagaggcaagtataatcagtaagaatccaagtggtcaaggcctcaagaggtggtggacactaagggaagagtaaggcatgaatggtagagagaaggsgaaaggcaaagccatgcaaggtaactgtgcgagcaaaggtatggtggcagaaatttgcagaggatttataaaaaggtagtttgactggaaccaaaggtttttttcatgagaatagctaaaagataaaactgaaaaaatagggaaggggctggccactgcaggttttatttttatcttttaaagatttgcttacttggccatactgggtcttagtggcacacgcaggatttttgattttcattgtggcatgcagggcttcccaggtggcgctagtgataaagaactcgcgtgccaacccag

SEQ ID NO: 3925 - DNA, 600 bp, Bovine  MMBT21874
ccagcatatggtgggtattaaaaagcaaatgtagtctatcgcaactttgtaaatttctgtttgttttgtcacagaaactctcacttaaagggaatttttctgcttcaatcttcttttaagagatgaattctctaaaacactacccaccgctttcaagatccttaaatccagagaaaagtggctcttaaaaagtattcagattaccgtggaaataacacagtaatttagccagctaagaattgagtgggttcggcttccctggtgatcaaatggttaatcctcctgctaatgcaaagaccsaggttcagtccttggtctgggaagatcccacgtgcggagcaactaagtctgtgagtgcagctactgagccagtgctctagagcccacatgccacaactaccgaagcctgaacgcttagagtccatgctcctcgatgagagaagccacctcaagaagcggcttgtgcacagcaatgaagagtagcccctgcctgctgcaactagaggaagtccacatgcagcaatgaagacccagcatagtcaaaaataaatgaataaatctttaaaaaaaaaaaagaccccaattgagtttttctggcta

SEQ ID NO: 3926 - DNA, 600 bp, Bovine  MMBT22344
agaaaagagctcagatgtaaatgaccttggagataagatagctagactgaaaagtcctcagggcagggatggcatctgtgtggtgtgtgtgtgtgtgtgtgtttagttctctctcattgtttgctcagtaagcgctcttgaatgaccagtgggagaactttctattatttctcctacccaaggaggcagaagtggaaacagagggagcagargtgggaagtggacagtgaatcccttacgtggctgctgttcatcatggcctcctccacacagagctgattctcctgcaaggtcttcccytgtctcttgcagacattgtgtagattcttgatgtcagcttgcaggctcaagagcttgctgttcagactgcttacgtctctgtctctctcccccacctcggcagtcagaaaaacaaaagcatcaattatgaactatcaagaaaatgcttactttcgttcactggttgacagagactttaaatttgctggaaatttgtccatcaacccttcactgttattacttattctgtgtaatgtttacacagtatccatttgcgaggtgtctgagtgctctgcattattcagacaattacttatttac

SEQ ID NO: 3927 - DNA, 600 bp, Bovine  MMBT04422
aggggaaatataatttgtataaataatttaccttgtttcacatttctctgaaatgttcatgttcctgaaaagcctgatgtctttaagggtaggcaccatattttttcatctttgtaatctaatcctaaagcccagaacaaagcttaacaaatagcaggttctagttaaattactgtggaatctgcaataccaatcagaattcttaaacagagtgccaagggttctaatctctgaaagatataattttattatgtaagatgtgagttcatgaaagaggccctaccccaaactaaacattgmttttcctcagtagagactgagaacatgcttttaacagactaacaaggagataatacacagtagtaagtacttttgataatgtatttttatattattcaaaattttgtgggggaaagggtggtaataggtcaaatccatgctcctgatttaagtatagccttaaataataatctcttcaaaccaaaagaaaataaacttttctttgttgtcagtcaagtcccaagcacatcaggtactaaaagatagtacacattctcactattcagagccaaactaactagtaaattaacataattgaga

SEQ ID NO: 3928 - DNA, 598 bp, Bovine  MMBT07366
  misc_feature (1)..(252): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagaactcggatgacatctgatagtttggtgtatcaggggagaacrtatttcattaatacattacctgctactgctgacacattttgtcccttgctccccccgacccccacaaagaaaggtaactctgagaagcaacccagaagagatgttaggaaaatagatactgttgcctggagagaactttgtgtttgttgcttaaacatatgaaaaaataaggcagctcatgtgaacaaaaacagtgtgaaatgtatatgtaactatgtccaatgtaaagacagatgtttataaaaccaaccccttcaaataaaagtgaaaggtttgagaagtgagaaggactgagtcc

SEQ ID NO: 3929 - DNA, 600 bp, Bovine  MMBT11023
gatgtacagcagttaggtactttgcccaaggttacacaggcaggacttaaacccacatctactaacccagagcattagctcttagttatcatgccattgagcctcttggcttggtgttctaatcagtcaatctaatggctcgtgatagaaacgctgagctgaggtgttccacggggcatggtttctgtctgtctaacatttcctattacaatgaacttcaagggatagtcttagttcttttgatacatgagactttggctgtaatgtgcatggtttgacagaaatgggactactgggctyggggcttcttttatgagaacttcttggtcaaaatacagtgttaatgtcagtcccttggtagctggaatgcaggtttcctgaactctaccctcccagatacttcttctttcaaaggagtcaagaggtctggatgagctgctgtgtgtatgggggtgacagagagatccgagggcgcttgatccggtcaaagagtaatgggagtattccctggggctactaaaggctggctgctgagcttcctggacaggactgactgatgggagrcccttttggcccgggttaggtggcggacccgccgct

SEQ ID NO: 3930 - DNA, 598 bp, Bovine  MMBT15122
  misc_feature (1)..(118): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaaccccattccagtattcttgcctggagaattccatggacagagcagcctcgcaggctacagttcatggggtcataaagtttgacatgactgaacaactaatatatctgtctaggtttttgccctttattttcctctttctcatctgaaacaacttttaagtaaccttaaactaatastttaggataaaattactctcctttttcttaaaaaagyatccttcatgtctcacatcctgctttatttttcttgcatactttgtacacaggggttttccctacatttttattattsttaatagctaatttacatatgtggattagaattcttaaccctttgtaaccttaatttccagggaaagcaaggaagtaagcaattgtgaacacatgtgaacacacacacgttttatgtatgtatgtatatattagcattctgtgttaaattagaaaatttatgaatatagcaattttataattt

SEQ ID NO: 3931 - DNA, 600 bp, Bovine  MMBT17208
tactggagatctacaaaaaaaaatctctgtcacagactaacataccattcctttgaaaatagaagggtgggtagaaacactctaaggaagaatggaatttgggagtggtaggttgagaggggrcatgtgagaagtggtagaagttaaataagtttatgagtggtcaagctctggcaaaatcctgcagtggtcatcgttttgtctgacttcatgataaaagtatgctgtggccttcaatraagttacattgttttcatcattaaaaagtaatactaatgcraaagcaaattttgcctgctrcagatattagacgtgcccctggggtacagctctgtcaagttstatgatcattctctgtctttcagctgatgcccccattggaatatgagctgagagtagggtctgtgtctttttaacccacaaccagtcaaaaaacaagtgattagttaactatcaatgtatctrcagcacacacacacacacacacagagttaagagcccttacttacataaggctttttagaaatcaataagacaggtgacccagtagatcaaaggaagtgcagatgccrtataaacataacaagttgctcaatcttg

SEQ ID NO: 3932 - DNA, 598 bp, Bovine  MMBT18834
  misc_feature (1)..(96): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacaacaggatgagcaagcctcccatgaagcaaaggggaaataagactagaatatagcattgtgtatgctaaaactgaaaaagtccaaagtattggaaataaatgacaccatggaaagaaattgccacagctcactaaaacagctaactgaaaatttgtcgatgaaaactgtcagttcatatacccagccatcattataarcactataaaggaaatagctagaggaggtgagaggtgggacaaaaaaaaactctgtcctttgattcttttttgaagccccctgtgactcactgagcttctatttaagcttgaagactcagttcaactttcaccttctgcatgaagacttctcactcctccaggaaaarctatttgctatcattctcccccaagaaggagrggattaagtatatcttctttgctgcttcatcatgcatacctggtagcatgccaggcatatagtygaagctcaataattataactgaattaattaaatca

SEQ ID NO: 3933 - DNA, 600 bp, Bovine  MMBT20097
ttagcttttgatwttttagaaacaatcctggtggctcagacaataaagtatctgtccacaatgcaggagatccgggttcaatccctgggttgggaagataccctggagaagggaatggctacccactccagtattcttgcctggagaatcccatggacagaagaacctggctggctacagtccatgggttcgcaaagagtgggacacaaccaagcgactaagcagataaacaaaacaagcattcatagctatgctctaacaacaagtatcaacatratgctgtaaaaactgtggtctaayacattgggagctaataggtaagggctgaccctcctggaagcgagggctgttcttggatgtggaactttcagtactaaaaaactgggaaagtcctgggtaaaccagaactagtttgtcacatgagtcatgaggagaagagatggctaaaagatgctcatatgctcactttgyggagcagaagtttgatagatgctttagaaaagagtaagttggtgaccactaacattaacacagcaactcttagcagtggctgccacttaaggaatgacgtgtctatgtttgacttcagccccttccaaa

SEQ ID NO: 3934 - DNA, 600 bp, Bovine  MMBT01021
cttctgtgtatatatttagaatattgtgagcctatttctctagttaattgggtatacattcagtgatcactggtatattcataaattattagaagggcaagagcacttggtttctttctcaagaggtagttcaggaactttggagatctataaacctccagcaagttaaattatcctacatactacccataggtactattagaacacaaatgttcaacctttmtgaagaatacacatttcactaaatctgtaggcagaattgttattttacatagtctactatgtgatttgcaagaattrctgttacaacaaccaagaaagcacttgaaaggtatctgaaattatttttcacacagggctatatatttctctatctaatatgacagcmtgycattcatataaacatatttatggctgtgtcagttcatatcaagcacattgggacagtgaaaaaaatgtaatctagatgaaaaagaatttcatctgattctcaagagtccccactcctctgtaatgcattagaaattatgatcagaatgatataacttggacaccatcacatctcaggaatcatccattattgtaacagaagtgcctgaa

SEQ ID NO: 3935 - DNA, 600 bp, Bovine  MMBT02964
aactgagacttattcatttttatcatcttcctgttgttgttcagtcaccaagtcgtgtctgactctttgagaccccaaggactgcagcacaccaggcttccttgtccctcattatcttctggaacctgaccaagttcatgtccattgaatcagtgatatcatccaaacatctcatcctctgttgccttcttctctgacttcgatctttcctgcatcaggggcttttccaatgaatcagctgttcacatcaggtgaccaaagtatggcagcttcagcctattcagtgttgtttcctttaarattgactggtttgatctccttgttttccaagggacgctcaagactcttcttcaacaccacagtttgtaagcatcagctcttcagtgctctgccttctttattgtccagctctcacaaccagacatgacactggaaagaccatagccttgactatatggaccttacaaatgtttgtagaaatgactggatggatgagtggatgctgctgctgctgctaagttgcttcagtcgtgtccgactctgtgcgaccccaaggacagcagcccaccaraccccytcrtccctgggagtctccaggca

SEQ ID NO: 3936 - DNA, 600 bp, Bovine  MMBT05164
tccaggtaagcataacacttacagtgccaaggtcaatgatgaagcagtcacccttgttgaaactgtcccagcttaggggaacttccgtggccctgacgactctccgacctttcacatgcaggagcctctgagcagtcaagtcatttgtaagcacatgattgagtccagaygccacaccgccagcctgatcagtgagagaaagaaaacaaaacaaaacagctgaggctttgacacggcagcttagaaaaccgctggtgttggtaccaaactgcttgctaggccaagagaaaacagccaagkgcgtgtgaaaaattaaatatgcagaagagaatttccaacaggcaaatcaataggtaattgttttgttgtgggctctttgtccttcctattttaaccattcctgttaataccgcaaatatttacagaaaaccctcagtatataaaacctgctacataaacagaaaagagttgttattcttttcctttggggaactaatgattctcaaagcactgaatgagaaggcagataaggatttcagaggaaaaggtgacaggaggttagagagtcagaggtcacaagcatacacgaaggagggcccg

SEQ ID NO: 3937 - DNA, 600 bp, Bovine  MMBT05412
aaatgtggggatatacattttcaygggaagaagtggttcacagtaatacaattgtctcgagtggcaggtcagctttggaaagttaagcacgcaagtgctctgtggtgtgtagcactcagaagtactgaccccctcagcaggaggctctagccattaagggcatgatggaaagtctggtggtcccagttctgccatgaccttgggccagtcacctcacctcataggcttgcagcaactcaaaagcacaggagttgaaatccagagcctggtatgacttatgactgtgggcagaactctttycagcagcagactcttctgtcagaaggatgacgtcagaccagaagttttctaaatgaaactccagcattagcattcttcatttcgagaattagttaacaccagagttattttccaggtggaagtttttttaaatttaattgttttgaatgacacctgtcccttcattcaccactccacttcatggtacttyttytgggatcattgaactgactatcccagcacagagaaagtaaaagtattagtctctctgtcgtgtccgactctttgcgactgcatggattggtagcccgccaggctcct

SEQ ID NO: 3938 - DNA, 600 bp, Bovine  MMBT07929
agaaaagctaatcggaggaaccggggattcctgtacaggattttgggactggcaggagagcacatgttgatctcttaacaacctttctgggttttcatggatcagattcctgtgggtgaaagaacacctttcagaggcatggttatacctaatttttttctctttatgtttaaaatgacagagaaattttgaaagtaagagacaaaagcatgaattgaggaaccataaatccagggattgtgcccccaagtgtatcttaagaatatcctagtggttacagatgggagctcattgatagcyttagatttgaatctcagctctgttacttattagctgagctatataatttcaggcaaattatctaacttctctgagtcttattttctgatctagctaggaaatgagaagtataatagtcctgtactaacctcataaggctgtttgagagatttaatgagtcactttctaccaaaccgctttagcagtgtgagtgcccggcacagaactggcactacacgagtgggattttctgttttccttaagccttcctcgttcatatcaccagggactcaactcccgtggtgctgactgctcatatty

SEQ ID NO: 3939 - DNA, 600 bp, Bovine  MMBT08354
tcctttctgctagctctgaaaaacaaaaatttccaacaaatctgtagcagatgtttttcctcacttctaattggtggggcagtccaatcctggaattaacctagtttcatacttagttttttttcctcccttgttcaatagtccctttttattgttgaattgaaatctctttccttgaaagccaattcacacctctaatgtcaaactgtgagtggtctatattaagcaagggcaaggtagttattctacagttgttcttatttatttaggagtatcatgcatgtaagaagaaacaccaaycttagacaataccattgcctcccccacagcccccaatccattattaccaatgagctattgtgcagattctactactgtaagcaatctgttctggttgtaataatgtgcattctgttcagtaacaggaatgttatgtccattaccttcactctagttattttttataatgcaatctcctgaaaatattgcttggttaaaataagaaaataaacagatctttaatttgtagattcttgtttgcagttgcatcatggattagaaataaaatcaatatgatattatatagaagcatctaacaaa

SEQ ID NO: 3940 - DNA, 600 bp, Bovine  MMBT09234
ccattaaaatctcttctacatgtttaataatattttaaactacccttggaataactattttctatctgcttttacttgcctttataactaaataaacactaaatctttgaaaagggggaagtgaaaataaagaattttctatactatgaaataaccattcttttctatggcctcaactaaataatacctgtgaatattccagcatcttataactatcaaattttatcttcttcccaaagcacaaaggctgacaacagctgaacaacaagagaggaccacacacaaaaagaagaaactctyctaaagacattttagactgtagttgtttatattcaatattgtgtaatactaacaagaagagttttattttatggaggcttttgattatcattttctttttaacaataaataaatcctgaagcactttcttctgaagattatcaacttggcaccatttaagcctccagttataagaacaaattttaacgatttctagagatattaaattcctcctgacaaaccgtactctggtgtagattagtatcagtgcaggtgcaactacaactgatcagtttgctacttctgaggggcaataagaaa

SEQ ID NO: 3941 - DNA, 600 bp, Bovine  MMBT10398
tcttctgggcgcctcagttccctgtagacaccccctctttgatctacggttctgggacttggcatttataccagtcacctctctagttaaccctgacctgacaaggggctttctgtctgctcaggactcaggggattcacccaatgataggtttttttggagtacttgctgtttttcttacccaaccccattccccaggccagaatggagctccaccgggcagcgcttttgtctgccttgtttattgctgtatccacaagggctagaatgtgactggtgctcatgttccgtggatctttrtrgactgaatgaatgtgaaggggataaacagcagtgacgttaacctgcagggtgtgggggtggggctgtcgcatttgagctgagacagraaagaccagaaaagaccacaggaaaaggtgtggggaacagcaggtgcagagagcctgggataggattgaacttggtgagttggaggaacagtaaagaggttagcatggctgcagtgccatgagccgggggagactggagggggatgtgttgcagaggtggccagacctctccagggccttggaggccatgatctggagtttaggttttatt

SEQ ID NO: 3942 - DNA, 546 bp, Bovine  MMBT16339
catttaatttcactgtagtttccttttttggatatcaggttctttctccacataaatcggaaaaagaggcaaactattttattctttagacactgttaaatactttgcagttgggcactggctgcttaatggagattaagacttttaaaaataggaaagttttttgaagatcacaaatcgaaggacatttaagtatttggggggtataattgccaaagtaactatcaaacatgaatttaaaatatataacaagtgtacttttaatcattatttcttgtgatcttaaggtggacatatatygcccatttaaaaccttggaaaagccaatgataaatttatacttaattctttaaataataaattatttaaaatagggatgcatgttctccttgttttctagagtgacttttcttatgtttattagctagatgtaccttttcttttgtgaattatgtacctacagtctttccccatgcttctgttggtctcctaggtttttttttttaagttatttctgtgagctctctatatttctgtcttaaatat

SEQ ID NO: 3943 - DNA, 600 bp, Bovine  MMBT19283
tgccccaaatgctcagtgtccaaagggggccagagccccagtcgtggccaccctgagatcttcaatgactagaggacatactagtcagcaggccagtagggcctgacttctggataactgacattatcaggtggcatttggcagagttatatcattagcaatttaatcaaaggttagtaaaattaactctatggttttgaaatgttcaatctgattttattaaaatgttttaactctattaaaattcttgacaaaaaataatgaggtatgaataaagcatctatatgtgcaggactcatrtttgagtgactcacatccgatatttgtgtcattcgctctcactgctgagaagtgtggggtaggggggcagttggcaggctcgggtggggggttgggggacttaatatgcagatttgtggtcctccaccagaactgcttttcgaccagggagcccatggggtcctggcttagtcagcttcctgatgctcagcactctttctcctttctttctttgtcctatagaaatatattgcagtaaaataaaatggaaatgggattacatgaaaggcattggagaaataaatcaagttgagtcgcaga

SEQ ID NO: 3944 - DNA, 600 bp, Bovine  MMBT20153
ttctcttatgtstcttattctaggtcttttctgcatatttggrtcatcactggaagaaatttatgtttcagacatccatttattgctcaaaaaaatagccttgggcatctaargcaaaacttagaatctgtaccacttctgttgccattcagtaaaatgaaagtttaaaaaataatttcaatgacaacaaataggaaacaagctagcagttaagcactaccaggagtgcttttaaatctatctttggaaaaatcatgtgtaacattcaggttccggtcttaaaamaattatgaaaaaaayagtctctaagagtttgcaatgtagctggtaaggagagccaagacataaaaagatgaataacaatacaaagaaacatctaccaaatgtcaaatgaacagtctagcaaaatgcaaaagaattttagtttagtcctaaagactacttggaaaatcaggatttagctgaatatatcactaaacaaacaaacaaacatgacactctgatgatctctgtaaaagggagagggaagggagtgggcagaggggagagagacagtgagacaggaacagatatatctggaatattagcatgaggccagat

SEQ ID NO: 3945 - DNA, 598 bp, Bovine  MMBT04048
  misc_feature (1)..(90): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataaaaaaataaaatgttaaaattcgggaattgtcaaaatataatagggcattgaattcagaattgttttcactttggtatcactcataatagaaaagtaatatctaagttttcatctgagctttctttctataggtattttgactcagagtatttaaaaggttagcaatttacagatcttatggaataattcagatatttttctscattttaaatggtagatctgccttaagtcagatggataatgactgattcaagccatatttctccatgaacatcataggtatgaaatcataatgttcactgtattttagaggaaaagcctcaagacagaaggaaatcatttaatactttaaaatatatgttaaagaaacaagataattttattcttcattaacttactcttttaagctatccttcagttacaagtaacaaattaaatcagtataagttaatracaaatgttggtgtttgtaacaacatatttgagtcaaactataacac

SEQ ID NO: 3946 - DNA, 600 bp, Bovine  MMBT21705
tcccctggattaccgtgcagttaaaaggaaatcacgcttttgtcccctgactttgaccacgatggtgccacttaacgcagacygaatgcttcccacgcaccccctagtttaagccttgcagtcccaggaggtgggttctctgatcatctcacttcctccagaggagcccaaggctccgagacggtggtgatgttcccgaggaygcctggggtgggagggggaggaccggggctggacgctggcccctccctactgtcctgtgatgccgtgagtttaagccccacgtgtggtctttgctgmgtccctgggatgggattcgaactcctgtccttttgacatgaatgctcctgtctttggaagggaacctctgggaggagatcaaggatgaaggcttcagcctggacacgctgggggccttcggagactccccgcttggctgtgagctgggggcctcgggcctgacccccgtctctggtggcagcgaccagtccttcccagaccttcaggtgaccggtctctacgctgcctactcgaccccggacagtgtggccacgtcagccaccacctcctcctctcagtacctgggcgccccagggaaca

SEQ ID NO: 3947 - DNA, 440 bp, Bovine  MMBT00761
actccccccttcttctcccttccccaacacacacagttggcccagaaggtaggaacacccattgctcccatgactttgtgagaagctttttgggttgtgtgaaaacaaagatcctaaatttttacagggaaacatgattgtttctgaaaaacaaacaaacaaacaaacctcatttgatgattaaatatgagaaaagcaagaggagaactatttactgttggcagttcatcagacttcatccatctggtggccaaggccggctctcgtccctagctgtgctgggggaacaattcaggccaytcagagccacctcgaggcctgccagcgagctctgcccggactgctggggaaggagtagtgggtgtggattatttatgttccctttcaaaacaaacccaacaaaagaacaaagctcctcttctgctggcaacgttagcagc

SEQ ID NO: 3948 - DNA, 600 bp, Bovine  MMBT20866
ccttaagcaaattgcttgactttcctgatccctaggttccccacctatagaacagtccaataatactgacatccagtggttctgaagatccaatgaactgacccacccaaagagctcagtgcattagatatgcacccaaagcacccaggagggccattttgtttaagctcagtggaagccggacagagagaacagtgaaggaatcatcccagagagtcacttctttagcatccttgttccatgaggactcaggatgcatagcaggtgagcccagagcaaaaggcagctcaagatgtcacrctgagacgcattcagatctgttctacaaggatctcttttctgatcccctcctcctgagattctgggtgctgtgggacctgaaaaagagatgggggtggggtagctgaattcactagacatattcctcggtgctatgttgccaggcaatgaaattcaayatggaattaaagatttgcctggccttggaaacaaagcctcatctgtagygtttcctcttatttttaggcttttgaaagaaatatacaaccaggtatggggggtaaaaagcaattgcagagaaatttccaatagaatgtagcc

SEQ ID NO: 3949 - DNA, 598 bp, Bovine  MMBT11652
  misc_feature (1)..(28): n is any nucleotide
nnnnnnnnnnnnnnnnnnnnnnnnnnnntggggcagcgtgggggtggggcggggtctggggaggcctggaggagccccccttcagtcaggggctgggcggtgggggctgagccaggagccttagcctagcccctgaactgcgggggccccctccacagcagtgagcttgcaatgcccccaccctgcatgacggcgcttgggctcccaggtggtgcctgtcsgctttggatgtgggcacgtgggatgggcggagggatcacaggaagtggacgaaagggaagactctgaccgcccggaagrcccctcyggaaccctagttgagtgctccccaaccctgctcccttgagtcctcgggatgagggagaagatgcccacacaggagccacctggggccttcwtccgggggcygtcccgactrttcatccattcgtcccgttctagcctggaggtgtagagtcattttttgaaaaaagaggaactttcctggtggtctggtggttgactctgcgcttscactgcgagggtcgtcatcttggtgtctggtccttgagccaagattccacagggcagcgtggccaaaaataaaagagcaaaaacc

SEQ ID NO: 3950 - DNA, 600 bp, Bovine  MMBT06937
tacgtttcaataacaggtaaaatatttccttctaccaccctgctcatcttgttctcatttcaacgcacaatccaacctggccagctttctgacaccccacctctcactaagcctcagaatcaagcctgatcatcatacagttagtttcagcctttctcctgagcattttgcaagtaccagctcctcacagtcctaactggttactatcagtgttcccattttacacataagaaagctaagtcttaacgaattaaattctccaggtcacacagcaagcaagggagcaatcaggattcaagygttagctggcttgaaagtgttagtcactcagtcgtgtctgactttttgccaccccatggactgtagcccaccaggttcctctgtcagtgggattctccaggcaagaatacaggcgtgggttgccattcccttctccaggggatcttcccgacccagggatcaaacctgggtctcctacacttcaggcaggttctttaccgtttgagccacaagggaagctcaaaactagcttaccagcactcttaaaactgatggtgctattstgctttcccaaagtaatcagattaatttactgttaaa

SEQ ID NO: 3951 - DNA, 579 bp, Bovine  MMBT09373
taactcacagggaatagccagatgtcctctgagacatttgtccgaaatgacggtaatattttatgaagggcactgacaagcaacctgtttctgaatttcatttagcatattgagctccagccatgagaactgccctccaaggtgacccaaggggaagggagaagagtgaccatacgttgaggacctactaagtgctagagaccttgatggacactttgaagatgccacrcactcattcatcccaaaaagcaagggcggacacagtggttttcaaacacaatgcccaggcactcatattgyctgcartgtcacggataaatgctacaatctgagaaaatgcaggccacttttgtccgtgaacactgaagagagatggagacaggaaaagcaattcagagtaaaagaaggagatggatacactccaggcaagaaattggaagcagagaaaagataaaagtaaaaatccatctatttttaaataaataaatgtctgttgtaattgaacaatttataaatatttacgcccttggacttcaaacactttccatagccacttctattcaaatattggtatttttt

SEQ ID NO: 3952 - DNA, 601 bp, Bovine  MMBT18827
  misc_feature (1)..(1): n is any nucleotide
nctctctactgctagtcagccactagtggttgtgaatataacaatacaaactttgtcctgctggaggtgtaaagactaaaaacagagagagagagagagaaaaggatatcagtaggtgtaatggaaggagctttttaaaaaatgacggtcgttaagacagtacagacatccgtgtcatggaggagctggtggagtaggtggagagcctgatcagatctggttaaaggcatagcttgagtttctccagttagagcaattgaacatccacactgtagtatctgtgtgaagatatatcctgagrgaaatggggagcaatcaggaggggattctgaaagcatacctcccatccacagccccctaacatacacactcactcctcactcgcaggtttctctttctcagagctgctcctgcagcaagtcaggcaaagagggaggaaaatatatttagatatttcattcatttcagaaaagaaaacaaagctgtaataggaatgattgcttttaggttcctctctgttacttggatttacctctatgggtttgctaaacttgcttaattttgaggttagcatgagaaaaaaaaaggaggaaggaagaga

SEQ ID NO: 3953 - DNA, 603 bp, Bovine  MMBT06595
  misc_feature (1)..(3): n is any nucleotide
nnnatagagaagaagtcataataagcctttagcttagagcrttaggcaaatttcatttcattttcccttgcctaaaatatgaaagcataatttttttccacactgtcagctgtagatagattaaaatataaacaaatcaagtggtcaaactttcttagaaaatgaaatcagagaaaactcagttgcttgtctayttctttgagagaaggggagtttgcttcctagttttattttattctgagctctcgccctctgaatgtctgaagcagtgaagaaactggggagaaaggcagtaatagaccrtygcacattcttaacagcctcctctggtaagtgtcctctgaaagaggacactttcagactccttttctgaaatccattatgattatagaatttagagatgaagggaccaaagagatcatgtggaayagktgttttccattcggagccagcagcacccagccagagactccacccattctcaggcagactgtgccttccagcccctatgtccatgcaggaagctgccagcattatgcaaatcatttatgtattctaaggagaggttttatcccaaaggacacaagggaagagtcaaagctt

SEQ ID NO: 3954 - DNA, 600 bp, Bovine  MMBT17297
tgttatattctcctggaatttttttggttttttatttaaccaataattttaaatagctattgtgcactcaaaggttgccactctgtggcagagaattagggcaagtattggggtttttcatggtgatttaaactacctcgtggtttctgtgtgtatgtaacacaccacatacacacatgcttagtataaatgtgcatatttagtgtttgggtggtttttaggatgwgtattaagtatatgatctttaaaatcatgttatttaacccaccaatcaaatgaaaaggggtcagggaaaagagkgttgcagattktctccctcaaagctagtgtcagaattcaacacctgtgttcaaaggctgtctgtccctgtcctgggcaagacttgtaaataatactgaacacccataagcagtttttctttctcggmcctgcaccagttcgagttcctctttcttgcctctggagcatgttagggttaggggtttccttggaggttcaagaaaaccccactcatcagcagggctgagactgggaggcccatggcggttcagctagctgcctgtgggtcgtgccgcgatggtggctggggtggaggcagct

SEQ ID NO: 3955 - DNA, 600 bp, Bovine  MMBT07168
cacaacaaatgagcaaaaagaacaggattctgacacaatgcagctgtgaagggggtggggcctgagggtggtgcagagctggaagagccccggtgggtggcagggccccttgcacagatagccacactgcaccacagtggcagagctgctattggaaaggggcaggcgtgtattttctatttccagaattgatcctttttccaagctggcctcagatttacccagaaaaaacacttgttttcgttcttgctgaagtataacaagttagactcctcccaggggttgctccctggaataagrgaatcggcagcaaaaggaacatttccaggatcagccacaaagaaggggctgctccattttcacagggacagcactggtgcctctgctggccgccaaaccttatgcccgattcccactaaccaggtcttggtatatttattcataaaacactgatgaagcgtctagtacagctcatattacactaggcattggggaaaccagtctgtcttctggagacagcagacgctggccaacaactgtgccggtgatagtacaattaaacgtgcagatggtgcttcaaagaaaggaaggactctgacc

SEQ ID NO: 3956 - DNA, 601 bp, Bovine  MMBT16304
  misc_feature (1)..(1): n is any nucleotide
ngagagayatttccccagagcttccctttcaagctctcacagctggaagggtcgcacagccaagttccaccctcttcaatgcaggttgtcacttggatgccggggtctgctgatctattagtcaaatacctaatgtgagaaaaagagccatcacacatctttctgcttatccatcattcaatgctscatttagcacaaaagaacctctctcccctttttctcttctgctgcagctaaaaggcccctcccaagagataaaaattacaaaggaaataaaagaaaaaaacacgatttctgagcygatgctcattcgtaattccgtacctgaggctgtttgtttccttgaatctgagaacaggaagggggcttggggaccctctcatgtaaccccttattttacagatggagaagcagttgcctggtgaggtcaagtgactcaccccaacaccatacaactagcaagggcacgggcagcatcagacccacatcacctgatcctaagctagactttacccgctgcaccactgatgatttcttatgaccacagtcacagactcttgtaagatttcatgattcaactagatgccgcccttgcagaagg

SEQ ID NO: 3957 - DNA, 600 bp, Bovine  MMBT20806
cctggaatttttttggttttttatttaaccaataattttaaatagctattgtgcactcaaaggttgccactctgtggcagagaattagggcaagtattggggtttttcatggtgatttaaactacctcgtggtttctgtgtgtatgtaacacaccacatacacacatgcttagtataaatgtgcatatttagtgtttgggtggtttttaggatgwgtattaagtatatgatctttaaaatcatgttatttaacccaccaatcaaatgaaaaggggtcagggaaaagagkgttgcagattktctccctcaaagctagtgtcagaattcaacacctgtgttcaaaggctgtctgtccctgtcctgggcaagacttgtaaataatactgaacacccataagcagtttttctttctcggmcctgcaccagttcgagttcctctttcttgcctctggagcatgttagggttaggggtttccttggaggttcaagaaaaccccactcatcagcagggctgagactgggaggcccatggcggttcagctagctgcctgtgggtcgtgccgcgatggtggctggggtggaggcagctgttaacagccc

SEQ ID NO: 3958 - DNA, 598 bp, Bovine  MMBT18823
  misc_feature (1)..(153): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatttcatgatgaggaaatttaagtcccaaaagagcttgagattcataatcctctgaaccaattaaattctaattttcaacagatgaaagcctttggggtcacttctttgggtgattatttggtgttgaaataaagagaacattstgtactcagacatggggactgaggtcttctcttgttgactgttaaaatgtgacagctgaggttgtaactccaaatacagtcagacacctcaaagtcaaaagagcaatgggcagagttaagaacattcagtgatgaactaatatcaacacccaatagaaaaaacttcagtaatggggaggcaaatcatttctggaacaagtttatcccaacttgaatgttgaaacaaaagactgtatgtcattctcacacaggttttggttcattgtacactctgaagatgttgagtctgaatccattt

SEQ ID NO: 3959 - DNA, 600 bp, Bovine  MMBT00578
tcttcctggccacccacaagggggcatgggtcggctgagctgcaatgaggctggctgtccacagagcacctgctgattcaacctgcctctctgcctgtgtgactcaagtgagttcctcaacctctctgagcctgtgtcctcatttctaaaatgggaaagattatcattgttgtgaggattggtgatggcacctatgaatcgcctggtctccagcacgtagtaggcattagtgataagaagtggatacaggaggtgctcctggaatgacagccactgccatgcctctagtctggcaytttstatgtgggatggtgtgtgctgctggcgggtcagcctcccccatctgaccatgacctcttcaagcatagaacattgctgagctttctttctgtatccagagccctgcacacagcccagtactctgggttgacatctgctgaatcattggaaactgacatcccaaaggagggaaggaagcggagggcacttccactttgtgttcattgtccaacagctgccaagccttgaaaccctctcaaaggtctgttttcagccacacacatctaggaagggcataaatttcttgacagcagaggggtt

SEQ ID NO: 3960 - DNA, 600 bp, Bovine  MMBT11757
ttgtaaaaagtatttgtcaggtccagtgaatatgcaaagcaattctgtgggttgaagtcaataaaatcaactgttagtaaataaaatatgttgctgtgacagaagatacaaaattaaaagaggattttggccttgctctaccatccttcattgcttgacaggagggattggaaggaaaccaatacagacatatctcttcagagctggccctgggaagacttttacagtgggtgaaatttgttttttagaattcttgtttcactatatggactgtcctgagcactttcttgtctctgggcyctaggtcagcccctgataggcaggaaatatcctcttcatctcttccwtaccccttcctcaccctttacrtgtatctgatttgcatataatatgtgcgatgccttccatctaaggatttgagtaccatatccatgactactgaaagaaccagaaaaaaatcaaccatatatcccttcccagatagactccattgtttagatgagactatgttttaatgtatctttaagagccttttaataacaaaagtactaaatacattctttgtaaatataataggaaatagtaataagcaaagaatgc

SEQ ID NO: 3961 - DNA, 600 bp, Bovine  MMBT08101
ccaggggatcttccagacccagagattgaaccctcggacccatgtctcctgcattgcaggtggattcttttactactaagtcaccagtgaagcccctacatttgtttacaatttgttaaatagtatcatgtgctccctgctcccacccacccccaaaacatcacttggtaccagacccccaatagatgtcatgaatacctgttaaaaagattcaaagagcagtctcagcttagatcttcaaatctcaatggactcgtccatcctgaataaaaaacaatcacttgggcctttcaagatgarttacatatcttaaccacaaattatctttttctgacctaagtaaacacagtggagcttgtgaggctgaagaaacattgctcaggagcagaaaccaactacttatcttcccccaaagaaatcaaagccaggagcatggggcacatgctgcaagagccaacatctactaggttggaggtggtcctggttccatcctcaatccctagggccagattgccagcccaggagactcaagtcctttgccaaccaacagagagaatccttggaaactcttgtacttgctgcccccacaccagcttacaa

SEQ ID NO: 3962 - DNA, 600 bp, Bovine  MMBT11008
cacacrgctccacccccaagaggctgaggtgtggggggtgctgtcagaagggccagcctgcagtcagatggttcatgaccgatgtgttttccagggtgatgaagatttggggctgaagaaaggccttcagtggaggatggtgggttaacatctagaactctgaaaaaggactcactgcctgaactgatgggtcctttctctgaactggcccccgtgtctgagcacagggccgggagccagggcctctgagtctggtgggaggactaggaggcccagtctgtggacccaccagaggtgggsagcaccccgaacgcccactcaccatctgtctgcagcgtccactcgatgtgaaccacggggagcaartgtccttgctgcgtgtgggcgaagcgcagctgggtctgcacgttttttgggkacgagggggtgaggttccgagggtggatccagctgtcgtccaggcaggtacctgggagcaggagaggcagaaatcagaggcttgcgggctctaagggacagagatgcagcccaaagaggatgcctggcggggtccaggagccttcacagtcaggccatgaccccaagaccaaaactgggctc

SEQ ID NO: 3963 - DNA, 600 bp, Bovine  MMBT18828
actgttagtaaataaaatatgttgctgtgacagaagatacaaaattaaaagaggattttggccttgctctaccatccttcattgcttgacaggagggattggaaggaaaccaatacagacatatctcttcagagctggccctgggaagacttttacagtgggtgaaatttgttttttagaattcttgtttcactatatggactgtcctgagcactttcttgtctctgggcyctaggtcagcccctgataggcaggaaatatcctcttcatctcttccwtaccccttcctcaccctttacrtgtatctgatttgcatataatatgtgcgatgccttccatctaaggatttgagtaccatatccatgactactgaaagaaccagaaaaaaatcaaccatatatcccttcccagatagactccattgtttagatgagactatgttttaatgtatctttaagagccttttaataacaaaagtactaaatacattctttgtaaatataataggaaatagtaataagcaaagaatgcaaaagaagtataatcccaacattcatttgcattcttgtatctatctttcaagttttagtatgttacatt

SEQ ID NO: 3964 - DNA, 600 bp, Bovine  MMBT20874
gcgtatgaaacaggtggaagaactgtgagtaggccggaagccctgccgagcaccacccgccgcccctgtccatcctcccttccctgcttctcttgaaggcrctcactggtcaaggaaggcgaggtggcgggagggcccgtctctggcagcagctttggctcacgagggaaggggttcgggtgaagcygtgtcagctgtggccgcttctctcgttggtgcttctgtgcagccgtgcgttcagagcctggtcrgttcgcctgctgttagctttcttactggactagccactgtcagcagacygggcggccggtaccctagtgctcctctcttggcaggaaaccaaatgcctcttaaagtctctgattcttggtaacacgttcctgttttatttcgcttttggagacttagattctattytagatctttttttaactttcaactcagttgtattaagtttgctattttcacatctgcaaggataccaggagttcagcctgttgtattttggttcccaagggttcaagtgttgttggattcttcataagaaatcctcagctaatgaaatgtgctttacgtgatttctccttccaaagtggccaa

SEQ ID NO: 3965 - DNA, 600 bp, Bovine  MMBT07276
agctggttttaatagttcagcttcccaactgttgatgtcagcacctgtgcagcgcctcccccagggagaggctgccctggtgctgactctgctggggacttggaggccgtggccaagctccatccccatggagtagtgggagaggctcccctgacttcgtgggctgcactgactgagtcagccccacggttgaacattttaggttgctgttaacgttttgttatttctttttttttaaattcgaacatgccagctcttagttgtgattaagtgggatctcatttgctgtatgtgggattyagttccctgaccagggattgaacccaggtcccctgcattgggaactcagaatcttacccactggaccaccagggaagtccccatgttttgcactttcaaattaggctttgctgaatacatgtaagccatgcttgttatgagacttgtctaaaaggagaatggctggagcagtgggcctgtgtatttttaaagcatttggtatatactcttgcatcgtcctccagaaaggctctggtggggatgcagcctctgcaggaatgaggaggccccctttcccactgactcccaactccagacttt

SEQ ID NO: 3966 - DNA, 600 bp, Bovine  MMBT07031
ctttagaactgaagacaaaagtaacccttacacctatttccaatcaagaaacctcccgggttcttccaaggattagtgaagggagaaggcaggaacggttggtagccaactcttccccaaacctacctgaccttcccacgagccctttctcacccattaattcaccgtggctcctctgtagcccgagcacctccaagctgctgcaactaccttccttactcaattcccaccgcatttcctggtgcctgaactggcagtacaaatgctggcaccgacccccggggctgtcaaaagggcacrgaaaacggcaaaagtaacccacggagcgtagcatggactactgctcgaggttcacctcacctggctccgaaaacgcgcctgcactgttgcggtgacagtaccgggaaaaggcgaaccccccagcccactgctacttctgccttatatagtctgcggctactcggaggcggcgtcttgtagcttttccagccaatgggcaggctggagctgatgtcagggragaaaatggggagagaaggatgattctgagaatggatggtagggtagtggcatatgagtgtagtgtgtgtgtgcgtctat

SEQ ID NO: 3967 - DNA, 598 bp, Bovine  MMBT00809
  misc_feature (1)..(10): n is any nucleotide
nnnnnnnnnnatgtatggttatgattacaatgccatcttctcttaaaagaatggctacttaacccagatgaaaggccattcacaagcatgccccaaataagtggacacaactgttttgaagctgttttggctattgacgctaaattatattctcttgcatgttttagattcagaaatatttgaggaaaataacacacagacaaaaaagggaatacaagcttaacaagtttctatattttttaatttcctgaatcatttatctagcaattatttatattagactaaggaggcaaagctgayccatatgtatgtatgtcctcaagtaatctaccasctaatgagaagtaccagtatgcatataaaaaacaacaatgaaatagatgctggagtaaaccatgaaataaataccaatgcaatgggaagagaagggggagagtggcaaaccataaacttaagacaaattgtccatggattcttctttctttctttgtgtagatgatgcaatgggcagaaagtagtcaactgtacaattctaatcaggatatagaatatgctatgaagaatgtcctctgcagttatgcatcacggcagccctaga

SEQ ID NO: 3968 - DNA, 598 bp, Bovine  MMBT11135
  misc_feature (1)..(128): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggaggcttataatctagctgttcttctaaactgatttttacagaacacctgggaagcaggcccagagcaaatgagacatctgagaagttcataagtattattttcaaggggttaatagcatagaagctctctaagtcttccttagaaagaaatatgtgacaccagatrscaggtcacagagctggctcataaggaacaggagtttggggacactttcacagtgccaagttaagaagatacaagagaagaaaaaaaggaatttgctcttttctttttatttctaagctcgtttacagtttaaacctgcatgaaatctctacttagatcttcagaggaaagataataagtagctcagttaatagtttgggatgtgtcatgtaagatgctaccccaaattgtgctggccttgatgacaaacttccatgaagaaactttgcaataaycacaacaacttaaagcaaaggtg

SEQ ID NO: 3969 - DNA, 598 bp, Bovine  MMBT13694
  misc_feature (1)..(19): n is any nucleotide
nnnnnnnnnnnnnnnnnnntccctttctggtgtccgattcagagaaagaccatgtccccacaagccagcagcctccacggcccctggaatcccagcttcctggggcactggctcacatgctgccaagtacagtgtttgtgcggatggcaacccagctcactcatccctgtgggtgtgcaggatgcctggacacagaggacaccggggaacacccactctgcctatggaaacccataggcgacgcaaccctcagaggagagaatcacacaccacataggtaaatccttttgtgacccacamgagagacaactagaagacaaagtccatgggatagtcccatcactctgatctggaccacatttccaacaacacacaactaacatcttgaaatacataggctttaactgtgttctgaaaagaaaatcaaaagcctgcttcctttacacaaggtgggcacatgagcaaaacaaataaaccratatgcaaatgagaacgacgtccaggctcatacsagaaagaaaccaacctaagtatttcatagttctgaagggaaatacataggaaatgtaataccaaattgagcgaagcctttggaacc

SEQ ID NO: 3970 - DNA, 556 bp, Bovine  MMBT18247
acccagcaacaagcagctggcaacctcatcagagtaaatcctttctcttccaagacctcartttttctcacatgtaaaatgggagaatacaaggacaaaacgaaagattcagagaaaaacacaccgaagggaaacaacagcacagcatctggaaccaaggagatgcctgaccacatcacttctgtcccctcaccctcccaccccacatgaattcacagggtcagcagaggatgaccaaggaaaagactcaaggtcagggaccgacgctggtcacagaccccaccgatcataccgctgggyatccgsaacaggtccactgtccctccatctgtgtcgggcgggactgggggctgggacagagaggctgacgagcgtgcctttaaagaatgtggaaaagaagcacatttccagcagaggggctgggtgatgaggagggtttcccagggctgtggtgtgggagaggggcgcgggtgaagctgacagggaggaggtggtgggccgtggagggctttttgcttcagggtgttttgttgttgttctgcatcttgtttcattt

SEQ ID NO: 3971 - DNA, 600 bp, Bovine  MMBT01239
agggaagcccaagaatactggagtgggtagccttttccttctccaggggatcttcccgacccagggaatcaaactggggtctcctgcattgcaggcggattttttttaccaactgagctatcagggaagctctctcttgtgggacatatactattaacagtagcttctgtgttttgtagcattatataattcaaaataatgtttttgtattttctattttcctgtgtttaatttataagagaagcagaacgacttttatttataaaaacacaaactccctcacgtgcttcctatgcagarcttttccatgttagcctgacccagctcatccagtctatataaagtttacttataaagtaaaattttcacagtattatagaattaaaactgtactttgatattgaaacagatcacggcactggaaggtgagttcatgttaatacataatagtgggtccttgggagcgaaaaatggttcccatagggtgtctttcaaaatattattaaaataaagcaatgctgcagagacatggttttcatcattgcagtggaggtttagtacatctaactgggatttgagtgagcttgaaacacttaaccc

SEQ ID NO: 3972 - DNA, 598 bp, Bovine  MMBT18995
  misc_feature (1)..(15): n is any nucleotide
nnnnnnnnnnnnnnngttttcctttgtgctagtccagagcttctcaaatcttggtcacataaaagctttagaggaaactcatattcagttatcagaaattgcttccccttgatttatgatctggtcaggctccttggtaagctatatgaactctcccgaacagaaaaagagaaactgcagatggattcggcacatataaatgcatgttggcagtggatatataacttcagacagttcagagataataaattgagttccctgtcaatgccagctgaataaacacatttgttgtaaatgatytgacaatagcattattgattataaatccacaatttgacattcggaatcacatctcccattttactcctaaggaagggagcgacttggtcctttttataggggcgacttagcaacatctctggcaactcagcttcttcccgctgtgattaattaaccctgagtccctctgatgtctctctcagggggattgcattaaccttgctttgcttatctggaataatatgtatggctagtgcctttcaacaggagcttggttttgcctgcctgttttagtgttttctactttgaagttagagag

SEQ ID NO: 3973 - DNA, 598 bp, Bovine  MMBT02478
  misc_feature (1)..(188): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttaaaaccagcaagcaaactttgagtaaaatttccaaaacagcagaaattatttaaaaaataataaagataattattttctcctgattaaacttctaaacattcagagycaataaaagtttatacttaccaaatgtgtcatagttttcaaacacgttgttacccacattaatttccayagctcctcaatattatccgggagaggtgtgtaaacataatatgccccaaggacccccacgatcagaagcaaaatcgtctttcttcccatcatgttttccaactgcacattctacttggcagcaaagcaaatacacttctgaaatatttgaatgttgaaatttcataacagtttttggatttatcaaaaagtgttatcttacttcttagacacaaattccattggtccar

SEQ ID NO: 3974 - DNA, 599 bp, Bovine  MMBT05697
  misc_feature (1)..(10): n is any nucleotide
nnnnnnnnnnatgaaaatggtaaatgtccatatgcaaagcctcagacaaagcctgtaaatatttgtgaaattacacttactctggcttttcccagggttacactttgataatctttttgatggattatatgcagatgtgtgattatatagatagatgggaaaaggaaaagagaaaaatgcacagggtgggtatagttttttgtaactcttctgaaatgtcaaactcagattgtgacaatagaagcagaataagaaatgctaagattttccaaaaaggaactttttaaaaaaaattttttcrtagccataactctgaaaatgatataattgatcctgtagaagcttttaaaaatgtagtcaattaaaaacatactccctactaagtaggaaaactagatatcattaccagtgggggttggtcaggtcaatctggtactggttaggttatctcgtatggaagccctggatgtgatatccttttcagatggagagatgaactgcagatggatataatgtattccttaccatagtacctcactcactcatcttagactattatgtatatgcatatgtatatatatataaagtagctaagtctg

SEQ ID NO: 3975 - DNA, 600 bp, Bovine  MMBT14209
gagcagcacgcgcgcaaacagcagcaggaagaggaggtagctgaccacgttgcccatgaaggccgtcaccggcgccccccagaactgcggccagcggcgcaggcgcggcaggcaccccccacagcagtccctgcgtctgggcggcctcagtacccccaagggcatcttctcagggggctctgtggccctgtgcgggagaaagggggagaagggaggagggctcaccctgatctctgcacctgactttcaccaccatcaagactcagctttctgaccctcctcatcctgctttccagtcartccccaccttcacgccttcggacrccctccatctyctcgagttttgacccctgatctaacctytgaaatctaccttcaacactgctgagcttccacccctgactttccccacccttctgacctctggcctctggcctctggcctgacttctgactcttktctggcttttggctccaagtccctcttctttccccctcacaatctctggctctctttctgaccttggaccatctacctgacctctggccctcatatataacctctgacctcctcatttcgcgacctcggttccccaggttt

SEQ ID NO: 3976 - DNA, 600 bp, Bovine  MMBT15849
ctatactratattctggagtttagtgtagctccaaagaaacaaatgtaaaatgggttaaagaaaaaaaaaatctggatgtttccttaaagacaactgtcaggtttattaatgtgttcatttatcagggggaactgtgacgttataggaggtaaaaatagaaccagtatttgtctgctctccattgtgccttctcctcctgtccctctccctccgtcactttccattccttccctgtatgtggtcttttctggacctctcccacctcccatagacaatttagaatgctaatgagttaagtsagagaaagacaaatatcatcttgtgtgtgtcttgtgtgtatcacttgtgtgtgtctaaaaaatggacacaaatgaatttatttacaaaacagactcacagacaaacttatggttaccaaagaggaaaggttgagggaggaataaattaggaatttgggattaacagatacatactgttatatatacaatagataaccaataaggtcctattgtataatacagattacttggctcaatatcttataataacctgtaatgggaaataatctgaaaaagagtagatttgtgtacatatatatg

SEQ ID NO: 3977 - DNA, 600 bp, Bovine  MMBT07280
aaaggctaaacaaaaacaaacactttcagaacttccccggtggcccagtggttaagaatccaccttccaatgcaggggacttgcgtgtgatccctggttgggaaactaagattccacatgccatggtaagcccgtacgccacaactagcgagaagccagcatgtcacaatgaaaagatccagaatgctgcaacttagacccgaagcagccaaataaataaataaatataaaagaaaaaacagaaagaaagtatccctctactttataaaataaatacttttgtttttggtggtgacagtmcctagggtctttaactcctctgatcaacccaaagaaactctgggcagcaaccatgtcagcaggccagagagggtaagtttgtatctgtggatttccaaggagacaggttaagaaacagcccccttaactgttacctggaaagcagagagctagcccttctgcctagaggcgggagagaggcgcaactgtgggtctgaaactcactcgatgccgaggtccacctcggggatgccgctcagcatctggttagacagcatctcctccgtcttctttgccgaggaaacccggatgttttctggc

SEQ ID NO: 3978 - DNA, 600 bp, Bovine  MMBT10112
ctttaaatgtgctagtggatgtttcatttaactcaataataggtttataaaccattaattttataattcattcaagtcttataagatggtcaaaattttcaaagcaggtattaactctgctttttggctrtatcgaatcccacctctgctaygaatctggctacctgcctttgttgttttgcrggggggcggattctcaatttcctcaccttaaatraargattatgaaagaaatttcattttttaaaattttgccttcttttggattttactagaaccaactgtactagcaaattattsactaaagaattccctggagcacagcctccaggctggagggttttaggtcctgcctttgtacttagaagtcctgagtgaaatctatgcaccctgccgtttctctcccaccatattatgtggactacactctccccrttgtggggtatttctatcaatgagcaacatttctcctttttgttactcaactagaattgtttgattctttgcactgaagtttcaaatgacaatctggatagaaaagtttactgggtagaaatgtttacttatgtatctctctacttagaaaacttatccttcgag

SEQ ID NO: 3979 - DNA, 600 bp, Bovine  MMBT12212
actatttttaatttggggatgctaaatattgctgtaataggaggtaactcaaagagcaaaagtgaataaatggcaggatatataattattgtgtatttaagaaattaaccaaataatggataactcaaccagtgtctcttaacccaagagccagttttattttctttcatacattttctcctaagataatgggcatcttaaaaaaatgcttttaaaatgtattgcttacagcaaagagttagtagtctctgcagttaattttgctgcgtaacagagagagagggagagagaaggaaggcrtcactataattagacacctgggtttgcggggactggatgtcatttaaagcattttattccttgctgcagaactctttcagttgagtaaatgagtaggaattaatcaatgaaaacatgacagtgttctggaaattttataattgatgtaatgtttttgtttattgggccagttccacctgattgacttgcagattgcagcarctctgacaaggyacccgtcgctcacatttcaggtctctgcaccctgcactgcagatctacagccagatcratgggccccaagatcatgtctgagattgc

SEQ ID NO: 3980 - DNA, 600 bp, Bovine  MMBT12597
aatatactttaccttatttctgtccttttaaatgtattgagatttgcttaatgctgtggcacatggtctatcctggagaatgttccatgtttatttgaatgtatattctgctggtggtggggggagtgttctacaggtgtcaggtctagttggcttacagttaattcagaccctctatttccatgttaatcttctgcctagttgttctagctattattagaagtggattactgaagttttcaaatattattgctgaattgtctctcttttcagttgtgtcagttttgcttcgtatatttyagtgccttattgttaggtacataaatatttacagtattcacttattttttacagtcttgatctaaaaaggatttaagtggttatggtatagcaagaactcatagattagagtagatgagaaagaaaaagcaagacaagagtagcaacatgaaatagaatttgccttcttgttctctgatgtctctgtgtgaacagagcctgatgcatagtaggcccttgtaggattgaaataacatcaagaacgaggatgtcccaaaaatgaagtaatacacattttataggtgaaccattaatttggca

SEQ ID NO: 3981 - DNA, 600 bp, Bovine  MMBT04112
ctttatatctttgataaaatatttaaataaataggtcgccgacgccgtccccgcttcgaataccctggatcagccgaggcaggaccccggcaggttgccatccctcctccaggggatcatcccaattcagggatcgaatccaggtctcctgcattgccagaagattttttttaatcatttgagctaccagggaagcctgagaatactagagtgggtagcctatgccatcccaggagatcttccagacccaggaatcgaaccagggtctcctgcactgcaggtggattttttacctcccarctaccagggaagcccaatatacttcatagctaaaagccattcccagtggaaaatagaggcagtatatttgaaattaaaaggtggtgctctatttacttgttttgtatagtaattttcttgggttgtcaaattgattactaaaaataataccacctattatagaagtgaattgaaataaaattggtacaattattaaagtggatgaagtattattacttacagagaaaaaaaattactaaacagaaagatgtcatatattaagctgcttttttctcttaaacactagaaattttaaatctc

SEQ ID NO: 3982 - DNA, 600 bp, Bovine  MMBT07162
taaacaggactgtaggtcacaacaaccaggcttgtgatgggaaggccaagggcagagttgttaccaaagcaagtataagaaaccagtggcatgacatgggggcccattctgctaaaattaaaaaatacaaacctacacacaccaagaataatcccttccatgataagtcacaaagagaaatggaaaaaaatctctgagatcaaagaaatctattcttttaccaccactgagtagaaggcacagacagacccttgggaagaggtcttaggaaaatgtttccacttttcgtttttcaagagytatggcaaatatgatatagktttaatcagcttgatttatggagtaaatgataaaagtggagtgctacctctctttcataaactggttttcctttttagaatagttaacactattatgactgaagatttactgtattcttacagtgagcaagaacacacagaatgatgaccccactccatcagtcagggtccgggaaggaaaacacaaaccattgtaggtcttaataaacagaggtaatttaatttaggggattggtcctagaagtaatagaagtactgagaagccaaacagcagatagcg

SEQ ID NO: 3983 - DNA, 600 bp, Bovine  MMBT10327
cactttttgataatttgtaaattattttaaagaaactgagtcgccttttcctctaattaacgctggtttgtttcgcttttccccgtgaatagatcactgtcctggatgagacgtggaccgtgttcaggcgttacagtcgtttccgggaaatgcataaaacactgaagctgaagcatgcagaggtgagttatgacatagttattttcaattaagaacatctgttttcaaaagtaaatgccattggctgccctgtcagtgccccctccttcctctttgggtattagcttatgcgtgtcaccragttttcctccagtcactcatctctcaaagacagctttttaatttttgttctctgttccgtttgtactttacacaattcagacatctttctgaacacaaaattttgagtgatagtaaggaacagtaagtcatttctatccttttcattaattttatgatgtattttaaataaatattttgatcaatttataacttctcaaccataagtgagacctattaaaatgaaatagtaatacatttttcaatatgaatttgcccctgtttcctgtaaaaaaaaaaaagactgcattaatgcttaga

SEQ ID NO: 3984 - DNA, 601 bp, Bovine  MMBT16488
  misc_feature (1)..(1): n is any nucleotide
nctaggaccttatgacatccttttgacactaacttgtcagcaactgtgatctcagtggaggctgtaattgccccatgaggagagtcaccatgtggattctgtcttctactttgtgagactgatcaccagaaattccagtcttctgatgatgaaacttgcagaaaagtatacttcaaactagttgactatttactggttttcacgtttgcttacatttttagtagttctgaagtttctaagtcttataaaaaaaaaaaccaacgcaatatttcctctaaaaacatctatttggaatgtagcrcaagtactgagtccagcagtggcccattaaattcagtgaacaatttcagaatacctcaagttgtaggtaattagaaatgggttcaggatatgattataagtcaaaatagctggctatataagtaacattagccagactctgtaaatctgctcaattgtctgattttccccattcagaatacacccccaaatgaactgaaacagttttagtttgggctttactcccttttccactcagatcctactcttgaactgttatctgtaagagaaatgggagggctctgtcagctgaaggggtctt

SEQ ID NO: 3985 - DNA, 600 bp, Bovine  MMBT15504
gctctggccactcttggctcrgggactatggcaaaaggccgcttccccatcgcaacccaaagtgagcagctgctggaggattacaaagcattggacctcctcgtgctcattttaaatgttatctcagctgggcagttcttgcaaatgagcccttcaccctcccctgcctccccgtccccaccactaccacccaacgctctaccccaktgggcatgggccagaaccagggcctgtgaggggaggctgtaaactggctgcggctttctggccatggaggtgatgttcccagattgactcctytggcttaatgctcagatgctcatggcagaagctggttggtcagatgcggcagagggatggccttcgatttggaggtggcaggagttaccagccagagctcagtgttaggctgtttcctggactgataaacgagtgtgggagagccttttttgttttttccctgaacaatggaaacatctttctttctgctgcagaaaaacttgtactccataactgtccacagccgtgccctgcaggtttcagaaacacaaagccaaacctttcatcgattctgctgaaaaataactgcctcttctttct

SEQ ID NO: 3986 - DNA, 600 bp, Bovine  MMBT08973
ttagttttgaaatgcttttagaatatcacagtagactaagcgttaactaattctacttttctcccattggcagaagtcctttaaaccatatctgtgacagtggtcaactaacttttatgtgaatacttgaatgggtgtcagtgagcttactgtttcacagggcaaatggcttcattgttgaacaactctaattggtactgtttcccctcatgtttcattcaaatctcagaacttctggcctttccattcatagctctttagagaaaaagagaatgattacttctctcacaatgttagacstccaaatgtgttcttttaaagttatctcttttccagaataatcatctccagtaaagtttggttgtcactcacattactgtcatatttccaatacttcaatacccagtcatcttttggacatgacttcagtgtataactgcagctcttaaaatgttcaactctgaaatttaacacatctatggaataacaatatgggatatgaaacaactatagcctcttttgattttgacatatacttctattaataatatctaaacttgcatatattttaaaaaatatgcctctgtacattactgattc

SEQ ID NO: 3987 - DNA, 600 bp, Bovine  MMBT19018
aaaccaagtatttccttataaagttctagaaaacaatagatacttacttcgatttattatgtttctgactctggcatgaaacaagaatcaggtttgttttcacatcctrtaatatctttgccagtttactagccagagcctcacaaatatatttccttattaayaccaataygaattttcctcatactgcagaaattmttttcttaatgtttaaaacttgtttgttaagatttaaaaatctaaagtatttagatttttaatgctaagagtagaacactctcattgttctaartagttaarcaaaattattttccccaatatggagataatcttttcccccaagattgtaagcaaactcttactgttgtaaaaatttggatagtacagagaattataaagaaaaattaatgaccctaaaaaaattaatcacattaatctcactacccactgatgatcactgtcaacatttaacatctagtatattcaaatatatgtaaattttacaatataggattatattatttgttcttattttccatctaatgtgattatttttctcatgggtaaatataggactatatcatcttttcactgggctca

SEQ ID NO: 3988 - DNA, 598 bp, Bovine  MMBT21742
  misc_feature (1)..(178): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaggaggactccgggagccggggtgccaccagcccagggtggttgcagatccgctgtagcctcaggaggatgctcagcacgtccacaaagtgcccgctcttcagcgcttcctgggtcctrcgcacatgcrggaagagayaggagcattgccaggggtgcaaacatgtgccagctgggcttctccccgtctgctatccccactctatgaacgcacarctggtgcatccccttgacctggtgagtaaatctgccacatgccaacccacctccatgaggttgtggttctgagactggctcaccaccccatgagagaggacgggaggccagagagccagggtacgggttagacrtcggggcaccctccatkgcatgcccccaaagagcaacagggcaggtgtcccaaagagcccaggggtct

SEQ ID NO: 3989 - DNA, 600 bp, Bovine  MMBT01900
gtcatttaaggaaagtgaacagatggaggaaggaaaattaataactaaatttccccacctcattgattgagcccatcacaaagaatattagaatgcttgagattccttctcatgctttagaatatgatcctagaaactaccaagcagtttgcagaattcttaaagcaaagctattccattatcagtgtaacaagcatgaaccacatcttcagtttgagaatcaagacaatcaatcctttgtgtttttgcccaaatttacttgctccacctctactccttccctcacccctgaagtctagwacctcctatgagtctccattcattgctcaaataaccaagaatcacactactttcttaattcaacataaagacctatctctaaacacatcctgaaaaggggacagggatgccccataagtctacaagtcagagacttctaacattttcttttaatgaagtttattttatttgcacattgcaccttaaagtcttttattatattctgtgaaagtgaaagagcgttagttgctcagtcatgtccgactctttgtgaccccatgaactgtagtcctctcccctcctctgtccatggaattcccc

SEQ ID NO: 3990 - DNA, 600 bp, Bovine  MMBT05194
cttttctgtagtaaccctgcctcccctgcatctcttccttggctggatttcttgagcacctcaagacccccttcccccgctcctaagatgggccagccagcacttgcagagatgggagtgcagtaaacccacatgtatgggaaagagccaaggctcagatcatgttgggccaggttaagataagtctaaagatggagtcagagagccaagaagtcagaccctgggagctaagatcagaccaaagcaaattgcaggttaagaggaggaagttaaacttgagcagttgtctcatatactcaytcttctttgaatcatgtctttctagatggttagcttggctcaaattgtgttatttattatcttgctatgaaatgtggtttaataaatattttattgatggtagtattatttttgagatgtggaagctgtaataaagttatattttctgctggcaaaatcgttcctagcttgtataattttatgttggaattaaacacatcagtgattcatggtgctatgtaaagggcaacatggctttgaagtatctgggtaccataacaagtttggaaaaccactgttgaagaaaacagtataaaggca

SEQ ID NO: 3991 - DNA, 600 bp, Bovine  MMBT10329
tcacctctctaagaaattacttctactcctatccttgtttctgggtctatttctcgggaaaccgaaaccaagacaaaaaggatagacaactagttccatccttaacaggcagaccctctccagagaagctggaagcaaaactgaatgtaagaaagcctggtgtgcaaagatgcaggaggtgaaaaagaaggagctggcagagccatatgtcttataagcccagcggtcctcatgcagaagtagggcttggcgcagtgagtgtcttggcatctgacagtaatatttacaattccttctccrctcaaggrgagatggcagaagacagggtagtagaaggttgggattcttcccttcaggttccagcccagcccactcctaaatagagaaaagccaaaatagcttcccctccccacagctcaggtttgtcccaagcttttcccacttcagaagggcaagcattccaagctgtccatggtcagaactccccataagctcccatccctgcagggaagacagaatactatttgacttccagaccccgaatcactttcagattcatcatggtaggccttactattcaaacaagatagttctttaatt

SEQ ID NO: 3992 - DNA, 600 bp, Bovine  MMBT14969
aatccacagatctggggctctgagtcagctgtgtctgtctcattcagtgattcctgcatccagtctgagccgcacccaggtacccaaatgcccagtacgctgatgagcataccgctcgtcaggaacagaaacccaaagatgagacactggacaaactggcggctctccccacagaggaagggtcggtcggagtcygcctggttgttgcctcgcaggcgctcctcagtttgctgaagtcgtgcccgggagcgggccaggatcacagcccccagcccaaccacggcacacgcgggcccagcratcttcagcatcatgctgcagtctgggaaggttttgtattggcatgcctggaacccaaagatggagagcagaactcccacgcacagcaggatggcaccgatgacaaaaaggaagaaaatgagcttgctgacatgcctgtctccccggaccccgtctggctcagcagcggctgcaggagacatggccaggagaggccccttgcccgaggtgggtgggatgtatggattcccttcgatggttttagcagctctgcagacataaccaaacaccaaattataaaagggctacaggtgttcctga

SEQ ID NO: 3993 - DNA, 600 bp, Bovine  MMBT18092
ggggtggtgcctccggcaggtcacaacagatcttctgctgagagctgtgccctcccagagggcgggggtgggccggggagcagaggtgccatcatacgtgtggagagggagcatgtggacaggccactgtggacacagcagtggtctgtggactaatgacaaggcaggaaggaagagaggaggaagaggagggagaagggggtaataaggagaggggagggtgggcagaacgctactcagcaatagtgtttgacggtgcctcgtcactcccaggtcagcgytgtccagcaagttcccaasatggtacaagagttcgaggaagctggacgggactctcacttttggcatctctctgttcaaaatgccctggagctccaggaatttggcagggtagatctggctgtcatcttgtacatatttcgttataacaagtgatgcaagaagaattgaggcatctcctccagcaaattcactatttccctaacagtgtgtcccccagggctggaggctcagaaccaacagagggagcaatagagccagcactctggcaggacggggcaggaccaacagccagaccccaacgggcatgtattctttgct

SEQ ID NO: 3994 - DNA, 600 bp, Bovine  MMBT03735
agctgaaattccaatactttggtcagctgatgtgagcagctgactcattagaaaagaccctgatgctgggaaagactgaaggcaaaagaaggaggtggcagaggatgagatggctaaatagcatcaccaactcactggacatgaatttgagcaaactccaggagatggtgaagaacagagaaacctggtgtgctgcagtccctgggatctcaaacagtcacatgctacactccatgaaaccgcaaagagacatgactttgcaaatgaacaacaacaacacatatacatatgtataaaagraaaacaattagaatttaattgaggtagttgagttgacaaccatgtaggataagtactttaagagatatttaaatgcattatgctaagtcacttcagtcgtgtctgactctgtgcgaccccagagatggcagcccaccaggctcccccgtccctgggattctccagacaagaacactggagtgggttgccattyccttctccaatgcgtgaaagtgaagtcgctcagtcgtgttcaactctttgggaccccatggactgcagcctaccaggctcctccatccatgggattttccaggcaag

SEQ ID NO: 3995 - DNA, 598 bp, Bovine  MMBT03826
  misc_feature (1)..(1): n is any nucleotide
nccctttgagaaagccctgtagatgcctttccatgcagcatgagattagatttttctttctttctttttttttttttagaaattacactgcatttcagttatgtattagagcaatctgtcatcttcacattagaagccgtggatgcgctccagcagctggttctctaggacttatatttcagaaagtgtggcaaagggtgttaggagagcagtgtcagcaggccgttattcttaatatgatgttctaaattataaatattaccagacgtccccgtgcagcatgaggagatgattctgtgkttacaacaggagaaccttcacacaacgaccaggcagaagcaaatggaaagagtaaaaatatattgcttctattagttttaaaagctgacttggatagcagcagcaacttggtcgtatatagccayagtttagggctctgtttagtattttctccttccatttgcccctcaaggtgggtcggtgttcagcttgcgcagttaccagaatggaagttgataattcttgctagacctttgctaaaggtgggagcccagtggtggctttacaatagtatctattattaacgcacatccatttt

SEQ ID NO: 3996 - DNA, 600 bp, Bovine  MMBT09651
actcaaatgtggccacgttacttcccgtgcccgaaagtctttccatggctcctggccacacctagaggcaagcccggccagccacacagccctcccacactcctggacttggcccagtctgtccccgaaccggtgcccggtgatccrtctggtgcaataacagcactcaggtccctcccagcccacgccattcacacctcactgcccgcaggctggtgctgctgcctggggagctgacctcactcaccgtcggagatggctgaggcaccaccaagctccagaaagccccctccatcctcyaaggaatctctgctagcacttgtcatatcccatcgcaactgtctgtctgtctccctatgagactatacgttttcatgagcagagactgtcattctctttttttggcagggggcggggcccttgctgcacagcatgtgagatcttagttccctgaccagggatcgaaccctagttccctgcagtggaagggaggagtctttttcatctttacttccccaccagccccagggcccagcactgggctttgattataggtgcccagtaaatgtgagctgaactgatttagcttttctaaccccc

SEQ ID NO: 3997 - DNA, 600 bp, Bovine  MMBT10801
cagcaagggaattccagaaaaatatctgctttattgactacactaaagcctttgactgtgtggatcataacaaactgtggaaaattcttaaagacatgggaataccagaccaccttacctgccttctgagaaacctgtatgcaggtcaagaagcaacagttaggagctttcaagatggaggtggttgggtggttgaccgaaaagcagaggtgaaggcccctacgaagtcaaacgggccgagaatcatcccctccccacttctcccagccccaggagcccagcaggagcccagcagaagcstgagtgttttaggctttattttttaaacaagcaagtaaatcaaacaacttgtcaacktggggcggagatccacrtcatccaccaaaagtggaaaatttatgaaccctacagaccaagccagaaaagaagctcrgaaaagagaattaaagaagaacaaaaaacagcgcatgayggtacgagctgcagttttaaagatgaaggatcccaaaccaattatcccgggtgccgggagccrgcgagagacactccactcgtgacaaaggtcatgaggaaggaggctcggcatacacaaagggcggg

SEQ ID NO: 3998 - DNA, 601 bp, Bovine  MMBT13477
  misc_feature (1)..(1): n is any nucleotide
nacagcaaaatscatgataaattaacttctactcagacatgatgaagaatatgaagagtgtgaaggcaaagagaaaagtaaagaggaatcttgcacttttctaaatgcaaatatcttattcttccactagcctcatttgaaaataagaggatacttagtgtggcaaatatgcagcatataattggaagagctgattatagagaaagtagaattcctgcacataatgttcagggttttttttgttaggcttattcatatatacattatgtacaaaaattttatattttaagtgtacagttcygtgaattttgacaaatacgtaaacttgggtaaccaccacgataatcaggatgagaatggttctgtcacccccagaagttccttctggtcgctagtgaactgacttctgttcctatagttttggtttttccagatgtcgtatgagtggaatcagacagtatgtagcctttgtgtctgacatctttcacttagcatatgcttttaaaattcatccatgttgcacgtaccttaatttgtttataatcaccagttgattgttcttgttcagtcgctcagtcgtgtccgactctttgtgaccaca

SEQ ID NO: 3999 - DNA, 598 bp, Bovine  MMBT20985
  misc_feature (1)..(64): n is any nucleotide
nnnnnnnnnnnnnnnnnnnnnnnnnnnnnnnnnnnnnnnnnnnnnnnnnnnnnnnnnnnnnnnntccctggtggctaggggtacagaatctgcctgccgtgtaggagacatgagtttgatctctgggtcgggaaaatcccctggaaaaggaaatggcagtcractccagtactcttgcctggaaaaccccatggacacaggacctgggtaggttatagtccaaggggttgccaaagagtcagacatgacagtgactgaacaacaacataaattggtcaactggcttgccaggacaaaagycctggtctgcaggaatttctgactcctgggtgtgtatactcccaccatgggcagtttcaatggatcaatgtggtgtcacaaactcagagctgggaaaagatgtattgtaccccacaccattgtatgatattccactgcctagatacaactgatataaacaacctcaagagcatacataacagtaaaatgtggcaaaataactaggaagtgatgagttttgagtattttttacctttgtttttcatgtaacttatttcactataaattgattaatttaatttttaataacaaatatata

SEQ ID NO: 4000 - DNA, 600 bp, Bovine  MMBT21334
gtgggacccgagagtccgcctcgctagagggtcccaggtgatacgggtaaagatctgtagcaatgatcaagaatgaaatcagcagaggctctcaacgtcccgatgccaccttctcgattacaaaatgacaatcccatctgccagactttcttttggcaaagaagatggcgcccccggggagtcagggagtgaaatatttgtgctgtttctcaccccctgactgcccttccaccyctcggccagtccccaggaaagggctcaaaatcaggccaactgggagagatgaagcaagtatcacartgcgagtgcagctttccattaactgcctgaaactgctccctgcaataatgttggtgtaatccataagattcaattatggttatcaggcaatcaggcacactgcggcgaggttctcacataattaatgctcagcccccatccagcagcttccgaaagtggcacaggtaacatgactcacccaccctcagctctgggagagaaacaggggacccagaaatgaagcctgccctccccctcgggttccagaacattcctaggagataagccctggatgtgttgtgaggggacagggtgcagctc

SEQ ID NO: 4001 - DNA, 600 bp, Bovine  MMBT22362
cgcctgaagtgttctattccatatgtgtacatggctgatatacttcctcatttcttttaaatgtcaccatctcatcaaatgtcaccttctaagggaggccctctctgaccacccaagctaaacacattctccagtcaccctctctctccttactctgctacactatttttcacatgccgctaagcattgtgttacraacrtatcagcttgttgtctgctccccaactagaatgtaagcttaatgaaggcaggsactttgactctttagtcctttgctgtatcccactgctggagcagtgyccagtacatcataggaactcggttaatttgttgtgtaagtgagtgaacaatgagtgattttcactcatccatccatttagtgcataccggttgagtgcctacagtatgcaaagacaaagacatcatagtccctgccttctaggacatagcagtcttgaggagatagacataaatagatacagatatataaacagatatttatgaagaagatttgcaggtrcagtgatagagttatggcccggatgttttctcaaatacagtgtcagagaagcagcagataatatgctgacattaagtata

SEQ ID NO: 4002 - DNA, 600 bp, Bovine  MMBT10435
gaaacaccatgtaattaaatgctgcattataagtataaagcccaacttctacaataattctcagaaggaatttcaaaaaaataatacaataggagcacaaaatgtgagagtcaaacataaaagtcccagcttttaaatttaccagctatgtaatctcagacaagtcctttaaacccagtttcttctcctataaaataaactgcttgttactttcactcatcatttgaaaataaaaggtgacaacccagttaacattattagcgcagtggcaggcacaaaatagatggtcaatagtaagcrttatcactaagaacatgattgtggtttgtggtttaatggtacaagttcagtggagatggtaaaatttaagctgggcttgaaaaggaagagctagggttaaaaaatggtgaagggataagtaatagattaatgctgcaccctgtcttaacatcttccacaaaaggccttaaaaagcacttagaactgagtgtcttataaatggatacatgaacacaccgaaatgtgacatgtcatcttagaataggtgagtaatgaagtcaaaataggtaactcccaggttggtattctaaccattcaact

SEQ ID NO: 4003 - DNA, 600 bp, Bovine  MMBT22557
tctttttattctgtagcccaagaatacgtcgtggccctggataatccatagtaggtaaggtacacacaaatcaagagtctatgcctgtgatgaagccagaggataatttaagttgcaccatttaccaccagccaaagacamgtgtatcttttggaacaataccttttctgagcccataagtggctgcactgttttccttcaaaccagtcagttaagtgagaatcaatggctggatggcctgttggtgacttcacctcatcttgtgagaacgacttgaatgtaagcaataatacaggaagmaagataatttaagaataccaaagaaacaacaagggaaccacaatgctaattgtctcaagaagccacctcaccttcagtttaaagggtgtccaccagtgcaaggcaaatggtacctgaagagaagtttcaggacccttgattcaacccaggtccgctcttgggaatgaaaaccaaaactcaacgctaaaagcatttgaaaattctataattgagctagagatttggaaatagaactatctagacaaactggggttaagaggagagatggctggaggtttcacaaatcgagaagcagggaag

SEQ ID NO: 4004 - DNA, 600 bp, Bovine  MMBT22959
acaatcagccagccctgacggtcgtccggccgggggacacggcccgggataccctggagctgatctgcaaggtatgaggccacttggggttgtttgygttggaggactcyacggacactcagatgcgggtggcagaggaggaktcttgaaagaacacctttatttcataacagagcagtgttggatcctcttgtgatataygcataatggatggatgtgatttcttccacactaggaggagagggawtctcttagtagcttcttgcaacatgtgttcttgatagatttgtgcaaagcctmttatgtgctcattgcacaagttgtaragaatttaggtaaagaacaaagccgaaaattaaggcacccttgctcacaaaattcagaagtcacctcggtgaacattttggtgtttgtccctggtctctgtttgccacaagcacacatacgtgtattcagtggcatcatatyatgtgcacggagcttcccaggtgtctcagatggtaaacaatctgcctgcaacgtggagacccaggttcaatccctgggtcaggaagatcccctgggggagagaatggctaccctctccagtattcttgcctg

SEQ ID NO: 4005 - DNA, 600 bp, Bovine  MMBT03040
ataaggaaaccttaatggtttaataaatattccaaaaccaaacattctgaaaccagatctgtaatcaacataaaatgtctttgttttgatggtggtgggactgactgttctctccacagaaatgatgatggttaattagagctagaatacagatcttaatttaatcagagatattaaatgtgcttgttcctatcaaacattggctttaatttttgtataacaataataatgaccaattttagaactgtactgaagttgaaatagttatcattattatcaatatttatagaagactaaaawtttggatttccaagggcagtgaagaattaagtaactaatattcatatgggcacaccactttcctaagtatcataacaaaatcttatcttgcaagactcagatattatttactctagaaagccttctcagaattcttagccttatgtctaggttagacattcttcctctgtacactgatggcctgatttatcactccattataatacttttgtgaatttatttatctgcctctgtatggtaagctctctggtagtagaaacatatagtacttgatcatgatatgttccagttattgattgc

SEQ ID NO: 4006 - DNA, 598 bp, Bovine  MMBT18573
  misc_feature (1)..(134): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtgcccctgatatactgttggtgggaatgtaaattggtccagtcactttggacgcaatatgaagttcctttaaaagttaaaatgctcaggaatgagaaatgggaagaagaataaatactaggtcccacatctcctaatcccttgtgttagaagaacattctygtggcagtatactactagagaaattcactcagtgggagaaacaaaagatgcttccacagtcttttctctttacttgttttaaattatgacacatctatatcttatgaaaatagatcttcgatacatcaagaaagaaagtgtagtgaagtggttaataggctttagaaccagatagacagatttactgggcgaagtggccatyagcaaattacttgacttctctagcttttagttttctctgataaaaacaaacattaagtttgctgtgattagtaagggaaggcagttgttataaaac

SEQ ID NO: 4007 - DNA, 600 bp, Bovine  MMBT10324
tcacttaaacctttcacaatcctcattttactcataaaggagctgaggcccagagaagtcaggccctttcccccagttcacatagctatgaaatggcagggataagaatccgaattcaagtttttgacgcattcatctatattctgaaccctaaacccatcacataccacckactgaaataatcagtgagtctrtagttgttatattgcaaatgagcgaaagtgataaagtaagaacctaaagcatatgttaacctgggtttgcagtttggctatttytctaacaccattgtctctgagrcaaagacaggaaagtaatgtataattgtgtgtgtgtgcacctgtgtgtgcttgtatgtgtgtgcacatacaatgagtgtgtgcatgtgtgtgtgtgcatgggcctgcatgcatgtgtgtgtgtagaccagtaaatcaatcctaatttatttgcaccctttcttctgctgtttctaactcccaattttgaaactatttctcaaaaatcattatctagggacacagctactcacagaacaagatagttagggtcatttaaattctctcaggcagagagcatttaagttttctcgtctctggc

SEQ ID NO: 4008 - DNA, 600 bp, Bovine  MMBT06726
taatctgactagactgaatttatcttacaaccacataaatgatcttagtggtaagtagataagcttctgttttctataaagctgagtattggtcacatgtaatgagtgatatagctctgcatgttgtagaactgaataatccaatttttgacttaaaatctcatctagagtgtttctcagtcatatttttttgatggagctaaagctatagctgaataagaactcaggagtgaaaacaagagtaacaagttacaggaaaaatttggttaggaaggacgtactttgggagagacgtacttytaatcttagagaattgatgagttatctgttatcaatgtatagagaggaatagttccaatagaacttttcacagtgatgagaatactctgtgtgtgctgtctggtatggcaactaatagacggatgtgcctttgagctcttgaaatgtgactagtatacactgaggaactgaatttgtaattttagttaattttaattaaatttttatttcagtttaaaaagccgcatgtggctagcgctgccacgctgggtgtagcgtaggtgtgtagcattccaaaggctacagcaaattgactgtcac

SEQ ID NO: 4009 - DNA, 598 bp, Bovine  MMBT00713
  misc_feature (1)..(38): n is any nucleotide
nnnnnnnnnnnnnnnnnnnnnnnnnnnnnnnnnnnnnntgagtaggggtgggcggtaaaggctgctgttaattggttgaaacccagaaatgtgtttgttggagtgggttcttattggctgactttcaaaagcaaagggctgtccctgattggttggtttataaagcacattcactacagcagttgttgatcaagggactggatttaaaaccagttctgttgattccttgttgccatggctacagaacaattaatcttttcttacgtatgtgaaaacttaacctttcaagatttcagtttyttatctataaacttcatagaggtttataagaagtttaaaagataacactcaaagaattcacactgtgcttactgtgcagcattcaataaaaattatgtttatgtttttaagatacacatgaagcatttcatttgtaagatgaatagggttcctatgaaccatggtctgaatgtttttgtcagcataccatgaaacactgtcacttacttctcttccttttccccacttttggttgggaaaaaaaaaaaaaaaaaacaactaatatggtattttgttcacaaggcctaatattgagttt

SEQ ID NO: 4010 - DNA, 600 bp, Bovine  MMBT19366
caatgaggaatttaaccagaaggtgacagggtacactcaattcctcctctgttgtcataaaaaaagctttccttgaaaagatgttttaatccactcagttgctcaccctagggtcacaggagttaaatctgatctaatcagtagtaagaaggtgttttttttttttttttatagtaatccatgaggaaaacgagctgaattgtaggcactttttaaaaagtcagccacagaagtacagatatgggctaacaccaaaacggacgcacaaaagtggaaaaattactttaaacgtggcaaagygcttcttagtgtgactttctttccctggaaacaagatgcagttcagtgtccacgttgctttgtgtgaccctttaaggtattagactctgctactcttactggtcaaacccattgcttgattttctctctaaacctcaccagccaggcacgacaatctttcttaatccacaaagaaatttttttttttttaacttgagtatgggttgtattttccatgttcatgggctgctgtcagcttagttttatccatcatagatatttaattccttcacttggggcacacataatctactgaatgct

SEQ ID NO: 4011 - DNA, 598 bp, Bovine  MMBT23445
  misc_feature (1)..(218): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcattactatataacattatagaatccttgcccagaagaatattagtctctatttctgcaaaaacatgtggtttattwwtttttttccagccccagatttagataagggaggaatgttttmagttgttactcaaagaaaagatatttaacttttctaaatcctggtgtgagtttatgtatgtatttccttcgaagttttatgatgctatagcttcttttaaatgtttgcacctctaaccttttcataaactctgtctatgattcatttaaacaacgtaatcaaaattgccattcttatgaggttcctgagagtggatagaatttgtaatattaatcagacaatttggggcccttatatacataaattgcactcatag

SEQ ID NO: 4012 - DNA, 600 bp, Bovine  MMBT16419
ttaagagagaaaaggctttcttttaaagacagactttttgaggcgattaagatcagcaatgtttaaagaattcttctatcatattcttagtttagtctaaatcatgtctcctagtcaaaaggagtatcataagcaagttggtttatatttgttttgtacggctaaaacatggccctagagattatgatcatgaaagacttcaatatatactgtattacagtatgtaagatatactgcattagcactattttagccaaaagcyrcagaaatctaaactcctatagctaaaaggagagtatrtaggtttatatatcttgaaccacttgactctgcatatcaaaattaagggacatatatcatattattgacattttctttgtcatctgtctctcctgtttccatctttcagctcttcttccttctacatgtaggttcaattctaagcctttctatctaagaaaaaaagaagcaggtttccccctcatcagtctccaaagagcaattatctggaaggcttatacttctttaggccatgtgtccattcttaacccaatcactgtaactagagacatggagtcctctgattgactggccttaatc

SEQ ID NO: 4013 - DNA, 600 bp, Bovine  MMBT22125
ctctaggttatttattttgtgaacaggagtcatctgggccgattcatattttttcggttctcctagaatttgaaattctaagcataaataatttcagtaaacattgtaaaatacagatgcaattgatcttatgcatgacataaatttgtgtgggagtccagatgttgaaatgtgaacacaggttgcttctcccttatgtcctatgtgaatctaggactttttaacatttcattttcaaatttctccttttccttacacacttttaaaaattcttatagaaattctgtttagttttttggrttgatgtatcttttaataaaatcttattaggaactagatggaagttaacacacctctaaccttgtgtgtattgtactagacccatcttcatatagaaaattataagattagttgcatttgtccccaaatatcgcttttgaagtcagtcacgtgttcttttggatacctgccctgagcaaggtactgcacttggcagtgtcagaggtgtaacaccaacattccgggccttgggagtactgttctgtgggttctgttgctggcatacgttctgtaccttctcatctcctttactggtttctt

SEQ ID NO: 4014 - DNA, 600 bp, Bovine  MMBT01733
tctgttctttctcctttccactgattcccaaagttatttaagtgttttctcccttaatacctttaaattcaaagttctgcttctttagcagaatttagcaaatctgttctaagactctggcaatctttttacaataagcaagtaagcaactcaaacctatttagcagaagttccttgaggtcccaggggctgtgtacctctttcatatatttcacaaatctttattatatcatttcatgtgtactttggttgacattattttttacctttgtgcagatagtcacaaatgcctccaccgcyggacatataggaaacccacttatggagatayttccttgaggccacaagcgtgttgtcctgcttcacctggaccaggtactggagtgggcctgtgatcgtcttcttgttacagtgccacttcaaggaaacgtgggtggaatcacactcgtatatgctcagcggctgctctggactagacacgttcaggcccaggcagccactgccttccgatgttaaataggcggtggtttgaaacccacttccacagcatgtacttgttgggtggtttgcagttctccagggtcagtgtagatttgctgg

SEQ ID NO: 4015 - DNA, 601 bp, Bovine  MMBT13307
  misc_feature (1)..(1): n is any nucleotide
ntggagtaggaggtgggcaggaggttcaagagggaggggacatatgtatacctatgactgattcatgtcaatgtatggcagaaaccaacacaatattgtaaagcaattatccttcaattaaaaaattaaagttttttcaaagtcttattcagattgcctttaggttttttagttaaatgtagaaatgattcttcctttttctctttactttgttttggtcaaakaaaatgtcagtgtcgattctgtctaaacgtaaaatcatgtcattggattcctggggggaaaaaaccctacatgaaaygtatattcagatgctacgggtgaaagcctggtttagaaaagcctttgttctgtggtggaggctgccatagttcttccattgcatcagtttttacttacacattttaatgaataaaaacatgcagactgacaatccaccagaatcatcaaatagcaattaccaaggaacagaacagcttcagtgagaagtgaagaaggacaaaaagtatcatcaaatgagtttaaaatttttttaggtagagcaccaaattgaccgtttcatttccccgtaactgatttcttttgcttcaagagaaaccca

SEQ ID NO: 4016 - DNA, 600 bp, Bovine  MMBT13508
aacgtcagatgagccgatgacaccacttttatggcagaaagtgaagcagaactagaggctcttgatgaaaatgaaagaggagtgaaaaaagatgacaggatgagatggttggaatgcatcactgacttgatggacatgaggttgcgtaaactccagggcttggtgatggacagggaagcctggcatgcttcagtccatggggtcgcaaagagtcggacatgactgggcaactgaactgaactttcactctctgccagtatagtgaatactgttccattatcaaaaccaaggtgctatttygtgcgtgctataattaaacagtaataatactaatactttctatttacccagagtcttgccctccaaaatataaccaatttatttactaaattaaaaaatatttattaaggttcattggtaaaccagagtctctatcctcatagaccttacagccgtgagatattatagagctacaacatgtgacaaataaacctttactcatttamgataggtcttaacaaccaaattatgtctttagtcataattttaagaaaaaatgttaacctgaaacagtgctgattattttagtgaatttatgta

SEQ ID NO: 4017 - DNA, 600 bp, Bovine  MMBT09419
ctccccactgtgtcaagtaacatcaaacattttctttatctagaatattcaaggtcacctgggtgaagccctaatccaggatttaatcaactactgtctgagctacatcgcgaaaatcaagctcccgaagaagaggtaggtttgctcttagcaacgaggtgctgctggagtacagcgtcacatcatctggcgggttggggctcagttaactccacagtgcagtgcttacaaggggccaccggaaaccttctgcaaggcccgcagtggactaaaggaaagtgaaaggagaagtgagagtgmagtcgctcagctgtgtctgactctttgcgaccccatggactgtagcctaccaggctcctctgtccatgggattttccaggcaagagtactggagtggggtgccattgccttctctagtggatcttcccaactcagggatcgaacctgggtctcccgcattgtagacagatgctttaccgtctgagccgccagagaagtcctagcagtggacaaatgattatataaatgatggcatgtccacatgacaggaattgaaagctcgatgctttcaaagactgccagtcaaggcccctgcctgtg

SEQ ID NO: 4018 - DNA, 600 bp, Bovine  MMBT05021
gtagtgaaatattttatggcttacaattttgctttataagattctacagtcaagctttctttcacacatctataattggacctggcacacagagttctaactcttaatatgatttcttgcatcattttgcacctttttaaacttcctcaatgactcaaatcctttggcctttgaaatgtgtttgttaactggaaagatgtaaacagctcatttaacttgaccttcaaatgtgccttcctttctcattcctttagtgtgaatatagcagagagtgttagtctccattgtagctgtgaagasgcatccaccttccctcagctcttcccagttgttatgccggtcatgccctgtcaatactgacaagcgattattagtctttgtttgctttgcactgtatattggcaaaataatcattgaaaggaactgtagacatagaaaccattattgttgcactattgtggtaacatagctcttaggcttgctgagaagatccattagatttgtcctcttatctaaaaatgatttcttctttgctttgtattgctccaggagttgactgtttcaccaacgtctgccacattagagatggatacctttatt

SEQ ID NO: 4019 - DNA, 600 bp, Bovine  MMBT10806
acttgcaggagcaacttcaggcttgtgaatgggccagacaagaagctggttcccttgtctagaggcacaagagctcctccattcatcctcattcaggctttctctaattccttctcatttcctcattgggaacctggggctaaagagggcttgtgactagatcctgagaggaataactaagtactttacatacttaattgcaccaaaggtaaattaataacatacttgaagagggtgaaatgagctctttcacagtagctagattcagaaggactcaagaaagacagtgatgaggtcttstgcctgcttrrgtctgtttgaattcagcttttgctcgtggtctaccaggcccattggagaactctctgtgagctgagggagcctcctcaaacatggcctcccacaaagttcatcccaggggctgtggatgagcttttaactgtggagttaaaaaatactgacccaggtataggttttcagtgtgtaagagcaccacagctatccacctggaaagaacctttccaaaarcctagggcaggagatgatagccttccaaggagcctaaatatcagggaaaaggatgaaatgaagcagcaagat

SEQ ID NO: 4020 - DNA, 600 bp, Bovine  MMBT03494
tttcagtgcagagatgtactcttgcttcaattctgccttgcttttcctgcttccaggccactttgctcctctccatctgatagatttgccccagtttactggggtgcatttggacagcttctctcaagcttccccaagactcctgttttgtgagatatatggcatcttagtctggagtaaaaagccactccaagaacatgtaagtaaattcaaagtgcagcatacatacagtgggatactatacacctataaaatgaataagaaatgctttgtgtgaaaataagaaaygatgcccaactygtattaatgaaaacagaaaggagaagattatataagtgagcttttacataaagagcataaaaatacacactagtctgcttatattttcaaatggatgaatgaaagggaaacaaaagaatagtaaaagtgatcattatgttagggaacaagatgatcatgggatacaatgaggatttcaatgtttcactgaatatcttttaatattattttactttgtttttttttaactacgtgaatatatcaccttttaagtgtcagattttggtgatggtcatgaatctgtgtcctatttttgtggtt

SEQ ID NO: 4021 - DNA, 600 bp, Bovine  MMBT10685
aaccttaagaccaccaaatttgacttttgatgtaagccatttacaatatgatggtttctttactcttacgcacttcctataaatgtttgcttatatgtgacttacatattgatcacacaatccagatagctctgggcctaactgatagaaaagaagttaagaaaatcatgaattcaaaatctaagaagcaaatacatggcttgggatctcaaagactggtaacttcaactgaaactaagtatttattaggagcccatttgaggcatcacccttttctcaggaccaggaactgagagagakaagccaggcagcatggcaatgaagcaggaaagacaggagaattttaatcaaatatacttaaattattactcaattcctcccactaagcaaacacttcttgagtgcgctatgccttaacaacacttgcctaggctcaggtttgggctcccctggtagctcagctgataaagaatctgcctacaatacaggagaccccagttcaattcctgggttgggaagagcccttggagagggataggctacccactccaatattcttgggtttccctggtggctcagtcagtaaagaatctgccctgc

SEQ ID NO: 4022 - DNA, 601 bp, Bovine  MMBT08892
  misc_feature (1)..(1): n is any nucleotide
ngggatgggattgtttttagttagtagggatgaaattcctggctcccaacttggccttctctgatatcatccctgcagaggtgaaagtcagctgcctattccatctttgcaggcatgggtagggttggggccacaggtttcctgtagctggagtagggcatttattgttgtagatgttgtaaatgtaaaaattgtaaaagttttctgtctccctaggctgtcctttttctggtcctctgagtaaagtaagcaggcttttgttgggactttaaaaaaaaaaaaaaaaacctgttcccatgakcatttccagtttccagctacttcagctccaagtctgagaaagatgaagcaaaaaagaaaacccactggactcagcaccgagtcattcctagtcccaaggagcccagctggtctgaattattctctccaccttgcagagtgctcttatgcttattttatatataattgccaagggttttagttgtacttrgtgagaggaatggggaaaagtacatctactccatctcctcaaaagcaggaaaatccattttttaaacttcaaatacaaatttctcctttacagcaaaagctcctcataatt

SEQ ID NO: 4023 - DNA, 600 bp, Bovine  MMBT12065
gctgactaccttaccgacttttaaaaataaattcctttaggactactaggtccataatcaaattatttgtgaagcactgacagaattatatcctcctttctggtatttctcatttgtttctctcaccttattgctttggtgggaacttccacagtgatgttaaataatagtggtgtttctggttcctgattgtagttagacatccaccctccaacctttcaaagtccccaaaggacaaaaaagatattattaatttgaaatctgttttattctaaaactttactaaagtggaaaastgcyatgcctgtgatgaagagtgctgatccttgacagtagtgggagtttggttgaactcagtcatgtctgaaaaagggccacgtgctgaatgatatcccagtttagtaacatcagtaatctggtgtgtgtgtgtgtgtgtgtgtgtgtgtgtgtgtgtatttaagtgttgagtctttctgaggaggatcagcctctcaggtgaacttgatgaatcttctraagtatatataacagcaggggaaggagagggtgggacgatttgagagagtagcactgagatatgtacactagggtgagtgaaac

SEQ ID NO: 4024 - DNA, 600 bp, Bovine  MMBT16543
agaacttgttctaaattgctattgtaacaatgttcttactgggattttgttactaggaagtttaagaagtactttgccaataaattcaaatatacctaataagtttacttcttaaattatctaattcaataaagattacttcatcttgagacatatgccttcctggaatccccataatgctaatgacccctcattcatcgtctttaatttcttatgagaaacatattacattttcttcttagaaatctttatcctgatcagagagtcaattaaagagtgattaatcttatttcaaggtargaaaatttctcaatttgaattgcagttgtagttctactttcaaattctttagtatatgaaaggggacatagcttacataagcctcattatcaacactgccattttayaatgatgtctgcatttaccttagtaacatggactgaaaaaaattcatatattctctttctttctctatttgtttaatgcaaatctcagtgtttcttttccccaaaaatatttatattcattgaataaaaagtggctgaggtttcttaactaaatttataaatatctttattctctgaatttggctttctatta

SEQ ID NO: 4025 - DNA, 600 bp, Bovine  MMBT15563
atcacttgctgggaaatggggttccttttgagccaactgagaaggcaaggactcaggaccccatgccataccatgatgacccttcatgatccacaccctgtgatgacccatgcccccctcacatccagaacctgtgacctggggctcctgcagagacaaggccaggcycaggagaggccccagctcacggcactcaatggagtttgtgtttcaggacaagacatcctggacacagctctacagtgacacactcatccatgygcccctcccacacacagatacagacacagggcctccacrgctcccggttcccacctgtgagtctgctgcaccctatgtggttctaggacgtgaaatcagtrttttggctcccatgtggcccctacacttcacctggtgagccgtgatggggggttaccatctcaagggttctcaagcgccacggtgacctctcaccactcttgccacctgtgccagctttggatctccaccctcctgctcctctaccccatcctggggaggtgccagcgccccagtctcttagtagtgagtgtaaagaggcactggggttacagaagacaacatttactctctctagtt

SEQ ID NO: 4026 - DNA, 600 bp, Bovine  MMBT15080
gctcacattctatacaaaacacaacacttaagaaaagttaggtttaattgcccttaaaccaatggcacctacaactcaagtatttccttcatcacacattggaatttaatgtcaataactactaatttaaatcaataattgaatgaaactttgtaaaaagtttgaaatacaatttcactgttccacagaacattttaatatctcaaactgggtcaaccatagtttatccttcaagggggattcaacaatttcaaacaatcatataggtccagaatatgaggtcactcatgatttacagasgcaagggtctgacctcagacaggcaagagtgagctgtttgaatggcaagtaaacctagatctcagtgtccaatttttttgctcttgacttactcatacaagtagagtaacacttaagagtgagtaagtgagtgattttaactttgcttctttgtgtatattggccatcaggaaatctttaactgctagaaaatagaatgaaaattcaaattcttagaatatgactgttgtctgaaaataaaagtttagaataaattaaagggtagagtgtagaacgcaacaggccaacagggagcctgaa

SEQ ID NO: 4027 - DNA, 600 bp, Bovine  MMBT21881
atttcttggctgtgagaaacatgtgggatcttaactccccagccagggggcaaaccctcaccctgtgcattggaaggcaaagccttaaccactggaccttcaaggaagtccctaggcacaccattgtcttaaaggactttccttggttacttctcyctgggtgatcataaacttatttcccagtaattcctgttcatttgctgaagactttagcatttgttctttttactctctatccctgctcttaacatcattcttgataataggaataaatatggtaaatccaccaaacaattamayctaacactttaataatgcttacaatatgatgggcacagttaagaagtctgttaataaagtcatttaatcattgcagtaatttatatagtagaaactatcattatctccattgataactccaatgataactatcattatctccayggatatggaaattgaaacacaagatgtcaagttactcacttggatcctttaataagaaggagagatagggtttgaatccataagttctgtcaccagagtctgtgaacttaacaatcaacatctaggtgaggatcacagcttttgcgatttaaaata

SEQ ID NO: 4028 - DNA, 600 bp, Bovine  MMBT21550
ggtttttccactcaacactttacamagagaggtaggtacaaatggcaagttgctgtatctgtgtaatactcagacgtggtcctcacccattccccagagcccactcttcattcctgtataaacagagtggtttcaacaggatcttagagtatgcctcagtatttaccatttgcaaatatggaatctattaaatcacgtcttcagttcaataaacatctactttgtgtacatcactgtgttaagctaaagaagagttagacagctgagggtaatggccctgttccctaacacagtaaggargacataatttagaarcttttgtttaacatgaaaaactaaccataaatccataaaaaaatagaatatcagggatgaagtgtcatgactgctaattttttaatggcttaggaaaagacaacaraaggatgaagtattaatagatgtgataaaatgtcagtggctgattctagatcatatttgggtatatagtttttcttttctgtatatttgaaagtttatgtaataaaatttaaaaaagggaaaaaagacttaaccataaagagcattataaaactctacaaaagatcatttcaagggtat

SEQ ID NO: 4029 - DNA, 588 bp, Bovine  MMBT23417
tctctctgctacatctttgtcttatttctcatcgttgtcaatatggtccgtataactcataataatagtggtatagggaactggtaaacttaaaagttatttccaagttgagagacattcctacatttccagctgcttttatttctaaaggtggaaacttttcttgagtgggttatgtagatgcaaagcaaatatgtacccattactccaggggaggaacatagcagatatgtttggagatagataaaagctttttctctttatattccttgttgaatrgaccttgttgacttatggagrggggtggattctagagatggatatgctaataagtcaaagggtatatcagtcagcataggtaagatargctgcaataatgaacaactctaaaatattaaaacaacaaaggcttatttcctattcaccttatatattcagctgggttatgcttatgtattcactcactgggaccaaggctgataaaaaaacatccaccatttcaatcattgatagtctctgtggaagaagaaaacagttctttaggtgttgcattgacaatttagtgttctggtctagaaagtggtaaaa

SEQ ID NO: 4030 - DNA, 600 bp, Bovine  MMBT02343
aatatttgttcatccaatatgtcatgctgtcaagaaacataccaatgaagaagaccaagttcctattctcctggagtatataatcttgttggaaagcaaatgtctcaatcataaatgccttttctccatacacagagaatactagtttaaagaactagatgttcaaaaaaggtaagggaagtgaaatcaagttgaaggggagtacactttcccttttaagctactctttgttttttctttttagctactcttaagccaagaagaatctttaccaattaccttcaggcccttaaataagakccattgacctgtcaactgtatggatgactcaggtctactttatataaaacactcctttgtaccctatagttgtgtaatcctcctattcatgcacatactttcttgactctagagcaggaacatggacacaaaagtcatttctcagctgagtctatctttttcttttggtgaggaaagttccatatgctcagatattcctccctttaacttagtacaggtatctttcttcactaacttggcaggtactttcctgctccttctggagatttctgctcttagaacaattatactcttcctctt

SEQ ID NO: 4031 - DNA, 600 bp, Bovine  MMBT01068
tcctaaaagatggccaacagagcaatatacaaaaaaatcaaagacccaacccacgraaagtccttcaggactcactgtccttgtctcattgttctacttaatagggattaggtaattcacaaaagagagggaaaattaattttataaaatatttaaacaatgrtattagtctttaaaggagggatcataaataaaatgaggagggagaaagatgagaattcttggttagtgatacctgaatagaactggatgtccaaggtagcagagtaatttaaataatgttttaaagaaagaaaataygggtggaagtgttatactaagagtctggtatttctttgagacagtaatctccccttcccctgtttgttagttgaaaaaacaagctcggtggttggtagtgatagtgtatttgtgggaacatgggaaaattartacatgtacacacactgtactgagtaggttataaaagatgtgaatgatgactttttggcatagttaatgaagtctaaagtccccaaagttccagaagtaatttgaagtacattccctcttttgtcgttatttaaaaagagacttagggagtttcctagtggcaaagta

SEQ ID NO: 4032 - DNA, 600 bp, Bovine  MMBT01315
atgccaaactgttgactctctagttgtggttattctttaaaataagccatattaaatataattcacctttcctgatgaaccaaggtcatttttatgagagcgtattatactgacagtatgtttttaaaaaacaatgatatcattagaggtttttaagtgaataggctgtccttaaaatgaactcatccaggatactttaccttaataatccttctgttgcttttgatagttcttttctatctactatacaaacatttgtctcattttgctatatccagtgacattgtaaattttaatctycagtcatacattatacacaattatctaaatgaaaactaaagatgcttctatagctcatatataaaatacagcatgtagtccctatyataaaattcagaacctctttctctgggagggtggggttatttttggtttgtgactatgtaccaggtggttgaaggtgcacaaaatctgggacatacttccacctaccaattcataggaaatgcagaggaacatgttaaactgtgccacgggaatataatcaacagaatctagtctgtggtaattttataagacaaatagatctgcttcttccat

SEQ ID NO: 4033 - DNA, 598 bp, Bovine  MMBT19623
  misc_feature (1)..(32): n is any nucleotide
nnnnnnnnnnnnnnnnnnnnnnnnnnnnnnnncaagtgcatctgttaatcttttttaccttgaagacagcaggcgtaaatggtctagaagagaatcacgtcagatggacccttgccagagccatcaggtgacttactgaggtgcctgatgactgcctgccaaacgcagaagcatttgcctctggtgcaaagcacagatggttgctgttctctaaaacacgaagttggacacagttccaagggtagagatgtcctgaaaataattgcytgtctctattgttattagagacctagttaaagyacactcttgagagacaagaaaagttcagaataaccttgttccagtcattcttctgggaatgaattgtaacaaaataatctgaggtatagaaaacaacaacagagatgctttttataaaaaggcattggtaaagaatttttaataacatggggaagggattattagaaagttttttgaaagcagagaataattgtacttatagaatgatttcaactatgtaaaacaaaagcttttttaaaaagactagaagatatatatgaagctcctaacagtcattggaaaaagtaaactgacttgt

SEQ ID NO: 4034 - DNA, 602 bp, Bovine  MMBT20483
  misc_feature (1)..(2): n is any nucleotide
nntttttatctgtaagtgtattattccctggaaatataattattttgttcatttaaaattgcttttgatcaaacaggttggtataaaccagatttttttggttgcctgcagatggcagtgattattaacttgtcattctaaataaaaggtgttggttttacttagcagttctaaagtgctatattaatggcagtttattgkgttctaataaaaattagtaagatttacatgctgcctttgaagaagagagttgatttatatatttaacgtgatgtcatttaaaatattaggtgactagacaygaaacacaaagacattaaattaacatacttcactggattatgcaaaacattgaacagtgacaaaagcgtttcagagcaggatttgattattgtggccaaatccagtaatgtatcctggaaaatttgattccaaagatatgcaaaacatgataaactttgcactctgttttatctccagaacaagatatagcagtaayagttgattgtaccttgaygatattggcaagtcacattctggaatgcagacagcagtgctgtccaaatagaaggaattaccaaaaggcaayggaaaaaaatctg

SEQ ID NO: 4035 - DNA, 346 bp, Bovine  MMBT20978
cagacacgacactcagggttttctgtttattaastcatttaagcctcaaaacaagtctatatggatggtgctataattactttaatttaactttgggaaagkctaagtaatctgctcaaggtcacacagccaggaagaaaaggagccaggatttagaaccccggccatttggcctcagagctcatgacactttggctgattaaatatattctagcaagggaggtggcaataaagatggatgattaaatataattttaatatgtactgcaactgggaagtacaggatgccatgtgttatayggcgggtggagtaactccagtcttgaggggtgatcaggaaaactta

SEQ ID NO: 4036 - DNA, 600 bp, Bovine  MMBT21650
gataactaaagaggctacctgacggacaagggagtccaagcagtgagaggtatgggatccaaggctgatgggactttggagaagtccttcaggagcccatctcccgtgtcagggatgatacgggtgggtattctaccatagagcccgtgaagaacaaacacatacatactatagagaagccaggctttggctgccacttatacagaagccgtcaattataaagggggaaccaaaacagtgctatttaattctgcmtttccccctccttctggacagacctgaacactccaaaggatatasagtaacccagaaaagggagtaaggcagaagggaggctcctcccctttcccttgcaaggctcaattcctgatcaaggacaaattagagaataggtagtgctttgaactggatataagatataagccataaagtgaactgtgtatacctagaagagactagaagacaatggratctyccaattrtagatatgggatgaaaaagggcgattcaactgagtatgtttgaagttaattattggagaaaattaagatattttatatctatatcttactgagttcatttttctgaatatattgattc

SEQ ID NO: 4037 - DNA, 600 bp, Bovine  MMBT16171
gtgtttcatcgggaagcagatgtgctccagtgataggagatgggaaggggatgttttgttattaattrcttagctttgaataaacaaagactttgtatttttgaaagatgtcttcttctggtttatagaaattaatcctatttttaaagcttttcattagttgatctaagaagtatgtactctgttgttccagtaacctaactcctgaactcttggttaattgtattatgtcatatcttctattacataagagcatgtgagatttataggatagaatttcggtagagaaaaggtgtgtcktaaaagataggaagtggtggcagactagtatttgtaatctgagaaagctcargttttgccttttcatctctgcttgcttcccttmgttgaaagaaatcagaaaagccattttaatgagaaaytgatatcctattttaatgtttaaaaaataaagaatttagcatttaaactagataacaataaaatatcttgactcaatgtcacaattatgccccgtaaacctaaatttatcaactgtattctgtgaaccatagttggaaaatgctaatttaaagaggttatatagaatcctgaattagg

SEQ ID NO: 4038 - DNA, 600 bp, Bovine  MMBT21415
ccatcctactctattattgcatgttgcattttataaagggcactagtcatgcactcctttacaacaatactattgctggcaaaaaagttcctggatatcaaataattaaaaagttacttcaaaccagttgaagtttcatttgaatgttttacaacttaaaaaatgctgtatatcaattacaaaagtgaataggaaacacgccaattcatttggtgtgcaaaaatattttttcactacacagaatttaagggcttcacagaatttttttcaaattttacattttcagcagaaacacttaasgaataagcactttctcaaggggatgttaatatgcttccacttttgtcaaactttttaccctttgacaacgctgcaacctgtttgagtagctctctgtttttggcctgtgggagacaaaaacatttaccattaaaaatatttcaaatattaagtcatgctgaagaatacacactatcagaatgaaagaggtatttaggctcatctctttgatatgtaaaaggaaaactttagattggtttgtcagccccctttgtaaatgtccatattaatgcrattgttgtccagattcaactggttaca

SEQ ID NO: 4039 - DNA, 600 bp, Bovine  MMBT09985
aatatgaagagccaaatttttcatgagatttagctgtggcattatattttgcacctgtacttttacagacatagaatttaattgctcctttatttggctgataatttttacatttggctgtttctgccactacactgagattcaattatgcacttattgatccccttgggaaattttgcttcatcatgacaattcatagtcataatttaattgcagaaatgatgcatggaaataaaaaaggtgtctactaaatgtgttgagaagagtgaggaactacagttgcacttagaagtaaatttsaaaatgagagctgttattggaaataatttcagatcaattcactactacattcttagggagacaggtctgattatattttctattttcaattttatatgtgctcttgctttcagggagaaataagtaacaacatatattattgttatatatataacaatatattaatgtatataatattatatatatattatcataaatacatcaattggtaaatctactacacctacattatatctactactgtgggcaaggatctattagaagaaatggagtagccatcagagtcaacaagagtccgaa

SEQ ID NO: 4040 - DNA, 600 bp, Bovine  MMBT04890
attggtagacaaagaagcatatgagaatagatttgggcaacataatgatgtctggaagctaagtcagggcaaacttgagtggttaagcttgaggaagatagaagtgaaagaaagaggaaggtgaagatgcagagaaacaaagtattgtttgaacatcaacagactttcaaaatcaggaaaagcttgaaatagttattttagagaacatgatggggagctaaaaacaaggaaacaaaagggaaaaaaggaagaaaagtcaagagaatgagaagataagccacagacagaaaatatttgcaraagacacatctgagagagaactgctttccaaatcatacaaagaactaatatatcttaaaaataagcaggcaaccaaattttaagaagggccactccagtkttcttgcctgtagaatcccaaggacaggggagcctgttgggctgccatctctggggttgcacagacttggacatgactgaagcgacttagcagcagcagcgacagcagcagcagcagcagagaccttaagaggcaccttaccaaataaaacatacakataacaagaatgaaaaaaatctgtcacataacttgacattagg

SEQ ID NO: 4041 - DNA, 582 bp, Bovine  MMBT20052
ttttcataagggagcagcaccttgatttacattctggtgtaagctcttttcctcattgttacagacaagggttttgaatagctgatattctggtctgggttggcagagggggttgattaccttgacatgcaacagaatatcatgttggggcaccaggaagaaactaacaaacagatgccttaggaagacagcacagttgagggagggcagaacccacgtaaaaggctcccagacctctgatgttatgaagttcctagtaggacaatggtacaaaaacgccaatacactccctcttaaatragagacaagttgcttcactttgcagagcccacagcagaaggagcccgaggacttagtttacctaaggctttatatttgggtatacggctctgatccatctactcggtaacccataaggctcctgtttaaagagatatgtggagcaagagaagatctgcagtagatccaggcttttgcacaggtaacctgtcacttagacctgtgacccaacagattgagtggtacttgacaaaatatatggaggaactgaatgaagtatgtgccagcaatagtaacatcaca

SEQ ID NO: 4042 - DNA, 600 bp, Bovine  MMBT11505
tatcctacttgaagttcactgagctctttggagggctatgtgcatgtttttcatcacatttgagatgttttcacccattattttttcaagcagtctctctgctcctctctctctatctcttctaggattcccacaatgcatatgttgatctgcttgatgttgtcccacaggtcatttaggcgttcatttcagttttcttcaatctttttttttcttcctgttcctcaacttgacaatttcaattgttctatcttcaaagtagctgattcttctgcctactcaaatctgcttttgaatccytttagtcagttttattttagttatattttwaactccaaaattttttagtttatttttaggttttctctctattaaaattaccattttgttcgtacatcagttttttgactttgttcacatcttcttttagctctttgagcatctttaagacagacagttgttttaaattctttgtgtaggaagttcaccatctggtctttcttagacatttattttttcccctttgaatgggtcataacattcctgcccttttatgactcatgatatttttgttgttgaagcaggacatttgaatcttat

SEQ ID NO: 4043 - DNA, 600 bp, Bovine  MMBT12518
cttctcccaagtcttttagcatttcactcaccttttgccctggtctgcttcttttagctactgctttctctttttcacttctgaatctctcttttggttgagatggttatctacagagaaacagaatttcttctaaagaaagcaaaaatctaacttgcagttgtgaaaactatcttacactatttttgtataattactttcattttctatagtggagcagctgagaaaaattgctctaattgtgtaattttctgcaactactctgggacaaaaatcttggtaattggatttttttaaackaacaagttgtcacaattggatagttcttaaactatttgtgcttatgcttcagaaattttcagtggatgtacagtgtattttaaatgttttgcatcagcttgtggtctcaaatttgatttaactttgaattttaaaatagattgacaactctgattatacattgtcttcactaaatggacctttgctaagttttgagtgtrttcatccctaccccactctctgctgttgtcatgsgagctaaaatcctggcggattcagctccacccccaagtggttctgtctcccagagtgctttgctgt

SEQ ID NO: 4044 - DNA, 600 bp, Bovine  MMBT06436
tagaaattattattacatgtaaatatttaaaataatgtctttattactctttgaacacttaaagcaagataacaagcatgcaaatgaatcacatagtcagtatatactcaagaataaaatagagaaatatgtctgtttattttcttagcctctagtgggaaaaatttacctgttctaaaaccaactcaaaaagtattacaatttttcctaaagagaagctcacataggcacggaaacatgtggagaagagaacagtgagtgatttttgaaatcagaagagtctgtttcaaattcaaatgytcaaatctgctttctgttagctgtagccatgggcaagaatataaactttcttgaatttaagttttcttatacataaaacagagctgtattcctgctaaattctttcctagggttttttgtcaggccccaaggagataatgtgtgcatgccaacaactgtttctatctgtgagtatttcttctgtgctaggcacaattgtagatgctagagatggtagggcttgtgttccattcacatccagcttcatggactcagagaaataaggctactatccaaaactgtttactaagttctgagata

SEQ ID NO: 4045 - DNA, 600 bp, Bovine  MMBT09242
cattccctggcatgcattcatcttttaaccccaaaaccaaagtacgtgagccaagtggacataattacataaatatctggctccaaaataatctacagtttgttgtacatatatagtgtataactttttttaattctctccctttttctcactttccccaccctatacccagaaaaactcatatttagagaaagccacacctatcactaagggtgaccaacctttcaaaaaaacattaagagcaaacatttagagccatttaaaccccaaggaaatgccagggcactggaaagttctaaycctcaatgcaaatgaagctactggaatttgtaaggagcaaaataaacaaaacaattaagctattagcatatctcctaggagacaatctggccttcggagaagagcaaagcctgatcccacttgggcaaggtgagtggttagtttgactaccgaaaaacaaaggcattaaatactcctctttcaaccaggatagataaaacctttctcaagaaattttacatagctgaacaagaaaaaccttcttactgtatgttaatctggcagtgatcctttacatcaccaaaacctgcctaaccactc

SEQ ID NO: 4046 - DNA, 600 bp, Bovine  MMBT02807
gtccattttatttcactgattcctaaaatgtcgatgttcactcttgccatcacctgtctgaccagttccaattgccttgattcatggatgtaatattccagtttcctatgcaatattgctctttacagcatcaaactttacttctatcaccaatcacatccacaagtgggtgttgtttttctttgggtccatctcttcatttattctcttcattctatctcctctgatctcagtagcatatagagcacctactgacatctttcagtgtcctatctttttgctttttcatactgttcatgrggttctcaagggaagaatgctgaagtggtttccctttctgttttccagtggaccacgttttgtcagaagtctccaccatgatcctttccccactggacagctaaaagaagtatacacaaagtgctatcaaaatttaagaaatcagctatttctcaaagtgaatagattagatagaaaaacaagctactattcaatgatcaaccagataagataataatgaatattttgctgtttcctggtttgtgaatggcattttattaggtcttatgaaaaatattaagagtaactaaaatttataca

SEQ ID NO: 4047 - DNA, 600 bp, Bovine  MMBT06527
gtagggcaagtttgcgagtgacaaactcagtttttgcgtatttgtaaatgtcttaatttctccatcgttgaaagagattttagcaacataacagaatttctggttaacagtcgttttttcccttcaacactttgaaaatgtcttctagtatccatggtttttgatgtcagctatcaatatttttcttttgttgcttttaagatttctctttcactctcataaatttgactatgatgtctaaatttgattttgatgtctatgatttgtctatatttgggtttattctacttggagtatacraagtttctttaatgcataaattaatatttttctagcaagtgtgtgatgttttctgtcattatttcttttaatattctttttgcccttttttttttccactcttctccttctaagattcccattatgtgtatgttgatacacttgcaatgtcccataggtctcctgaacttgtgttcactttcaattcctttctactcctcacactggataattagtcaactacattcaagttgactaatactttcttctaccaactcatatcagttacttgagcccctttagtaaatttttcatttttgt

SEQ ID NO: 4048 - DNA, 600 bp, Bovine  MMBT10483
tgctacaacattgttaagtagaacaacttcccttaattaaaaaaactcacatataaacataatgaaaagcagaaatgagcataactgtagttgcttgacattgaaacaatacaagatcagggtcttctcaccctgaaccctgttcgcctttgcctaaacaaaaatcccttccatcgtatactgctggttatgctgaaattttatcttctgatcttttattccatttggaagagttcttcctttcttcccaaggggaaaaaacaaaacaaaatatgctatgctttatgaggaagatcacamtataaaatcaccttcacaaagatatatttttcatgcaggttttctttgtagaatgtttgctttgtaacaatcattcatattctgactaaatataaaatccttgcttccctcctctaccaagttcatggttcaaaaacctgggagtcatctaactcatccttcttccccaaccatacatacaggtcaccagatacatttgaattttagttaaacaatgaataatttgcatgtgataaacatgtataatttgtatgtgatccaactattgcttggaatgcacttatgttaaaaaagttattg

SEQ ID NO: 4049 - DNA, 600 bp, Bovine  MMBT11906
tttgtgtgttgcttccttataaagagagaagcagctgcagtccttggccgagttgctgaaatttatccctttgtgtatattacaatatcctccattttttttccctctgccctctaaacaacaagcgtttcgccatcttgggcaatttttattctcaagtctctctctctttttttaatttttatttttcaaagactgggaagaaacctcagaaagtcaaaaagtgtgtctggttaagattcaaagtttagggaatgttcagggggcccggtgacgtcatgtaaactttatgaagaaatyttaccaggagtaaatttttcgcttaattttttccctgttttaagcgaccatgtgaaggaccatgtaacttacaggttaacgataagctgttctgcttatttttgtgtcctgctctcaaaatgagccctcggcgtctgcacattttatgttttggtaacaggtggaaaactgtgcgaaaaaaaggtggaaacagtggtctttggtatttagcaggcttttgtgtatatgttttttatactttaaaggatttgaatatttgcatgtttccttttttatttactccagtcctgtggatttttc

SEQ ID NO: 4050 - DNA, 600 bp, Bovine  MMBT11588
aagtatagtatttcagtgtattgacaactggtactttcctcctaaagctctagaagctgaagttcagacagttaaaagacttgcccaagttattcccatgaacaaggagtagagggaagacagaaaccctattttcttgctctagtatactttccactgtaacacactcccagtcaatatagccatgccttagggttaagagagatagcaaaaacattgcaatttggggtggtgaaaagacaggttaaaagagtattgaaggtcctcactgaagctgccctccctgggctctgggtttgkggtgaggaagacaatttctgagttttgagagggctagatcctcaggaagaacctgaggattctgatagaataaaactttgacccttgacctctgatccctcagatgtggaacgttactcagacaaatatcagatgtcagggccgattgacaatgccatcgattggaaccctggtaggtgatgggcccttacattgacttcttttctttcaaatgcttgagctgcctcaagccaccaccctatccaccctcctctgtccccaacctccaccctattcagaaggcttagatgtgctccagca

SEQ ID NO: 4051 - DNA, 600 bp, Bovine  MMBT00092
cgaatactcaaaaggtttttactgccagggggaagcacgtgtatttcttcacaaagtatttcaaagataatcacaacaaatggcacatgagacaggctactggaaaaagtggcgagccctattttccttctttttctttacctttttagaattcatctattttccctaaacctaattcagttgtatacttatattattgtcttagctccatcagatatagcaaaatataactatgtccacttggagggcttctcagcagtgaaccacagcccgtttcatttccgtagattagtatgtccrtttctcatggacatctgaagctttctgccctgtgctttctactttcgatctcttcaaatgttcaatttttgctaagtctacaaaaaaaaatttgaatttttctatatcgtttcttaggattgaaaacaagcattttctaatgggacctctggtcttcttaaccaccttactaggtagcttctagcttgctacttttatttctgtccaaatcttcttctggaaatacctgtaatttcttcttatagctttttgcttctttcttacgtaatttatcctttctctaactgaagacactgtact

SEQ ID NO: 4052 - DNA, 600 bp, Bovine  MMBT04486
attgaagtgtcatgagccgtgcttctgtgggtttcaggagcagccattgacaacaggaactctggtctgaagtgctgagtgcaaggcctctgcatgcagtactctgtgagcaactgcacctagattaagcacacacacacacacacacacacatacatacatgtacacacacacagattagactagtacatggattttgtttttattcctttgggaattgttaatgggctttgccagtcacacctggacaaatgtacccatgcctccctctaccctgcctacaagtgtcttttccaacakaacttgttatgttttcacttccctttttatgtttcttcaaatgccaccaataaaagattcarttacgttgacatattcctctggaaggcttgaggggtgatcagttggttcattagttttgtaacacgacattttggttgaatctgggactcattacccactcctccattagtatgaagaggccttgatttgttctggggtgagatggctgagctatttgcccttatatagttgggagcacagtcactccctgagaggaaagaggtaggaactccagcttaatctcttggaggctcagag

SEQ ID NO: 4053 - DNA, 600 bp, Bovine  MMBT06245
tgggaatgttgctaaagacagtttaaaatgaatagcagccacaggatttaggaatccaacttaagacagtccacacactggtgatcttttcatgaaagcttggatttcagttctgtatcctacccttgacaaacgctctcaccttcttaaatggtcttgttgagtgggaagtaataatgttgactgatattttttgtataaatgatataatgatgtttcacagcagaggtttaaatagtgaaaggccatgaaaaccctcattgatgaggcctgtactttagtgggtagaatcaccaaacyggaaagatcacccatgcaaacagtggcctgaagactgacaggggatggaaacrtacactgtcctcccaaataagaatttgggcctaaggaagaagggcctgggatttcccagcctgcccttactctggtgaagtaggaaagccagacgtctcggtagtcagtcagagtttgaattctgactctgccctctttctagctgtgtgactgcagccagtctccacgttctctgattgaaatggagactactcacaggaaacgtacagtcgacagttggtgctcggcaaatttcagcacgtaaca

SEQ ID NO: 4054 - DNA, 598 bp, Bovine  MMBT07456
  misc_feature (1)..(162): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattaagtaaaatacccaccaaattacagtatgctttggatgaagaatttactccaggctattccccatctcagattctgcttagctgtgctgtccttccaagctcacctgatacaataatgtatgggtcagctatyacggagtaacaaacaactacaaaatctcagtgacacacaaacataatttcaggtcaactggtggttagctgagctaggctgggctcaggggggcagctcttctttgagctgtgggttcaactggactagctcctcaccaaggtgtatcactgtgggcccaggctgaaagggacgttcaaaagaagttctactcatggagatggcacaagtacaagaggacaaatcccgctgtagaggctaatttccagtcctacttgagtcacaactgctaacatctattggccaaagcaagctacat

SEQ ID NO: 4055 - DNA, 600 bp, Bovine  MMBT23034
tgtcatgcctgaggacactgctgtggaccttcacagttccasctggtagaagggaaacttgacagagaaacacttcaagcagagctaaacggacacacaagggttttctgaagcaccagaggtaatataagttggatgcaaagtataactgctactgcattaaaagaattgaaagtggaagattttaatttcgccctgaataggaaacccactttggaatagctgcttaaaaataataamatttaaatttmctaaaatatgaaactgaaatatgattttggctgaactcacatttttttkataccatctatgatctgtaaatcttgttaaagataatagctagcaaaggttgcygtgaacattaaaatctgtaaattatcaaaatttcctacttgtggcttcttactaaagtgttcccccatttcgccattttctttttcccttcttttggatgcaatgttagaaatagtgaaatggacttagggttaccagagaggaaaagaccttgtctgagggtctctgagtggactttkcatgtatatgtgaaaattcttcctgttccaagatctctgggacctgtgtgacaagtggggcaagttg

SEQ ID NO: 4056 - DNA, 600 bp, Bovine  MMBT23031
atgcaatgttagaaatagtgaaatggacttagggttaccagagaggaaaagaccttgtctgagggtctctgagtggactttkcatgtatatgtgaaaattcttcctgttccaagatctctgggacctgtgtgacaagtggggcaagttgatctaagttttctgtgatttggatatcattctgctgttaagtgccaactccctggggagtttttaatgtttccttgtggtccccaattaatctataagttaagtatgtgagaaggttaaaaccagttttcctttgacttttttagcgaacycttgaaagccatttgatgtcccctgctgagattccaggccagcctrtccctaagaacatcttgcaggtacttaacaatcttataccgaggccttggagtcctgaacagtagtcctccaaactggttttgtgtagtgggccagctttgggccgtagagaatgatccatgttgcctggcaatgaaggatacggttttgctgcctgacatagttctctgtagctataaatgtggggtgggttggtgggtaaaaaagatgatcgagtaaagcyttggtttcccgtttgcaggtttgcaatttct

SEQ ID NO: 4057 - DNA, 600 bp, Bovine  MMBT21489
ttcctttcctatctagctataacaatatcattgtcttgtagcccctwatttttgtacttgtgtatgctttctgctgctgtctaattgtgcctttggtttacattttgcttccactaagaggctgaatttcttgaccacgtaggttatactttagactttcttattactaccagaaagatttgcacatctctggggatatcatagcctccgttttgttcagttgaattgaattgtttaaaagggaagctgctggagaagctcagatgttcttctgaagctcaggtgggaggacggccgtgygttatgctagagaaggtgctagagaaacacaaagaggcagagtgagcacaggagtgctggctctggctgcaatccaagtgcagtaattacatcctacctcctgaaagccccctgcaggttcaatccgttgtggtacccagcttcattccttttctacagtctgtgctctgataaatagaggccgctcgcaaggagtgggtgaagggcccagaagcagagcgcgcaagatggagagcctcagcgtagcctggaagctatatgccatggcatgtcttctcttcaaggagaatgtcaggcatc

SEQ ID NO: 4058 - DNA, 600 bp, Bovine  MMBT14690
caaagaaagattatatcagaattttaatctttgtagacttccttggcattttagcattcataacatgaaacaaaataattaagaattattttattcttataaaaattttattcttataaaatttttmttatataaaaattttrttattaaaatttaagaatttaatttttagttattaaattttattcagctttgagtctttcaaaaaaaggcctatttgggaattcttcacagcttgtgagaatgacttacaaggagaacatcaacttggccatcataaaagtttgtaagaaggaaaaytcgaaaatcctgtaaagcaatatctatgctgaaataaatctgacccagatagaacaaagaatatagactatgagaaaggagaaagtttcagagaaaactgtgatatcccacacccattcttccttaactaatcaaatttcaaaacaacagactttataaaaacatttcaagaaaataggtccttcttcttttgagtctatgcaaaaatttaaacagaaagcttgaaaaatattgctatagactacaaactatttttagtgctagaagatgaaggaattttgatgtttgatgaagaaataa

SEQ ID NO: 4059 - DNA, 600 bp, Bovine  MMBT17295
aatatttacaaattgacctggatgcttgctgagccttgcaggtgcagggacaccccccaatcaagcccctggcccytggcctctgtgttctctctggcctggctctagcttagagagtggactcttggggacaccacaggccttgcagcttgagctgtccctctcctacaaataaatggaagcagcagagggacagagggacagccctctggggacactcacgagagagaaaaacatctcagtttttaaagyagaggtgcagtatatactaggaaggaaaataaacccataagcatggtmtattcactggtgtttgcagacgtcaaacctcatttaaattctgcaaagctctggtttggtggttttagttgttaagtcatgtctgactcttgcgaccccatggactgtagcccaccaggyttctctgtccatgggatttcccagayaagaatactggagtgttttgccagttccttctccaggggctctttctgaactatcagtcaaatccacatctcatgcactgcagtctcctgaattgcaggcagatttttcactgactgagccaccagggaagcccaaacaattctatttacagta

SEQ ID NO: 4060 - DNA, 589 bp, Bovine  MMBT20446
ggaaagagtcccactgaactttttctgtgttaaggccttaagttgctcaccattgtgttgccttagaagtgggacatcagtaggggtctttgttccctacttatcagytgagatgtcacttgtcacctcccatcctcatttcattcaactgtaaagtgggggcaaataggtccgtcttaaagtgtggctgtcaagtttaaaggtgagaaagtgcctggcttcgcagaagtgctgggtaaacgtcccccttgcgttcgtttgtatcttcctttcagccctattctgcgggagacttgctcrattgggtctcttaatgcgggtcaattcgccttaattccgaggtgacggagacgccaccgccttggtgcgcagcttcctcctaaaggggttgcaaacggctggcttaccccagcacagcctcaaacccgggcttgacgcaaacgccaccctatccacccaggaaatcgggtccccaggtgcgcgtggaggccgcaacaggcacttctttctctgtggaccacctgttccccaacacacacacacaccgtggaccctgctccgacgtcgcgctccaaacgtccaaacgcgt

SEQ ID NO: 4061 - DNA, 600 bp, Bovine  MMBT05968
tcaggttctatccctgggtcaggaagatcccctggaggagggcacagcgacccactccagtattgttgcctggagaatccaatggacggaggagcctggcaggcctcagttcatcaggtcacagagagttggacatgattgaagtgacttagcatacaaagtggaagcaatttgaaatactacccttaccatattcgatttgggtacatccagagatatttgctgtatttggcaaaaataattattctgaaacaattgttgagctgaaattttctgttgccagcaaaaattcacattgcyaagtcctctttgcctttatcttctaaatccaagagtatttcaagggaaattcaatataaacatgtcatataccttcaacttcttgatccaattagcagttctttctagttgcagtgggttatccatggggtctttttaaaaaatcttacagcttgaaggggagaataaatggaactgatcccccctaagtactgaggacagatgtgcattgctcaaagactctcagcttagaaaagactttctcccctcttggcaaatcaggcagcatggaatcaccaatggcccagctcccatggtatt

SEQ ID NO: 4062 - DNA, 600 bp, Bovine  MMBT07153
gcaggattcacgcattatctatgattatggaacagataatcttgaagaaaccttttttagccaagattatgaggataaatacctggatggaaaaagtactaaggtattttatttctactctaaatttaatttataaaatagtcacccatttaaatgcatgtttttgtttttttctgaatgtgtctgataaggtaagaggaaaggaaaagcacttgaaatgattcaaaacaattcaaaataactgtccctaaattatatttttaaagtatgcatgcttcccaaattaataaatagactctrtgataaccaaatagtatctgtaacaaccaaaacataaaatttaaggaaarctaaaatttgaaatatamaatttaaggaaaattcaatttaaagatgatctcttatcagcagagatttacatttaagtcatgatacatagtgccttttatttgcatattaaaataaaayaggagaaatgtgtattaggagaaataawgatggattaccagctttaaggtttattattttaggaagaagtagttcaagtacataaatagaagagtactgsttattttgtatctacaggatttcataataatt

SEQ ID NO: 4063 - DNA, 598 bp, Bovine  MMBT07154
  misc_feature (1)..(107): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccacccctacaacaaggctgggaagtcaagaaggattgagataggaattggtgtttaaaatcttctaagagaactacttcagggaaggactgcctagttttaccactgcaagatttcttggtagcccagtggtccaacctgttcatcccagagtaaaaatatcacaggagagataaggcttcacctgtgamaaaaatccacagacgtgtccctcaactttgggaaagggcctggatgggcawctagggcaggaagtggacagaacactgtatcccagagaagtaaccagcggggtggtcagagagcagagcatggrgaaggcctgtgggatagataccccggccagctgtgatcgccacatgcaaggcaagtccccaacttgaccctttcctggtgtcccggcgctcacaaaagacgctgaaaccgctgaaggcagctgcgcccagagacaggagatgatatacatagaaatgatggatacacacgcct

SEQ ID NO: 4064 - DNA, 600 bp, Bovine  MMBT09346
actaatcaaacaagaaagcatggtcacagagtctgctgcactggaacaggaggatgccaatactgcaacactcaagttctgaaagagaattgttaatcactaataaaacatttagtctactatacaaaagctaagtgctgataattttttctaccccaagtcacaaagcctgtttggtttcatcaattcctaggaaacgcctccagagagtaaggaaggaagagattctaggtaagatggggtatgcatgcatcatctccttgtctgtgttagcgggtgtggtggctcttaacaggtcartgggtaggaggaccctcactgacaggggaagggaaaaccgtctgaatcattttgcccagagccagtctctagttcccgtattatccattttaaaaagaaatgaaaaaggggaagagggcataaaaacaccttccagaaacgtggcatcctctgctaaagaaaacaggtaaacaaagcaatctgtttaataaagttctgtttttctcttttccttgctattagtgtctcctgaactccttatgaacttccttggtctttggactttttccacagttttcttcagatgacttgtcatgaaat

SEQ ID NO: 4065 - DNA, 600 bp, Bovine  MMBT13227
ctttaaaatattctgagtgcaacctatttttaaaaatggcattataagaagagtggcataatatttgaaataattttctagaaacaagctttacttccaaaagagcgtttgatcaaacmcttcatgatgaataagactaattacacttayggtccttgtgagctgtttttaaaaattcatgtgcaaaccttcttcaagcactttaatctcctgcattccactgcaaaaccytcttcaaaatgctaaatggtttactgcccctgcacagtaattatttattttagtactctactggcttcycttgtagctcagatggtaaagaatatgcttgcaatgccaaagaccagggtttgatccctgggtcaggaggactcctggagragagaatggcaacccactccaatattcttgcctgggaaatcccatagacacaggagcctggtgggctacagtccacggggtcacaaagagttggacacgactacctcaaattatcctattttttkttkttkttgttaccttgatattctccctgttctacctagatatattctgaatgcttaaaggcagaaattctgctttatctgtcccttaagtctc

SEQ ID NO: 4066 - DNA, 600 bp, Bovine  MMBT20261
tttaggggagaaggcaacaggagtcagggtcaagggcaactaatatctcatgatcaacttgagcaactaatatctcatgatcagaggaagaggcaagagaaggagaaggaaaagccgaaccccggacgaaagcctaggggtcgggaggacatagagctggggcaagaacccaaggtggagagtggtcatgaaggccacggagccaaggtggggaaagagctggggaggctggggckcaggtgaaggggagaatgcaccttgaccctcacgtctgcctcctctcccaccccccaggtttgygagctggacatcatcttcaattttgagaaggcctacttcatcttggatgagtttctgatggggggagatgtccaggacacctccaagaagagtgtgctgaaggccatcgagcaggcggacctactgcaggaggtacgggtccgggacagtgaggaggaggaagaggaccgtggccgagggcaccctccctaccctggagccctcacctgtggaccccagctgccctcttcccgccgataccgaaacggcccccctccatgtggcgtctggcccccacgctgccaggttggccagctggcc

SEQ ID NO: 4067 - DNA, 600 bp, Bovine  MMBT22205
ggaacctgaagcactaaaaggatcatttgcccaaggtcactcagctcacaaatagtggagctgaaatttacacacagtctgacttcatgcagcatcaccttgccttgagtgtagccaggccctcctgccactggtcctgggggacatctgtgtcttgacacactgaaatgtggcctcacccgggaggtgggtgatccacggggcggaggcgttcattgcgcatcaggtgccagtgtcgtgtctggcctctctgctgctgcaggagagcccacagggtttgctctggggccacagcctcamaaccacaaggggctctgacccttctcacttctgcttcccctgcaggtacactacatccttcaggaggtggtgatgggtgggatggtcctggaaacaaacatgaatgagatcgtggctcagattgaagcccagaacaggctggagaagtccgaggtgagacactgctggaattttgccgtggctggttagagaagacctgggcagagggaggaatggctgctgtgtggagttggattattgtggaaccttaggagtattttctgctccatcttctttttttccctgactcaattgacactc

SEQ ID NO: 4068 - DNA, 600 bp, Bovine  MMBT10578
taataamatttaaatttmctaaaatatgaaactgaaatatgattttggctgaactcacatttttttkataccatctatgatctgtaaatcttgttaaagataatagctagcaaaggttgcygtgaacattaaaatctgtaaattatcaaaatttcctacttgtggcttcttactaaagtgttcccccatttcgccattttctttttcccttcttttggatgcaatgttagaaatagtgaaatggacttagggttaccagagaggaaaagaccttgtctgagggtctctgagtggactttkcatgtatatgtgaaaattcttcctgttccaagatctctgggacctgtgtgacaagtggggcaagttgatctaagttttctgtgatttggatatcattctgctgttaagtgccaactccctggggagtttttaatgtttccttgtggtccccaattaatctataagttaagtatgtgagaaggttaaaaccagttttcctttgacttttttagcgaacycttgaaagccatttgatgtcccctgctgagattccaggccagcctrtccctaagaacatcttgcaggtacttaacaatctta

SEQ ID NO: 4069 - DNA, 600 bp, Bovine  MMBT07169
atgtcagtgattacaggctgctctcrgagtgaagttaaataacagagctggaattatttctaaagaaatctttaaaatattctgagtgcaacctatttttaaaaatggcattataagaagagtggcataatatttgaaataattttctagaaacaagctttacttccaaaagagcgtttgatcaaacmcttcatgatgaataagactaattacacttayggtccttgtgagctgtttttaaaaattcatgtgcaaaccttcttcaagcactttaatctcctgcattccactgcaaaaccytcttcaaaatgctaaatggtttactgcccctgcacagtaattatttattttagtactctactggcttcycttgtagctcagatggtaaagaatatgcttgcaatgccaaagaccagggtttgatccctgggtcaggaggactcctggagragagaatggcaacccactccaatattcttgcctgggaaatcccatagacacaggagcctggtgggctacagtccacggggtcacaaagagttggacacgactacctcaaattatcctattttttkttkttkttgttaccttgatattctc

SEQ ID NO: 4070 - DNA, 600 bp, Bovine  MMBT17145
acacttaggacgcaaatctgagtgcgccttgactcccgacgagatcccttaggtgtagctgatcgctcacagttgaactgcgagagtttgccgctagaggacacagcacctttgcaactcgtttgcctgggaggacaggaagctcgcacttttcagaaatgccgctctcctgagaaagctatggatctgcgcctccacgctacgcccagagcaaacagcgacctgactgagtggaccgaacgcactctggaagcgcaagggactctactgcgaagattcgcttgaaaaccgacgcggagkgggagagggtgcgcgsaacctcattacacaaacccggatcccgggattggggtggttgatggtgtgggtagggggaccataaagcttgtgaaatccccacctctggtttttgtcgactgtggcacctccaccccagggctctggattggtgtccttggacgagaagggcaggggtgaagggcgattgggcataaaaatatggaactatggaacgggactgttgtaaaagccaagtaagatgtccaaagaagaaaggagggtgggcggaaaattttgtaggatgaaacttacttcttgttt

SEQ ID NO: 4071 - DNA, 543 bp, Bovine  MMBT00797
gagaacctgcaaaagatgaaggcagaaatgaatctggtatattatgttaagtgaaagaacccaaacacaaaagaccacacattttatgattctatttatattaaatgtccagagaagtcaagtctgtggagacagagaatgggatgcagatgggaatggkgttaactaaatgagcatgaaggatcyttttggggtgatgaaaattttctaagatcacattatggtgatggttgcacaactagggaaacttactgaacaatgaataataaaagtaggtgaattttatgttatgcatattaygctttaaaatgttaaaaaaaaaaaaaaaacagaaagaaatgagtctagtatgagtaaagggtggcaaggaaattgacattattgtagtataataataagaacagtctcagagcagggaaataaattgatcaaagtcacacagctgataaaatgtggaacttgttaagaggtaaaactgtccgactacaagtaagactagaaaagtgaagtgatgccaattaggacataatactggattaattg

SEQ ID NO: 4072 - DNA, 600 bp, Bovine  MMBT01354
ctgaactgattggccctttaagaagctaattaatcactaaatatagaccacgagttgttcttttcaaccccctgcgtgtctcttccccccattgtgtgatgccatctggtgctatgatctcatgctttttgtgttcctttccagagaaccagattcatygctctctaagccyggamagccagttaatttcagtttgcatgcatggatttgaaaaaatttgcatctaatgcctccttgtggattttcatagtattgctcttcagtatatctcacggaacttctatcttgaccaccccttakgtatatacrtattcttgtctttttatcagaagaactttgtctttagcaaaccatcaagcaactgcaggccttttcctrtgtgattttcrtgaagtttcattttgtcagttttatgtgcatgccataggaaattagaacttaataatatactttccttttcaaatcgatttgactttctgctatgatggtgggacaaatgtttaaaggatataaaagagctaatggcaggcctctgaccctactgcgatctgtcctatctccatctttacccccacttctgcctgaaatctcgaataatct

SEQ ID NO: 4073 - DNA, 600 bp, Bovine  MMBT12666
ccacctgccctttcccagtcccaaactctaatccgttctttgggcaagggttttgaaccaaattcttgttcaagtgcatgcactgattcaaagttttttttgagtaaagtctggctttgcacagttaccctgttatcaagtgtgtacaccaataaggtagcgccccccccagtctgggctagcgtacaagtcaggttgctaaatttacacaacagaatgttggctttgccatctgcacacctgttatctaaagcatatggctctctctttaatcaacaacacaaaacataggctcttcakgcgctcctgggagatttcagtcctgcctctgatccagcccttggcaaaagctcacttgaaacatctgatatttgaaggagagtctttaaggcatgctaactacacattcctttaggtacctaagtgaaaacatttccctcttacatgtaaatatttcgaaaataatgtatctggacactctgtgagcctcacacagaagttgtccctctgtgatatggattataatggaggtaaacacatatttacttgtagtttatttggcatcatctgcaattctgtatctgatgagcatatttgaga

SEQ ID NO: 4074 - DNA, 600 bp, Bovine  MMBT22158
ctgggcctctctggggctgatgcggctctcccaggggacacctgaacaggctctctgaggttctcgttctctctggggtgagcttgcagggtgtggccacttctcggggacaatgccagaggcactcctgctcaggtctgccagctccatcctgaggaccgtgtaaggaacaaggatcctaccccctcccacctcctggctcccacactgccttccaggaaggagagttcttgggcttggcagggtacctggacacccagacttggattgggacttttcacctcatttagtaaccctcckaatctcaccaaagaatttcctcctacttattcaccaaaagattcgtgagagcctaagcactacatgtatcctgttatcctcacaatagccatgggattwaggcagaaaacttgaggctcagagaggtgcatgactttccaaaggttgtacagcaagtaaagtgactyaaacacaggcaggccractctgggtaaatctgagtactctattgtttcaagaaagcrtttatggagtacttaatgcayacagaccagagtgctgaatgggaagaaagggcaacagaaataaataggagctaga

SEQ ID NO: 4075 - DNA, 600 bp, Bovine  MMBT23025
agaggcaatggttactcacagaaaatgacttgtgagcaggagcatgatgccaactggccttctaagaccctccagataccagcacacggatcctttgttttcccgtgaaagtktggagccaccaccacagagaaacataggaaatagacaagtagcagccttggtggtgtttctccctgtggtatatgctcttgggggtgagggtccatcttgttccctgctggtccccaacatccagccctgggtttggcctggagtaaaaactagggatatatatcaactcaaagaatgaaagagccrgaaccctgcmtgcctcgcaggtgaagtctctcaagaacacgcagcacagagcagccacccttgtcttatggggaggaagggaagaaggcagactggtggcacagcccgaaaggtgagatgccatctcctggacacctggcagagtgccaggacgccaygccaacggtgggggggggcctcggcaacagggctcccctgagaactcccctcacccaactctcccaccagcagtgctctgcccacactgtcagcttctacaaaaagcaagkaccgtctgattccctgtccctcctctccaat

SEQ ID NO: 4076 - DNA, 600 bp, Bovine  MMBT01698
cctggtgggctactcttcatagggttgcagagtcggacatgactgaagtgacttagcatgcatgcatgcatagcagatttgaatggataaaaatatatgtaagactttactatatattttcccctctttcctatgaattcttgcccagattagccaatggaataggcctaagctattttgcaactcaggataaaggtgtactggggagttttgacaccctgagttggtgtctatattttactttgaattggatgctttagtcacagttatgttttctcagagtgcagtgtttatataccrgttccttctatttctaggcctctgaagttgacccttaggcaccagcatcttctgtttagagatgacattatacccaagggctcatagaatgacctcactccttttagctctggcaaaattaaccttctgtctgcaacataatctcactcaattaaaataacaacaacagccagaatgtaaataacaacaacagcaggctttactctccagtatgtctctttcaccctggatggaaatgacccaacccagagcccccgtttgacttactttggcactagctgggtgaagctgggcctggca

SEQ ID NO: 4077 - DNA, 600 bp, Bovine  MMBT22107
aatctggcatatatttactgattcatgtggtgcaaagaacctagaaatgtatcttttttaaaaatgcaaatttttattttatttatttttggccatactgtgtgggttgtgggctccctcttccctgaccaggaatcaaactctggcccttgacagtaaaagcatgaagtcctaaccactggactgccagggaattcccctatgtaaattatttttaacttgaaatctaaataattaaaccatatgcgcaataccaagcttaagaaatagaaccgtatcaatatctttgaagcccaatgygggccactcccctcccacattctcctttcagacatatctttaaaggaatatgaaatcttgaccaggaaactgtttgagacttgtgactgtggatagtgttttcactatattttcttgctctagatagaacttcagggaggacaatctgggaggtaaataaatggctgagattctgttggatttgtgtttctggaccatggtttctgataccasaaagaagggcctttgctagggctgaagtatttaagaggcctgggaaggttaagattgccctgagctaaccggccttgtgaagaggac

SEQ ID NO: 4078 - DNA, 598 bp, Bovine  MMBT13462
  misc_feature (1)..(22): n is any nucleotide
nnnnnnnnnnnnnnnnnnnnnnctgttttaatgttttgtataattttgcataaaaatagcaggtaaccattatttttcagcattggtgtgtactttatcaattctaccttgctttgactgagtttacttataaacctgatgaggcaataagcaaaagtgtctcatacttgattttttactctttgtttaaaatatattgtacttaaaaaatgaaagcaggaagtggcaacttaccaaattaaatatttttgaaccaatcacagtgggaacacatagcccaagttccaaagtaaacgattkgtgtttaaacacaggttcatgtgttactgtttctttgaaccgcgcagcacagaaacatagtagggatatcttaaaatagacagaggacggtggccagaaattgttgactgctatagatggtgaggctgtctagctcttgtagtgatataagccagaagtacatgctaagggcattgatttgctcaaggtcagcatgttctaaattcagctgcttgagtatggtttctgtcaagaacacgtagggctcctcaatgcataaaaggttttagcagcagaaggggctgtatttatgaggtgt

SEQ ID NO: 4079 - DNA, 600 bp, Bovine  MMBT17713
agagctccagcttcacgaccccatctaagcttaataatctcccaaagactccacctccaaaaacaatcacactgaggtttagggcttcaagatatgagtttgtgtgggtgggtggggggaggagatattcagtgacaacactactaggtttagaaacagtactgttttctcactcagtccctgtcataattctgaagctgtactagtttccttgtgcatacactttatttcctaaccttattaacagccatccattcgacatgaatttgttctattttaatgatgctgctgtcataatgrtaacagtcgagacctagaagccaaggtagataactcatggaaataagcttggctgggggtttgaaacttcagctctacttgttcaaaaagtatgtgggaaaatacaaagaaagatcctacttggattacagccagagtgtaactgacagacacataggaaaattatgtacatttattaatatattgagaaatccaatatgtttttttggtcttttgccttgtctaaatcaatgaaactaaaaattataggattccaaggctacacatgaaatcacaagacttttatacactccaaggtag

SEQ ID NO: 4080 - DNA, 598 bp, Bovine  MMBT17061
  misc_feature (1)..(78): n is any nucleotide
nnnnnnnnnnnnnnnnnnnnnnnnnnnnnnnnnnnnnnnnnnnnnnnnnnnnnnnnnnnnnnnnnnnnnnnnnnnnnngaaatggagaaatacgcagagagggaagatatggtcatcatgtttgtggacaggtaaaggggagggggcagacagaaggggagaggatagggagattcctagtggtcgtcctcctcatcgtcccccgcctccctcagctacgacgtagttctggctggcagcccctcagagctgctgaagaagttcgtccagagtggcagccgcctgctcttctctgcagaragcttctgctggcccgagtgggggttagcagagcagtaccctgaggtgggcacggggaagcgcttcctcaactctggtggtgagtggcagagggtccagcagtggtggggaatggagtgtcccaggtgcttgagggcgggcaaaggaacggggaccggccctgggacactgaagaagtctgggagtcagtgcatcctctccccctgccaggattcatcggcttcgcccccaccatccaccaaatcgtccgccagtggaagtacaaagatgatgatgatgatcagctcttctacactcg

SEQ ID NO: 4081 - DNA, 600 bp, Bovine  MMBT00600
tctttctctagacgctctacatgtatttgacctccatgaaaagtatcactattatctgcattttgcagatggtcaaactgagtcagagaggycacctcacyraagsacatgcacccactaagtggcagagccaggatgcaccccagcccacccagttctggacctgtgtccctaaccactggactgagcccgtggtttgcctccattatcctatttagttcttacactggcccttgcagggataggttagttattattccatcttccagaagaggaagccaagccaaacttctgctggcrggagggagcacatttataaacctcttccttcaccatgcccccagygggcccagctgatggatcatggcacagactcaagaccygccccttgtaggcagttgtcattaatcaattaaggtcagtccacactttaaaacctgtttaccacccctcagcctaaacaacctccacttctgcaggccctagtkgtcctcccagcccttctgtctgaaagacctctgccccctcctcagctgtggaccacacctgactgccactggggcactccggaccygagaggttggtcttcccaccatccag

SEQ ID NO: 4082 - DNA, 600 bp, Bovine  MMBT08161
sgatagccgcctaggctctagtgttaaggtcaacctgtggctccctggagtgtgggtgtacagtgaccatgtggggcttgcctgattagatgagatgaggatcaaaagaaaggtccacatcccaggagcccaaaggttcatgtagggtrcatagggacaggtgggcattccaggtmagtctcccttataagacggagaaagccttctgaacgtttctctcttggaaattcgcagaaactggctttgattgggtttgtcagcttcatcaagtccaggagatgagaacatgcttttgctccygaaatgacaggattctgttgcacacrtcatgtcctggaggatggtgcctgcatctctgggaaggggttatttcctgccacaccratgctgatgggggttcttgctgtttgggatggagtcaccctgatctttgccttcattctccttcttctcatttcttcgccctccctttgcctcccttttccattctcaacaactcatatgtgggttttctttctatttttagtgtcaaaatattcacttcagtgggatgttgtgttgtgctgtcttcgcatctaggggggaaccgggataaggtaa

SEQ ID NO: 4083 - DNA, 600 bp, Bovine  MMBT11495
gaagccaagccaaacttctgctggcrggagggagcacatttataaacctcttccttcaccatgcccccagygggcccagctgatggatcatggcacagactcaagaccygccccttgtaggcagttgtcattaatcaattaaggtcagtccacactttaaaacctgtttaccacccctcagcctaaacaacctccacttctgcaggccctagtkgtcctcccagcccttctgtctgaaagacctctgccccctcctcagctgtggaccacacctgactgccactggggcactccggaccygagaggttggtcttcccaccatccagtgttccacgtctgttacagatcgaaactgcccttgaacaagcctctgacgccccttgcctcggtttccccaaatgtgacttgggcaaaaggttgcatgacctgtaccgaccctaaagcaacatctgtgtctctgctttctgcctgtcttggagggagggtgagttaaagaccaggaccactggggaccccatttctggagaatcaagactttgggggccctgctggcctcacccctccccaagccctggattatactccaagccgctcctagca

SEQ ID NO: 4084 - DNA, 600 bp, Bovine  MMBT12153
tatgacccaactatatagagcttaacacacaactgtttctccttcaacccaccctagtcttcctgtctacggttgcatcccattcggcagttttcaataagggccagatttccatcagatgccacagggaaaatggtaagtaagccaagcctatgcttgtagtaaaagaataagagaccctttctcaagacaatggcttgactygattccacttccatcccaaaatgaatttggccccagtttcctacttggatttatrataaataatgaacctgagaacctatctaatttgagcttcaraataggcattatcaagtgatattccagaagcatgtgactcttgggatagatcccaatgactggagccagtgactcttggatgtgttgtggagtttactatccagaaccacctgcattagagggaaaggacaccactgaaacagacatgggcagagccaagaaaagtagaaaaaggaggctaatgggagaatttcgtgtgcccaattgccatcaaatatggggaaagccaagacattttcatagttgccctaattcttatccttcccattcaaaccagccctgactccccaagcaagccaa

SEQ ID NO: 4085 - DNA, 600 bp, Bovine  MMBT02351
gcatatgataagagccttatgttttctttgaaatattatttcagtaaatattcggtatttataatttattgcttgtcctgctgtattttccaactgctgtccaccaaaggatcacaataggaatgttgtttggaaaatgttaattgttgaaaatgtgttttgaaaaataacacttaaggaaaatatattttaaaaaattgtatgcttcctgacctaaatattgacatttaaggtctgggattattgcagacctttcttgcattgatctttctctggtggctctagaaaaaaatcccttcrggcaatattatttaacataattggttttttagcatattgagagataaggaacaatgtaatctagtgttccaatttggaactggaatgtcatacagaccaaggccaaactgtgattttctctacaatagggactggtatatttttctgctgctgctactgctgctgctgctgccaagtcgcttcagtcgtgtcccactctgtgagaccccatagatggcagcccaccaggctcccccgtccctgggattctccaggctagaacaccggagtgggttgccatttccttcttcaatgcatgaa

SEQ ID NO: 4086 - DNA, 600 bp, Bovine  MMBT03055
acttctctcactttcttctgggagaatggtgttgatggtgcagtcattaataaaagcaaagatatgaaaaggaggaaattcatatattcttcatatgaattcatatttctgtatttcatatgacaggatttgacatgatactcatggagttggcttaaagaggtggagaaaactccaattttgatattggaaattagccagcttcatagtgttgtgattggaataaatgagattaccacagaaggggcaaaatgtgagagagaagatgaagagcagagtcttgaggaaagtcttcatttraaagaaaaataggcctcagagagggagtaggcacaactgctatgatttctgaagagctgagaatgcccccttgggccagacttctgcttaggccagttgctctaatggacagcattcaatttctgacccatccaacaccctctgcaaggctttgtatctggcatataggaaattttcaaaaacatttcaaaaatgttttcaagttaaattgcaaagaactaacattttctgtatgtatttgctatgggtattaggttttcataaccctacctcatcaactacttagtctcttttcatgac

SEQ ID NO: 4087 - DNA, 600 bp, Bovine  MMBT21466
ctcagaacccctggcaggagtgtggcttcagagccgagactgcccttcttcccatcaggttgccaggaccatgtgcacccttaagagatgctggttcactgttcttcttcaagcatgttttgatttgtttcagaaacacgcaaaataataccacaaagcaatcaggcggccttttgtctgagctaaagaataggtcactggaggcctagcttgcctgctcccgagcagctgacctccggtgccagggctacagggccttctgttgaccccagagactgaaaggtgagagatgyygagggyctgagggcttgtaaaaggcagtgatgaggaatggctgcaacctgcagccacgtggggagasaggcaaccctcccagactgttcactygcatgatgagctcagtggggtttctagacctcagctgggaagaatgcgccctgctctgggcccgtggtggccccgccaccagcaccaactgctgggcacctttcatctctgggctgggcactctgctctgaagctttgccactccaagtgcaagttcaatgatattggattagcactaggacagccagaacaggcccaawtagcacagaggac

SEQ ID NO: 4088 - DNA, 600 bp, Bovine  MMBT02297
ccatggactatagactgccaggttcctctgtccgtggaattctccaggcaagaatactgaaatggttatccattcccttctccaggcgatcttcccaacccagggatggaaattgggtctcctgcattgcagacagcttctttaccatctgagccaccagagaagccccaaagctctgggaggaaagtaaaaattgttcttgaattcatgtattgttttctcatgtatttctcctgtaagcttacatttaaccaaagttttatggcagtacaacccctctatccaaaacaatgtattcamtaccagtgagttctgataggctggaatggatagggtacatttatgatatcaggtgctctgaaatcagactacacagggaaacccctacctgagggatattacattgtgttagtcagggttccctagagaaacaagaccaatggagtaaatatttacaacaagatttattataggaagttagcttgtgtgatgatgaagactgagtagtccccagatctggatatagcaagctgaagactctgaagagttggggggtatagttccagtctgagagcctgcaggtgcaagattctagaagag

SEQ ID NO: 4089 - DNA, 600 bp, Bovine  MMBT06545
cgcatgtgaaaatacatcttcaggctgaaagataagcatatagtcataaatgctgagcagatcttctcattgcagggacgcatacattgtagcataattaagaaggaaggcccrtccttgggaaagatttgcagaaaaggtttataattgcaaggacagagatttagttttaaggcttcttgacttctgtgataatctctagggcttctttatcaatttgtgcccagatgatgttgctcgccagtcaaaagcaattggcttatcagttcctgctggcatctcatggctgagcacaacccygggtggggttaggtggagcattgctggtcagaaatggtgaattctgtttattataatatcccatgtggacttagagctccataattaattgacattcctggaagcatccccaagatggtgagtccaataccatggacatcttcttaattataggagttacactggttttgtgactgttgttttttaaggaaggaaaacatcctagagatgtgtttgcctcaggaaggctggaagctgttctttagttttgaaaatgagcagatcgtggatagtgaggtcgctgcctggtrgcgggagagg

SEQ ID NO: 4090 - DNA, 598 bp, Bovine  MMBT16464
  misc_feature (1)..(135): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaattttcttttggactgggatccagcagatttgtacaatttagccacaaaagctcaaaacaatcttctgaaatgttttctgaaccttggttcaaaaatagatttttccctccctaacctttaaaaatggtttgaaatgtaaaaggacaaagcgattcttraacacagtcacaatgacattcggcaaaagctaaaaatacctcattggtttcacaggacaaatttgtggccactatgaagtcctaatgttattgtaaatgccctatgatgggctacacaggcagagtaatgtgttagtagaattatatggcaacccaaagagacactgataagctatattttacacttttgttccagaggcaggaaggaaacattcagtccatctgatttgatctagaaaactctcctaatgacatttgcagggacttaatgacattttccctggttccagccctacta

SEQ ID NO: 4091 - DNA, 600 bp, Bovine  MMBT04128
tgtatattcctttactgatttactgagtttctgggaagaccttgtattgaaaatatgcgttatcatagataaatgtagcacagtaagtattaatttattacactattaatttaaacatagcacattatcctctgagacacattaatgtgaaacctcaattttagtcttatataggaatataaggaatttttgcttatccattcctaratgataagagcaaatgactcttcctgttcccctcaaaaagaggtggtggtcatgggtgtatgtgtatgtcacacacactcatgcgagaaagaktgatccagctttgtaacctgtgsaataggtarataygagatactcatttacctgtcctgagcctcagttttctgctgtatgaaagactagatattctctaagaatattttcagtacatatgctgtatgattacaaatgtaataaattaaaacctagactaccgaaattctggtttgtctttgcatatttagtcccagtatttccatacccaacataggactagttcaatttgacaaatatctattgagtctccactgtatgtcaagtgcgagattctagaggttagacagtatcctgagc

SEQ ID NO: 4092 - DNA, 598 bp, Bovine  MMBT08545
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnacaggtgagaaaccctatgtatgtaatgaatgtggaaaagctttctctcaaagaacttcccttattgtacacatgagaggtcatacaggtgagaaaccttatgaatgtaacaaatgtggaaaagccttctcccaaagttcctcccttacaatacatatacgaggtcatacaggtgagaaaccctttgactgtagtaaatgtggaaaagccttttcccaratctcatctcttacacttcatatgagaaaacatacaggtgagaagccttatcattgtaatgagtgtggtaaggccttcagccaaaagtcacaccttgttagacaccagagaattcatacttattagaaatagraactttatgaatcttgtgartatggaaaaagacttcagaaggaatttgcatttccttgcacattacataatgggatctagagcagaaaactgtgaatgtgggaaagcctttttaagaagccacacatttgtgaaacagaattcttaccaaggggacaaaatgtat

SEQ ID NO: 4093 - DNA, 598 bp, Bovine  MMBT10361
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnncagggctttggtcctttgggactgcagtcctatgaaccatcgtttgcttgtccctgctgctgttgactgactcctgggtgggcagtctccatagtgttgccatcctgaacagtgactctgagcacaggcttgtctgtgtctgggacacagtaggctgttttttggggtcccagctggcagaagagccatcggcgaggagcggagcacacatgcacagtgygtgctgagtgtgttgctgtgcagtccgttctgaccacagggtaaaggggctcaagagaccatgcacatgtctctgtgagcacttggtgttgtcaggctgcttcatttctgtcagcctggagggtgtgcgagatggcttgtcttgagcacacacatcatagcaggtgaatcttcagcttgtacctctgcatgccaccctgtgcttagaggagcatctatctattaatagactgctgctgggcctggagggccttcatctgacctggactgacctcttgacctcctggtcctcagactcc

SEQ ID NO: 4094 - DNA, 600 bp, Bovine  MMBT12577
cttgcctggagaatttcatggacagaggagcctggcgggctatatagggtcacaaaaagttttatactactaatgctttcactttcaactagttctaacctatattagctgtatttttccacaactcaaaaccctgatttaaaatacaatcatactataagttatctgaagatgaaaaaggacagtgatttttagaaatatttttataagagacttctgcactaggatatattaatagataagctagttacaggtgatcaagctctacagagaccagatttcctggcatccatcttggamctctgttatttaggtgaacaaaggtggagtctgccaccaaagaagccaagtcaaattcatgtaacacagcaagacacgcctccatgatgctgagtactgggtgctaactcctgatttactggtaactgtaagaatgattctcaggccaagcagtaaattaagggcaaccctgcacttaccacactgcattttatggcttctcaagagtgataggataaatatatcacataacaacgattattcagaaagccaggcactgtgtaaagtgtgctacaaaaattttcttttatgaaacccccc

SEQ ID NO: 4095 - DNA, 600 bp, Bovine  MMBT14812
aagaatgtgagaatcctaacactctgctatgtatgaatatagatccactcactaaaactcaaagtggttaactttaggacaaattagaagcaccgctttacacaatattgagtgaatttaaagtacttgttatctcattaaaatagtaaacatataagagttataagaaacacttaaataatttcatgagccctggatccttaatgattcagtggaggaactcagaagatttggggttgggggtgcaaaaagaaccccataatgctcagttcccacagcccttccctgatcctctgccasaggcagaattctgggtggactgaccttcaccttgccctagtttagcattttttatactcrcttgcttgmttctgggasaagtaatatgctgctgtggcaaaatttgtcctcacagggctctggagtcaatttccaaacactgaaaataatcccatttttttctcccttaaagacagaatggtgtggtgtaggggcaggagtggtccaagagaagctgagcccctccctgaactcccagarcagcttccctaaaagtctgaagcctcctacttgagttcaactcctagatttcttgagtac

SEQ ID NO: 4096 - DNA, 600 bp, Bovine  MMBT19288
aggttgaggcccaactgcagggtctgagatgtttgggttaggatacattgtgaccagatttacatgcttggtgacactctgwagaggtcacgctttctggaggagacatggaagcttaggctgagatggcgcgtggctgtgccttattgccagctcctctggttgggaggccgtccttggaggacggtgttgagggtgattctgaggctaatcccaggctccctggcagagactcccctgattagacggtaggatctgcgtgrgagtgaaggagggcaaggtgcgtgcgccccgcgtgcrcccctctctgctgtagcttctttccactgtcttgggaggcagtggatcacctgacggacaaactggggccatccagggagtccctgaggacagcccttaggcggattcagccactccaccaagcgtggcttctctctagtgtgacttgctgggactttgcattggaactggcaactgttagaagccgaagagccccatggatgaggactttccagtcctgtggcctctgtgcctcccacctgctgcccccactaatggcacagctcttgtgtcctcactcacaggctctttgcacagcgt

SEQ ID NO: 4097 - DNA, 598 bp, Bovine  MMBT20644
  misc_feature (1)..(8): n is any nucleotide
nnnnnnnntttccggaatatcgaagattaaaggaaagctttgtttcaaggattacccttacatatcacctctccctgtagaaaagggatctttgagacaaaaggaaagcataacccatgttttgtgatgacgtttggaagatctgaaggtgttagttctagaagtgaaggaagagtaacttccctcttactcttcttttccccgatttccaatggttttctcaaataagggaactacaagtttgtaggttcaccacacaagtagtacttcatgaggttgttgcctcacacactgcttcaragttgcttttttctttttttaatttctctaatawgcaatttttaagttttaagaatgtgggaaataggagacatagtttttgactgacttgtgattaaacccrtttactaaagcacatgttaatgggtgcaacaagaggaagttcctgaaatagtctactttaagtaaagtaaagctcatggtaagtcatgactcacttttgtgacgtggattaagaagtgagcgggccgaagctgcaggaggactcagccagctagctgaagagaaggggcttgtctcggttcccggcaagtaaagc

SEQ ID NO: 4098 - DNA, 600 bp, Bovine  MMBT21265
tcatgactgtgcacccttagtttttaaatgcttagtagatatagaacaatattttgttttattttcaartaaaattttatacagaatcttaatatctaagacagataagaatggagctgctctgaatgaattgggcttagggataggaacaggagaatgaggcctttcaacttggctgcctgctggcaggctggttcttcctgtgagctccacgggtttgtctaagaaacacaaggtctctctcagacacagtttgaaaattctttctctagattaagtcagaaatgggaagtggccatrtatctgcataaaattctgttygtgtgkagatatggatttgatggagatgttgaataatgaaaraaagatgtggtttagatgatggaattgtagaytgagttttctttctgcaaataattttatctattgttatacaaaaataaaattaggataaattatttttggttctgtgattttattagaaacttatttgattgaggttgcttaatacagcttggtctctagttccttcttcttccatggctacaaatctcatgtagcctgaggcctagagctctgtttgttttggaatctccagag

SEQ ID NO: 4099 - DNA, 600 bp, Bovine  MMBT21266
ttttaaatgcttagtagatatagaacaatattttgttttattttcaartaaaattttatacagaatcttaatatctaagacagataagaatggagctgctctgaatgaattgggcttagggataggaacaggagaatgaggcctttcaacttggctgcctgctggcaggctggttcttcctgtgagctccacgggtttgtctaagaaacacaaggtctctctcagacacagtttgaaaattctttctctagattaagtcagaaatgggaagtggccatrtatctgcataaaattctgttygtgtgkagatatggatttgatggagatgttgaataatgaaaraaagatgtggtttagatgatggaattgtagaytgagttttctttctgcaaataattttatctattgttatacaaaaataaaattaggataaattatttttggttctgtgattttattagaaacttatttgattgaggttgcttaatacagcttggtctctagttccttcttcttccatggctacaaatctcatgtagcctgaggcctagagctctgtttgttttggaatctccagagaagtaagggtctttatgaagt

SEQ ID NO: 4100 - DNA, 595 bp, Bovine  MMBT02300
gcacttagatcaattgtaaaaattcgacaagcctctaaaggttccattttttaaatgatgttatctctaaaagtgtactgtgaagatcaactatttcaaaaataggagattttcccagagagtaacaacactaggtgactaaagcctaccaaaaattgtcagaagtcctccccacaaccctgactgtaaatcaggtaagcgcgcaaagccttgaggacagcaacagcggtgtcctacgtcgcatccaacgctctgaaatagagttgtgagcaaaatagcaggaaggaaaaagatgtgtgraagagacgaaaggtggaaactgttggaacgcgaaatgagaaatgaaaactaggactaaaaatgtctcagttatgtgggagggagtcatccctaggtgtaccggtcaacctctgaaccaagcaaaggctacrgcagtcatttcaaggggtctcttcttcaaagagtattccagtgcctaagatctgcatccgcgaaacttccttcctaaccagcagcctactctgactccccgggccagggactccggccaaacccagccccgaagccacccttctccagcacatttggaagccgg

SEQ ID NO: 4101 - DNA, 600 bp, Bovine  MMBT03923
ggaagatttttcttatgactatcaaccccgctgccaaaattgaaaaccctgttccctaattccggattaggctttcaagatccttaaaagagcagcccaaatacctatattcttcaacagggatcrgcaaatgttttctctaaagcaccagatagtaaatatttttggctttgcaggccatgggatctctatagcaactattcagctctgccataggggcatgaaagctgttacagatcagatataaatgagtgaacatagctgtgttccaacaaaattttattcacggacaccaaaatytgaatttcctataatttttacaggtcaggaaatatctttttcctccaccatttaaaaatgtagaatccattcttatctcatggactgtacaaaaaacaggcagcaggctgcatttagcacacaaaccctagtttgccaacctctgttctggaagatgctgttgtaaggatgcttcatccacctatattattataggggagagagttaattttagttcactttcttttatcaatcagcaacacatttcataagatactttctgtaaccaggcccagaggacaaagaaaatgaaaaccaggt

SEQ ID NO: 4102 - DNA, 600 bp, Bovine  MMBT07198
actggagtgggtagtacactctaataaacattacagaggaaatacaccagtgtagttaaagatgtatacagcgtatacagccaataagcactaaaaaagcagggatgtgaagcaggtagttgagccctaaggcccatgatcactcgactctgccctgtttattgtggttactgtatcctgtatggacataaggaacagacttgtggttgccaaaggataggtggggtggactgggagtttgggattagcagatgcaaagtactacatatagattggataaacaacaaggtcctaccgtayagcacagggaactatattcaatattctgtaataaaccttaatagaaaagaatataaaaaaaacacatgtatttataactgagtcactttgctgaacataagaaattaacaaaacattgtaaattatcttcaatacaaattttaattaaaaaaaaaaaacatatctcgtatggacactgtggatggttggatgtggaaaggaagggaggaggaaataagaggcaagaattacagtttaccattgaacaatgcaaaggttaggggcgtctaaccccgtgcagtcaaaaatctgcatatgact

SEQ ID NO: 4103 - DNA, 600 bp, Bovine  MMBT06559
gggcagctcctggcggtctcgtctccctcctcacccagtcaggaagaaaccattacaatcagacatgtttgttttggttttgaccaagtattaggaaaacaaactttgccaactgcaaagttcagctctgtcagtggcctcagctgagggattgagggttccctgcctgagtagttgggtgaggtgtgggtaagcagatcggtactccgttatcccagggttccttgataggtacattcagaaagaaaatacaattccaaggtgaacttgcatgtgatacctaggttaaatagtcagaaygttttgatttggttggctaattgaagggtgggtttttctcttttaaattcttttttctactttcaaacatctttgtcaggagagattatcttcttacaaaaaaagaaaacaaaacccaagtctggcccattgtctgacgaattatacctatcactttaaataatacttgcacaccccatccagctgtagttcaggctgacatttttatttttaagcccaatcaaatccacctcattttatgctgtttaagtagcagcatcaatttttaaagcctctagtttagtctgcattagtaacaca

SEQ ID NO: 4104 - DNA, 533 bp, Bovine  MMBT18994
atttgtggacatggaaactagttttgcttttctcttttcagtagctgttgccaatgcagttcctctgtttactgagttgtagctttatagacaagaatgcaggaagtctctatagtattctgatgataggttagtcrtcaggcttattatagtccctaaatccagcaaggagagcagagagaagcctggatgatgaagtcactaggggaagaaaatggtatggaagaaatgataagatattcagaaggctgctcaaatgctgcctcctaataaattgtcaattcctcccaaagagagtgmtgtctttttatgctgatgtgcmttatgtgcagagcttatattccttactcccgtgtgcacgtttgtcttcataggtcataagaaaggaaaattgtctcacgtttgacatctccattcgattttactactttagcatcttgatggcttttaaataaaaatggggaaaggattatagttggcagcaaagtgaatttcagggacagctagaaaataggagggaagacagcctctta

SEQ ID NO: 4105 - DNA, 600 bp, Bovine  MMBT20642
tgtgggaatggtgtatgtaacctcagtttcccagagaggatccaggaaaattttacattgtggaagaaagaagaattgcatacctagcgaggtacttttgcacatgcaaattatttatttcatttagttcttgtcgcagtttcatgacgtgggaattgttacctgtatttgatggatgagaatatggaaaccaaaacagatagaaccatttgtccagggtcacatggttgagtttctggagctcacatttgaatgctgggggtcatctcttgtttctaagctgggatcccagttatgacyctctgccaacaatttcaggactctgggtatttcacgaggcatccctgggtgccccttgcccccttggtaacagacgactctgtcatgtctctgcctccccttcctagctcatggttggcaaatggctggaaakggatctggaatcgaaggaggggctgctcaaagcccagggaattgcagtgttggggagacagaacgtggcctgtgtggtgccagggttggaattctgattaatcgggcattccacaggaaaaccctgtcgggtcgggtttgggctcctgacacttgaatttcaactca

SEQ ID NO: 4106 - DNA, 600 bp, Bovine  MMBT05339
gttttcatctttccagaaccaataatgataaatgtcttggagtcaagaaaagtattaggtttaaccatgaatcaaagagtcacagtcccacccactttctatcaaccttctccaaagggtaaatcagaatcctttaacagaaaatggaagaggattgtcaatctaacctgagtgactgttagattgctcgggtgtttaaaccatgacttcctctgagataaaaacaagatgattaatttcagagtctctctcggtgtctcatttaactttccccactctccaccgattcataaagctccygcaaagggagatgaagggcccagctatcaaaaaataaaaaatataaatgttcctggctcgccgtgtctgcattgctaagttcaatcaagactttgaattgaaataacagaatcataaaatttccagacacccgtgtctgccggctttgccttgctggctgctcctcccccayagcataacacagtcaccccagccatcgcaaaaagggttcttttctgctactgaaaagccagagatgcagactgctcactctacacgttccagattgggggctttcagtgaaactgccagctctaggat

SEQ ID NO: 4107 - DNA, 600 bp, Bovine  MMBT13150
ataagcattgttcaactcatttaaagatagattccaaacacctgtttccaaatcaaaatagaaatctattttccaagacactagtatatgtgcaagcttattaatacasgcaaaacgttattttcatcagttgatctgcacctgtacatttattacattggatcggaactgtaaaaacaccatggccactttggaatctgtaataaatttgttaattactatcctgaaatatccccttgatatttctaacatgtcattaagatacatgtatctttaacaataatagtcatttctaaaatytgtatagtagttctttacctttgaaagcaccttcaaataaattctcaaatgcattttagcatagattaacttaacaccactttaggaactgagaaatagaggctgagagatgatacattcagaaggcacagttaggggtgatacacagaagttcttttgactctaagtgcagtcttcttgtcattgcatggtagatgaaggcacctgccaaactttcaagggaggaattactcaggcaaggttatatgggggaaaggaaataccccaaataatgccagctaaaacctgtgtgacctttta

SEQ ID NO: 4108 - DNA, 600 bp, Bovine  MMBT16193
tttttttcttttttttctataggtaagaagtagatttattcaaagagaaacacactccatagatacagtgtgggccactacagagggcgagtgctgtggtcttgaaatgcggccatggttagtttttctgggccggacaatttcataggctaatgaatgggaggattagtctatctatttgcggggaggggaggagatttccaggaattgggccactgcccactttttggtctttaaaaaaaaaaaaaattatatttatttttaattgaaagataattgctttacaatactggtttgatktctgccatacattaacatgaattagccatagtctatatcccctccttcttgaacctccctccctcaggtgaggttcttaaagctgttktgttyactaatacagctccaagtttaagtgcctaacacaatgcaggtgattagtaaatatttattaaatgaattaatgactattatatgaatgattattgtcctgtgttactaactacatcctaaacaaacggacttcagtcggctttaaaagagcatccatttattcctagagagatcagaaataaataccttactgccatgcttgctcaa

SEQ ID NO: 4109 - DNA, 600 bp, Bovine  MMBT16450
tttcatacatgtatgatttatctcactaaccagaccagaactcccagaactggaggcccatgggttgaattcagcccaccaacatgttttgtttggcccacacaatgtttttgaagaatctgaattagttgccttgatggcatatcataaaaatttgattttgtgagtctcgtgacaagccagaggctctgaccatgctgggctggcattctaggatggctccaatcagctggagctgctgactggagtaatgatggtcccttcagagtgacgtgtcctttccaacttggcagggtccaratcacacctctgacctgcgccggccccttcctgatctcacagaccttcctgtctcctgcagtcatttaaacttgcaacctctgaactacaccctatgtcctcggaggacatggtctttgtcttcatttcctcacctccttaagtgtctgaacactgctatttacataacaggtgctgaaaaaatacttcctgaatgaaaggaagaaaggccagaattgaagaagcagatgaaagtgatagggagatgagggttaaaggaggccaaggctaaggacaaatgatgaagtgttttccagtgcc

SEQ ID NO: 4110 - DNA, 600 bp, Bovine  MMBT22797
aattatcttcatctctggacaagtgaagaaggattaatagccctttaggggcatgtctgcttttaaacaaacaaacaaaaaaaaatggacaatagtcatttaaactaccaaacccattatwtgcatgtaaaaaccttcaaagtgctttcatatctttatattaggaaggttgtggcaacatcctaccccaataaaattttattcatgctttcagttacatagaaaattattctctyttttcaaaatatgtgaattctcactactttctgaaggatcataaattcagaattattttgatcrgtagaggaattgttgttaacacaagttagtgtttcttgaggtgattatcacctggacattctccttttgccactccagacccttttccattctgctctgagttcctaaacctgacctctataaactgcaactgaaacctttgccagctggtttccaatggrtttggccaaagcggagaactaaataagcaggagatacctggagaaaggaaggaggcagggagaaaaggggagagaggacagagtggaaacagggtgttttccaccagctccctcatttcagactttggtggccagtggc

SEQ ID NO: 4111 - DNA, 600 bp, Bovine  MMBT01228
tggctgttctcagacccgccagacactgggacgatcctgcccactgcagattcaagggcaggagcccctcctacctgctggcaaaatacccagaaagcttaagacacaaacctcgctgtgtgggactttgcaggatcccagggcacaaaaggtgaccttcgtgggacgtgtgttgggctggcggtgcacagcggggcagccagcgtgtgggagcagccagggcaggtgtgtgtcgccaaggaaggcaggtgaccccccaggacgaggaggaagcaaggcaggcggaggcatcaaggcccygaggaccccacctccctctcagggaaccacttcacgacctccagaaatgtgggttgtattgaacaatttgctcacagttgaacacagactagcgtttctgtgctgggctcagtaagaacaacacagtgaaacggacaccagaaaatctctccagtgattgctggacgaggacctagcaagagggacttcgttttcgcttctgtcaccaaggacacgcacgggcaaatgtcccgagtcggtcttgttcagggtggctgtctcccccacgaaggcagggccggacgcctcagcccttacctt

SEQ ID NO: 4112 - DNA, 600 bp, Bovine  MMBT03400
tgtgaggtgttctcattcccattttatagatgaggaaactgtggctctgagaatgatttttcaaagatttcttgtgatgaagcctagtgcataccccattctatttgtcctttggaaatcaggtttttttgtggggctagagggaagggactaaattcagacagaatataaatgagtttagttgtttagtaaagtaaatggcctaatacttaccatccttcttgtctcacacatatgagagatgaagttgttatcttggatccaatatgacaaagttagaatagttaagaaaactgaatkattgtctcatctagtcctatatttggtcttgattgaacttaacgatctttgatcttggttttggggtgttttttttttctattttaagaaataaagctagttttgaagaacccaacaaatgcaaggcattgattctcgagatgatagcccagtactaatacacttacatatttaagaaaagttgaggagagaaataaatcataaataggaacttctctccaatcccttaaaagaatgcaccttagcagtcctctttccttactaaactggaaaatccaagtggaggtgccttagagaaga

SEQ ID NO: 4113 - DNA, 598 bp, Bovine  MMBT04477
  misc_feature (1)..(16): n is any nucleotide
nnnnnnnnnnnnnnnnctgattctcttgttctatggcagaaaccaacacaacattgtaaagcaattatcctccaattaaaaaaatgaaggcaagatcactggatcctcacagccacccagtgaaacaggtatattattctcgagaaaacagaaaaacaaaaagagctgaaagactttgctcatagtcctacccctgtgacagagctggtctggaaccrggcctgaaggactccatgctctaaccrctaccccatccttcaccatgacagcccttgtaagatttcacacatttaaaactgmggcattgaccggagttggtctgaattagaytttagttgactcagatccagggcaacctgagagttatgatggttctccagtgccaacccctttatagctcagtcttccccagtccccatattatttactcagagtctatttgcatttgyggaggaagctgctagtggagaagctggcaggaaccttaatgaagccaggtgggacccattgaaatgggaatgtgtygaactaagttatgaagaaatgaagccagctgtcagcaggcttaatgaaaggttaacagaaatcctgcaayggg

SEQ ID NO: 4114 - DNA, 600 bp, Bovine  MMBT06907
gaatttgaaacatattttctcccagaaataagtgtaggttgacaaactgcaaagatccctagacttgaatactgaaggaagactgggtttaaactcaagttctgtaaagacatgcgttgtgattgtggacaaggtggtcattgcttcattccatcagtagccattcacttagcatcaattttggcttggctcaagtgtaaactccttcaggaagtcttggatgtcttcacctcccccttggcccttagctgctctgtctttgaaatcccattatacctcatgcatgtctccatcaacaamctttccacactgaattaaaattrttgttttatttctctatgtttccccrtcagactattgacaatagctggcatctatttgctgttcttcagcagcagtgcccatattttccttgagaagtcccctctcccttcctcctagtgtgtggttccagtgaacagactgatttccctcccrgcctttgatgcgctccaatccacttggagcttcacatgcatgcatgtgtgctatgtcactccagtcatgtccgactctttgcagccctatggaccatagataggcctgccaggctcctctgtc

SEQ ID NO: 4115 - DNA, 600 bp, Bovine  MMBT07457
cgtgggatgaatattcagagaggattggaggaaaaatctaattgaattcaaaacataataaattgaagccaactcattcgattcatggcaatgtcttctggcatcttttaattttgcgtcatattcatttggagccaatcaaattagggtgctcattagtggctgaggtgggcagtgaggctggagccctgctctggtggtaatgaggtcagtgcagcaggataattcagaaggcagttggagtggagcagacagtaagagctcaacaatcactgtctcattatcaggaaaatggactcrgggaggggtgagtgtgyaycccaaatctgctgcttgcttacaggctggccttgaccttcactttctgcagctttggttctactgggataggagtagggcccacctctaaggatgagtgagtatgagatgaaatcatatgtaacaagcatctcstcctccagtttctcagagtccgcctctgctctctgtccccaccaagggtgagtgagtatgaaatgaaatcatatgtgacaagcatctcgtcctccagtttctcagagcccacctctgctctctgtccccaccacaccacacagcccc

SEQ ID NO: 4116 - DNA, 601 bp, Bovine  MMBT11661
  misc_feature (1)..(1): n is any nucleotide
naatgattatacccttaacctatttgtaggaacgaacattgaggaccatttataatatataatattaggtttctatataatcttctgggtgtttaaagtacagtgttgttgttcttttcttatagttggttagaaaaaaactattatttgaagggaatagaatggaaaagcaaaatgaggaaagttgaggagggtgggatatattagttttagagggcttccataacyaagtgccacaaactgggggacaaaacaacaggaatttattatctcatagttcagggttagaagtctgaaactmaagtgttggcagggatgtcctgtctgacggctccagtgggaaggatccttccttgcctcttgctcacttttgatggttgtctgcagtccttggcttatggacgcatcactccagtttctgtctccrtcgtcacatgacattctccttgtgtatctctgtccaaatttccctcattttataaggacaccagtcatattggatataggtttagagcccaccctaatcaactctaacctcatcttaacttgattacatctacaaagcccctgtttccaaataaggtcacattcatagattttg

SEQ ID NO: 4117 - DNA, 598 bp, Bovine  MMBT13041
  misc_feature (1)..(186): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggtatctgaagaccttctaacgagactcttctttgacatcaccagcaggtcaacccaacctgaatctgtgtgtgagtctaagtacaatctaattacaagagaacacattcrgaatgtgccaatctatttagtttgagaaggagtgattctgaggaagccaagtaagtttgcaaaattgctcagctgaattcagctgctctccgtggggactttctctggaggaaaagaaaaatagataaaaatgtaagcctggtgccagcgaaatacaatgtggggaatccactcagggaaggaaatgatattccaagaaaaatgcagagaaactttasggtccaatcttccactttccaacagtaacatatttaaggacaatctctaatgttaacactcagaaaagatgcaacaagca

SEQ ID NO: 4118 - DNA, 600 bp, Bovine  MMBT15645
cgggagacggccggaagctggctcacgcactcggcggacgcagtgtactctgggaagggggcgggcctccagctgccttcgggttgtccacgcccaccattcttcttcggcgcttcccgcttccccagttagaaaacgttaattaaatgctcgggttcccttagagccgcggagtctctgccaaagtaacatgggttccatatttagagggaaatttaaaaatcaagttgtcagggactccaggaaaaagttgagacttaactcttctttccttcctgcgtctgcagattgcggtgttcrcagggttatccccgtttccgaaaaacacgttgcccagcagctttgcawgagaaagctgacaattcttggtttaaaggaatgcactcaggcagagttctaagttcaaacttctggtccatctggtcctctttacagatattgattgaagccctaaattccgccgcctaacttccctttgtcctctctccattacaaattttcagtcatagccctctctccctgaaaaaaaaaaaaaaaaatccatggacttttctacttgtatttcttttttaatataacaaaygtttactgactacctac

SEQ ID NO: 4119 - DNA, 600 bp, Bovine  MMBT17389
gagaggattggaggaaaaatctaattgaattcaaaacataataaattgaagccaactcattcgattcatggcaatgtcttctggcatcttttaattttgcgtcatattcatttggagccaatcaaattagggtgctcattagtggctgaggtgggcagtgaggctggagccctgctctggtggtaatgaggtcagtgcagcaggataattcagaaggcagttggagtggagcagacagtaagagctcaacaatcactgtctcattatcaggaaaatggactcrgggaggggtgagtgtgyaycccaaatctgctgcttgcttacaggctggccttgaccttcactttctgcagctttggttctactgggataggagtagggcccacctctaaggatgagtgagtatgagatgaaatcatatgtaacaagcatctcstcctccagtttctcagagtccgcctctgctctctgtccccaccaagggtgagtgagtatgaaatgaaatcatatgtgacaagcatctcgtcctccagtttctcagagcccacctctgctctctgtccccaccacaccacacagccccagtggtggcgctccttg

SEQ ID NO: 4120 - DNA, 600 bp, Bovine  MMBT17926
agaaagtgtgaatcagatctaaagtccagccacagcagaaacaccggggatgagcttaaagtagggagaaacaacaaaaaactgtaggacaagcttgaatagatcaaaggttcaatcagagtgtccacctcagacttgaatgtgcgtgaggttatttggggatcttaaatgcagatttaaggtctgggtggggcctgagactctgcgtttctracaagcttcccaggcgatgttgaagctgcttggctggtgactgtgcttggaatagagaggaaataaaagaactcaaatctggttctrctagtgtcatgtcccttccccaggctctgccctcagagattctcaagttattggtctggggtttggcctgggtatggtaggtcttcaaagctactcagatgattccgatgtagccaggggggttactgaattcctagaccaagattttgggcaaattgggacatggggactatctcatttccctcctgactccatctctttctctcctttcttcccttgaagtcttaattctgcctggctcctctcacttcttcctttttttaaaaagattttatttgtttatggccatgctgggtcttt

SEQ ID NO: 4121 - DNA, 600 bp, Bovine  MMBT20438
tctttgacatcaccagcaggtcaacccaacctgaatctgtgtgtgagtctaagtacaatctaattacaagagaacacattcrgaatgtgccaatctatttagtttgagaaggagtgattctgaggaagccaagtaagtttgcaaaattgctcagctgaattcagctgctctccgtggggactttctctggaggaaaagaaaaatagataaaaatgtaagcctggtgccagcgaaatacaatgtggggaatccactcagggaaggaaatgatattccaagaaaaatgcagagaaactttasggtccaatcttccactttccaacagtaacatatttaaggacaatctctaatgttaacactcagaaaagatgcaacaagcactcagctgttggactataatagtgaaggtaaaaaaaattataggagtggactgtattcaccccatctgagaccttcatcaaatttctctgggttagccaaagctaattctttttttttttttttttaagaaaacggctcatcaagatgtcctggtttttctttatttggtttcttaaatgacattcagtcctcaaaccagcaacagtaacataagcaaag

SEQ ID NO: 4122 - DNA, 598 bp, Bovine  MMBT21125
  misc_feature (1)..(62): n is any nucleotide
nnnnnnnnnnnnnnnnnnnnnnnnnnnnnnnnnnnnnnnnnnnnnnnnnnnnnnnnnnnnnnacttacttggggttagaggctaaattcatcttgtatgggtgacgtttcccttcctctgtcaccagaggagaccagattttctgttcagatctgcaacagattgacaaagctaagctgtttcatgcatgccaataaataatacacactaaaaatggagtcgggttttgtcccctcttacccagctactagcattctgctccccagcctcccctctgttttaccactgatgtgattttcrgaagcatcaacctcatgacatcatgtctgattgctactctgacagctgcccactcagccctgagggatttcccaggctgctggcccttcgtccagcctcagccctcccccaatacattctgtgttgctgacccagctgcaccagcctcctccaggctcctgaacctgcctgatgccaccccacctctgctcaggacagaatgagcttctctgtctcatccagtgttcttgatgcagaccagacaaccagcttgatcatggtgcctctcctgaacttggraaaacagctctgtaccatt

SEQ ID NO: 4123 - DNA, 600 bp, Bovine  MMBT01100
gtcacatctccattcaaagccaggcactcggtaccacttggcaatgtctccatgtgtccctttcctccgtcattccctatggtggctattcaagacctctcttagaaggcggccttggggcttcccaggtgggtccagtggttaagaattcaccttgcaatgcaggggacatgggtttgatccctgktctggaaactaagatcccatgtgccacggagctactaagcctgcacacccaactagaagttcatgtgccacaacaaaagatccacatgaggacataaagatcctgggtgctgyaactaagacccaacagagccaaatgaatacacatttaaaaaaatagacgaatacagccttgctggctgtaaatagacaccaagactatcagtcatgaactttctccatctcctctctctctctgcacctacaaattattgcatttatacttactgaacacttctctccttccccagtcacaggaagacatgtcctgtccaaggcaattcctcacactgctctcatactcaattcccttctccctctcggaaacatttgccgccattctcacccacaaaccctttcagactctttcccaaa

SEQ ID NO: 4124 - DNA, 600 bp, Bovine  MMBT03521
ctcttttggggaatagtgttctagagatgtactgtttaacagcttaccactgaacatgttccccaaagagattatacaaatgaaaaactgagcttgattctgtgaaggtcacaaagaagagggctccaaattcaattccatctcaacattttatcccagactggatttaataactgtttccctgaacagctatggagccatcttttagccgcaaaagactggcagatagtagtgattttaagccaaaagcagggattatgcagtgttggtgtgtgtaggagcgtgtacatgtattcatayaagttctgtagacatgaacttcaagaatttcaatttcaagaagatgtactttgtcaaaccagacatattttagtgtcaacaatctgtgactgtacttaaaagccatcagatagactatcttatgtttacagcaaacctagagtgttctcttgtgtcctcacttgtgatatggggaggctaatatctggtagtgtttagtaatgtgctcagagttacataggtaaatagtcacagagctaagatgaaactccaggctcttgatgttcagtttagtgtttatttataataccaactaatcta

SEQ ID NO: 4125 - DNA, 601 bp, Bovine  MMBT06890
  misc_feature (1)..(1): n is any nucleotide
ntgttttattcatcttcaggtgccttgaacccaacccattgtagtacctagtgagtgctctgtaaytayacaaatgaatactattgttcaacagagtcctggaacttcatatttctacagcactttcctgatgcaaaatgcatctttgtgcttctcaataactctgcaagtcaagcaaggcaggttgtattccactttttcagagaagaaatcaagccttcaagatgtcaagtgactcggccaagataagtcagcaaggtgtacagctgaaaaccaggtcttgttaaacacacagcaggarcataataaatacttattggggagataaggaagagaagaggaaaaatcaacagaaagaggaaacacaggggtgatttggatccaactccagtgcaatagtctgaccatctgcccatgataatctggcaatatccatgttgagagactgaatcaatgattgtttttatagccggagataagtggacacattttcactttgatggattatcaaacggcaattttagtaatgtcgttagactgcagtagagatagaatgcaatttagatatgcatatcctctttctaatcatcatttatccatc

SEQ ID NO: 4126 - DNA, 600 bp, Bovine  MMBT10202
ctgcccgctcgtgcggaacccagaccagcgaaatacggatggcgacaagtggggcgatgcgtgcgacaactgtcggtcccagaagaacgacgaccagaaggacacagataaggacggccgaggcgacgcctgcgacgacgacatagacggcgaccgtaagttctgggcaggggaggagaggagaggaaagggcgggcaccaaggggtggggtttggctggaggcggggctcagcctcttctggaagccggggagcgggtgagctygcctagggcgccatggaccgctgatcctgctccgygggcagaaatgcaagctgggatgccgagggaaagagggaagaccttctggaggagggaaagggggaccgtgcgttagatgctgcaggggaaagaggacagagccgtgagcatgggggacagggccccatggaggaggtaccatttttacagccrggagagactcaaggtggtgcacatactgagccagtccctgcaccgctccatttagtctctaggaggctgggcactgggcacgaatacttggtttaactttgtagttattgggagccagccaaaggtggagtggggactctgtccca

SEQ ID NO: 4127 - DNA, 531 bp, Bovine  MMBT12582
ctctagaatttccaattagttctttttaatttcctcatcaggtttagttttcctctatcttcttgtaaagttacagagtatctataatagctgtgttaatgattgtgttggctcattctattacttctgtcatgtctggatctgtttttactaattgattttcttccctgttatgggaaacatttttgtgctttatgcatgcctggaatttttttattggccgcaaaagaatgagaattttacatccttaccgcttattattattattcctttaaatacaatggactttattctagcagscaattaagttacttggaatcagatggatcattttgaggctaacttttaaggctggtaggaatgggctcagatgaactttagttattagtctaatttagccccactactaagtggatcattttatcagagtactatcaaatgcccctggcattttgaagttcttccactccagctggtgggaatacacagaacttgcagcattgtttatgctagtaaagctttttgcttccc

SEQ ID NO: 4128 - DNA, 600 bp, Bovine  MMBT17025
gagttcttcaaaggtgagcgaagagtctctttctatcttgaatcaattgcctaatctgcatataggtaggcagaaaagcaggcctaccagaggtgaaagattttgctgataagacaaaaagaagctgaactttaagtggcagtgtgaactggtatgatgaattcaatctagaagaggcccagatgtaaaaataaatctcttggtctaataactataacccaagggacttctgctgagtaagcagcagaggaagcagagaaaggagagagatctcccaaacttgtgtggtccttagattcyagggccctgctgcagctgcaatccagaggtgaaacaaattaatttaagcttcaacccactccctgccagctgctagttttaaaaagccaaagaaatcagcctttcatcctcagaacacaggaaactgcgggttgggctaaaggtcaaatctccataatttcatttaaatctagaagtaaatggactaaaactgctgctcagatccagctcagtctgactcaatgaaatrtgaatgatcagccaaataccccagctgcctgagagaggaaagaatatgccccatctgggaaaaataaagga

SEQ ID NO: 4129 - DNA, 600 bp, Bovine  MMBT19849
ttagagattattgtcgactttcccttggaaaaggaggtggtatattttaaaccaccaggaagcaatgtcagtgaggttaaccaaaatattgaaaagcaagaaatggacacagaaattatgaggactcatcacaggaaaacttgccaagacttattgccatagcacaactttcattcctcttgctttctttcccccactgtgctgagaaacattctaattgctattgacatttattgaaaaagtcaccaaagagcctgatgtaaccttgtgtaccatatagaaaatacactgatgcactarctgtgtaagcagtagtcttgcagataagaaaatgagataattccaaattagatgaattctaagatacaaaatgttttccttcactacacaatgtgttacatatttttgttcttatttttcagcagttttccaaggaatgaaaaaaagtgaatttttatcgttgcactatgggtttctaaaacttactttatttaaaaaaattgagatttcatgaaattgtaaatacttctcttttcagtactgtcttctgtagttccatggttggttccctagtttaggggcaagacacatagatgggtt

SEQ ID NO: 4130 - DNA, 485 bp, Bovine  MMBT20879
aatgtggtgtagatatctcagagaagacagaggaattgctctccagtcactcgcctgtgcttggaatgcagccacagggccacctccacgcaggactcagaacaaattgctcccttttcccgcttggtttcatgcccaaccccaaccccaccctcgatcaacctgtgactagaacccatcaatgtgatagcgtttccccaggcgacgacctgccgttgggcagaaagaacaggtcctctgtctgccgtgggacagactgactaagctgagccctgccaggcacacgacacagctctcccygcagagccctggcaagcgccagacgccgctgtcctttggcttcacgtgctcaacgacccttaagatgagagctgtcaactcaggcgtgtggggaggagactcggactcaaaggttgaaggttttgctccatgtggaggcacagctcctgcccagcggggttgaacagtcccgttatgcttctggc

SEQ ID NO: 4131 - DNA, 600 bp, Bovine  MMBT20994
gaggattggaggaaaaatctaattgaattcaaaacataataaattgaagccaactcattcgattcatggcaatgtcttctggcatcttttaattttgcgtcatattcatttggagccaatcaaattagggtgctcattagtggctgaggtgggcagtgaggctggagccctgctctggtggtaatgaggtcagtgcagcaggataattcagaaggcagttggagtggagcagacagtaagagctcaacaatcactgtctcattatcaggaaaatggactcrgggaggggtgagtgtgyaycccaaatctgctgcttgcttacaggctggccttgaccttcactttctgcagctttggttctactgggataggagtagggcccacctctaaggatgagtgagtatgagatgaaatcatatgtaacaagcatctcstcctccagtttctcagagtccgcctctgctctctgtccccaccaagggtgagtgagtatgaaatgaaatcatatgtgacaagcatctcgtcctccagtttctcagagcccacctctgctctctgtccccaccacaccacacagccccagtggtggcgctccttggt

SEQ ID NO: 4132 - DNA, 598 bp, Bovine  MMBT22798
  misc_feature (1)..(22): n is any nucleotide
nnnnnnnnnnnnnnnnnnnnnngatagtaaaaagtgcattcaagaatattttttaaagcaggtgaattatcttcatctctggacaagtgaagaaggattaatagccctttaggggcatgtctgcttttaaacaaacaaacaaaaaaaaatggacaatagtcatttaaactaccaaacccattatwtgcatgtaaaaaccttcaaagtgctttcatatctttatattaggaaggttgtggcaacatcctaccccaataaaattttattcatgctttcagttacatagaaaattattctctyttttcaaaatatgtgaattctcactactttctgaaggatcataaattcagaattattttgatcrgtagaggaattgttgttaacacaagttagtgtttcttgaggtgattatcacctggacattctccttttgccactccagacccttttccattctgctctgagttcctaaacctgacctctataaactgcaactgaaacctttgccagctggtttccaatggrtttggccaaagcggagaactaaataagcaggagatacctggagaaaggaaggaggcagggagaaaaggggaga

SEQ ID NO: 4133 - DNA, 449 bp, Bovine  MMBT23271
  misc_feature (1)..(22): n is any nucleotide
nnnnnnnnnnnnnnnnnnnnnngatagtaaaaagtgcattcaagaatattttttaaagcaggtgaattatcttcatctctggacaagtgaagaaggattaatagccctttaggggcatgtctgcttttaaacaaacaaacaaaaaaaaatggacaatagtcatttaaactaccaaacccattatwtgcatgtaaaaaccttcaaagtgctttcatatctttatattaggaaggttgtggcaacatcctaccccaataaaattttattcatgctttcagttacatagaaaattattctctraaggggaaggaaactttttcctgacaccttcacttctgtcaatttttcagtgtctcaggggaagaagggggtttcctcaactgttagaccctggatgggtgagggacttttgaggtgtcccctcaggagtccaagccatctcttctcat

SEQ ID NO: 4134 - DNA, 600 bp, Bovine  MMBT09214
agagagtttcccacccacgaggcagaagcagagaagaactgtgctcaccctgctcctgcaggacaggccttccccatctaaggggcaccatcaaagaggcacagggaaggtttatcccagcatgcacaggagagttggcctgaatgaacccctgtctgtctttcttggtctttcacagtcattttgtgctgtttattctggtttgttaataaattggaattatccttcaaacaagatgtttttgagttgtgattcaaaagtcaaattccttggagtttgatacggtgttaagaatgatgsgattgaaaggaggaagaaaataaagagtaagagctttccactcagacccgaagggaaagtagcccctgggggagcaggtataggctgagacctgtgcccttgctcagtggggagctattgtgacctccttccccgtgtgtcttaaatcctcacattcacacaaagtatttaatgccttataatgttgtctggaggccatcaccttaagagacttgcccatccagcatcacctctgtcctgttatgcttctctgatatctgataataatgcaaaaatactaccattagctcaagccccatg

SEQ ID NO: 4135 - DNA, 598 bp, Bovine  MMBT20976
  misc_feature (1)..(159): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcatttgcttcaacagtacataccagaatttcttcagctgcctctgtatttcaaggcacaaatgccattccaagaccgttataattaattgcccccagataaatgtacagcaagaatatccctatcatgtcatctgtcrgcactgatttacacatctgacacagggaatgtgtagtttaccagttaggcggttaaatttggttaattgacctgccaccagtctgctacagaggtcagtagactctttgtgacctgcccgcctgtcttcccgagcgcagcatactcatgccagattctggctgaaatcaggcataaagcccacggctggggtccctaccccctcaacctcctgtcagtctagttcacagggtttctcccgagcctggcacacagtaggtgctcattaaatttgttaactacacagtggaataaatgtt

SEQ ID NO: 4136 - DNA, 600 bp, Bovine  MMBT01730
atttaatttggatacttaaggtatggttggctatggcttttattatagtcattactttagagctatacattgtatatatgaatagctaaagttgtattcagacttgtaaatataactatttcaagtaatctggaagtcatgtatttgcatgtgctttttaagcttcacccatgctgtttattgcactgagcgatatatagggcatgttaacagtatccaagtaacggcactttatctcatttatatgaacacctctgaggtgctacaagtccaaactgatgtattattcatttgtaaagrtaaggtacaggaatgatccttgagttaaaggtatttttatatgaaaatgatatgctattggaggatgttaaaatgctagttttcagagaggtgggagtgctttgttttatatgttgggatgtgaaattattttctagaattggagagaaggaagttctatatttacagaatgttttaaaaatgaagagttgtaatgaagtcctgtaagcaccattgtggtcttgtacgaacaggaatcttctggcgtcattcttcagcattggttcctgtgtgcagtgtactctgtatagtttcattgtg

SEQ ID NO: 4137 - DNA, 600 bp, Bovine  MMBT05016
acccatgtccatcgagtcggtgatgccatccaaccatctcatcctctgtcttccccttctcctcctgccttcaatctttcccagcatcagggtcttttcaaatgagtcarttctttgcatcaggtggccaaagtattrgagtttcagcttcagcatcagtccttccaatgaacattcagggctgaacattttaggaatatgctttacatacatgtaggataaggcaatcatacaagaaatgagtacaggaaattctttttaatattaaaagattcaaaggcatataaaacattttagatycacacttctcctgctacttggaaaagtttcatactagcataagaactggtggatcacctccaagtctagttcaacaataagaggctctgagtccatggaactttccaaataaagattcagaaactacattacctttaactgttgctgcaattcactattcaatctggccaaaactgtgttggtttccttattgcgtctaattgatgcctgaatagctttcttatctttcccaacagacctgagaagataaagagagcaaaaaacgtgaccttcattcttattattaaatttgctccattc

SEQ ID NO: 4138 - DNA, 600 bp, Bovine  MMBT13252
ataagacccaagccataccgagtagacaggtggagcgaggttcagagcaacattcttagtgcccttgctttatccttagcctttgagagaaccctacttataagctgtcccttccgctgcaaaaagcaggacacgatgcctaaaaccttgctctcatagacccttgcagaccctgggtccttaactcttctcttccttccaaaacccaggcattgtgtccgttacagactttattatgggttgttagtgctcttcctgtttggcctggtgttgttgatgggtatgggaaagggaaaaayrttcagatcctaaggagaagagcatgggacaataaggcctttgtggatttaccaccaagtaggaagtagggggagggggggaaacacctaaaataaaagaaactccaagaatgaatacttaaatgattgagatgaaattcttttcaatgaattattttatattttatgcttatataagtatttgtcttccttcctgctttgagtcaaaatagggaaaaacatttcctagtgccttggtcttagaaggttgaggctccagggaacaggaaaatgaagagagaaagtgagaaagagagaaaat

SEQ ID NO: 4139 - DNA, 600 bp, Bovine  MMBT19605
cagatgtagctgactgctcatttctttcccctccccatcctgttagatgcttttgccaaccatgattcatggaatgatttttttgagctgagtaatttgtggcttttcagtttccttactttctttccttagctaaacttgttttggttttagcaaagtgtttaaaacagcaaagatctttgaaaatgaaataatacgtgtaatgatatattttctaagtagatgatttttaacaaactgtaaaaactttatatgcctgtccttctttgtatctttcataactcctctgtcagacaaatyctctcaactctgaaggagagccttatgtaggggaagacacagcaacctttgaacagccctttgtgaaatctgatggtatggcagctggtatttaagaacttcttttctaagactcctaaagagcattttaaaatgtgactttcttctttctttacagatcgaaacgaacgaaataaaccagagcatcgttcttcaaggtatgaatttatagttatttaataactctktataaagcttctcttttaggaaatattatttggaagaagtgcaagtgtccctttttgaaacactgtatacttg

SEQ ID NO: 4140 - DNA, 574 bp, Bovine  MMBT06893
gaattgtgtctcctccaactagaaaccattcctgtacgcaaaagatgaaacacgtcaggatgcatttaagtcacagggagcgagatgttgctgttctatccagggagccataaattctcatcggggtgggacgccaagagattctgtaggcaaagtgaaagtgggaacaaagtgatgactctgccttagaataataacacgaggtcttttgcataacactgtgcaacaattatcttgatagagccttacaaaacccataaacgtaggcgagcaagcaacataattgtcctcatttcacayagaagaaaaatgaggcttgaagactgtgaatgaatttcccaaagtcatgcaaaggagaatcagggctggaaacagtccccagtctgacccttttccactccactaagcagccttctacccaggggcttttgtgccccatcaaacagagaaatcagaaccactgagcttctataaaagaaaatggaaagttctttcattccaaaggaaaccagttgtttccgaggctatcaggtgataataagagctattcatagttagtaatactaataacaaa

SEQ ID NO: 4141 - DNA, 600 bp, Bovine  MMBT11221
ataaagataaagagaagtaagatttttaacatagtagattggtaaagatgaaaatgagaaaaattaaattttatattagccaagatttgtacactttcataaacttatgtaggaaattaaattgcataagttttccagaaactgccaattatcacaaaatccctaaaaatatatctattctttaaccaagaattccacttttagaaatttatcctagagaaaaagctgaacaactttgcaaaaatagattttcatcactgcaatgcttatataataagaaattaggagataaaagtctamcaataggatattggtaaaatatgtcatggtaatccacatayraagacactatgtcttcattataaataatgatgtggatcaaggatcacmacttaagatgaccacaggggcaagatgtaacataaatgagtgaagagactctttggcagacttagacagcatgtgccccttttgaagagggcaactccaattaattgatgccaagtaagaagtrggggagggtctagtrttgtcagtatagccaatattttaagtgaagtaaaaaattgaaattttatgtgaaatctcctcatgtttaaa

SEQ ID NO: 4142 - DNA, 600 bp, Bovine  MMBT16086
actgggaagcagctctcatcaccactttagccaaggggacagtgagtgactcagatggacaagccaccaaatacccagacccraaagaggggaaggagaggaggtcgtccttgagcaggatctcctggcaccctgccctggctccctgcctgtgccagggcgtcaatctcagcatctaaatccgtcagacacttgtccagcatctccttccatcggctgacagtatcgatcctctctgccagccgcgtcctattgtcatgttcatcccaaatggtctggaagagacagacacagataaaraggctgtcgggggctgggagctatcccttcaccacccagctggactctggacccccaacctggttgttggtctcgttgcggaggacccgggcctcctggcggatctggtgtgaggcatctcgctggcgctcggcgttggtggacaacaggtagcttgttggtctgccagtccggcaaccggaagcgtggactgggcttgacactcagcgtggccatggtgcaggtcctgaagggtcaggcccccaggcctgttccaggacacctaactctgcaggagggggcaaacaggtggcaggagac

SEQ ID NO: 4143 - DNA, 545 bp, Bovine  MMBT17157
tgattgagtccttactatgtgccagacacagttttaaatgctttatgtggactaagtcattctctcataacgttgttacaatataagtactattattatcatctctctacacgaaatattattttggaaatttgcataagaggatctagctgatctggggcagagcaaggatttgaggccagggagtctggttacagagctggctcttgcccaccgaaccgtatcccctctcctaagagaggtgacgtttcccagggacacagtttgcacaagaatcccgactctccatgttcacagcamcacccttcctccgtagaatgttctgtcctcgycccatttctcccagcctattctcaggggcatcccttaccaaaaacgygaaagaaacaccctactaacaacaatgtccttctcacctctgtcaaagggggctgcaaaaatatgcaaggcagggtggctcagacttgggggaggggctccaagtccaacctcagcgttaacggctgggcaccctagtcaagtcacaccacatcttcacccacaca

SEQ ID NO: 4144 - DNA, 600 bp, Bovine  MMBT20630
cagcaaactgcagatgtcttctcctcatctgccactcttccagaaaagttcaccttctgcaaagtccaacttgcagagtggtagaaacagggagattcacagccagttcctagctttggaaggatctgatggagcctgaggagatggttgggctcttttttcttccttaaatagaattttttttgtctgaggccagaagtctccagctgggccctggtttagtcaggcatctcccagatttcctcttgtcccagggcccctttgagatttcacatgcagtctgcatatacastcctggaraacttcagtcgaaacgaagcaaactggagagtccttccaaggtggtggtggtttagtctctcagtcatgtcctactctttgcaaccccatagactgtagcctgccaggctcctctgtccatgggatttcccaagcaagaatactggagtgggctgccatttccttctccaggggttccttcctacccagggattgaacccacatctcctgcatttcagggggattctttaccaactgagccaccagggaagcctgttcttccaattggcttagccaaataattagaaaagttggtctggg

SEQ ID NO: 4145 - DNA, 598 bp, Bovine  MMBT22240
  misc_feature (1)..(44): n is any nucleotide
nnnnnnnnnnnnnnnnnnnnnnnnnnnnnnnnnnnnnnnnnnnnccgcacggggctgggctcctctgggggtgcagggtagactgcccaagccgcggggacaggaaacggcgagccaagcagaacagccgcccgtgagtcaccgttccagaacaaccacaaatggcccgcacctgctygtccaccccctcccgcacctgccagcctcaccaggggcttttggctgctggacagagtgggactggtgcacactgaccacctccagaagacagtgacagatgttagcgccagcaggtcctgyccctcccgtcagcagatgtcaagacatgaaaaattggggtaaatgaagggtgcacgattagattcgggcgcaagctgggttcttgtgggtgccagagacagctgcaaaggcacgtcggggacaggtgccctgatgcagtgggggctgctcggcccgggtgcccggggacagctggacgaggtgccgacgtggcccttcctccgtggagccaccccgcagctgctgggagcaccgccagccatgagccgtgcgccccagctccgggcccaccccggggttcccaggaccccagcctatc

SEQ ID NO: 4146 - DNA, 600 bp, Bovine  MMBT00015
ctgggccctgcatcccaggaagcaaaagtggccgtcttccaaccatagtgtgaatactgaggacccctaattcccatgaggatgtggaggcaggcgagctgtggatggctgggaggatgggtgtcatcagtcagactttgaggtcccaggctgagacattcagttctgggggtctctggacaggycctcagagccttctgagcctagagttttcgaggcatgaaacaagtaatgatacccacccctcatctacttcccatgacacagagctgatgggggctctgcagccagcccacccarggtcagcacttggtgccaccactcacagctgtgtggccctrcacacrtcccttcccatctgcgccttcacaactcrtctggaaagtggggacccccagacytagcctttctcacctcagggctgcagtccagctgctgatggaggcagctgggggccgctgagtggaggccaaagtcctcatcctcctcactggggaagacgggcctccccagcatctctgggctgaactctgagccttgccctgggatccctggggctgcgggagggaccaggcgtctggacgcccgggacagttatca

SEQ ID NO: 4147 - DNA, 523 bp, Bovine  MMBT03561
gacactttgcaaataaatggaaaacctaattccatatacaattatataattctcaagttaaaacacaaatattatcagcctcaaggtttcaagattttctctcctctagtcctttagcctttactcatccagtaaatgatctgaatccttataccccagatacactgtaagaaagatccagaggcaaatgagaaaggctagaaaggctaggtaaaaatcttgaccaaggtaaaggttaaaaagaaattctgttacaatgtactataactataactatagtttgtactattcctatttaarttctagaaatcttacagactattagcattttctatatcacaaggaaaactataaatttccctttctaaaaggcattaaatcaaaatttgtctagggaggcaaataagtactgtatatacaagggaaagcaattatacgattcagaatcttcattaaaaaactaaaataccagccctaatacaaaacagaagaaaaaacaaagaggaaccccaaaaaaaaacaa

SEQ ID NO: 4148 - DNA, 600 bp, Bovine  MMBT03976
tcctgcagatcagcaggtgttcccggagggagaccaactcgcaaagctgggctcacctgtctggttctcatcgtctctcctgtctcgtcccacagacgctttcataaggcctggttctcaccaccatttcagagcaccagtgtcttcaagcaaaatatctttcccagctttccaagttgctctcaatgagcacatctagtctcttctttaaaagatgattttattgcagttgtcatatttaaccaatagcggatgtcagggatttgcttcttaagagatgtaattgaaaacacccaaggktaagatttttgctttcttagagggaagatcattatcatcayaaccttttcctttccaaatctcctcttctctttctattttgtaagtcaacgctgacatctcaacatggagtttattttgttgggtttatagctctggcatctagtgtggttgtcttgcttacatgccaccctctgtttttactctggcttcactgtgatcactaagctccgatgtgggtgtgtgagctaaggagaagagcatattacaaagctgcaacgctttgtactcaccactgtttatattgtatgggttttgaac

SEQ ID NO: 4149 - DNA, 598 bp, Bovine  MMBT10365
  misc_feature (1)..(52): n is any nucleotide
nnnnnnnnnnnnnnnnnnnnnnnnnnnnnnnnnnnnnnnnnnnnnnnnnnnngtgctcggcagaatgaatggcacagctgtcagctcgtcgacgtgagctcccagtgtgagagcagcccgcacgcatcctgcagccctctccattttgtgctctttgaataatttatctgcaggaaatccaaattgccaaggcccgctttaacccagcagaatgcttgccaatttccttgggaaaactgacaaaaaaagaggtgtagattgcatttcggctgagagtggctgggcaatcagagctcggcmcctttgtgccgctgcatcggaagccactgcgccgggctcgcgcagacgacatttgaaggctcataaatgtaatgaagtccctttgacacctgctcctctcttcactttaaatgtgagccattggtccatggggaacctccgctttaaaaatagaaattatagtaattgtcttccgtgctgtcgggaggctgtaaatgcatggctctcagctctactgcctgcaatygacggctgcaagaattaccccaagttgagattttttgtccttaacaaatcacatgtatgctcgtgctgcgtg

SEQ ID NO: 4150 - DNA, 600 bp, Bovine  MMBT12851
ggagtcgtggagataccccagttgcttccaataaactttcttctagctctcaggccagtgagagtaggactttgtaaattgtaagtaatagagttttagtgagtgaagtgaagtcgctcagtcatgtccgactctttgcaaccccatggactatagcccaccaggctccttccatccatggaattttctaggtaagagtactggagtgggttgctatttccttctccaggggatcggcagaaatgatcttcaaggtgttgtgkttttttttgtttttttttttagctctaatattacacyagtggttatctaagtatggtcttcccaccagcagcatcaacatcacttgggaatttatcagaaatgccccaccccagacctattaaatcagaaactctaaggggggcgtccagcaatttgtgattttacaagccttccaggtaattctgacatgtgatcaagttttgcaaactgctgtatttactattttaaagggttatgttttatgtaagaaagggattttcataacaagtgccactatctttcttttctaattaagttactagattgaaggtcaaaagatgatttttattagtaaaa

SEQ ID NO: 4151 - DNA, 600 bp, Bovine  MMBT19541
ctaaaatgtgtattagttggccctttacagaaaaagtttgcagaccctaatacacagtagacttaagtctgtaggaaatactatttcctcagggagataatattgtttcaggggtttagagcaggtttcatagggaaggtaacattgaaggataagtaaaagctcaccaagaacaggaaaagaagaaaaatatcacatacagaaaggcacaagaagagagaacactgcatgttaggaaaatagaaacaggcagagtccatttggtatacagggtacttggcatacgccaagcgaaagaayggtagagaatcctttcactgacttcccctgcctatgctgccctgttcatgtcaacaaggaataaaacctacaattttaatgctgtactctaagggaactataaatagaaaatgtaattaggctggtaaaatagatgaaggttatcttgtcaggwstctgaacttcatcctactctgaattggaaggttatcatttatcataaaaagttaaaatactaaggtttatgaatgagttaaagttttctgagattagaatagtcaatgttttccttttaatgttattttgatttgtattctgaca

SEQ ID NO: 4152 - DNA, 530 bp, Bovine  MMBT21674
cttcccttcttcaactcccacaccagtttctgtaatgytttccaacatctcaagtgtataatcagcatgttcagatgcttttctaaatgcagattaccagcacaatgccccagatatgcataccccttaagtcaagcagcattgsattccacatttttaaggagcatagggattcttacactggtggtcagcaatacacatctttaaaaacactgagttagtgtgatccagtcattgaaatccgaaacagaagaaacatcctctctagggaagcagaatagaagaaagcatgtcattcayagcatacatacatgagaaaaatatttttctgtattttaatttatttaagccctcatctgtgagcaacaaataaaaattgtaacttcatgaagataatgtacatcacttctgcctcaaaactaactcgagtggcttcatagatatttctttcctgcctgtgctcctttctctctaagcaaaggtatctatcaagagagatggcttagaatttagtgtgattaaatgttcag

SEQ ID NO: 4153 - DNA, 600 bp, Bovine  MMBT21682
tttttagagaactttatcttgtggtaaaatggcttatcatcaaaggacccttatcaactatcattatctggcagactgatgtatgccatgaatattgttttgttgtttagtagctaagtcctggacgattctttgcagccccatggactgtagcccaccaggctcctctgtccatggaattttccaagcaagaataccagagtgggttgccatttccttctccagggtatcttcccaacccagagacaggtatattatgtagttcttaaagtggttgacaaggactaaattaaacacgamgtgacatttcttatggaagcatctgaagactagttagatccggtttggggacaggcggctcccctttctagaagccaaaccccatctctcyagagcagagctggaggagggaagatactgtttcatgcattgtgacagccttagggaggaaaagatattggagactctttatttgctcttctcccttcccttcttcaactcccacaccagtttctgtaatgytttccaacatctcaagtgtataatcagcatgttcagatgcttttctaaatgcagattaccagcacaatgccccagata

SEQ ID NO: 4154 - DNA, 600 bp, Bovine  MMBT01814
ttaggacataaccctggtagaagcagaggagattgactggagtaaggagagctgctaaccagacattttgtttgttgtctggcttgaatgaactagtgaaccacagtacagagtgaagatgaagagacatattccagttctgtgatgcttgaagctttttacaaatttcaaggctctcaaaataaaaaaaagttcaaaattataagcacaaatttaggtacaaaaacaaacactttataataaggaaaagaatctgaaaacattactaaatttaaagggttgatgaatgctaaaaatttyataaaatttgggaaaataacayartatttctatgacataccttcctgacagttctacctattaaagatatagaaactttttagattcatgctctttaatatcttcatatgaataatgttcattatattaatacatatacaaaatatgaattataatagyattctgtaaggagagattagaaggaaattaaagcttttttcatattacagttgatcattttttttaattgatggttcagatgcaaaagcatgtggcttcacacagctgaatctgctgcttatatgcaacaggaggtgccct

SEQ ID NO: 4155 - DNA, 600 bp, Bovine  MMBT02665
tatccctcagagttgctcaaattcaggtccattgagttggtgatgctatctaaccatctcgtcctctttgagtataggcataattattaactaactcaatcctacctaatccttttatggaaaaaagattaggagctcacaactgatttactaagtttgaggcacacygtcttctggcggagtgagttaacagtttcaaaatgaacatctttaagcaatctgtgcagttctattcaaaattaaacaatgaggagaagtctcaaataactgtgacatctaaattaaggttgctgggctgcstagttgttcctcattaatgcctcatcctttcccacgatcttgggcctttatatactttctcaggtggtacaacccaatgatttatcaacctgattatccctcttaacatttgagatttattaggtgcaggccagtctttcagctacactttaattgtgttaactgcaaatgcaattaattgtgtcacctttggggaagaatttcacagctacatttgggggagggtggtaagtcccttattaaagtcgtatgtgttgaaattctcaagagaaagccctggttctatgatttttgtgagcc

SEQ ID NO: 4156 - DNA, 593 bp, Bovine  MMBT02943
cgcacgtttgtccatcaccctttttacttgtctgtggggaatctcctccccctcgtgcgattcgacaaatcttaaccctttgcaagagacagcgagacctctctagccccgggggcagttttgtttatgcaaaggtgactaggggagagaaggaagggctaggagggggaggaagtagctttgaggtcatctacaacgccctgtcccgacctcgtgggccgcctcgccaggcctttgaatgaagtttctgaaaaccaagcgaagccccagggcgaaaatagcacgtaggctataagtaartaataaaacctgcccgcttcctcgccaacaattccaggcaaatttgcgctgagatgccacgtgaaacgaacgcattttctgcctccttgcccctgccgcaccctccaggtcactcaccgccgagctctggctttgactcaaggtaacttggggccgggtctgcggagccccccagtcacgtgcccgctggggatgctgagggcgaaggtggcagaaagtcgagagtgactaaaagccagaagaggagggaggttaggtggagggttggataggaaaagggtagaggtagtgca

SEQ ID NO: 4157 - DNA, 600 bp, Bovine  MMBT03591
ttcttagtaaaatccaaatataggacctgaatctgtgttgtttcttattattctaaagcatcaatatctctagaactggttctacagaggaaattggatatgtgtatgatattcaaaaatagttacacattttcagctttttaatatatgaatatacctctaacaatattttatttcttgaaatcctctaggtttctcccagaaagtctcactagagtaaaagtcaaaacttcatagttctttcaagacaagagtggtttttctttttcagtgtcttaagatggttttatattcctgaayaatgtgcaagctctttcttgagtgtactatataagtgtgtttttatttttagtatcaagattatctttttcatacatataatcatctctgtatacattactcagtgcccagcccatggtaatcaaggacagcatgtttgcaacatcatgtgtaatcattctttctgtcttgtctcattagagaattgcactgaagagtcaagaacagagactcagcaggaatcaaagagatatgaaagtcctaatttctgtagctataatatcaagcaaaattatcatcccacacaagttcataaatttt

SEQ ID NO: 4158 - DNA, 600 bp, Bovine  MMBT10341
aaaaaaatagtaattccacaaaatgatgacattttaagtagtaaaaccttaattagacagcagtgaggacttgtagcgtgaagaagggactgtcacggtgtcttcctgtggttaaggaaagggcttcccagctgccacagggaaggaagggggcttcagccttgactctcagagaggctggctggtgggaccctcatccttaccacgagatccttcggatccttagacagtgcaggtcacatgttcctgaccttccttgggagtgaccacccacactttatctactgtcatatctgcagrtgggaggggtgcttttaygatgactgtgacrtcttagatgtaactgtgtaacccttatagcgactgaaggggaatgtccacacccagtggaaaattccacaggaaacaaccatgtcttcattgcactcagtacctatgtatgacatacacgttaagtgaatgttttcttgggttttccaggtctacaatatttagtccatgtaaatgatagaatttgataaatatggtaaattaagttataaggtgtcatttgatttctcttttgctgtctcacgttatttaatgttcctgatgctccat

SEQ ID NO: 4159 - DNA, 600 bp, Bovine  MMBT14152
aaaaaaaaaaaaaagaaagaaagaaagaaaagaaagaaaaagaaaaaagggggataaagaaaaggaagaatgaaggaaaaaaaaaaatctcggcctggagaatgagcaggaatagttaccctcccttgagcaacaaacggtttatcaaaaatgccctccccatcccccaccttctctgtgccggtcctacaaactctttgctccattatcttacatttgaacagaaaatcgttagaaatatttggaaacgaaataatgtggcagtatcttgcaaaaaaagagaaatctaaaaatagtgcrtgaactgaaccagagggagtcggagtctttctccctttattttcttctcttttctgaggagggaagcgggatttcctcggatgttagaaagccgaaggccagaagtggataaaggaaaggcgtgggcacgttctagaaggattctaggcccccttctcacacctttcctaaatgataaacttgattatgctaaatcgatgtcttaaaaagcacctctatcactgtgaataaagaatttgtattttctgttaaaatggaaagacacgtgtaaaaggttccgctgaaagacaaagtcagacg

SEQ ID NO: 4160 - DNA, 600 bp, Bovine  MMBT14849
tttttcatgtatgtcttacttctcccaccttattataagttgagtatttgcttttgttgttcaggcgataagttgtgtctgactcattgcgaccctatggactgtagcacgccaggttcctctgtcctccactatccctcagagttgctcaaattcaggtccattgagttggtgatgctatctaaccatctcgtcctctttgagtataggcataattattaactaactcaatcctacctaatccttttatggaaaaaagattaggagctcacaactgatttactaagtttgaggcacacygtcttctggcggagtgagttaacagtttcaaaatgaacatctttaagcaatctgtgcagttctattcaaaattaaacaatgaggagaagtctcaaataactgtgacatctaaattaaggttgctgggctgcstagttgttcctcattaatgcctcatcctttcccacgatcttgggcctttatatactttctcaggtggtacaacccaatgatttatcaacctgattatccctcttaacatttgagatttattaggtgcaggccagtctttcagctacactttaattgtgttaactgcaa

SEQ ID NO: 4161 - DNA, 600 bp, Bovine  MMBT15958
cagggtatcttcccaacccagagacaggtatattatgtagttcttaaagtggttgacaaggactaaattaaacacgamgtgacatttcttatggaagcatctgaagactagttagatccggtttggggacaggcggctcccctttctagaagccaaaccccatctctcyagagcagagctggaggagggaagatactgtttcatgcattgtgacagccttagggaggaaaagatattggagactctttatttgctcttctcccttcccttcttcaactcccacaccagtttctgtaatgytttccaacatctcaagtgtataatcagcatgttcagatgcttttctaaatgcagattaccagcacaatgccccagatatgcataccccttaagtcaagcagcattgsattccacatttttaaggagcatagggattcttacactggtggtcagcaatacacatctttaaaaacactgagttagtgtgatccagtcattgaaatccgaaacagaagaaacatcctctctagggaagcagaatagaagaaagcatgtcattcayagcatacatacatgagaaaaatatttttctgtatttta

SEQ ID NO: 4162 - DNA, 600 bp, Bovine  MMBT16361
gaacaaccaatgtcttccaggaagttagactacttatttctttatgaggtactttgaatagaagagttcactgggctgaagtaaagccagtgaattggcaggtgagtagaattctgccttacacgcaagccccattttctctgactaatctccctaccctccccgttctgtccaccccatttctcacttgttcttacatctgctggaactgttttcagaatttattgtttgggcgacttattttgacataactggcaggttgactcatgtgaatgagttaaattaatcatgggttaaaartgtgtcattatggtagcacgttagagctatcataactccaatgttgtctttgcatgaattttcctgccttgtcctcagctgaacatctcattttcaatttaaatgagaggattctgaatctgtctttcctatcttgttcactggttctggtttaattcactatcttcattgctaagctaattgcagttagaatgttatttcctctgttttagaagagatagaaagtggctagactatgattcagaattaaataagatagtttctgtatctattttacagtaaacacaattataatctttt

SEQ ID NO: 4163 - DNA, 600 bp, Bovine  MMBT17233
gcctggtaggctgcagtccatggggttgctaagagtcagactcgaatgagcaacttcactttcacttttcactttcatgcattggaaaaggaaatggcaacccactccagtgttcttgcctggagaatcccagggacgggggagcctggtaggctgctgtctatggggtcgcacagagttggacacaactgaagtgacttagcagcagcagcagctcaatcaattaatctatctacctatctacagtccatggaatcacaagagtcagacgtgacttagagactaaaccaccaccaaccrtctatctatccagctttgatatacttgttgctgaagaaytcagcaaacacaatgcaaaggattcctgaagccagccactgtgtaaggcatggagacctttctgtctctagaagtattcattctccctaggtccactgcaggctgtttttaaattaaggtggatcatacacatacaagacctacctcaaagttcattattggattaccgcccttrgcatcaagggaggaaccacactggttaaaatgatctggtttgctccacctaagaatctccggggttttatagttgacctccaggta

SEQ ID NO: 4164 - DNA, 598 bp, Bovine  MMBT18950
  misc_feature (1)..(143): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagaaagaaagcaagcagagtactttctattcacaaaaatcttcctgagacaaatgagaattgtgcatctaaagaatagcacccaacttaaaagamaatggatcgaggaagttcagcataaccagtgttgaatgtattctgctcattctagcccrgaagtcccagaaacagtcatcaactacaagtgacattcaaataccttatgaactcagtgtgttggtatttgaacggtttccctctaaagtcactacaaagtattactgtgttatagccaaatgttttctaacagtttgcacaattctgtcatctacccagggaagcaaatatagatagtattcagtctgcagagtaccaaaatctagatggaaagggtcaagcttccatcacggcattatacyacgttayayggctatttcagccataatgtcagttattatatattggcgacgtgcc

SEQ ID NO: 4165 - DNA, 598 bp, Bovine  MMBT21254
  misc_feature (1)..(49): n is any nucleotide
nnnnnnnnnnnnnnnnnnnnnnnnnnnnnnnnnnnnnnnnnnnnnnnnncccagggcagctgctaggttcgtgcatttacgtatcacgctcactctctcctcaggactttttttctttcttaattaatttttattggagtatagttgatttacaatgttgtgttagtttctgctgtacagcaaagagagtcagttctacacatacatatgtmcactctgttttagagtcttttcccatataggccattacagagtatagagtagagttccctgtgctatrcagttcctcaggactttccygcacaactctctgattttttgctcaactgaaagttcaatgatgacagatgctgtatctgctttgttcgcaatctttattcccggggactagcaaagtgtttactatacagttagtgcccaatacatgtttatggaacgaattcatgagtcaacacatcaatggaaacaaaacagtttcaaagaactttccacccaaccatggtgagcacctgtgaaacattctgacctayaacaggaaggcttctctagatcaagaggctctgtctgcctgattttcaggccctcttccctagatgat

SEQ ID NO: 4166 - DNA, 600 bp, Bovine  MMBT01553
tggatcgaggaagttcagcataaccagtgttgaatgtattctgctcattctagcccrgaagtcccagaaacagtcatcaactacaagtgacattcaaataccttatgaactcagtgtgttggtatttgaacggtttccctctaaagtcactacaaagtattactgtgttatagccaaatgttttctaacagtttgcacaattctgtcatctacccagggaagcaaatatagatagtattcagtctgcagagtaccaaaatctagatggaaagggtcaagcttccatcacggcattatacyacgttayayggctatttcagccataatgtcagttattatatattggcgacgtgcctaaaggctggttcaaatctataatttaagcacatatcatgctaaatagtgttgtgccatagccaagaggcatttggtacgtgatgcctttccccttcctgagacacaaagaagcttattctgttctccagtcataggtgtgacgtaggaaaatgcctcgaaaattccacccacgcatttgcctgggaaaataactgatttttctgagctataaaaatgtactgtcttttccttctgagtgggttc

SEQ ID NO: 4167 - DNA, 600 bp, Bovine  MMBT03005
ctgttgcaaggccttcttggtggcctcaatgacctccacctctttgtgcagctcctcctccacagggtccttcaccacatcaatgtcacgccgactctcccgcagggtcaggcattcaattgccacatccagaggtaggttcttggcctgcaggttttgctccgctgactctttcatctagaagagagagggcacagggggctggtggggccatcctactgggaagcagctctcatcaccactttagccaaggggacagtgagtgactcagatggacaagccaccaaatacccagacccraaagaggggaaggagaggaggtcgtccttgagcaggatctcctggcaccctgccctggctccctgcctgtgccagggcgtcaatctcagcatctaaatccgtcagacacttgtccagcatctccttccatcggctgacagtatcgatcctctctgccagccgcgtcctattgtcatgttcatcccaaatggtctggaagagacagacacagataaaraggctgtcgggggctgggagctatcccttcaccacccagctggactctggacccccaacctggttgttggtctcgttgcggag

SEQ ID NO: 4168 - DNA, 601 bp, Bovine  MMBT08413
  misc_feature (1)..(1): n is any nucleotide
ntgttaacatcaaagaagcaatccagatctaaagaaagagctggacgctttcctcgcattatctccaaagctgtcagtgatgtaaaatgtgatcgtgagcttctgctattgtggcagtgttataagtaggaggggtcccagatgaaatgtgtgtgactggcacttacatccttgattttgatttataaaaacaagaacagaatcatgaagggagtgtaagatttaccctacctaatctgtcatgttgttgggttacatccaattttataacttctttcagtacagtttttscccccttccrtcttactagaaaaataaatgcaatgctaycatttttagaaagaaaattccagtgtttattgtatttagagggaatcatgaatgatttatttatattaagtatgagagtttccagaacagtgattaaaaatgcttacaaattctagattagaagtgtgggaatttccttttgggataataaccctttagaaagttaatattataatataactcacaggaaccaattaaaatcaggtcatttgcatttattctcttcagagcagtgtatacctgttgcgatttttaattctaaaaaattttt

SEQ ID NO: 4169 - DNA, 600 bp, Bovine  MMBT08915
actatgtgcctttttgttagaaggaagataccataaatcagtctgtcagcttacaccatggggctcataatagattcataacaaaaagaattatgaaaaattaacacgcagtatgtcatttataatcaacttgagcctgaagaattgaggattatctgacatttctaggttccataaaggtttattttactttagatacagggataggaggaataagaattaggaatcaatatgcataaattagagatactccaagttgaaaccagcaagttggtataaatgcatggatctgagcagagrgattcacgagttttctggagaaggtgttgtaaagatagatgtgctttcttttggaaggtggaaatcagagaatttcagcaaatagaaaccagttggggatcttttttttttttcttttttttaaaattttattttatttttaaactttacataattgtattagttttgccaaatatcaaaatgaatccgccacaggtatacatgtgttccccatcatgaaccctcctccctcctccctccccataccatcctctgggtcatcccagtgcactagccccaagcatccagtatcgtgcatcg

SEQ ID NO: 4170 - DNA, 600 bp, Bovine  MMBT08954
ccccaggatgaagtacttactgtgggctgttttattttatgatctgacatcggaatggaaagggagactatgctttttaaactccttaaaatgcagttctattgaaaatagctgttgagacccacccacaaagtaagctgttgagtgataagagagatggtwgagttataaaacatgatatggtattctatctagaaatattgtrcaatgtraatatcaatttattccttaagaatgtaaccaaaatgtatataatcctctgtgacttttgctttataatttaattcactaaagttttcratgtctgcatgtagccatttgattcagtgatattgagctggaaatattttgatgtattctaaaaagtaaaccctaaaattatatccatttaaattatgaataatacatgaatcagatttatctcctctttgaactaaacttcatcttcaacctatactacctggggtagtagattcatgctggtcttctgacttcaaaattaaagtttatttwtgcagaataatatattctatatttaaataatgcagaaagaggaaaattctccatgatcaagtttaaggttgggggtggagtataagt

SEQ ID NO: 4171 - DNA, 600 bp, Bovine  MMBT10138
tttatatttacatgacacttttttttttctattatggttcttacagctaataatgctggaataaatattgattaaatacagttcagcctataacaaaggcatggctcccaccctgaagatggagaggtttccgactggccatctcataaatcctgaaacgtctctgttagaagacggccctgtgcttacgattcttggcacacagggaaaatctctcgtccttcagagactggtttcctcacccaccgggaagctttctgcctttggtgttggtctctccactgggctggttctgaggaytttattttatgtcgctcttattggggggttccacagttttctctgttgctgaatcctatcaaggtcctgttgcatgtgcccacctcacggggatccacggccctggctggagtcccctggggtctggctgcagaatgtgcacgaggctctgagctgctcgtctcctattccatctttggtgactggttctttaccactagtgctggcctgggtctaggtctctgcatgcagcttccgatctcccaactgcacccactgtctgtttcacaaggatgagaatagtaacaacagcaaaggccg

SEQ ID NO: 4172 - DNA, 600 bp, Bovine  MMBT12615
ccatcctgtgatcacaggaactgattttcacagcctctcgtgagctgcccaaggacttctcttcctccccagggaatctgccctctggtttgsggacacctccgcttaggtttggaaggaggcatctaccctggtgagaagaggaaatkagtttctcaaagccccagccagttcagagacctaggggctcctttccaatgcacctttgactcacaaactctcatgggtgcatacttctcaagtctccctgcccatagaagcctggaggaactggactttctctgcacagccctggtggayagaactagggccagtaggtggagtttatacagaggcagattccagctccacataaaacagaactttgtataatcagaactgttcccaaatggaatgggctgtctcctgaggtggtgagctccccaacactagaggcaaccaacctgctagggratcctactaatagaatagagttcctcaaagtgtagcccacctgtatcagaatgaattatctgggattattcttaaaagggcaaagtcctgggacccactcaacaatcactgaatcaggctgagtgtgggctaggatctacctttcta

SEQ ID NO: 4173 - DNA, 600 bp, Bovine  MMBT13138
ccttaaagcagagccaccaaaggctctgagtaggaaagccactcggtttggtttgcattttggaaacaacactccccatggtcatgatccaggtgaagcccgcaagcaactggacactggaggcatttaaaacatgttttcaaaagggctactgagtgcccagcataatataaccttttacatatttgagaaatctccaagctggggcaagcaccagccaggatcagcatcagcctctggacacatcctctgagcagtgatgggtcgccctggtgggacaccccagagccactttttcargggaatcggtacccactggttgttcaccggcttctccccctgtatcagcagttctgacctgtgggagcctgggtgggagggaggcacccacccagattcaggaagctgaggagtggattcttcggccagggcagatcccttcaaggagaattttcctccttttgctctccataaactccgtgccattggagggcmtgggctcaggcttgcrgctggrgaytgggtatgtgaggggcttttaggcatggcagttctctccaycctccaccctgagtggggctgcggttactactgcttttc

SEQ ID NO: 4174 - DNA, 600 bp, Bovine  MMBT14222
gaggtgactgtgaacagctagcccccagccaagccaccagttgaccacaaacatgccaactaaggccagaggaactgcccaaataagccaagaatcctgtgctaaataaatatgctttgctacagagtagaacacaggagatgcttgtttgatactgcctgtaaatcaaacccagcaatgtacttagtatcataacagaggaagaaggaaagagttgtaaggagttagcttccttcttcctcaactacttttgatcttaacactacagtctaaagtaatgagtgctgtgtccttaaagaygcacctttctacaaaggagttaaaacattctgataaaggagaaagatcagtgtgtgtgtgtgtgtgtgtttcttaaacaatattaattccctctatgtaccttccctaggctgagttgcaaggctacccaagttggattgagcaacaagtcctcttcgtttctggatctggtgatgggtggtcactgatgctgccaggaaagtaactgtataggcattctgaccctgagaggtaatattctgtgaactgcctgatgtgcccaagttaacagtgttatccaacgagctattttctgctcta

SEQ ID NO: 4175 - DNA, 600 bp, Bovine  MMBT21256
tttcccatataggccattacagagtatagagtagagttccctgtgctatrcagttcctcaggactttccygcacaactctctgattttttgctcaactgaaagttcaatgatgacagatgctgtatctgctttgttcgcaatctttattcccggggactagcaaagtgtttactatacagttagtgcccaatacatgtttatggaacgaattcatgagtcaacacatcaatggaaacaaaacagtttcaaagaactttccacccaaccatggtgagcacctgtgaaacattctgacctayaacaggaaggcttctctagatcaagaggctctgtctgcctgattttcaggccctcttccctagatgatggtgggcactgagtaacaaacctagtcataaggggctccmccctgaaagttcatcrcagaccagctttctctattagcaaggctccttcaagcatygagttgccgttagattccagctgcagccaaggtaatgcacataaagaaatgagattttccagcctggctgaggcctgatagacttggtactctgaaactcctttttactgcctgccttttactaactgcccatttt

SEQ ID NO: 4176 - DNA, 561 bp, Bovine  MMBT21261
tgatgacagatgctgtatctgctttgttcgcaatctttattcccggggactagcaaagtgtttactatacagttagtgcccaatacatgtttatggaacgaattcatgagtcaacacatcaatggaaacaaaacagtttcaaagaactttccacccaaccatggtgagcacctgtgaaacattctgacctayaacaggaaggcttctctagatcaagaggctctgtctgcctgattttcaggccctcttccctagatgatggtgggcactgagtaacaaacctagtcataaggggctccmccctgaaagttcatcrcagaccagctttctctattagcaaggctccttcaagcatygagttgccgttagattccagctgcagccaaggtaatgcacataaagaaatgagattttccagcctggctgaggcctgatagacttggtactctgaaactcctttttactgcctgccttttactaactgcccattttatgaactctcaggacatttctagagagcacagctctcattccatgatattttcattcttcttaatttca

SEQ ID NO: 4177 - DNA, 600 bp, Bovine  MMBT22834
ttttaagtagtaaaaccttaattagacagcagtgaggacttgtagcgtgaagaagggactgtcacggtgtcttcctgtggttaaggaaagggcttcccagctgccacagggaaggaagggggcttcagccttgactctcagagaggctggctggtgggaccctcatccttaccacgagatccttcggatccttagacagtgcaggtcacatgttcctgaccttccttgggagtgaccacccacactttatctactgtcatatctgcagrtgggaggggtgcttttaygatgactgtgacrtcttagatgtaactgtgtaacccttatagcgactgaaggggaatgtccacacccagtggaaaattccacaggaaacaaccatgtcttcattgcactcagtacctatgtatgacatacacgttaagtgaatgttttcttgggttttccaggtctacaatatttagtccatgtaaatgatagaatttgataaatatggtaaattaagttataaggtgtcatttgatttctcttttgctgtctcacgttatttaatgttcctgatgctccatacctggtttgtgcctacgttggtgtagaccr

SEQ ID NO: 4178 - DNA, 600 bp, Bovine  MMBT07141
aaagatacaccaatgtggttaattctatgtgtcagctttgttgggctaacaagctgatcccagtgtttgttaaaaccccagtccacatatcactgtgaaggtatttggtagatgagatcaacatttaaatcagtaggctctgagcaaagcagattacctaatataatgtgagtgggcctcatccaatcagctgaagactttaagagaaaagactgacctcttaggaagaaggaattctgcagcatcaactattcctgagtccctggcctgcccttcagaattgccagcccccataatcaygtgtgtgcgttcagtcactcagtcgtgtccaactctttgagaytctatggattctagccctccaggctcctctgtccatgggattgtccaggtaagaatactggagtgggttgctacttcttcctccaggggatcttcccaacccagggatcgaactcacgtctcctatgtctcctacattgcaagcagaatctttacccactgagccatcagggaagcctctgtttctctgaaacagcctaatgcaagaataaatttagttctattaaaaagcatctattgacaacctacttttcattg

SEQ ID NO: 4179 - DNA, 537 bp, Bovine  MMBT05865
gctgccccttttaaygatgaggrtgcaatattgcagacaatattttaggatagtcttctcagaatcaagatggtctacaaacatattcactcatatgctttacttttgcatagtaaacaaagtatgrgaaataaattgtgattttgttctaatatttcctgtaagatctcacaattcctatgaaagtttagaatatctcatttattatgtcaactctaaattctacattttaataattaaatgatttatatatattcatatgtaagcattctatagattttaacactaccaattttaacrtaatagaaaactctattaaaagttttcttcaaagttattaagcagttaaattcctaaaggtgtacctataaactcatgaaactgaaaataatatagttttatgctgctgacatttmtattttgtttrtatgcatagycttccaggttttgatggctatataactaatctattgtattttgagtaaactacygtgtaacaaatgttgttattgttcagccactcagtcctgtccaact

SEQ ID NO: 4180 - DNA, 600 bp, Bovine  MMBT00933
cattagtccagtgtttgacaaatatatgtggaaggaaggaaagaaggacagaaagttatatttttgttgcatgattttccaatgtttttgaaagagttacaatatataaaacttttaataaaagataaaatgtaaagaaagccataaacataagtggatattttgatgataatgaaatattggagatagaacattcttagtaagaatcacatttttataagaagtaatatttattttagaagatcttattcttagctcactctgcttaaccttatgctaaattccctaagatggaagtgrwtagcatatctgyatgttttttkaatrataaacaggaatattttacttatctttattcaaataaaacattgatttgargaatctgatttgcctattgagaaactgagtcctggttatctaatcaactgatatactggcaaaggtaatagaaacaatatccactgaagtacagctttcttttctcaagttgttttgtctgttctgagctttatctcaactaaacaraaccaaagatctgaagagagccagaacagtgctaataatagcrcaagtcacatttatattgacttctttctggaa

SEQ ID NO: 4181 - DNA, 600 bp, Bovine  MMBT14398
cataatatacgtacaccctttttcatattcttttccattatagtttatcacaggactttgattatagttccccgtgatatatacttgtcatttatccattctatacacaatagtatccatctgataatcccaaactcccaatccatccctcccctacctcctctctaccatggtaaccacaagtctgttctctatgtctatgagtctgtttcttttttgtagataagttaatttgtgtcatattttagattccacctataagtaatatcatatggtatttgtttttctctgtctgacttrcttcatttagtatgataatctctaggtccattcatgttgctgcaaatggcattatttcattcatttttatggctgtatacatttgtattcatcttctttttccattcacatgttgatggacaattgggttgtttcctggtcttgactttgtcaatagtgctggtataaatataggggtgcatgtatctctttcaattatagttttgtctggtgatatgcccaggagtgggtttgctggatcgtaaggcaactctattttttagttttttgaggaacctccatactgttttccatagtggc

SEQ ID NO: 4182 - DNA, 600 bp, Bovine  MMBT00841
tttgtttacatttaatttatactttttcccctttccccatctttccatccttccacccaccttcccaaatgctgaggctgaggatctcattgactatttgaggttccgtagttaaataagtttacattaatgatcaaagtaaacactttagttctccggcacttttccaggactgtatgatttttcttttaagcagtctatgaagggcaccctgcctgaacacastctgcctgtctctatttccaccccttcatccaccttttcttttaactgaaacttctggggaatttgaatagaacytcccttatgccttgcaactacacacacacatacacacacctggagtcagcagcccactcagccttgaccgggatgcttctctcagtcttagagaaatctgtacccccatgacactgggaagtctccacattcctcattctgcttgsagaagaacactcttgggtgggcacagttctcagggccctgtgggcagtaggggcagaaccaatatcaagttcatctgtctctggtaacgggagtctgaagtggggcatcttcttttctcttgtcctgtccattcaggttggagaactgggctct

SEQ ID NO: 4183 - DNA, 600 bp, Bovine  MMBT13514
tggaaaacctagttcagacattagtaataattctcaagcttaccaaaggcaaacagcccaatgaaaacccctagtctcccttcacacatcaaaccattcaccaattaagctaaatctttgctcaaaaattgaatcatttgtactcaagagaaattccaatgtgaaccatcttgaaatttggtcacctgtggatgtttagcagacagggaagcaaagcaagctggctgaatactaatasagaatttggtctgagtggaagttggattatctctctcattttagatgccttaaagaatcaaygaaagagtgacttaaagacctagtgtatccgttctggaggcctgtgattggccataacagctgcaggagatggggaaatcccattgacctagtttgctacagactcatagcrctacgggattagcccagccattgcttacgtgttgataggatgaggtgaattgggttccagcctagttcccacacagcattaaagacagaaatgtcttcgacaaccacccacagactatggaataaacccaagcttcctaatcaaaatttggcaccaaatcactgcctctsttccaatctcctgttatt

SEQ ID NO: 4184 - DNA, 600 bp, Bovine  MMBT21841
gtgtgtaatagtccttgttaattaaatatattgattaaaatataaacatttttggaaattataaatgtattgatatactcagtcatgaaagtaaatgtagttcactttttaataatgtgaaaatatggacaatttggaaggctagtttagtcccaagtaacaggatggattaagattagtaacagatatatttaaataaagtttggtgtggaaatcacatgaggacaactgtggtaaccaacttctacataaaaccagaaatgtggcaatctcagcattattcctgatgacagtaccatktaacttggtattgttatgtagttttaattccttgcctattatgatttttataagtaactatgaattactttggagaaggcaatggcaccccactccaatactgttgcctggaaaatcccatggacggaggagcctggtaggctgcagtccatggggtcactaagagtcaggcacgactgagcaacttcactttcactttccactttcatgcattggagaaggaaatggcaacccactccagtgttcttgcctggagaatcccaggaatggaaaagcctggtgggctgcagtccatggggt

SEQ ID NO: 4185 - DNA, 600 bp, Bovine  MMBT03332
cctgtccaagttcaacctactgtcttctcttactggactagagaaatagcctcttaatgagctgacctgcttccactctgcccattctctagttttctatctgcaaccaaaatgaacaagtataaataccatcacctcctcttcctgccttccacaatgttttttcatgtgtattcagataaggcaaaatgtcctcactagaatccacaatacctgggatgcttcagtgctcatcgatgtgtactcttcatttaaacattgcactcttctaacagctagctctgttctggaaaataaaartacccctctttgtttctattcttctcaaatatgtcaagttctctcccactacaaagtctttgtaatatcatcctctctgcttggtatgatttcctttactcttcccattttagtcaagtrgtctcttttttttttttttcatatctcagtttaagcatcactttctgagaagggatttaccttatggatccctccttactaccacctcagatggtaaagaatccatctgcagaatgagagacccggctagataccttggttgggaggatctcttgaagaagggaatggcaatccattaca

SEQ ID NO: 4186 - DNA, 600 bp, Bovine  MMBT00802
tattttttctgtcccacccatctgtttattttagcttgtttgttctctcctctgctggcctctttatagattcctctgttcaatagtttaaactccatgacaatgctttgtttatcctctcagctagcacagtatattattccccatctgctatagagagggccccagtgccccacaaagttaactaagcccctcttgtctgaacaagtttttcagccatgcattcaagtttctaatctacccccatcttccctggttatgagtgtgacaatattatttctaagcaagccatgctcaatrgatctcatcttttgttcttctttttctttcaaatacctcagataagaagtaatggtctgctgctacagacgtaggcagtttcaatatcagtcactcagtaaatatttattgagtatttgctatgtgactggcagtgtgctaaggactgggtctatttccagagacatacaaggtacacagtccaaggcaccacaattttcctgatctcggaggacatgtagtrctaacatatatttattatgcagtcgctgcaatccaggaattgtgctagaaactgggaatacaacatgaattttaaaa

SEQ ID NO: 4187 - DNA, 600 bp, Bovine  MMBT00080
tatacacacattgagaggaaaaaatacatttccttcgtgttaaagtcaccaagtaaagaaatctctctaaacaaaaatcctctcaaattcctttccactgatgacttcctagcagcttccctttcatttaaaccaaacgtagctttatatctgcatttcattccccttctctctaattagataaatctgctcgctcttctctctagaaagattaaaaggttggggtgttttgtttttccagtatttcagcattctaacgctcacagcgctgggatgacagaaaggatcctttgatttagrgcaggcaggctccaaggaaatatatctgaaggaaaaatataacacaagcaaggaggactacggaaaataaacacacagattcctgtcaaagatagtgggtcactccagcaacttccagtccacggccctgaccctggtcccgcaaggaagcctgtacttacccagattggaagacgctcgcccctctgcagcccggtccttgagatcctcagcaatgcccagctgctgctcgtggtactgtttggccctctccaaatcctgcatgcacctggcagcgtggcccaggccagcgtaggcccg

SEQ ID NO: 4188 - DNA, 521 bp, Bovine  MMBT12521
gcctgcgtgttgcctggctccctctgctccgaaataaccacagggcttgctcactcagtagcaatgctgacagcattctcagcgactggaaggtagaaaacttgcctctgtggttcccgaggctaggatcagactagagcaattatgcagtgtttggcccaccttggggactttggctctcaaatggcagggctacgcagactaaactgaaggttgttttacaagagaccatcaaaatcctcatttgcatgtgtgacattcctgtggagaggctgattttcaatcaagctggctgggccygattacaaatccagtctgctagtgtgaatgtaaatggcatcagctggatctcatccctcccagttagcctttgccttctctgacccaatgcgtgctaagcacttcagttgtgtcctactctttgtgactctatggactgtagcccattaagctcctctgtccatgggggattctccaggtaagaatactggagtgggttgccatgatctcctccagggagt

SEQ ID NO: 4189 - DNA, 598 bp, Bovine  MMBT00893
  misc_feature (1)..(39): n is any nucleotide
nnnnnnnnnnnnnnnnnnnnnnnnnnnnnnnnnnnnnnnctagtggggcgctctttttgagcgcggggaggaaaatgagtgagtgcttagccgctcccttgtgttatgtaatcccgcctatagtacatccgaagccttagtgcgctgcagttagtttacaaagtctcctcccctggctctaaaatttcttcgggatggcgccgtgatttataaaatgggatggggcggaaaaagcttattttcgtatggttatatcctgccgcggtgggcgccatgtttatcccagggactattttctcyagattcttagcaccttctgaaaaggagggatattgttgatccacctgctttttctgytttcgcaagttgtcctgctttctytcccgtcagacgcgggattccttcaaactgttaataatactgagcgtttctttgcttgtctaggacattttcagctcagaaaaaggtagagctggaaggagtcttgttagacatttagtccaaatttctttttcgagatggaaactgagatacaggtgttctgtctcggaatagccgtcattctattgcagactgtggcccagccctctgcactcct

SEQ ID NO: 4190 - DNA, 593 bp, Bovine  MMBT04153
gtgaccctgggctgagctccctaacacccagctgcctggtgacctgcacacggtgtgctcttcagcgtgttgacatggtcgtagggactggccaatctaatactcatctttacatccttccatggaaaagtggattcagattaggatcaggcttactaatagtagacttactaataaacccagaaatataattagccgccttccccaaagcgacatttctcatgcaatgtcctcattcagggcatgtgactaatcagaaatctctgataagtagtgtgcattcaacatagcttgtaaackgggtgtcacgttgacattttggcctgatagtgctgaaacaggtatttccagctttgtcgaatcaaacttacaccctaatggatacttttggagaatgacagctgattcctcatctgcttaaatttccgtagcttctcttctctacagtagcaataaatgacaaacttcaggtagtcatttggttatccttgttgccttaggtaagtgagggataaactgctcagagactcatgttttccatatctcgtccttctctaaaggcacagactctcatcctttagtggccttttagt

SEQ ID NO: 4191 - DNA, 600 bp, Bovine  MMBT08554
ccaaatatttattactttttaaaatgtaacttttaagttcatatactgctacaattgatggcttcggatatgtttgtgcactggtacaattaataaagctccaaaacttacagtagcaaaagcattaatttgaacacattatctaccagaacacatgcttcatagaatgagagtaaatagtaattttttacttccaggttcagctaaataaacataactgcaaaatgacagattaaaaatgcttctgcttttacaatttgttttccttcctttcttgccttctctgtccccatctcccckaaaagcacctccaaagagttacagtaggatacagggacagtgtccacgaggaaggaaggaaagacagcttctcattcgtgcaggacaaatagctttgcccaaagcacaaactacatctaatcacagggtataactctgtcatctctcttttcataatctggccacttacacactttgatttctgacttccatttgggtttattaacatcaaagctgtgtcatcactttatctgtttccagacacatttttacctgaggcaataaagtataaaaacttctttgcattcttgctttactgtt

SEQ ID NO: 4192 - DNA, 601 bp, Bovine  MMBT03869
  misc_feature (1)..(1): n is any nucleotide
naggaacttgtgctgtcttcagtctactctctctgccccaccttgggttctagtctgcatgcatgcattaacagtgtccaggcttcctacagtagtcctgttagtcccaccatccctccaaccagccaagggggctctacttccctgtgttgtacaatatgcgattggaattgctcacttcccrgggagctactctgtccatgtaatctcccttttcttctgaatcccctctcaggggcacaggtcttgacctggtcacttctctttcctttctactcacttttatgtgaatctttcttayagccttggttgtataagagactttctgtcagtctccagttagtttccagtaagaattttccacatgtagatgtatctttgatgtgttcatggcagggaggtgagttccatgtcctcttgctcgaccatcttggtcacactcatctattgatttaaatgttaatatccaaaaaattccctcacagatacacccaaataatgtttgaccaaatatctgggtgcctggtagcccaatcaagttgatacataatgttaactatcacaaagaggtttaaattataaacaaaagaattgtcaaaca

SEQ ID NO: 4193 - DNA, 598 bp, Bovine  MMBT20998
  misc_feature (1)..(112): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagggagttctctgggcccgcccctgggctgggcccgcctgcagcgcggggagggtggctcgtccgggccgctgtttgagtcccagaagagcctcaccctgtcccgcgcggaaactggggtctcagagctctttttctccacccacatccatagacttcccctactgtccttttataaatacttgrgaatataaawgtttttactccaccatagtggctcaaaaaaaaagatggccttttagaaagattggtttaatcagatactcatttcttctcccttcctaggtttttgaacatgaatccttcactcctcctgacagccctttgcttgggaatagcctcagctgctccaaaatttgaccacagtttagatacacaatggaaattgtggaaggcagcacacaggaaaccatacgacttggttggtaacatctgaaactgtccatctgaaaccctgcagagaatggtccatgctgttgggagt

SEQ ID NO: 4194 - DNA, 600 bp, Bovine  MMBT03244
caatagtctgtccctgtcccctctgttctcccagcacaatgcagacttctgcccacttttcatgagttactgccagaaaattagatttcaaacaggtgcagcctgctgattagcattataatagattgtaattacttaacaagcccgtatatacccagagggacttggagagaaacacaatgttttgccaaatgtagcttttatttatgtaaaatactgcaggcctgctccagagttccaagtgaagactctggaagctttgtctgcatgtgtttcaatgagctctgagttcaaccacgrgaacgtaaaatttcacttctcttctcgttgctgccaattacaaaaggtgttgtctctaaagcccttaggagaatttgaacttgattttaaactctgcaaagggagaacaagtggatcttttctttctccccctatcacagcactctgcaggggtcctcagtacccagagggtacacaattccgtccttcagaaacctcagaccatcattttgctctgtaatgggttatttggcatttggaacctttattttttttggtgacagttcccacttgtaaaaatggtttgacaaagacctactg

SEQ ID NO: 4195 - DNA, 600 bp, Bovine  MMBT08721
gaggggtgaggggacagtggaggagggtttgtggttycagggtgtggctgctggttggggacccagaccctcgggccctggtcggaagttctgcatggcttgaaattcttcaccttcctgccaggaaagcccctcacctgggtgatggctgtggttaagattacccaagagcaagccgttttaggactgcgaactgggtcagaggtatgaggaagggaagggctttttctaatccggggacagacagggtgtcaggagcatctgggtcccaggatttcagtggaggttgcctccgctccycttttgagcatcctccttttctctgctcctcygtgagactctcttaggaggatttttgctttcagttttgtgcaagttcctcatgcggttgcccgttgtgattggaacgattgtctttataaaagacacttgaaagtcaggttggaacaaggcacggtctctgcagaggatgttaagcatgttgactggaagcctgcctgccaggacaagatccctctgagaacaccgcacacaatctgctattgtctccggggatgagacagtgccaacaaaaaatgcgaagttccagccaagaggagg

SEQ ID NO: 4196 - DNA, 600 bp, Bovine  MMBT10762
agccagggaaaagcagagaatgcttcctggaggagaatgcctcaaagaggccaaagagaggtttacatggtagtcaacaaagcttcagggtcccttatttgcacaggtcttttccaaggccctgcttaacaatcagggaaaaatcaaagtgtactgaagatatgtactcttcactctacaaaaaaactgaaaatgccctgacatcttacagttcatatttgaaagaaattaaacagaggttttcccacatttgatcatagtcctaaaaatgtacattattgtaaagctgaaacttttctraactatcaatagtgaaaaacagatttctatcaaccatgctattaagaaagactgactaatatttctagtctctctacagaaaattgatcttatctcgtgcttcagtgataaaagccatcagacattgttccaagaccctcctcttcccaccactgactctctaaacctcccagtatctgtgttcatcttttgtctcattcctttctattacagtgaagggcctgaggacctctcctcctctctgaggcccagtaccccagatcccagccccccctttcctttccattctttgctttctct

SEQ ID NO: 4197 - DNA, 600 bp, Bovine  MMBT17014
gacattagcaataagcatcttgtgcaataacatcatacttaatgtaatattaacattatatgtagcaggctttaactgctcactggtttccccactggagtttaacatttttaacactctgtgctctgccacagtattcagttctatatctaatttacaagctgtaaaacacaatattcacagattacaataaatacaaagaagttctaaagatatatctggtggtgacaaggctgagagagaccactttttctaaaagtagaaacaaaagaaaatataaaacaacttatggttaccaartgggaaagggctaggggagggataaattaggagtttgggattaaatgatacacagtactgtatataaaataaacaacaaggaccaattgtatggcacagggaactatactcaatattttgtaataacctataagagaaaataatctgaaaaagaatatatatttatatatacatatatatgtgcataactgaatcactttgctataagcctgaaatcaacataacattgtaaatcaactataattcaataaaagaaaatctaggactaagtccttcatatgcaataactaatttgaaaag

SEQ ID NO: 4198 - DNA, 576 bp, Bovine  MMBT19862
agagagagcagagagaaagggagagagaagggaaagaaaaagaatatcacaggatttagagatggatttgatatagtcagtgaaaaggtccagaaccccctgaggcctctggcttgggcaaaggtattcgtttttctacgttttgtacaggttttcagcagtgagattatcagaaagaatgtgcatgcatagggagccgtagtcctttctgcacagtgcctagattccataaagacattttcccaaacccttgggggcaggaagggtgacagtcattcgcaatctgatgtcctgactgtygagctcggcttttctactgcatgaatcccgagactgaagtgcgcatcctgagcattcgttgcgcaagaagctgaaggctggtccctggcccgggaaggccgcctggccggacgcgcgggtcccgccctgtatgccgccctggctcggaccggagcatcaggtggggcccagggacccgtcattcgaggctgaggctcctctcctgcaccccacgggccacaggcagtccgtcgacattctggccggtggtcccagtgcactgcaggctccagctga

SEQ ID NO: 4199 - DNA, 600 bp, Bovine  MMBT01815
gtgattgtcaaaatgttgaccccaaaccagagattgtagaaaataataattgcagcttgtgtttagtttccatcaatgatcttaaaatctagagtggaaactcttgaaaaaaaaatcaagtttgactaagaagactaatatttgcataggtccaaatagttattttctcataaaagtaataaaactttaaaaatgagtacaatgatccagcaattattttctggagaactttttcctgaattttaactttttaaaacatttagagttcctttagtatttaaaaagaggctggtgatgtgrcatttacaacagtttggagatgatggtaaatttaaaacaaaaagacaagaagcctgtagtacagaaataatgaaaggctgtccttaaaagttcagacaataaaaaccatgagaaccatagataacacatgtccagccattcaacatagcccattaaaaagtgattacagagtcataggaaaggatgcacttcgactaaatgcgagctttgtaatgatccaagctactgtcttcctaatctttgcagtggcctactagaacaggagagaagtgatcttttgcatatcacaaacatctattg

SEQ ID NO: 4200 - DNA, 600 bp, Bovine  MMBT02410
accctcccttctggattcttatcaggatgrtatttctgggcaagtctgaagtaagcttttctaattttgctctcatcatgcctgcaaaataggaaaactgtttcatgaattgagtaacrtgcaagaaaaatgtttacacaatcatctaaaatgattattttaagaaccttacttttattgtgtatgatcatatattaggcacctaattaaaccagtaagactaagtaaggttattcttttttaaaaaatatcttttaaatttatctattttaattgaaggataattacaatattgtgatrgtttctgttatgaatcagctattggtatacatgtgtcccctccaycctgaaactccctcacaattcctcctcaccctatctccccaggtctacacagagcaccagctttggatgccctgcttcacgcatcaaactctcactggttatctattttacatatggtaatgtatatgtttcaatgctattctctcaaattatcccaccctcttcttctgctgagtccaaaagtctgttctttacatctgtgtagtttgttgccctatatgtagggtcatcgataaagattattcttatgtatta

SEQ ID NO: 4201 - DNA, 598 bp, Bovine  MMBT03411
  misc_feature (1)..(116): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaaaaggctatgtttttggcttaggagagttcagcttcacttcaaatcagagttgaagctattttctctgtactgaatccaaatcactcaaattcctgaaattcgtccatggttattgtctacctggtgccaaaatatcctgatgaaaagtgcaacattcagccagttgtgtggattttytgtcctgaaatctcaaagctcagctatttggcaggatagcacaacagctgagcagtcaaccaatgcttctgctrtggacagaggagctgaagaattgtgcacataaggccttatgcaaaaatcaaaatgcaaaagctcaatgccaatgtcccttatggctgaccaagggatccacagcattcgaatcatggaagtttggatcataatgaatcctgtccaactgcctctgtttacagattgagaaattgaggcaactcttattcatcctttaaaactttgatcaaatgccatctcgtct

SEQ ID NO: 4202 - DNA, 600 bp, Bovine  MMBT07017
ctgctcttcagaaggcagcttgctgctgccccaggccctccatgtctttataattaggttgatgcccacaatgatttgggtacaatgtttctccaaatgccttaccttccaggatacttagaggattctaatcgttcccttttatcacacctaaaatttcctttccatgggcacaactccaggtttctccctaataaatgatagcatgactgtgccagcaatcactacagcaggtgacgtgaaaagcaaagggagggggttgttttgatgaggggtgaagggttgaacacttgctgtcartgtaaggcagtgtgatcctggcagctaggaaaaagaatctggatgttttaaaagcaaaaagagtaatgttggcccctcttttgtctagatagatgctgcctgttaaagccgagacgtgcaggtataaacagacacatgtagacacccacagtcaccaccactgaacatcccacatgccctgtttctgcctaagtggargaaatttataaaacagagactaataaattattcattccctatactttggagtccagtttagagatactgtaacctcatctttcacatttagtttattttttc

SEQ ID NO: 4203 - DNA, 600 bp, Bovine  MMBT19280
ataggaggagaaacatatcctaaggtttcaacatttattttctacagctatagccaaattcatttcataactggccatgtatcatgaaaacacttaaaaaatcaggaatttgaggctccatttcagaccaggaggagggagcccaggctatacatatcttttttaaaagtatatcagctgattgtgcrgcaaactacatatagatgctagggaaaaggatttactgaaacaacacaaagtgataaacacagctcccacttttcacatattccaatggacttatttcctccttcaagagtrtcacaactctgaaaaagctaaaatgagtaccaagtggattttttaacagaaaaatcaaatgtgtctgaattctcataaaactctacaaaaggcttccttgcttaaatagctatttctcccagttgtttctgattgatggataacttgctcttatrttcttacagatgtcttagctatttctgtcaccagtaacataaaatcatctgcatataaaacctttagcaatatgatgcaataatgaatccactgmaatttctgctggactgtgttaaaaaaaaaagcctcaagaaaacaaggtca

SEQ ID NO: 4204 - DNA, 600 bp, Bovine  MMBT16634
gcaccagatggtttgtctattaaccatcctcactgacaaatatttataggtgcctaagagattcgtgcttctgtaatagattttggttggacaattccatcccacaaggatttcacaaaccaatgaccctctaaagacagcatttgtttctgttccttgcttgtgatcactttttttttaaatatgtcattctttaaggactcattgtcatcctttttctttgtaccttatacattcattgtactcctcaccagaggagttgcgttccagtatttttttaaatgtgcgtattaatttttstgttacctaaattagattttctttccagtatgaattttccaatgttccaaggctttagagcagttttccacgtataatcatgcagtaaacttttaatcatgcartagacctttaaaaagatgttgggaggaaagatacagtgactccattctgatttacactgcatattcttctttattttgtttgagtcacatgggactgccctagagtgcttggctgatgtttggagacactgggaggaaatcaaaggagccttgcggaaagcaaacttcactgcctctttgcagagataaagggaat

SEQ ID NO: 4205 - DNA, 600 bp, Bovine  MMBT17640
tcagctgagggtaaagcagggagaccagcttgaataaaggcagagacagtgggattagaaaagaggtaacagagaagcataaacagaggcaaagtctttgccactactgatgtcttttgaggaaaagaccaacagaactttggggatgaaagtcaagaaattcttcagaggcaggaggatggtgaaatagcgacttactgggtaaaaagagctgaatggccctctgctaagagtgcagcagaaatcgatggagaaaagttacacagcagctcaggagagctgatgggtgctcccaggctrgaaggtggaactcatgctccttttccatgactgggctccagagaagcagttgcagcagtgatgcttaaaatttcaagcctattggctgctaccaattaattacaaaaatacaaactgtaaggttccctctactttacaaaccctctttatagtctcaggggcctcagaatcatccttattttagtacacaacctgaaccggggttgacacggctgtcccgccttggtcagaaatcacgtaataatctaatcccaatcagtttttttttttcaattaggaaaaaaggttagaaaggaaatc

SEQ ID NO: 4206 - DNA, 600 bp, Bovine  MMBT22291
ctatcgtttttcaccagttaatttccagttccttgttcattattgcttttaatttctgatytccttgaagatgagcaaaacctggtgaaagtcatggaactggtggatgctgtgtatggtccgtacaagccctaccagctgaagtatggagacatggaagagaagtaccttctcatccagttcagcgaggtgcctctggtaaggkcacagcactgccggggccaactgggcatcactgtatctgccaggctagggtcrgggtggctgggatgcttcagagaaggtgggagccagcatacrgaatgcagagagtgggaacaggtgtgtaaaacatgggctttcagcgcttcctgggctcttgtaatccaaattaaaacgagaccacaggtctgctacctggtttttatttaaaatccccagtaaggacctcgcacccctcagaggcttaaatcttctcaagattaagttggttttctccctgagtcagtcatgattatgcagtcttttgttcaaggcagatatgcaaacagacactggagcggagcactcaaggatagtgctctcaggccaggttcaccaggtggacacaccagaggggaa

SEQ ID NO: 4207 - DNA, 598 bp, Bovine  MMBT01816
  misc_feature (1)..(96): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctcgttatattgtatatttgatttttttaattttagtcacattatgggacttcactttcagatagaatttctgatagattttgtgttgttgcatttctaaatactgacttctattttttgctctttttgatgttacttaacataaccatgaaaaaaacctggctgttaataatttttctgttccagtgtttccatctatrgttccaaattcaatatttattcatgattttgggtttcagcctctgttaaattacttgaagaatcttggactcagttttgacaactaaatcccagactccacccaagctacactctttttgggcggctaacgcactgttgatacgggtatggctagtatgccctcagccacctgtgactcatgcaagaagcacctaatttaattgtcttctgcttcctagataacctcagacaaatatctcaagaacttctccctctaacacccatctcataaattttacacaaagttacatacctttg

SEQ ID NO: 4208 - DNA, 598 bp, Bovine  MMBT08968
  misc_feature (1)..(17): n is any nucleotide
nnnnnnnnnnnnnnnnncttggtctcgtcctcgcctctggtgacctcgagggtggcaacctgctgctcctgcgtcaccaaagacaccgtggcttctgctgcttgaacagctgttgtcatctcttgagtgatgatgtcttaaaagcgaagaaacaacatttttaaatagactaaatccctatacctgaaaaagtcactatataactaataatttaaagaaaagcagactgtcatttcagggaatgagaaggcagagggatggctcagaaatgaactgccagtaaataaaagtttccagtgytgctgttttcaggagtggtgaatcaatctaagaagtggtgaatcaatacaagacagagataaagacaataatacaaaacacataaaataaaatwtaaaataagaaatcaagttaagtttccctttatgaatatcaacataatcagtttatttagaaagacattatacagaactaagttcaaaaactctccgaagcatttatatatatcaatattcacatttgcatccctgaaggggacagaaagttggcattttgaattaaaggaatactagttacaataactaatgtttactgagtt

SEQ ID NO: 4209 - DNA, 600 bp, Bovine  MMBT13003
gaagaacactggatgctaagtgtgttctaagcaggaagaagtgcttacctcttccctaagaggtacaggttgattgtaagatctccttgtctgagaccaagtattattttttaattaaaaagaaaaagaagccccacctctgctccggtcttggcttcctctttaggctgacccacagggctaagcggcttggctctcccttcggccttcccctgtgtgttcctgggccccaccccgggcctcggggcgggagacgtgctcatgatgggtttcacttgagccgcgggtgtggaggagcakcgactggtactcatctctataacgtgagacggcgcgatcggtaattcacgcaaattactgtttctcggagcagttggctgcatttgctgcattggtcgcttggtcacattctgagaagtagtgttctgtcacaggaagaaagaaattctaatcacaactggagactcgggagaagaaactgggcacatgagattaatctgactgagtgagtgacttctcttttgggaggcggacactgtccccgctggtaaaccttttcttcctacataaatgtctcttgttctatgtagcagcatagcc

SEQ ID NO: 4210 - DNA, 600 bp, Bovine  MMBT17961
gcagaggcgggcatggacgatgccagaactgtccacagggtgcaggaccaaggatgcaactgactttggtcagttttggggcctcctgcacttggctcctttgggggtttcagggttctcagggctgatgggtcccgcatgaagagagtcatgactgcattctgtccacctgtgggttttcacacaggcccggcgcccagctgcctcttggcccagtcttcatcttgggctacccgcggtaccctgaaaacacacaagacagggaagatgcgttaactcggcttctccccacagaacacsgctcgccattgcagccgtgattaaatacaggacattatctcaccataatgccctcctggccgtgttcccaggaaaattctaactaatcataaaaatagaaagaaaaacgcaacctaaattccattcctcttcttaaatgagtgatgtgttcacttttatttatttttctggaagcgaggcgggaaaagaaaatgaattttagggcttagaaaaacaagctactaatagtactaagtagagsagggtggtggtgcagacagcgggatgtagcggacaggccaggggcaggtccggccctac

SEQ ID NO: 4211 - DNA, 598 bp, Bovine  MMBT19861
  misc_feature (1)..(106): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaataataccaaaaaagtaaaataatttacaattaatccttatttaaaaaagattatgtcacaaatatcattttatcatgcttttaatttcatgtgaaatatcagtgtccaacttggtgcttttaatataataattaaaaaaatgtttttgatwaatatataataaacaaaatcttactttatcttgtgctrttctgtggcttgtattytttttgttgattaattcttctttctcctgctgaaatttttccagtgttgtttccaaagggcttagctgctctttagcatcctaaagatataaaaaatataagaccttatataatagcattacattatcatatttcacacttcatagttataataaaaccactttctatgtaccaggctttaaaaatcatttaaaagattaaatcattcatttgctcctttcaacaaccctatgagaaaagtaccattattttcatgctaaatttcagatgagcacagaaat

SEQ ID NO: 4212 - DNA, 600 bp, Bovine  MMBT18482
gctcctcttccttctgccaaccactgtgtgggagtctgggggctgtgaaggcaccctgaccaccccgcccgcccccaggtgatgaaggccatcaatgacggcttccggctgcccacgcccatggactgcccctccgccatctaccagctcatgatgcagtgctggcagcaggaacgcacccgccgccccaagttcgccgacatcgtcagcatcctggacaagctcatccgtgcccccgactccctcaagaccctggctgattttgacccccggtgagttctgtactttcggtccagggcrgtcccccaggcatcctcctgagccgcttcagcgtggtgggcagcgaagggtgggggtgagggctcagaagtgacacgtgggcgttacttagcctggaccagggtggctcaggcggtactaacggaagcaatcagcatgcgtggtaaatgggttggcccggcgcttagtgtgttttaactcatctagacggcttaggagatggccctgtaaccccctttgtagatgaggaatcagacacggggcacttaagtgtcttacatgctggcaagtggtcaggctgggaccacggctctgaagacc

SEQ ID NO: 4213 - DNA, 600 bp, Bovine  MMBT04986
cttttaattgatcttagaatttctattgattttctatactcttaaaagtgagaactaaatctgtaaattagctgcatatttaaatattattccagttactacaacggtataacagataaccacaaaatttaatggcataaaataatgagttattatgctcacaaattctaggtcagtaattcaagaaagacacagttggttagttctcacttaggactcttttgtaatgggagtcagattagggtgacattcatctgaaagtttgactgtggcttgagggcctacttccgaagtggctcyctcagaggtgtgacaagttgaccaggtgctccagttctctccataggggcctcttcaaagtatggctttggtgtcctcataatatgtgcctggcttctcccagagtgagtgattcaagagatcagaaaaccttgagagtcatacactgttgctcctatattctgttggtgacacgcagccagtctgaattcatgagagacaatgacgcaaggatgtggataacaagggatgtggatggttgtgggccatttcggaggcttgctattcggaggcttgctaaagcaaatttcattaaatatt

SEQ ID NO: 4214 - DNA, 600 bp, Bovine  MMBT20916
aaccaacatgcaagaaaataactacttggcaaatcatttctgggttatccagataccattcctccagggaggggattaaaaaccctctggctcctctcctgcctcttccatccccttgatgtctatagaacttgctgtctttggcagtggagactgagtacagtgaaggagtaaagccccatgagtttgtctgctttcttcagcttttgctaaaggctcagagacgaggctgaaccaagaaactgaaatgaaactttttgattatctgtgtttttccaattaatcctgctccccactaarggatcatgagttggctgcatcactgtgtccctaagtgatgaatccccatttgccagctggccatgcatgaaccggatggcctggcatttcatttcttcctatccagtaaaatgagaaaactcaaaccagacactgaaatgtctttttcttttattaaaaacatttctcaattgtgtagctgggyactctgagagtgaacttcaatatttctgaacctctgaatgytggaaacagggaaaaaactaccattcaaagaagtgccagacaattacataatctgtctctgatctatggttctca

SEQ ID NO: 4215 - DNA, 600 bp, Bovine  MMBT02526
cctttgagttccgttgaggtgtgaaattttttttgagataattacatttaggaacattagaaagctgaactgttagtgtgaacttaaagatttgaaactgagggctaacagaaaacccaacttctgtggcctgtcgtaactgcttgtccaagcagaagtaaattgcttaaaaaaaaaaamaaaaaaactcaagcactaggaggtttgaaactgcagtgcatacttttacattcctgagaggatcagtgaagatagcaaactttcaaaatgcctcccttgttttgatttcaaagaaaatayaagctcctatgtgtcttactgatttgataaaaggatttattattttgtttgctgcagtgaagcctcggactctgtttattagcttgactgtattcaggagtagttaaaggagttattttggacagtaaccgtggttttgcttaaattgatcaaggaagtcttgatttgaaaacagtagctctgtactttgcactggaaaaaaattgctttgtttcctttaccttatctttgacagatgagatatttcactttagaatctgctctcttttataaagttgacagcctgtgagttgttaggta

SEQ ID NO: 4216 - DNA, 600 bp, Bovine  MMBT19687
gcctgtgacttgctctcttctgaacttgaaatgactgctgatgagctcacagtaaatcaaccacagcaacgtgtgcgataattagtaaaataaatgtgtgcttaagtattaatgaaataaatatttagcagattatttgggatctttgttctagcctcaagtgcttaaaaaataatgagaggcttattaaaactttaaactatgactggttttcttttcacaatgtccccgtctccctaaattcagaaaagaaaggacctgtgttctaaagagygtggcttgaccgacagaactgaatcygaagacggtgatcctggacaaggtgggggctgccttgatccgtaagaatcattatccagccagggtttggtcctggtggggaaagcactccagctaccaaaaagaagggcttggaacagggattctgggccccacaagatcactgggtcggaactgaatccartcccagaaccacgcggcacgctgtgccctgaggggtggctgctgctgcatggctgggaactccaggatacccctctcmagccctgcaggagggctcggggggcgcctggaaatgagaacagcagccgtgggccagtg

SEQ ID NO: 4217 - DNA, 600 bp, Bovine  MMBT12187
gtgttgccctctctgcattttcttctccctggtactgagcacaggccttccacatagacacatgcattggctgcctggaggtggtggcacayrcgcaggccttgaaggataggcaaaagctgacgcagaaatgggagggtgaggcaaagggaaaagagtgccccaagcctcggaragaacaggaacagcacttgtctggggaacttggaaggagaggygacctggcagtagaggctgcccggcacacacagcattcatggggccacagcaggaagtgggctggagtactcaggtgtgtcygactgtatacatggggccaaatggatctccartcyctgccttcatgggcccagtgccagcagtaacagcctgtgcagagggaacacttagctgtgtcatacagtcgcatcactcttagtgacacttgctgaaattgatgaacgctgcaggcaccatgacatagacgagactgtaacttccagtgctattaagctgctcaggcagtagcagcagcaagcctagaacacatcaatcagcagggaagttgttaaagatgcagggtcagggtcaggggcacttagccttggtggaatggggaga

SEQ ID NO: 4218 - DNA, 600 bp, Bovine  MMBT19229
ttacttcaggataagaataattttttcttatggctgaaataagactttaactggggaaacacttattttcacatgaagataaaagtgagaaagaaacaacattacaatatattgctggattagatcaccgtttcagccttatgtcaaagtatctagagttgagactattttcaaaagttctattctccctccaatagttgatttatttgcaatctccaaagtaatttcatctttaatatctccctatactatcacatcccttgttccttttmcccttacttcctcaataagtggtacttktccagtaattccatttactagtagctccttctttaaatccatatactctgtcttcagccatcactttttctctatgcctgtgtctttaaaaataataaattatccaccttctaaaattatctatggcatctggaattgctgactatccgttcctttaaatgcttagaatcttggtggtggtggtggtttagtcgctaagttgtgtctgactcttgcaaacccacggactgtagcctgccaaactcctctaaccaggctccaagaatactggagtgggttgctgtttccttctccagctta

SEQ ID NO: 4219 - DNA, 600 bp, Bovine  MMBT08764
ctctcatcacctctaattgtttgattcttaaaagctctgacctcttacctttgcagcttcttgctcaactctgccctcttcaattgccatgttgtccattgcttgtaactctaattttctatttttattttatattctgtagcttggtgttcccacccatgtttaattaatcatcagttcctattgattgctcatcagtaactgattctcccctggaacattgcaatagcctcctaactagtttctctgtacccactattggtaaatattactaataacgatgccaaatgatgccttacytatgtgagtatactgctgaagactctgccatttcttctcattgcttttatgtgaaatttctaagtcctaacaaatggaaagtttgtcaccactttgttactccagcttagttaagtattcagacatcatcttcagggaatttttttaagccartgagtgggtttttgttatcatattgctttacacacattttttgtacttcactttcatatattacaacaattagtatatcattttctcattccatctagaacacaatatttatatattgaatattttaattaaaaatttaatagctaa

SEQ ID NO: 4220 - DNA, 600 bp, Bovine  MMBT15372
cattcaaagggtttctccccagtgtgtgttctctgatgctcaacaagagaagactttgactgaatgttttcccacatgctatatattcataggacttctctcctgtgtgttttatctgacatccaaygaggtgtgagttaccactaaggttttcctacattccgtacattcataacatatctcttcagtgtgtgttctctgatgtataatcagttttgactttccatagagggttttcccacattcagaacacacaaagggtctctcctgtgtgtgatctctgatgttcagtcagtgtcyacttgtcactgagttatcccacattcagtacattcataaggtttctctcctgtgtgtgttctctgatgcacagtaagtgctgacttcacactgaaagttccaatatttttggaacattcatagggattcttccctgtgtgtatcctctgatgtgttgtgaagtatgtatgttttttgttgaagagtctgaaacatcgattacattcatagaatttctctcctatgtgcgttctctgagtatgggtgaggtgagtcttgttgtataaggcatcctacactcagtgaactcataacgattct

SEQ ID NO: 4221 - DNA, 600 bp, Bovine  MMBT17353
ttttaccccctttcatatggaaattatttccacaatatgcaccatcaatattcatcaagtatcacaccaattaacaaaccgtgaataatctggaacaaaaatttaatgcatgaaaacccacaaacatctaggtggctgttaataaggctatgtttgaggtaatcacacacaaatttaattttaaatatacttcccttaaggaaggggtatcaatgttaatttaagaatttaatttgtatgttgttttaacaaaatgtctttcaaggaatatgcaaaagcatcacgccagaaactttgctyatgaacccaatattgaattttcttttatggaatggaaatagactattcctgttatatttatataacttaatacaactcctttgtgaagttcacttaaccctatagtatcaaagtatgagacaagcaatacaaattctttgaatagatacttcataaaatgagtaatttcgagattagcagtaaaasagcactttgttttcatggaatattaatatttagttaaggcactttgagactgatcatttctagaagtgagcttacactgatttttaaatttatatatagtctaatcagctttcc

SEQ ID NO: 4222 - DNA, 600 bp, Bovine  MMBT19306
ggttgctagggttatggggaggaagagataaaaagggagagcaaaaaggatttttagcacaatgaaaatacttttcatgatagtataatgatacatacatgtcattgtacatgtttcaaaacccatacaatatataacaccaagggtgaaccctgatgtaaactatgcactttgacaggcatcatgatgattcaatgcaagctgatcaatcgtaacaaatgtatcacgctggaaagggataccaggggtggctgtgtgtatccaggaacagctatgcaagtgtaggggcagaggggacaygggagttctgtatgatgtctcacttagtttttctgggaacctaaaactactctaagaaacaaagtctattaaaaaagtgaaaacctcaatggttaccatcacaatttcctaattaccaaactttaaaatattagtgtttacatcttatattcaaaagttatattaaaaagtagaggcattaygttaatgtgttatggtttatgaaaatcagcataacaggctatcagactatgcaaacttggcctctatctgctaagaatgtacactatgtagaagttaaggcttgaaggcctgactaga

SEQ ID NO: 4223 - DNA, 598 bp, Bovine  MMBT02623
  misc_feature (1)..(163): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggaaatggcaagagaaagtgcatagagagagcgagaatgataagatggttacagctctgcatggcaacagagaggattgtggtgatcttgggaaaccgctaagaacaggggtaatttatgccgtcacctttcygagggtctcacccggacatgattgagcagcttgaccttcctatagagggcactgttgatgtcctgcacgttgaagagagggtcgttccagatcttaatgagcaggtccttggagaaattgctgacgtagtacttgctgaaatcccacttgcgcagaatgcggctggggataaccatctgggcattctcgtggcagcactgacagaagtacttgcccaagtactcacagtaccgcagccgcttgatgtagtctgaaaaaacagaaggtcaasaggtcagaggcggctttcccaattata

SEQ ID NO: 4224 - DNA, 600 bp, Bovine  MMBT04224
acctgtgagacaattagaaaagattgatgtctacatttgtttatttaagtgggctgtttttacatcattcttggtaagaaaacctgttgcaggtaaaaagtttacataaacacagaaaggttggaatgagtgtgggatgtttgccaggtggagtggcccttgatcttgagcaggaatgtgaagaccagtgatgaaacgtgctgcccagaggaggtgctgcttgtctcttaggcattggtccttctcttgagagctggaaagcttaggaagtgttataccagtgggttcaagaatgagttrtacgcaaatgtgtttcatgatatgatattataacaaatttccagatattaaatattaacaacgttttgaaaacaaggggcaaaggcaacttatgttaagtaccgttaagattgaacgatgaggccagtatagacctagttagttatttgtcagttcattcatccaaccagtatctttctttttctttttaatatttaggtatgggtgtgtagggtcttagttgtggtgtgcgggtaagtgtgtgggctctatagttgtggctcgtgggctgtctagttgtcacatgagagttcagttgcc

SEQ ID NO: 4225 - DNA, 487 bp, Bovine  MMBT05033
gtgagatacacaaatagtgtctggtatccacaaactcagaaggagtaaccagcaaacttactctgacagatggtttcatagtcagcaaaagtcacagaatagttagaactcagaggaggctgagagacctacaagagcccttaactctggcaattctctgcactcagggaaaccacagtggaaatgaggaggctagacaaacccacatgaaatattaaccaaaacccttccttgcttgttctctgaacactgaatgagtaacaggcaggcatataggaatttagagcaaggggtaaacaygtggactggattatctcagaaggctttatgtcagtttcatatmatggaaaactataaatatcgagatttcctggtaaatctaaagaaacgctgaatgaaacattttgttcatgcgtggagaaaacatttcaaaacttcaagtgttagatatttgagcattttataatttcaaacttaagtgagtttg

SEQ ID NO: 4226 - DNA, 600 bp, Bovine  MMBT17086
tcccaatgcagggatcgaacccaggtctcctgcattgcaggcagattctttaccagctgaaccaaaagggaagggactaaaagcatttgtcttaagtgttttcttgtgaaaagaaacattaccaaaattwaaaaaaatacattgttgtaatattgactatagaaagcatagcaataattaattaaactccaaccacattttctatcagttctgtttttcctttcaatagtaattacaagacatggatggcaaagacagggaaaattcctgaagctgtagcagctgggtctttgttgaatrcctgttggcttctaaattgcttctaggtctgtccctgctggtggagtgcctaagtttagttgttcttcagaaaactctgctcaagatgtctacagggaattttttgtaaatttaaagaacagtgtccttctttggaaacatgcaataattttagaatcttgtgatattatattgtaagacataagccaacagtttacacatccctgtccaggaagctgaataataagtaatcctgggaatttaaacttctattttaagcctctgtaaaggtactctcatttcttttgtataaattcaaaa

SEQ ID NO: 4227 - DNA, 600 bp, Bovine  MMBT17645
agagggttcggtttcttatcttcttcttcctgctcaagctgcctacgtggaatttgtggcttacaagatacccgttggactggctttaggctgataatatcacttccttcatgttttcttccacatctttttttaaaaagaatatatttatttttggctgcgctacacaacatgtgggatcttaatttcccgaccagagatcgaacttgctttccctgaattggaagtgcggagttttaaccactggatcaccagagaagtccttccatgtcttattttttagaactttttggtaactcytttcagtgagatcctaaaactttcctgttatggtttagttgtttctccaagtatttatttcttctggcaggaatcaataagagaggtacttctcatgactcttggctgcaagttgtgatgtgtcattattgacagcaaccttttgagcagcatggatgatccgttatttttgtgatgaagaaatgaggggtaaactttgtatttatggatttaatgtaaatttcggctgatttcatctgagtcttttgagagccttttatattctcctccactgtcttgctggttgggacttggaacttt

SEQ ID NO: 4228 - DNA, 600 bp, Bovine  MMBT19857
tggacagatgtgtcacagctaggtgctgcgcaggggcataacagggatgtggaggctcagacctgcccactgccgtcttgggccttttgtgtggccacctggactactgagagacaggttcagtccatttgccatcctgcccattaaacagcaacataacaggttggccgcacttcagttgggaaggattcctgctgcctaccacctggccactgcttcagtttgaatctcagctctaccaatttattaattgcattgcttaagacaaactacttagtttataaaagtttcagtttcctycttgtataaaatggcaacaatagtgcctactaaagatcattaggagggtcaaaagagacaatgagtgtaatatctgctccctgttctgtgaccttataaataaagcagcgtgcccagagagaggatgaacgtccccagttcctctacttggcattaggtaacatccgctcttggctctgccacttttcctacatcatcagttctcccctcttactaggtcattcccactggtgtattgacatgctccgtatagacctcatctaaaagaacttccttcacttcatacctgccttcagctat

SEQ ID NO: 4229 - DNA, 600 bp, Bovine  MMBT20161
gtgagtaaaccagagatagaataagagaaattatccagtgtaaacaacagaaagaaaataggctggacaaaaaaatgagaaagcctcagggacctgctggattacatataacagaagatctacctctcattaatggaactcttgaaaggagatgataaagcataaggataaaagcatatttgaaaaataatggttgaaaaagtcttgaatttggtaagagcaacaagataacatattcaagaatttgaccaaactctaaacaagataaaactcaaagaaatccaccacaagaaacatcayagtcaaaaattttaaaactaaaaacaaaataaaacaaaaacaatttcaaaacatcaagagaggaatagcatcttatctatacaggaaaaacaattcaaataacagtgaatttctcatggggaagcatgcaggccagaaaaaggtgacatttttcaattactgaaagaaaagaactgtcaattaggaatcctatatccagcgaagatatccttcaggaatgaataagaactcaacactttctcagatgaaagaaaaataaggtattatgctatcagaaacttatactagaatggctaaaga

SEQ ID NO: 4230 - DNA, 600 bp, Bovine  MMBT01039
gtacgcccttaatgaaggaagttatgtatgtagttttcaagttttattccttcagtggacttagataaatgaacctcaacatccattacttccaaagcataaaatacaatatgtttttgacaaagcaaatgcatgatccaggtcaaattctaacatgagctgacctgtagacatatacagattttgtttttctaaaaacaaccaagattagtatatagctatatatattataaaagcatcagcagctttaaatgaatttgactttctgggcagtagacttaaaagcagctaaaacatatstcttattatagcttaatttacatgtaaagttatgtaatggctgtattgcaatgaggcagtgttattatacagcaaattgtctgtgatagtttatatctgctcaaatagctccaacattgttttcagttcagttcagttcagttcagtcactcagtcgtgtccaactctttgcgactccatgaatcgcagcatgccaggcctcccggtcaatcaccaactcccggaattcacccagactcacgtccatcgactcagtgatgccatccagccatctcatcctctgtcgtccccttctcctcc

SEQ ID NO: 4231 - DNA, 600 bp, Bovine  MMBT00869
stcaactttttcttcaaaatatgtcctttcctagaartaggtgccttagaaagggatctcaacaattccatcctcggccccctgggtgctgggatagattaaaggagtggctcttttgtctgattgtgtgcatcatcttattttcctatttccagatcagtgaagatcagacacaaagactgctggggaaaacccaatggcatttctgtaatgccaggtgscacttgagggagactagttcaatccttagcccaccctgagcattactgcatccctcttattacatcattaatctatctstttgtctccttccatagactttaaactccactaaggacagcggtcatatctttgctttgtacccactagtccacttcactctgtagatcctcactgagagtttgttttattaaaacagtaagaagtttattacagagagcttaggaaacacagataaacaaaaataagacaataaagtcacctgaaactccaccatccagacataacaactggtaacttcttgaaatgtatcttgccagttttcaatgagcagattaataaatgatgtttaggaaataaacaaataaggaaatactgctt

SEQ ID NO: 4232 - DNA, 600 bp, Bovine  MMBT02799
agaagtttacaaagcaacattaaaaagttatgtatattttaatatggagaaaaaattattaatattmaactagattctatgagattgaaatttcattttagttatagttttggtactctggaaggtacattaattccttaagacaatgttatgtattcttcaactgtttcagactgaagcatatttatataactattacttatktccaatataatcatttttttctcctctgaaaagttgctgatttctcctcactctkatggcaaacatgtagtaattattgataagacattcaactaragaaaaacattgctaaaaatattatcatgattcataattaaaaatctctttctgggtatcctagtcaataattcaaattccctgcagcattygtttctgccattgctatttttaagacttacagaagcctgctgatcaagacatagatttacatattttgcttttaatgtattattgcttcatttctcttatattctatacctttgtgtacaaccatccatgttgagaaaactctccttatgcagtgtagaagttggaaacaattcttttaattatcttttgtgctgaatatttgtagct

SEQ ID NO: 4233 - DNA, 600 bp, Bovine  MMBT02849
cttctaaaggagtttcatggctggtgccagaagaaaaatggaaatttgtggctgagcaggtatttttgccatcggggaggtctggttaatgcataagccagacgaataatgcacactagagaggaggtaggagactgaaatgggcagagaaaaaaattgatgttaagtttttcttgtcttgccttaacataggaattttatttcgttagttcagagcgttaatgagaatgacactattataggagtttgttagtgaaaggaaaaaaaggattacccagtggggttttagtacctatatcrttttttacattaaaaaagttctaaagctaatataatatgttaatattgcttaatttcagaagtggttagatarttaattgttaaacattttttttttttactttcatttttaaaggttttattattgaatgtgtgaaggcttaatatgcttrtggaatttctttctcttagtggggaaaaagaagggaatttaagtaattctttcatcaaaaatccctttgagcttttatttgtcaaacttccttcttcctcgttatgggatttagttaacctcaaaccatatttacttctgtggtttca

SEQ ID NO: 4234 - DNA, 600 bp, Bovine  MMBT01606
cagatgctagaactcaggcggggcctctgcatgcccaggtcacttgctgagtgaggagtacctgtgctcagatgcactttaaacgtcttatcaggtcacacgagcagggggcttaggttttctgtccctcctgcctgagccagccagtgggttgtgctcccccgttctctcgcggtgctgttctcttagggggaagttactcgtggcacctctggaccccatctgagggtcccagtggggaagcatggtgttccctgcctgagtgttctggtgggtggtacagtctctgagactctgctrtggttccttggtcctgtttgattcaggcccatagttcttctttgggttccttctaaaataattgattgcattatctgaaagtaaacatctgtggtttttttgcatgtaagcatttataagttcctttacacacacacacacastcctatatacttggaatctcatgtgatttaaaaatgtaaatacagaactgagtgaggaaagaatgagaagtcttgatggaggaccaaattgtaaaataaagttggtccttttcttctgaatggtgaagtgtaaatttgggtagaaccttgtcccaaa

SEQ ID NO: 4235 - DNA, 600 bp, Bovine  MMBT00909
cctctgggggtccttgctcatctcccttgcccactgtcaggcagacatcacgatgcagatgtcccccagcttggttcaggggattagttgaggccaattctcctttatggtcagttcctctgggttttcccccttctctcaggaactgtgtatatgtaagggggtcacacctggatgctggccagcctgaccccaggcaaactgagtttgccagtgaggatgcaaatgaacacacaaatacccatgcaaataagccaagaggcaaggtctctgtcaagaagcctaagaagctgtctcctrttactattatcctggcttgcatggcaagggcaccactgccaggttcaagttctgctgtttattcctaagccactttaccaagatgccagaagcctttggctaaccccctaggacctattagaaggagaaagtttgtgctgtaagaggagggacagagggtagacttcagaaaggactttccagaggatcagaccagataggaataaaaagagagaagcctaagctggattctttcctattgagaggcaagcaggggtctgggcagaagctttggaagctggctgggccttggggtcctct

SEQ ID NO: 4236 - DNA, 600 bp, Bovine  MMBT00780
aaggaccatttcatattacttaaagttcccgaggttaaaatttatttattaaactcgtctcaacattacaaagtcaaggtgaaatgatattaatttctttcactgatttttcaggttctgtaagtaaatatatttcaagctatttccacagttcaaacgttatcttttgggcctaggagcatattctagtaccataaaagagaacatttctgaggacccaatgaagctttactaaaagtatgactgcaagaattatcttccagcattatcaaacaaaccaacaaataacaaaagtcacargattatgatcaaggttaatgcccagaaagtttcggaacccaaacatctaattccctcatgtgtcccattgagtcatgatgctaaggattccttatcatgtgaatcaaacttttatcagttctctctcagacttttaaaattccaaattataatccagccttttgttgttttacttaaatcaatcagctaaaatgtctggtctactgtttaaatgccataagtcaattttgtgaaaggaagaagtaggatagttctaacaatccctggacatttcagtcttcccacaaggcctagctaaat

SEQ ID NO: 4237 - DNA, 600 bp, Bovine  MMBT00770
gtcaatttaattttatgcattgttctacatgaccgaaggctgattacgggccttttcactccaatatcccaagttaactggtgccagccgcactcagggctgcctaattgcaatttagcccagacaattcctcccatttttgccctccagtaatggaacaacagatcacggccaggtaaagattttaaggtggaaataaagcccgagcgacaaaacactaaagttcagaaaagccttttttcccttcttttatttaatagaataaagactcactggaaaaattaaatgaagcaggttttyccctttttccttaatatgctgcgtttgtgagctgagctctagtagttctacctaactaccaaaagcataacctaccttgagtctaaggaccgcagtgggctgctttcctttagacagtcattgtaaccaaggctgactgtccacacctaggaattttgactgatagtatggaatccacaggaatattggacagtggtttcagcagatttcatgggttttcttggcattaaccaataattatttattgttgctcttttagaatacaagcaggttgcagggttctgaagttctgtttttgtt

SEQ ID NO: 4238 - DNA, 600 bp, Bovine  MMBT02060
ctcaacttcaaagggggggaaaaaaaggtagggagatcccattccagagaactttttggagcctggaccgcagtcagcctccatctgccccgggatggcttyctgcatgggcaggcctgcctgaggagtaaggacacactagtgggattcaccctggtgatgaatggcactaatgcatcatcaggatgacaggccacactggcgatgtcttgccaaggagcttaatgagagcaatagctcattctgattattctcccatgaaaggagggctctgtcttcagaagaactcatctacaagtygactctgtttaattacaggatacaacacacactaatagtaatgttaagatgttctttggcaccaaggttttggcactgataaaactaaaatttatgactctactctgtacacttggaaacattcacacagtgtgcatagtcttgaaatgagaagcgaggtaccctggaatccacttggtttctagctaggctggaaaaatgaatttctactgtagatctctcaatagatgcttcaaagatacagatttatgtacttgtgtcaatcaagctgtcctggaagttgcatttgattcacaagag

SEQ ID NO: 4239 - DNA, 600 bp, Bovine  MMBT09585
catttgttgttgtcagtctttttaaacttgaacatttgacattctaataaagaaatgtgtttgagttcttcagagaaaccgaaccaatgggatataaatatatatatatatatatatatttctgtttctctgcctttttattctctgcaggtcttccacaaattgaatgattccagcccatactgggaagggcaatctgctttactcactcttcgaactcaaatgttaatctcattcagaaactcccagatataatgtgtaaccaaatatctrtgcaccccaagacccagtaaacacaamattaaccaacacaacagataggttaagtacatacacagacagacgcattgggtattaaattgattttaagtatctatccttggggctgtctcctgatacttgctatgagaattctgttgactcctgggacagtaggtgagccccagactctagaacaagaggctgagtccagaagaggtgtgtcgaaagaggcaacagtcagaactggtgggcctttccctagtccaggatgttctgcaggagagaatggcccagacatcaacccctgataaactgtgcgttggtttccaggtgtttctt

SEQ ID NO: 4240 - DNA, 600 bp, Bovine  MMBT09134
tcatttgacctaacttggattcccagcaaaatgagttcttaaatatgtttattactgtttggccaaaggcaggaaatgggttttcaatttgcattctctcccgtgtctaccttccttggtgtctcccctcctctcctctctctattctttccttcctctctgcttacctcccgcttccttccttatttccagcgttagctttaaagaggaacagtaacagaagaaatcagaagatctctagcagacttgtctcttttgtttccaaaccactactaacagcagaattactcatagctcccscaccacccaccatgctatttaaatatccctcttgggacatatttttctctacattttctgttctactccatggtcatggctgtgggggaaacactcaaggcaacgcctcacacacatgaccacataaatgtttattatttttttatttgtaaatctctgtcctgtgcaatctatacagtttttcattgctgacatccttgtttatcactggtttcagataaaaggccgatttggtagttcagagaagatcatatcctcgcccttgttttgaatgatagagagcttaaaccatcacaggcc

SEQ ID NO: 4241 - DNA, 600 bp, Bovine  MMBT05273
tcccagcgaaggaaggctagcctggaggagcagacggggtgctgtggatggtgacagctccctcaggccctcagagggaagagggaatttcagaaccaaatgcacacggcccccaagggtggtgtggccacctacctcttggccccaggggggagtggctggctgccagaggggggcgtgagatggggtgccacaaagtccctcaggggcaggagttggctctcggtgtcgagcagtacctcagcatctgaggagggcaaagaatgaaaatgtggtggggactatccctcagagatcaayggggctcacagcccctgcccttacgatggatgaccagatgggactgtggggaaggaaggggacgatgggtcctcacccagaacccagccatactgcgtggccaccatgaagctgcccttgtcggcactccccagcagccccttcaacgtctcctgcagctccttctgcaacggggtcatcttctgttcaagggctgaggggctggggaccaaggctgaggtaggcagaaggggtcccgtgtactcagggtgctccagctgggcagtggcattgatatgcagcagcttctggaaggtgctt

SEQ ID NO: 4242 - DNA, 600 bp, Bovine  MMBT03319
taaaaagagcaatgatggtgtaactcagaatgcaaatgcatgggcatgcaaacgtctgtccatgtagtcaacttttgatcctcttgggggcatccttttagggcctgattttttctgggccgctacagtgcagcttagtgcaaaaggtgggctagtgagttatgaatctgaagttaggtattttccattatttttggataattaccttttttcccttgtgagggtggaagatatgacacagctaaaaacatctgaaaagaaacagaaatgctattgcagatatgaacattgtaattacargtgtgcatacctactaaatatatgtccaaaacacacactcggtgactcctggttttgcctcccctgaaacggaatgcacaattaatgtcactaaatataattctctgttaccaaaagaatgccacttccctttgtcttcaaaatatcactggatcgcctctatgcaaacattctttacaaatattacttcatctgatatggctatactgtatccacctatctttaaaggacaaaacaagatttatggactacataaaatgttttctagaacatttttctagaacaaacaacaatgaaaac

SEQ ID NO: 4243 - DNA, 600 bp, Bovine  MMBT04065
ctgcccctggtcagtatgactagcatccttatataaaaggcagatctggggacacagacatgcacacaaggagaatgccatgtgaaggctggggtcaggctgccacaagacaaggaacgaccagaagttaagaagttctgtagggtctatggggtcacaaagaattggacagtacttagtgaacaacaagagagggacctggaacagacatttctcccatactcgagggagtgtagctctgccaacgccttgatcttggactgtcagtgccagaaygaaaagacaaatttctgttgcttyggctacttggtttgtggtactttattgtgacgctctagcaaactaacacacrtgatattttgaccctgtcacctgcggctggtcagttattcaaacaatttcctccctgacaaggtcactctggaaactttacagcattgtggatgtttttggaagaggacactctgaaaattgtgtgtgggttaagtgtgggaggagcaggtgcaaaatgtagaagatgagctcatggttggcttattttaaaaattagcttaggggcagttyggaaagatcatccctgcaggaagagcagagaattca

SEQ ID NO: 4244 - DNA, 600 bp, Bovine  MMBT07865
tctcgcctggaaaattccatggacaaaggagcctggcaggctatagtccatggggtcacaaagagtcagaygtgactgagcaactaacactttcacttcacttttcaagctgtttactctgccctgcccaatgcaaactcagataaaatctctggcctaaatttgcctcttgctcctgcttctgcctcctgacccaaacctgatgcttccacggggacccttcatggcatggtgtgcctctttctctagggaaatgtaattaaaaaaaagaaaaacttctttccatggcattgaccttgycatggtgtcactcagtcacctccataaactgaaatcctacagtacgaatgagagacccacccagcaaaaacccaaactgaagcaaacaaacaaaaaaacccttgtgcktacatgtcttacttccaaactatttgtgcacatatttagaccatttactgaattagattcaggtcagttattccctgtctgtctstctcattcttaatcgctcagtcgtgtctgactctttgtgaccccatgaactgtagcctgccaggctcttctgtccttggagattctccaggcaagaatactagagtc

SEQ ID NO: 4245 - DNA, 600 bp, Bovine  MMBT08248
ctyctctgtccatgggattttccagacaagaatactggagtgggttgccatttccttctccaggcgatcttccccacccagagactgaacctaggtctcctgcattgcaggcggattctttaccaactgagctaccagggaagcccccaaaagatcaataaatgtgtataatagaatgtcctatgaaggaaaatcgagctgggaacagtataaaggaatactgtaaagaagaccactgagggaaaagagtacctttggtttgtatgaaccacataaacagtaaaaagtggaaatcccttyaggagaaaatataatacataagaaagaaaatatcgccaaaatacctattttcttagaggcatatcatgatcatacttacatggaaagcatcatcttctgaatttcaatcctgaactaggaaagcacttccaattggtaaaccagtattattttacttgtggttttatgacaggcttgccatttttgtctttctttaacaggaaagattgtcattgatgggatagacatttccaaattgccactgcacacactacgttctaggctttcaatcattctgcaggatcccatactcttcagcgg

SEQ ID NO: 4246 - DNA, 600 bp, Bovine  MMBT08643
taaacaatttctaaaatttttaaaaattttaaataaaggaaaagaatttttcattggaagatgagaggattctaagacaatagagaatgagaatgagatgttaaactgctccaatagtttcaggaggtttctagtctcatgccttccctagttggctcacctgatgcttctggctttctggactcctgtgggctacatcactttgggacatgaagaaggatgattcctccatgaaaccaccatggaagaaaaactgacacctgggtttctactaactcctgccagcatttttaaatgaaygcacacacaaatatgttctgacagttgcaaaaaaaggataaataatgaagtagatccagaaaaagatatcatcygctaatcctgccctgctgctctctgatgttcccttgcrtgtctgttacaaatggagttggtagtaaatgtagttttcaaggtagcctgacatcttacctgtataacaagctgccacggaatragctggcaggcagtgaaggatggggtgccctgagcctccctccctcctctcccactctatgttcttattatgcagaagggggtcatgaaaattaacagaacttt

SEQ ID NO: 4247 - DNA, 600 bp, Bovine  MMBT05827
agaatttccttggtgccagtcaactgtgtaaaactcacttgttccttttattacacttcaattcagtctcttgctctgagttctttgtcaatggtacagctctttaataaacatttcacatgctgtctcaataattgacaactaattaacaggaaagctctgctgctgggggctggtgatttcaaaaagaaatgagcaggaaagttgctttgctttctgtctccacaagctcctgccgttgtcattgtaatatgttggagatggtgatcccttaatagtgtgaacaattttactagagayctctgctgaaactatccatttgctatcagaggaccatattgatcctgaagaactgtcattgagttccagagtgcctgtaagaaatggacaataggaagtatgcttcagtctgggttattcctttctctgagaaacacattataatcaaatggaatctaagtgatttcctccactgctcctgcaggctggaaacactgacaaggaatttccagttaaaaaaaaaaaaaattagcaactggtcccttttccagatacttcagttaatctgtccccttctaagatgcttctgggtatccatta

SEQ ID NO: 4248 - DNA, 600 bp, Bovine  MMBT09955
cttctatagactgttaacccctctggatcacgaattaaaacctgttttacagtgatctgctgctcagaagaggagcgatgaactcctcattccacctgcacttcttggatcttgggctgaacaccacggatggcaacctctcaggactgagtgtccagaatgcatcctcactatgtgaggacatgggcattgcggtggaggtgttcctggccctgggcctcatcagcctgctggagaacatcctagtcatcggggccatcgtgaggaaccggaacctgcacaccccccatgtacttcttygtgggcagtttggcagtggccgacatgttggtgagcttgtccaactcctgggagaccatcaccatctacctgctcaccaacaagcacctggtgatggccgatgcctccgtgcggcacctggacaacgtgttcgactccatgatctgcatctccgtggtggcctccatgtgcagcctgctggccatcgctgtggaccgctatgtcaccatcttctgcgccctgcgctaccagcgcatcatgacgggccggcgctcgggggccatcatcggtggcatactgggccttctgcgccagctgcgg

SEQ ID NO: 4249 - DNA, 600 bp, Bovine  MMBT08103
ctacttcctatggggcttaactcatgggagctcccactagaagggcatctgtctgactccactctggtggaaggggtattccatggccctcactgcttccaggaccccatggtcattgttctccckatgtatcttttgaaaacacagctctaatttatcatgttcttgtttaaagccttgttgtcttggcagttgctactgaacarcttctacactctctagcctggcagtcaaaatccatatggccccaactcacctttgtagccttccctcctgacagtgtcttcactgtctccctcyrtgcttcagcccaggaataacttgctgctctttgagcacacatctctgcatcttttcatatgctgttccctctgcttagaatgccttcatcccttctccatctggtcaacacctcctgttatgacccatctcggtggtcaccctgtctattgacccctctctgattcttccaggcagagtcactgtgccrtgctgtgtcctggcacgcagcctttgctgggctggcccattgtactgtccctatctgtttccacgcctgctctctctgccttgtgagtaaacagggcaggggtgatcttc

SEQ ID NO: 4250 - DNA, 598 bp, Bovine  MMBT08489
  misc_feature (1)..(11): n is any nucleotide
nnnnnnnnnnnccagcccatccgtgacccagtcacccacacccagaacggaagacgcgaacactgacgtctttggcccctacraggcatcctccccagaacttcttcctcaggcattcttgctgttgaagcyggacgayggcaattgcctcttaacgacagtggtgcctgttggcctggatcgtggttgtgtgcccactaactgggcatcaggacatgtttatgttgtccttgagcaaaggaaggcattactcacaccagcatctgctcccaagaagtctgaaaagctcacttattccgyagagcacaatggaaaatatagccccgagctgaaggtcatcctctggctccttggaattcggggaaccagcagtcttgaccctttcctttcattctcccgcaactgttgcttgagactcttcaatcttaacttgaattctataaataaaaatacatccagtttttttwattttattttaaaagtatatataacttttttttttttttagtaaaaagctttttaccgggaaaccagttggcctccaatgtctgtgaatggattaagtttcaattcataaagtcggattaaaatgggagag

SEQ ID NO: 4251 - DNA, 556 bp, Bovine  MMBT07438
taatcaattagaagccggaagccttactaaaataaataagtgaaacagaagaaagtttgataacagaaccatctcaattctttgaacccctttccaagttatgtaccaaaaaattctatcatcaataattttctttttgatggagatataagtgacatatatcactgtgtcaaaagttatttttaatcatctatcagctgacaattcaggttctcccatttggtggaaagcaatgaactggaaaaccatctgacttttaaaaatatattatccagtcattgcagtcaatcaccttaaaayttacaccaacatttcaagtccctctttggtgctcagaggttccatatccaactgtacagcaataagacagagaatgggtgagaaggaacttttcccccaaaaaagtgggaacaaagtaactgtgaaggaacarggttcctttgtcttataggrccctttctcagatccacttaggaagtcaagggactgggaactggcttccttaaagcggagtactcagatcccactggaaaaatcttcgtagccaccaccctca

SEQ ID NO: 4252 - DNA, 600 bp, Bovine  MMBT09953
gtgcttgtatctgggttccctggtctgtaaccagcagaacgactgtggggacaacagtgacgaagaaaactgcctcctggtgacagagcacccccctccgggcatcttcagctgtaagtccttcctgcccacctcgcgccattcagctgtggtgtgtttgcaaacggtaggcggccctgaccctgggatgtgggaaagatgttgtttttggttaagagaagaggtttgtgttgtcacaaaggcaatgttttcttttaggatagaaagagggtatgtctgagagtcagaagttccttccaytttgagcagcctgtgttttgtttgggagaggctttctgctgcatatctgagaagcactgactgatcccaagaaataattattgacttagtattcttcatactggttttagagaatttttggaagtaattttaagccactattttaaaataattttaaataargaaggatatatagagtctgtgttcaagcatgtaattaaaacaagaaaatagaaaaaaaaaatttgttgggggtttaaaaaggttgtaattgtgtattttttctatttggtactggagtgggttgtttctcaggtaaag

SEQ ID NO: 4253 - DNA, 598 bp, Bovine  MMBT10355
  misc_feature (1)..(33): n is any nucleotide
nnnnnnnnnnnnnnnnnnnnnnnnnnnnnnnnnggtgaatcttgaggacgttacactaagtgagatgagtcagccacaaaaagacaggtagtgtgacgtcactacactaagtgcccatagccggaatcactttcactttctatttctagagcgtgaaatggtggttgccatggcctggagatcaggggccggggagacagtttaatgtgtgcaaagtttccggtttacaagatggaaaaaattctggaaatggatgctggtgatggtggcacaacgtgtgtcactgtgccctgagctgcrcactgaacaagggttaagacggcaaactttatgttacatttgtttcaccatgatacacaaataatgcatgttttaggtataatgtataatattttgaaagtatatytaaaaacaatgcaaaaactaatacaattaattcatattatgatagattgtgaaaataagtctaaaggctgtttctcataactggatttgtcatatgcaatgtcataatgtcagatgtaggaaaaattactatttatgaaataaaatatattataaaatccttragaataatttagcacaatctattaaaatc

SEQ ID NO: 4254 - DNA, 600 bp, Bovine  MMBT05758
tactcttgcctggaaaatctcatggacagaagagcctggtgggctgcagtccatggggtcgctaagagtcggacacgactgagccccttactttcacttttcacttttatgcattggagaaggaaatgacaacccactccacagtgttcttgcctggagaatcccagggacgggggagcctggtgggctsccgtctatggggtygcacagagtcggacacractgaagcgacttagcagcagcagcagcagtaatataatagaacttccctgctggctcagagrttaaagcatttgcctrcaatgtgggagacaattatgtgatataatagactatttcagtgtgcgagatagcaagtaggttggaaatatagatgtgtctcattttcactgaaattaatgcttctaaataacttaccatagagtttgataaagatttatgtatataatttggtgtttaatattgtcaatgtgtttatttttgagcacatccacatgtatttttaaaagaattcatttaaactgtatatatatgacaaaataatgatatattacacctcagaagtgtttatgacaaataaaacccatcacactgaatgtt

SEQ ID NO: 4255 - DNA, 598 bp, Bovine  MMBT10431
  misc_feature (1)..(80): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnctcaggctcttctggcctcgggtggcccttcctagcactcaggtctgcctgcagacctgcttccggcccatggcctgggccccctccccgagagcagagcacggtaccgaggcagcctgccgtctgcctcctgaggccccgccccctgaggcccttctgtcctcctcacagaaggcgtgtggcatcccaacgctgctccctcgagtttctggaagacacrgtgggatgtccctcgggtcaaaggtaaggaccccgcctctctcctggggccaggatgggtctgggaggggcagagtgacctgcttttcacctgcagaaccaaacacatatccggatccccgagacacaagggcctgaaaaagacacacttcatcaagaacatgcggcagtacgacaccaggaacagcaggtatgggcgcgcrgcccaccatgtcctccctccagccctgtgggacctcgtcctgcctgtgtcagcagccctgtcctccttcagctcaggggactcgtccccacagccc

SEQ ID NO: 4256 - DNA, 600 bp, Bovine  MMBT08488
gatatttatatatttttaatagcaataattgcttacccggtagtagttgctgtattaacctccaattgctagtaaatatttttaagtacataatagacagcaatttaaggcatagcatagcagtttactggaccgttttaaagagccatttgtacgtgtgatgagttcataattttaaagagaaaataatgtacgcaggacttgtatgctacaaaatatgttgctgtgttattgcttgaagagttagttcattgagaggaagttaggttgcggctgctgctttgtgagaataaaggcagrgggtgccttacgacaatgagtgttgagtttatgccaggtgcttatgtagtttagcactttctttggaatattttggattatatattatatccactactatattctttggaatatagtagtggattatattaattaggcatggaaagatttatcttttttgttcacgggctaatttagcctagttaattctgaattaattgtattcatcaaacattttcaaaggtcttctctgattaataagaaaaatactctgtccccactttatactatagtctatgtattatatattgacaaaagata

SEQ ID NO: 4257 - DNA, 598 bp, Bovine  MMBT10967
  misc_feature (1)..(52): n is any nucleotide
nnnnnnnnnnnnnnnnnnnnnnnnnnnnnnnnnnnnnnnnnnnnnnnnnnnnattttttaaaaaatgaattaggtaggccatggcttatataaaataaatgtatatttaatcttttaagcagtaatgaaaaatgaattacaaatggattttactagaaaataattggatgtggttcatgcttagtacttttgaaagtgtaaaaatatggtccccacacacaccaccaactttcctctgacaccttgcagggcttgccaaatgaaagttggaaaatatccaaagtaaacagtaattatgarctctgtgacacctaccctgccatcattgttgtgccaactagtgtaaaagatgatgatctttcaaaagtagcagcatttcgagcaaaaggtagaatcccggtaagtaataaacaatgttatttagatatgaacatatactgtatttggtctaatatggggaaaagcaagttagaaaaaaatctcatgaagaaaatggaaagtagaaaaagaagtctataaacctgaacatatctttgattctcaagaactatctatataagcattttgtctgcctgctatgaccccacctgccatgagt

SEQ ID NO: 4258 - DNA, 600 bp, Bovine  MMBT09975
tatgccttatcactgactctgccgcacgttatttgcaaacaatctctggctaaactgtaaatctacaagcaccctcgtggcgatcgcctggcagaattcagacataagtgctgtttgagctttttcctaattgtagattctaaatgtttgaccctcttctttgagtgccagagacctgacttgacttgtctgtggtttgggctctaatttgaaagcgattgaccatgtttggatggtgtttgaaatatttgtattgtatccacggaaaggatggcaggttttattttctcaagagtacartttcttcagcacgttcttgtgccatcgtgtgatgtcctccttctgctttgtttgcttccaggatrtctttgtggggcagcacattgcgcccggccatgtgcctcagccccatcttggaaaatgatctctactacaagctcagcacgcacaagagcggctggctcatggctcccaagcacrtacctgaccactggaggggacacgcttttcaaagtgtgcccagttccatagtcttctagtgagagaagcaggaacccagtgggtagatgggggttatttttttgtttgtttcatctgttg

SEQ ID NO: 4259 - DNA, 600 bp, Bovine  MMBT03625
ttgctttgactagaacaagtctaattttataacccaaaaaactgccaataagggaatttttatatacttttgagatayatattttttactggaaaactcctgagttaatttctctaaaagttctttgttaacactttctttgcaaaatcgtacaaggaaacaggataaatttatatcaccataaaataatgaaaactgtagtgtactggaaacctaattttggaggcatatagacacaaatattcatctccctgatttttaaatttggacaagttacttaatttccttaaagttgagttktatcatctgtaagttaacactaatcataccttcaatgtaaggttattattattaaacaagaaaatgtaggaatgcttgggacttccctgctggccagtggttgagactttaccttccaatgcagcaggtagaggttcgatccctggtcctggggctaagataccacctggcatcccgcccaaaaaaccaaaacgtaaaacagatgcaatattgtaacaaattcaatgaaggcttaaaaacatggtccacatcaacaacaacaacaaaaaatcaaaaaggaaaaaaaaaaagacaaggtta

SEQ ID NO: 4260 - DNA, 598 bp, Bovine  MMBT10032
  misc_feature (1)..(32): n is any nucleotide
nnnnnnnnnnnnnnnnnnnnnnnnnnnnnnnnaaaagctgaacatctatacctattaaatactaaagaacaagaatccagcaaagtggagttacagaaagagtaatgcaaataacagaaacagttgtggtcttcactctggcgcaatggatttagtgtgtggtgcctgattagcagcattagtatcacctggaaacatgcctccagcacatactaatgccctgacagcgaaggtttgaaaatcactgctctagtttaccatcatatttaggatgacttagctattttctttagatgtgtktctctttgytttgataaaggttgcatttttatgatgactggggctatataaacyacatagggaaaaaggaatatattttggtttatctgaatcagagagactgacattcttaaagatcctaaatgtatagtataaatattttatgaacattctttctagaaagtgttgcttttggggttgatctctctttgtcctctctttccaaatagtgtggataatgacagtctccaataattgaatactgtgggccttgcctccatgtaacagaaggtcccaattctcccactgcagagggctg

SEQ ID NO: 4261 - DNA, 600 bp, Bovine  MMBT02497
aagctcaggcaccctagagccygtkytctgcaacaagagaagctaccgcaacgagaagcccaagcaccccaactatataggagccccaactcgtagcaactggaggaaagcctgtacagctatgaagacccagcacagtcaataaataaataaataagattattttttaaaatggtgcccagacaaggatacactcttctagcctgaaaatactaacacaaaaataaatgtaaaatgcttgcaaagtaagtaggcatcaagtgctgtcagtttatcatattcaaaagctaagattcaacmattttaaatatcraacattaagagagcaagctgcttgaaatccttttttgtggaacaaagtagagaataaataaaaacattgttgatgtctctcttaggcagataatcctccaattttgagctgatttttaaaatagcattccgaaacgtcacattcctcaattctttcttttatcctctggtcatgcctcaagtttctgtatataaacttggagttaattgaacatatttttcttcccattgataaacacagctctattataatttaaacagatttatatattctaaataatcatttaa

SEQ ID NO: 4262 - DNA, 598 bp, Bovine  MMBT02875
  misc_feature (1)..(21): n is any nucleotide
nnnnnnnnnnnnnnnnnnnnnttttttttcttttgctgcttatgttctataattatgaagttaaaaataaatatgaatgccacgctttgcctggagaagataccactattttaagtacacacgtatcaatactagtctgctaaagcatggagaccaaatggaaaaccatactttgtctagaaatcttagaattggccaactaaatgtctaagaaagcatccgagtagcatgcactttgggaacccattgattcaagtgtaagagacttccaaattgttagtaatatgagtaggtctggtmttgacatctgccaatgaataagatatcatccagttgtccgtggagtgcaaattgcaggtatcaaatagagatgataaatgcaggcgttattcctttaagtggttcttagcttttgactgcatttgaccatttgtcaaagctaactggcctctgtttagtgatattgagagtgaaacacacgtacayagacacatgtgtgcaactgatacttgaaataaaatttcataacattaccatctatcttagagattcggtttctgaattccttagtttttataatccaatacttcagcaatga

SEQ ID NO: 4263 - DNA, 600 bp, Bovine  MMBT05684
tctagaagtatctttaaaaaacatgatagcatgtttaaagtgatgagttgtgatgtaaggttttttattactttattaaaaataattctatatttcagagaactatttccagacttttttactaggtaaagggaataaaaagaaatgtgaatttatttttgacatatgttttaaatcataagcaagctacaaagtacaataaatgtcatttgccttacccttattctgaaaaataagtaaaataataaattcttagtttcctagggttgaaaagtgcctgaaagatcttcatattacctmatctctactgaatacattaatcgtctgaaccatatccaaatgtttgaacacgtttcatttcagaaaagaaaaagaaaatactttgaataattccattatattttggcaaaattttattggaatttttttcctacatttaatctatgacattatgatttacaccaatctttattaaactttgttccataacccaatgacagcattcaaacattaaaaggtcttcaaacattgcaagaccataccatgggttctcagccatgcttccacttggaatcatcattgaagtcatcctagcctttc

SEQ ID NO: 4264 - DNA, 598 bp, Bovine  MMBT11536
  misc_feature (1)..(37): n is any nucleotide
nnnnnnnnnnnnnnnnnnnnnnnnnnnnnnnnnnnnncccttggtgggtgcattgttcattctccaaatgcaggacgactgatctatctcattccccaccttctggccgaccatctgacccgagtttgacacaatggcacaaagattccagtccagttgccaaaggctgaaaaccagaaagagaaaccagggcaggtaggggagaaatgtgtaaattagraagttcctcatattcccaacaagtttttctgggaaaacaaattccagatattgtgcataattgctaagtgtgggaatatmgctgaaatatatttatactaatccaaaactagctccataggatatcaagcttggggcatgcctccatttaaaaagtgaatgtggattgctaagaaataactttcatttctctttcttgtgttgctttgaaattcaatgaaaaagcagtcatttgtttcccaccttttatgatgtcttttcattcaaaactgttatttcaaatgaaataaggaaatacagaaagatttgctctctttaataagggtgatggctaaaaaaaagaaatgcaaaaggagtatatataggcatcaatttgaag

SEQ ID NO: 4265 - DNA, 598 bp, Bovine  MMBT12343
  misc_feature (1)..(236): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaaccactacttacggtgaaccagatgttgctatgggcaaaaacaatacagtgtgatggtsaaagagttggtgttgcccggagtcaggctgcttgatttgaattctgtctcctgttgtttatgagctgaaggaccttgaacaaattccttaatctttctgccttagtctcatctgtaaaatagaaataaaaatgtactcacttcacagggttatttaggggaataaataagcaattatattttaaactacctaatgcattaaaaatgttaggtatataaatgctacctgttgttgttgttgctactgttattattactaggcacattctgatttagatttaagaacaaatatccactac

SEQ ID NO: 4266 - DNA, 602 bp, Bovine  MMBT11726
  misc_feature (1)..(2): n is any nucleotide
nncaatgcaggaaatgtaagtgatgcggstttgatccctgggttggaaagatcccctggaagaagaaatggcaacccacttcagtattcttgcctggagaatccccacagacagagaagcctggtgggctatagtccatagggctgcmaagagtgggatggacatgactgagcacgaacacacacacactgcacaatccttcatctcagargtcacagtgtacacacagacctcacctggagtctcagatgtgcctggaccatgctatcctcatcctctatcctccatactctctayaccayacataggctcccaccygcctgtgaagtcttatgcctcagtttcttccactgcacccgacaaacatcccacccataggtcctcacaggacaacacacacggcccctttggagcatcaacagccagggactgtgtcattaagctgctgacaggtggtccctaccagcagctaccctccccccacccagttctgcatgcccagccttctgccagagccagacagtaaagcctgcctcctggcaggcctggccaaaattgtcaggaggttgatgatgtgtctgaaaaggggggaaaaaaaaaga

SEQ ID NO: 4267 - DNA, 600 bp, Bovine  MMBT14302
aaaaggcaggcccgggggtagyggggagagggggcagttgccacggctgrctccaaagcccctccagctgcgccctgctcccctggcttggccagcccaaccctccagctgtggagaaaaccaggcccccaaagccagatcagcccgaatgggctgctcctcacaggggtgggctcctggaatgggcccccccgtaccctcccaggcagccagctgccctctggttttcatttaaaaccagagctggatccactttggtgtcttcttaccaagtggggcagggagagggcggatggtgaygttgctgtgtttatttacygcctactgcatgccaggcccctgcgtgtgctcagtgggccctttgcacgcatggctggcctcaggccttgtgccagtccaggaggtgtacagagggcttcatgaccccattttacagatgggaacattggcaggtccagggaggaccagccacacaggcccgagagcggcagggctgggagccgacctcgagtctcttggctcaagctctgagcccaggcagcttgctgggcttgttggagaagcgcccggccttcccctcacccatcaccagcccctccc

SEQ ID NO: 4268 - DNA, 600 bp, Bovine  MMBT14078
gaacctggaagtyccagtgtcagtcttctgcccactggaggacatggactcatagagaagctgagaagggaaraggctgataacttcctctttcctgttgataaacaactttttaaagtggcgccatccagcagcgtccactctaagtgagaaaagctaggggcaggaagaagccttggttgggctgtgtctctgtgatgactctagcacttcaaggattttyctccccaggatgttcaggaggattctaggaacgattccaggctccttgttcctgtcagttcaagagggcagctttcygtgtccttgtctgtcctcctctaaaccccagaaggagcaactggggaggctctgggagcaggaagagtgtgctgggaagacctggttcccacacagaaagcagggttgccctgagtgacggctattgtactgtggtcgctcccgcatctgaccaccagagacgctgacttacagaagactggcggtcacggcagaacgcagaccccgcagggaagtgggagtgtttctggcactttcagctgcctttgtcttgttggtcagttcacatgtgccccttccctcaaacattacagattccct

SEQ ID NO: 4269 - DNA, 600 bp, Bovine  MMBT11745
acttgggctcatagcctgctatgggggaactgctgagactgaggttcagtgtggaaagtcttttctgctgcctcgggagatggttgtggaattgacaggcacagaaagaatcgacctagctcttccctcttccagtacaagggcagcctggcctggcaaagggcttatacagaatttcccctgttctttaggttatttctaaggtgttagcaccacgccgatgctcttgtaaaatcacactggctgctagtccccttggatggtgtctcagccaccagctctaaacaccttcagatgttygagccagcagaccctgcactgtcctcgttggccaaggcactgtcacctggtcagcaggtgcttatggagaatccccgggtgcccatctctgtaccaggcgctcttgcatttagcttatatgtgtgaagaaaactgttaattgcctgctggacgtgctgttctggaagggttctgacacttcggcgagcattgccagggcaaccagaccaagagtctgttagttaattaacattgcagtgatcgcaccctattctagcttctagagaagaggaaactggctgggatgttttcgttctctgt

SEQ ID NO: 4270 - DNA, 510 bp, Bovine  MMBT12168
ctcctagactgtcagcttgaaagtgggatttgtatctgagtcagtgttggcatttaataggtgttcaaaacctgtgcttttcaataaatgctgaaagagaagaaaggaggtggtggcagaatggctgtattgctcaccaaggtgaagtccgggatttgtccgaccaatgtagaaatatacaatggcagcaacacctatgttaaccagggtatagacccactggataacaaacatgatgagaagsgacccaacagcctgtggaaagagaaggaagagcaagtcagctcatggctgaaacaygcactaagcaagccacaagacaagggccttaagcggaggaattccctgtgctccagtggttaggactccacgcttctactgcagggaaccagggcttgcttcctggtctgggaactaagattccgcaagccacgtggtgtggtcccctcaaaaaacaaacaaaaacccttgataagactaggacctttagaaacaaggtcctctcatcaa

SEQ ID NO: 4271 - DNA, 600 bp, Bovine  MMBT12633
ttcagtatcagaargcttttttggtggaaatgcttcctacctgtcttcacrtttctcattcattcactcacttgactcagatgtttatttcctgccttctctgagccaggtgctctgctaagccctgaggccccagtggtgctgagctgttgtctgrcccccagtctggaaacagtgtaggaacagtggacccrcagcctgggctgctggacgctgcgactccgctgaacaaacgctgcgctyaccccactgctgggtccatgcctgggccatctgcaggcttggggcaaggaaggcagytagaaaatttggattcctctcagttggcaytgaccttcaaaatcacctcctaagtctgtgcctgttcatccttatagcaaccaattgtcttctgggacttgaaggtgggatgggagaggtgaaaatgactgaaatgtgagtcagaaaaggtgtgagatgcaggtaaagggtgctttgcccagctggctgtttttttgtttttgtttttaatcaggaggcatcatagctgcagtggcttatttgcaggtaagaaggggaaagctgtgagtctgggaagtttggattgccagccagtcttct

SEQ ID NO: 4272 - DNA, 600 bp, Bovine  MMBT12770
aactgatggtttgagttgcattgcttttgaaggctttattagagttgtcaaggaaaaaaaaatctactgtgctctcattgcccttcaagcaaatctacttaaatatcttctgctcagtcactcagttgtgtccgactccccatggattgcagccctccaggctcctctgtccatgggattttccaggcaagaatactgaagtggggtgccatttccttctccaacttaaatatcttgaatgacccttatttttgttttaaattatgtaggaatattaagattgctttaactgaggtaacygcttatgatcaatacctctctttgcygtgattaactggtattgatgagaaaggatagtcctgttaatactttttaataaaattagaacattaagctcttcagaccccaaaatayttggaattattccagcacaattggagcttaaagaaacagataaatgttttgtggatctgagcctccatgggctgccttctgacagtcagataagttttggcatagctgtattatctaggttggtttctgacatcttttcttttttttgtcagtgggccagaatccaaataaatatttttggaagca

SEQ ID NO: 4273 - DNA, 600 bp, Bovine  MMBT12699
acagtactagcactgaatcgttttcttttttccccccactgtgtacttattcatgttcggataattaataactagttaacaataattaaatttatacatcttcagcacatatgcccaaagacttgaagtcttaggacctcatatgaggtcagaggcatcaatttctaattaaagatgttatcattcagttcttgagccaaaggttacattcctaatctcagccaactaattcaatgtttaacttttggtgctgatcaatggttgatgattccttttcactaggaaataaaacaggtacaygtagtcctttgtggttcattggatgagccatttaaattgaaaaatgaatgtaactaaacattaaatattttcagttaatattatatctgaattgaacatcattttcaagtagtattgtctcatacaaaataaatttaatagaaccttttttatatttttatttaaagttgtgttttttattattttatatagcacatgccaaaatttaattcaatttcaattagtggataccatatgcaggaagcaggggctgatgccattctggaactggcctatactatagcagatggtttggagtac

SEQ ID NO: 4274 - DNA, 600 bp, Bovine  MMBT13934
ttcccctgccaatttagaaaagaaaaacagttctcactcatatattgctagatccatcatcgtctataagcagtgatggagaaaacagttttgggtggggggtaagcaaacctattgtgaaagttctactgtctttacattggatataagatcatctccatggtggtcaaacagagtggtctgtttgactcaactactattaaaattcctttaaaaagtaatgatgaataccctccaatgtctatttacacagatttctgactgaactgaaaagacatgggaaacaaattttttaaactygcaagagaaacctcttccccccttaaagtcaagcaaatctgagttgacttctctcataaattcaagaacaaaaagttataaattgaacatatgaaggacgttgctttttttttttaagtgatgtttccttgccttaatggatttagctgtggcagagagtcagagyaaagctgtcttaactaaatctttgactgattatgcatttttttccttattcatacaagatagattcatcatcccaatttgtcaagctggcgaggttccaattaattacacccggcaaacctcagcttgtgccct

SEQ ID NO: 4275 - DNA, 452 bp, Bovine  MMBT14105
attctgttatttctcaaggcaatgactaggctatagaatatctgcctggtagagtttctctcatgggattctggtcgctaattttattttcgctcttggggagagagatctttcagatctgtgtgaggtaatgctactcacgaaacattactttggcttctaagttggactgaaccataagcacatctttttccagtgtctggcttagaaactttgcttggtctgtcaaaaaatatgaattgagcacttggaacattgtgtaatgatattgttgcctccatccaggcataacaattctaygyagctttcttgaaataagaatgtctaaccactcttgtgtcctgatcaagacaacaatctataatgaaaattgcctaactcaggcagactatttttttaagctgcatctcatcaacagtttgatatgtttattgtttagtagggcttgccag

SEQ ID NO: 4276 - DNA, 601 bp, Bovine  MMBT13707
  misc_feature (1)..(1): n is any nucleotide
nagacaatagagaatgagaatgagatgttaaactgctccaatagtttcaggaggtttctagtctcatgccttccctagttggctcacctgatgcttctggctttctggactcctgtgggctacatcactttgggacatgaagaaggatgattcctccatgaaaccaccatggaagaaaaactgacacctgggtttctactaactcctgccagcatttttaaatgaaygcacacacaaatatgttctgacagttgcaaaaaaaggataaataatgaagtagatccagaaaaagatatcatcygctaatcctgccctgctgctctctgatgttcccttgcrtgtctgttacaaatggagttggtagtaaatgtagttttcaaggtagcctgacatcttacctgtataacaagctgccacggaatragctggcaggcagtgaaggatggggtgccctgagcctccctccctcctctcccactctatgttcttattatgcagaagggggtcatgaaaattaacagaactttattcaagtgtagagacagacagctgataaattatacacctgcctgggagaagacagaaaatcacaaggtcatga

SEQ ID NO: 4277 - DNA, 600 bp, Bovine  MMBT13542
atggagcccccctcccatggaccagaattctccccaagttgtcgaggctgcaaaacacttgtctccattgatatcgaccagtggtgcattcagtaagaagaatggggacagggagagagccagctttgatgtctccaggggcaggaaatcactcagatgattcttccagggccacttggcagcaggtagagggtgtgacagctggtgggaaggtcggcaactgggatgtgaccgctgaaccatatcrgggaactatgctgcccttgcaaacagaaaagttcattcctctagtctrgtagrgggtagggatgagggagaaagatcagagggcctggcacattaccacctgggaacaagagaattcaaaattgtccaacaatgacatgtcagaagctttcattactttgcaagaccaactggcccaagtcttcaagtcaatctaacaagaatgtatgactgtcaacacctaacaggtgggattcattgtggttaatccatgtaccttgaatgaggacttgaagcctctctttacccatctgttaaaatagcttataacatgtttctgtgagaaataataattactacatactcactatgtgc

SEQ ID NO: 4278 - DNA, 600 bp, Bovine  MMBT14316
gtccccatgtggtaaggagaccaacaggcagttgggaggaagggagattctcaggaacaaaggggctgtgggaacccaggtctggaatggctgcctggggtgataagaaaggtgatttggaggtcttgaaggatgagtaagagttcaccaagtsggggaggtgggtgaaggtcttgaaggatgagtaggagttcaccaagtgggggaggtgggtgaaggtcttgaaggatgagtaggagttcaccaagtgggggaggtgggtgaaggtcttgaaggatgagtaggagttcaccaagtggrggaggtgggtgaaggtcatccttgcctctggaaggctgtgagagcacagaggccactgtgggtagatcctgggagtcaggaacrtgacagcctcctgctcaaggagcattgtgcatgcccattttatagatgagcaaactgaggctctgagaggtgaaattacttgcccagggtcaggtgtctggtaagtggcagggtggtgattcgaacccagatcaatcttaagccaaagcctgtgctggcttaaggcatccaggaccccagaggttatgtgctgggaagggggccacttcaaagagc

SEQ ID NO: 4279 - DNA, 600 bp, Bovine  MMBT13221
gtgatctttgtacttagcttatttccatcatcttgtgttaaacaattgatggaacatattcactttgaggctgaacctgcttaaaagagccacctgttctcaaagactgttcactctgggagaacacacctgggccatcgtccactgacctccccactgtgcatgcgtggtgaccagcccaaggcgacagaaagaaacctagtaaattcagctttaagaggctctgcctgcttttctctggatttaacccgttctctaaggctccagccaaggttcatggctacagaatataaaaccccrattctcagtctttgggttcaacytgtacacgcagagcaccacagagctcttggtgagcatcggctgcataaaggttttgcattctcatagacatggaggttttaggagtctaaagcagaccttcgagcttttgttktcaaacacttgcaaatcattttccctccacaaaagcctataaaatgtcagcrtgtgagcatctctgcccatggggctgccccttccatgggacttgggtagtaattcactgctggggatctattggctcctggaccccaggaaggctgtgcatgtttatcaccc

SEQ ID NO: 4280 - DNA, 600 bp, Bovine  MMBT12342
ggggaggtctggttaatgcataagccagacgaataatgcacactagagaggaggtaggagactgaaatgggcagagaaaaaaattgatgttaagtttttcttgtcttgccttaacataggaattttatttcgttagttcagagcgttaatgagaatgacactattataggagtttgttagtgaaaggaaaaaaaggattacccagtggggttttagtacctatatcrttttttacattaaaaaagttctaaagctaatataatatgttaatattgcttaatttcagaagtggttagatarttaattgttaaacattttttttttttactttcatttttaaaggttttattattgaatgtgtgaaggcttaatatgcttrtggaatttctttctcttagtggggaaaaagaagggaatttaagtaattctttcatcaaaaatccctttgagcttttatttgtcaaacttccttcttcctcgttatgggatttagttaacctcaaaccatatttacttctgtggtttcattctgaaaatgaaaatttggctggtttagaaaaaaaccttccattaacctagattctaagctagagattctca

SEQ ID NO: 4281 - DNA, 600 bp, Bovine  MMBT16095
tggacagtgactactttctgtatgccagacactgttctgggcacagtggatgagcaacaaggaccctggccttgggcagggtgaggctgaggacatgagagtcactcagtgatggccctcagccatttatccagcaattgtccagcaggagggaggctgttggtgccctgagttttgcctcagcagcaccctaggtcacccaatggacacggcaccatcctgcccggcttctatccccaggacacttgtgagccacctgggtgaagatgggtcctagacaagcaggggatgatagaggamgggaggagaggcctgagaggagactgccagcaagccaaggtcatgctgaagccacaggactgcccctccctgcccctaacacattggccagtctcctttctaaaactcaccttgggcccaagttcaaaactccagccacaactggcctggtgtgaatcagaagcccatcactaagccaatcagcactgcccaggagtagggatctataaacaatggcagctcccattcccagagcagggtgagcatggggggaaatggttccctgaagacaaaaccaccaaaggccacaatactgacctt

SEQ ID NO: 4282 - DNA, 600 bp, Bovine  MMBT18177
gtgtgttgggtgttccagctgccctgagcccacatttctgtgagctcatgggttgcttcaaagctgttgaacgcagttgaaacagaatattaatacatgtgaactgagtctatgcggtttattctcttaataacgtctccaggtttacagggagggtcctgttaagtgattttctttagctttaaagaactagaaagtagagagaaagtgtttgggctcttttaaccttcaaacatgaccacactgaggacagagattgcccaagaaatgccagtctctttcctgagacttctgaagggycgtcgtcacaagtcctttcttacgctcatcaaggtctcaaaatgcgttttcattgtgcctgatgcatagtgtttctctgatcacaattccggtcttactaagcaaagtatggggcaatttagaggggaagagggacctttttaaaccttaatggggcaattgccaagatcatgactccttgtgggtgttggacacactgccctttagtaaawcttaaatgaccacacttctctcttctttccctccatccctaagggtttcattcctaatgtctgacctttattctggactcaggattct

SEQ ID NO: 4283 - DNA, 600 bp, Bovine  MMBT17000
cagcgggtttaaataagagactcgctaattaatggagcaccaggggacagcttaaagagaaaattgctcagtagataaatccaggttttcaggcctctctaaaggaatgatggcagtccctggagggctgtggaagtgaatgttttctctctcctctgtgatctggtttgtttggagtctttggaggccagtttgccctggctgtctgcagcgaggagtaaagacagcaggtacttggacttcccagccagttgaaatcaagatgtgaagtggcacggctgagactctaagacatggctytcccagcccctctgtcagccctgwccctgggtctctggctgtttgtgttctggttyttggtgagagccttttcagggaggtggctcccctgcccttacagggcttctctctcactcttcccctttcaccaatggcaaatggatacctctctttggtctccctccccattcctttgttcctggccaactttcaagactgtcccttttttaaaaaaaattttattgaactatagttgatttacaatgttatgttagtttctgctaactgaagtgaatcatgtaaacatatacatatatccct

SEQ ID NO: 4284 - DNA, 600 bp, Bovine  MMBT17512
agttcctacataacattgtattgaatttcagaatatacacatattcatgcatatatagagtgaaatatatgtataattactttcaatttcacatcctaacagaggactgggatcagccacagttcaatctgtacacttgatacctggacaccagatgtctttagaatggaaatattttactcagtgatttctttaagagagagtttatgttaccttactctcaccttcaatatgaataagaagagattgagaacatcaaaggmggtgataactccttttgaaatgcagcacactttgttytaaacyctctgacagrcagccaatccttattaaaatcaagccttcaagatactgtgaagytgtccttctctctaggctgttttatcaaatttggttcaaaatagttctgaaacttttcatggatatagatgtaccctgtatgtggtacagtggtttgggtatggataagatgcacccggctttctgggaaataggccaagcactggcttaaggggaccactstaaggacttttcttgcttggctccttgacaaataggatgcctgcttgatcaagacatggtgcaatattgttgctgccc

SEQ ID NO: 4285 - DNA, 600 bp, Bovine  MMBT12124
ctatgggctaaaaacttactgcttagaacagtatccacctagcctattgtaagtctttagtaaatgttagctattgctgttatctaaagataaagccttaattgaccattattgagagtatcatcaagctcactgaaatggaaaacagtgtataactcagtgattgtttttttttccctgtgttgtaggccataaaatttcctttttaatttaaaaaataaatgtggagatctttaaagatttgttcttattttcctaaagatcctgagcacaggtctccttccttatgaagatgatggrcttattgtcctgaaaattactgcttatcatataacttgatagttcctcattgaaccagtttgttgaatttcttttctctcttttcttgctactcatttgtggagaagtacatactttaaaatttatttcccactctggttgtaagtttatgttctctctttgggtactttctcttatttggtggcaagaaatattgaggtcctacagggcagggtattgtttatttttatagtgttattctcttgtgagatgttattcaatttaaagaataaattgcattctgtgtgaatgctgcaaggc

SEQ ID NO: 4286 - DNA, 600 bp, Bovine  MMBT17955
gcaaaacccgggtgactaaagatacttttttttttttwattggattgaaacaatgcaaactacacactgtgtctaaatgtttaatataaacatttacactgaatatatttgcagatcaacagctgctcaaacaaaagcagcgaatctaatggatttcatagttgaagcccccaatcaaaatggagtttacgttcacatagcttattcaattgcacttgtgtatgggcctttgtttcaaaattattatctacttttaatcttcttccaagaaacaatccaaagaaagttacttagttcacrtttctagaccaaatgaggtacagggcaattaattttattcctcaaacaaaatccagctagtattattgatatgcaatactactttgctatcataatgcaattatgctatgtatgctcatttcaactgaacatatacraagacattccaaatgcatctgaattctctatcgctgttctatgtgcaattcaaagcatgtcagttaagggcacttgcaaatgcttagggaccatgcactgaacacttccctttgtaatcaataaggaactccatgaagtaaattggtttataattttgcagga

SEQ ID NO: 4287 - DNA, 598 bp, Bovine  MMBT18261
  misc_feature (1)..(64): n is any nucleotide
nnnnnnnnnnnnnnnnnnnnnnnnnnnnnnnnnnnnnnnnnnnnnnnnnnnnnnnnnnnnnnnnacgctggctgcactgttgctgcggtggagtgacgagtgacaagccagcatctgctctgtgtgcaggaagctacaacctcaccagtgtgctgcccacagctcccgacatggcccagttcaagcagggagtgaggtcggttgccggaaagctctccgtctttgctaacggagtcatgacttccattcaggtcagtgagatggggactgcggtaactgagtttggtggtgggttcgtartttcgaaaatgagatttggaccactctttaattgctagaaaattagrttttatattctcgatttatgtgtttgctacagtgtaacccaggacatcatgaaaaccagaacttgtaatttcatatttgtttaaattttctagtttatgactccagaggaattgttacaggaattgtcatgatcattactacttttctcttatgttaaaaaacaaaaataaataagaacaaagttaaaaattgcccataaccccacccacctcccaaggaaaacgttcattaatattttggtttattctaa

SEQ ID NO: 4288 - DNA, 600 bp, Bovine  MMBT15490
tacttcctatggggcttaactcatgggagctcccactagaagggcatctgtctgactccactctggtggaaggggtattccatggccctcactgcttccaggaccccatggtcattgttctccckatgtatcttttgaaaacacagctctaatttatcatgttcttgtttaaagccttgttgtcttggcagttgctactgaacarcttctacactctctagcctggcagtcaaaatccatatggccccaactcacctttgtagccttccctcctgacagtgtcttcactgtctccctcyrtgcttcagcccaggaataacttgctgctctttgagcacacatctctgcatcttttcatatgctgttccctctgcttagaatgccttcatcccttctccatctggtcaacacctcctgttatgacccatctcggtggtcaccctgtctattgacccctctctgattcttccaggcagagtcactgtgccrtgctgtgtcctggcacgcagcctttgctgggctggcccattgtactgtccctatctgtttccacgcctgctctctctgccttgtgagtaaacagggcaggggtgatcttca

SEQ ID NO: 4289 - DNA, 600 bp, Bovine  MMBT14590
agtattggcaaacatatgtcttccctggacttaagggtttctcatttgtccaatgggaggggatagcctcttggaggaaggctcacatcttctaatactaaattctatcattttaaggtccatcttttaacttgtgaaaacatttttgatatggtactttaaaaaaaagatctcctctaaaaatctaaatgagtacagtgagacatctccgatcaaaaatgacaagaagctccaatctggctcaagtaatgggaagtcccaggcccagttcaagttctaggactggatgacctgttgcckctgggagaagagctcctttcgcaaatctacagtgctgtgggccccagtcaggcagagggaactctgccaaatacgagtatctcaagtggaattccaaatgtggatatctttttcctaagtgtggtgctccaccagttgaattctgatgactgttttatggtgtgctagcttgttattagctggatatcaatttgagatttttcagaacacatatatttttggaccaggctttacaagagatgctgagagtggctaaataccttttttggagagatggggaaagaatcactgaacataact

SEQ ID NO: 4290 - DNA, 599 bp, Bovine  MMBT13958
  misc_feature (1)..(77): n is any nucleotide
nnnnnnnnnnnnnnnnnnnnnnnnnnnnnnnnnnnnnnnnnnnnnnnnnnnnnnnnnnnnnnnnnnnnnnnnnnnnnctgaagaatccccatggaaataggagcctggtgggctacagtacatggggtcagamagagtcggatacgttgagcgactaagtgcaatgcagcacagcatgactaatgtattgaaaggcttttgtagatatattcctgcttacttataaaagtatttctataggataaattcctagaaatggagttgctgagtcaaaggatataatatattaagtttagacagkgatcaccgtactgtcatccaaaaacactacaacaatttatgcttaatgcataaccaagtcactttggaacttttgatgggtgatgtaatctttgtatttcattttccccacttgtaaaatgagaatgattatgcctcaggaataattctaaatgaggtcattgctttgatatcaccatgggtctttaagaagaaatacactgttgggaaatctaaggtgtcattttcattttaattttttctctcatatctcctcaaaccttagttccttttctattttaaccagcagaagaaataaa

SEQ ID NO: 4291 - DNA, 600 bp, Bovine  MMBT21450
gaattcttagccactgggcttgccagggaagtccctgcagcatgtttttaaactctgttttttctggagcttggaggctggagttgctgggaaggcccaggtgcagatttccaacccctgatccttagaaggatctagatctctagacctccaaggctaggaccttcagagtcttggacaggccatctcttctggccagtctagaactctcaccccatcttctacacaaaggctggtacctttcatgggaaccacggcagagagcatggggaaggagtgcaggcctgggagtcaggcttmagaaggagagggtrggacaagtggagagagtagcctggaaacatatatactagyrtatgtaacatacataggcagtgggaatttgctgtatgactcagggaactcaaaccagggctctgtggtgggatggggtcggaggtgggagggaggctccagagagagggggcacatatctatacctatggctgatccatgttaatgtagaaaccaacacaatattgtaattatccttcaattaaaaatacacttaaaaagccacgtgggttgtaggagtcaatgaaaagtcattactttgacatc

SEQ ID NO: 4292 - DNA, 415 bp, Bovine  MMBT22075
ggttggagcttgcctgctccatcagatatgcaggttcaggccagcaaggctgctttgaatgcagaagtgtcctgctgtggatgatamattatacgatcatcctattcttagcccaggggcctctgtgcattgaactgtctgcatctgctttgttttaaccacagtaccaagctttacaataggttggcaataggattctggcagacagagtgaggrtgaggaaaaatggaacaaaaagggaacagattgagaacaggtagcagagaaaatggtagggatggggaggaaaaacttctaccmttcttgctgggccccctgacctaggtagacccgctagggaacaggagtggacccaagaaacttacacgctgtaaggattacaggaagctgattctgaagacactgcgacccagct

SEQ ID NO: 4293 - DNA, 600 bp, Bovine  MMBT17346
ggcagatgggaggggggaaattctcacattttttgaaaatctcacatgcatacaacttgcattaatgttttaaaacacacattggctataattaataccacaaagttgtgcacatctcacatactgcgctgacccaactgtgagaatctgaaaacataagtttcacaggaagaaaccccgcctctctggggtcttaaaggaaggattctttccaccatgcttccttttgtcatgaccttagggtttctcttttttttttctatttgtgatcttgcatgatgttttaatagtacttaaagkcagtaaaagtccattctgcagttcaaggccaaattgtactaatacttttaatgctttggttcaatctaagtcgacagtgtgggacaatctactactaacatttcatctgcccttcagacttctcagaagtgcttttctggaattgtgttctgataccagttgtactcatagtggaagctcattattgtggataatctttggttttctttttttaaaaagtttttttgtaattaaaccccgttggatagcactttaaaaaagtcttatcctttacactaagttctacatataacttgaaat

SEQ ID NO: 4294 - DNA, 600 bp, Bovine  MMBT20130
aagcttttttaccaaacgcctatttttagatgacttctgcatcaaactataccatttcattttttttaagagcaaaatttcattttaaaaatgtctctaaacgtatgttcaagcytttgggggaataatccagctgttttgctgagcccccctcttttatttttttcaaggttgcacatgtacaaaaagtagattcactttgttacataaaggatgtactttgggaagactggagctacttctagttagcaagttctttgccacgcaggtaacaatttatcacaatttggcaagatacastttttacatttgaggttaagaaggaatgtagaaatagctctgggcagaaaggaaaggcttgcatggaagtatataacctgttgtgatctgatattttactccacacccatattataaataaacacaactgggaaagaaatcctcccaacactctctgcgctaaaactaaagcccgtgtgctatattaagagaagtgggatatatgtttgcatttgtagggatgggctggttgggtggttttcatgacaaaatgcttgctttcctttccccaccctcaaaaaaaaaaaaaagaaagaaaga

SEQ ID NO: 4295 - DNA, 600 bp, Bovine  MMBT22370
gaagagctacctctctggatgtctaccacacttcttagaactctgaagtaaatagtttatgcaaatacggccaagccaccccacctgagatgaggtcctcggtctggccaacaaaggaagccaggcccagcacccagaggtatttttaacagggtggagatgtgcgctttgcatattttgccttcttggcagcttgtggttcaaggtcccaaccaaaactaaatgtgtttacttgtttgtttagacaggtaagatctcacagtctcacaccccacagtgagaacgccttctctaaactgsagacaaaggctttcctcaaaacactcatttggttactcagtttgtgctgaagcctttatcctccaggtcgcatgagggttggcctggagtgtactgcaaagcccccatgtatgagcccacagaagcctggttctgtcagctctaagtctctgagtttctaagtgagagggcgttctggggaagcagggatatacggtgggcggttctagccctctcaacttctggagatgtcgccgcttgatttgttaagcggttttgttaaagggagcctgaatgtaactgcagagaggaggaagttga

SEQ ID NO: 4296 - DNA, 600 bp, Bovine  MMBT20748
ctattgcttaccatttaatcatcataaaataaatccttctctcattaaaaaataaatttatctcccctagcgatcattatttactattaataactttctaaaaacgaagccagtttttcctctggtttacttttacctgtctgttttattctatagaatattgtcataataattgaaatctttttctcttattcttattcaattgagctctgtgtttgttatctgcagcatactaaaggtaggatctttctaattatgaggccagtatttctgtactattttcctcattgtttttccaastgtgccatgatagaaagtgttgacagaagatggagcaaagcmgagtccagtttatggctcagtggaattgcattatagcagtaatttctcatattggaatgtaaaagcaaagtatgactcagaatggactgagaagcagctgtctagcacagggaactcagcttgrtgctctgtgatgacctagagggttgggattggtggggagggagggaggctcaagagagaattgatgtatgtatacatatagcttattcatgatgttgtacagcagaaactaacacaacattgtaaagcaattat

SEQ ID NO: 4297 - DNA, 598 bp, Bovine  MMBT21204
  misc_feature (1)..(81): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnncctggtgtgcactgcgcgtgctctgagccacttatctaaccatctatcaccattagacccttaggatcattccacttttttatttttcaaatgctgtgattgataccactttttaaaattttcccraaaagtctttgtgaggagaggatttgcaaagtagaagcatgaacatgcctcgccctgaaactattcacccaagcacagttgygatcatattgsccacagagctgttcgcagaccagaattaaatcctgtaaaattacactgggcagttgtagaagaggaaaaaacgccctggaaatagctcagaagtattcarattagaataattttcataattaaataaaatttaatttttcattcctattataaaagattatatcaggtttctcatttcttggaaaatcagagagaacttaataacaaataccataattatctgcaaagactgaaccgtgattaaattatcaggtggcagctcctcctaaaactacttcttcaattagctaaagctggc

SEQ ID NO: 4298 - DNA, 598 bp, Bovine  MMBT20219
  misc_feature (1)..(11): n is any nucleotide
nnnnnnnnnnntgatagagtaaacgggaaagctcagtgtgcctgtgctggcaagcccctgctgtcagccccctcccctcggtgggactgcttgtctctgaggamgctgtgctgccacagcaaatggggaaaacacccacatggctggagtccagagcaccracttacccagtgaactgttctggataccctcctgcttattcacatatcgagccacttcrcaagtcttcctgataaaccccataaaggctttccaaaagtgtgtgtgtyccaggaatgattgtgctttctcaagtgtatsaaacatcctgcaattaaaaccaatccagaaaaaacaacttttaataatgattttccagaaggtcttatcacaaactcatctaagtacaaatatatacaaatgtctgacagtccgattatacaggacattagaacctttgaaatcgttttcttatttatgaacattccgatcctgatttgcaaaatgaggaaaaattattttatggaaatacataaaacataagacaacaagccaagagaggagaaagtgggaaattaaaggatatgatatgaagcgagttctgagttacaaaaaacac

SEQ ID NO: 4299 - DNA, 600 bp, Bovine  MMBT22548
agaactcggtaagactctgaaccgtggcagagaccccggaggtcctgaagttgggtgtccccaggcagatcggggacctgccctgtgtctggcctttctttcaattgggatcgtgtcttccctgtccagtaagaaaagacttcctaaactgatagacagactgttgtcctcggagctagtgagggctgtggggtgcataaggtgcaccaggcggctccaggtccccttagaagcgtggtgtggggacgaggggacaggcagatccaygtttataggtgtttgtggcaaaacttgaattgsctggcataggggagccatgtgaaaaggtggattcagatgatggcctttgatggtgtggggaaacatttctggtataaaaatgagcaagaaaagatacaaacccgtggcatagtatgaccagattttgtaaaaataccctgggagcacgcttatctcatgatggagaccccagaagcttaacaggtggagtttctgggtggggttcttttcttccactttttctgtgtttgacacatttccaatagcagctcacatttcttttataatcgaggcacacagtgtggaatgtaaagagccgtg

SEQ ID NO: 4300 - DNA, 600 bp, Bovine  MMBT22072
ttggatgaccttgcctcatggaattcctggtgtgggcaggcttcctaaatagttgccacattattccattttacacatcagtttcaacatatacaaatattttattcagattttatagatattgtacaatctgacaggattttggataacagctccttgagttttggggaaaggaatgggggaaggtagggccagtatatttatgaagtaaaaatacagaatgaaataaatattgcatgagacctacttatatcctcaaaaagttgtttatctgaaattcaaatttaactggatatcctrtattttatctccccaccccagggagaaggagagtgggaaggtcatcacaaaaattaatattaaagaactgggtagattgaagcagtgttccaaattaagagaatcttggtctgtaatgagattcaaggagtgctctgccaatgacctaggggttttaggcatctgcctgagaaaccaggatcttagtggatggccaaagagaactcagggagtgtgtgtacagcagaggattgacgctgatgggttgtagagaggcgctgactacagaaggtctagttatagaccagagcctaaaaagcc

SEQ ID NO: 4301 - DNA, 600 bp, Bovine  MMBT19312
aattagttgtttaaagtcatgtcctattttagtttccttcctatttacatgttggctttcttatttacttctcctcgagtttcagtaagcgttttctcttgttgccaaaatacgcagtcagcaaacctttaaaataattcatagtgtcctttgtgttgaatccagtcctatccagaggcatccctaccggggtctcygttcttctgcttcagtccctgcgggtttctctgctgcacmactgttactctgggactttgttaactcctgacttgtcaccrctgctttgtgaaccttctcttyttctctttcatagcttatatcctcattgtactaggagtccttgctttagtgtcttcctcagaaatgatgtgtgggaggtaaattttctgagcccttctttgcttaactttactttcacttaattggtaatctggctaaaactctagtttcaaaatagcttttccacagaatttaaaaatcagtgctcttttctagaactcactgttgctgttgagaagtctgatgccagtctaatttttgttcctttgtaactgttcggtttttatctttgaaaatatttaggatttctcctaaaattgc

SEQ ID NO: 4302 - DNA, 601 bp, Bovine  MMBT21015
  misc_feature (1)..(1): n is any nucleotide
ntaatcgaattgcattgatactccaaacaagagtttcttctagataaagaatgacaagcaaatgccctacagaatgacaaatgttgcaggtggatctgatagggaccatctttacaaggagaccaagttagctgaatactttcggcttatactgtgaataaggatcctcagaaacaagtccatttttctgatcctcatatgtaatcttyataaataaatatttctttgctttacatctgygtggaaaatttgcctcctacacaagccccaccttccagccaggtccaaatctctcactacyaatgttatcattatccttkggagtccagctgctttgggttatgaggattttttgcaaatacgaaccraagggagcaaaacataaagcacttccatttttttccttcccatttccccaagttaaataacagtttattctgcaggctttcaaatcactcccacaaaattggcaatccaagacaatcgacacattcatgctaatccacccagaagtaaatacactgtggtaaaactgtgacatttgcaaaggccgtagctccccaattactgaggaattaactagggatataatgagggaggg

SEQ ID NO: 4303 - DNA, 600 bp, Bovine  MMBT21599
attgatctgctaaatcctgggtatagaatgtaaggggtctcaacacataggaaggacagggagataggaaaggaagcagagcggctttgagaagaaaccatgaaagaaggacatacaactctggagttgtgtggatatatgctctctagaaagtggagtaaatgtagtgccgagtcctgcagagaagtgacccttgcaccgccaggagaaatagtgccccccaccccacccagaggctcagggctctcctttcataggcagaatagaaaagacacaattctgagggattctttcattcaycaacaaatattccatagtaacgcagcagtgaataaaacaaacaaaaacctctgccttcttgaaacttatattctagtgcrgcagagaaaatccagtaacatgcaaaaagtagtatttcatgactgtactgctgggtgtgctaagttgcttcagttgtgtccaattctttgtgaccctatggactgtagcctgccagcctcctctgtccatgggatttcccaggcaagaatactggagtcrgttgccatttccttctccaggggatctttccaacccagggaccaaacctgtgtcttttac

SEQ ID NO: 4304 - DNA, 598 bp, Bovine  MMBT18877
  misc_feature (1)..(72): n is any nucleotide
nnnnnnnnnnnnnnnnnnnnnnnnnnnnnnnnnnnnnnnnnnnnnnnnnnnnnnnnnnnnnnnnnnnnnnnnagtaagtgaatgttagatcgctagaaagatcataatatttttgagtttgaagcaaagaagaaattatgaaggaagggttcatggtttcatacttaattgaaaagaaacatcatttatttaacttaaaaataggaaaaccggatataaattagtgacacattaattttytgatctactggaatttgtgtggcctgttttattttttgcaccttgcacagtgctcggcayataggaaatgttcacactagttatttgttgaacaaatactgcaataattaactaaatagacttggattaattatataagacaaagaagtgaccctagggtccaattagctagttgcaactaagaatgatgagtgaaaactaatttctttggcccaaatgcaaaagaaccatgcaggaggctgtctactcagtggtgggatgggaagtgatgggaaccacaggtgggctgtgtaagtgctatcagaccaaatcatgtcacacaataagcatcagctgttacagggtaatagcagccaac

SEQ ID NO: 4305 - DNA, 600 bp, Bovine  MMBT20368
attttcactttgttagtcaaccatctcctctaatcatcttgagagttcattatatcaaagagtaaactgattactaaaaatatggacatcatagcctcaaaaacattggattctttaaaaactgcacactatatataggcaacaaaacaacactttagaaatcatatcccctggtatggcatcacttttaaaaggttttaaagagttcgaataaaaaatctcaagcacagatccttyatgtttcccatggacaaaatgctattctttctattaatttcatttggctaagaatacatggcyaaaatgctcctcgcaacctaatgctttgtggttaagtgatatacttctaaaatctactcagtggcaatttttaaaattagtacaaaatcttctctatttaaagataggaagctatttcagaggaattctgtaataagtttgtcacatcacaccaggcattcaactctaaagctatattttacacttatggcgcagcaatagcaattggcaaattacactgtttaaaaaacattttcatttttgaagcaaaaatatcatcaaatgaattatttatacaggatttaaaatatttctaatttt

SEQ ID NO: 4306 - DNA, 600 bp, Bovine  MMBT19155
taaaaataaagcttttccaaccaaagacaccttccatccagcagcaccaagacaatgccgtaataactaaacacagaggaagagatagaataaggatggtttttaaaaagtagaagtggttcttaaagattagaagatatgtgtttcaaaaactgggcttgagtgaagccatttgaatgcactgattgtttatattagcactcacataccaaaccctattttaggtgttggggatacaaagattataaagcacaatttctgacttcaagaagttcagtcttaaggaagcaacatgagccyttttaatcaatattttctatcaccacctagtcaaggctgaaattgtgaaaacagagaaagaggaagcaaaaaagaatcaggacaaagagcacttttgcctcacaaaatcgaaattakgggaagaagaaggtgctgattctttgctgaattgaggtcacttattaggtcatctgaattaaatataaacatatatatttttgcaaaatcagggatgggcaatatatggtgtttactcttcctgtccctagtacatcagagtaccttgtcctcctgaggtcacaggtggctttaatgtctttt

SEQ ID NO: 4307 - DNA, 600 bp, Bovine  MMBT21453
atggggtcgcaaagagttggacacgactgagtgactgaactgaactaaactgtacctgttttgtgtctcatgagcttctggacctgaccttttcccaaaacaactgctttggagatttcatgcttaccttggtccctggctcctttccctgagggccaccattggctcctccactgctgtccattctatatgggaggattaggccccatgccagttaagttattgcaagacctagaaatccttcccattgagggctyatttgcctatcagtcctacctggcgcataccactaatggaaayrgaaaggggggatttccaaccaggacccttgtaattgtggccctacttcctatggggcttaactcatgggagctcccactagaagggcatctgtctgactccactctggtggaaggggtattccatggccctcactgcttccaggaccccatggtcattgttctccckatgtatcttttgaaaacacagctctaatttatcatgttcttgtttaaagccttgttgtcttggcagttgctactgaacarcttctacactctctagcctggcagtcaaaatccatatggccccaactcacct

SEQ ID NO: 4308 - DNA, 600 bp, Bovine  MMBT22130
tgtcatggtctgatactacagtttcacacaggattcttcccattgtctcagttcccatagattgctcttgttcagtcgctaagtcatgtccaactctctgtgaccccatggactgcagcctgccaagcttccctgtcctccactcttctcccagagtttccacagatacttggtgtaattagtgtcccatacaccgttcacttctgaattatctttggggtttagatcctagatattttgctaccaacaatgagatagaaacattggcagaaaaaataacaaacatggagaagaggaaaygaatatttattaagtactccccatgtcccaagcaacaacccttttatctagagtgtctcatgaaaacccaatagcaactctaaaaaggtggtactattattctcctatctggatgaggaaccaggctcagaaaggttaaattacccaccccaagtcagagaactaaggagacagagagctgggatcagttatcaagtatgcctaactctgataccgacttgggtagcattggtagtacttgaattctttcttttctgaatttgttaatattctacagtttgtattataaaaacattacag

SEQ ID NO: 4309 - DNA, 587 bp, Bovine  MMBT21791
ctgccctgctgctctctgatgttcccttgcrtgtctgttacaaatggagttggtagtaaatgtagttttcaaggtagcctgacatcttacctgtataacaagctgccacggaatragctggcaggcagtgaaggatggggtgccctgagcctccctccctcctctcccactctatgttcttattatgcagaagggggtcatgaaaattaacagaactttattcaagtgtagagacagacagctgataaattatacacctgcctgggagaagacagaaaatcacaaggtcatgacagaacrcagcagatgaatggtacatcaaggtcaagagccatgactaggtgagcagccatatgccccctctgcytctgaaaagtttgcttttccacagattcaaggaattggagcattggctgcaccagaaaagagaacacgctgtgggatggataggtgatgtcatgccaggtagatgtctgtagtgtccccaactccgaaatgtaaggatctaaatcctcctcaggacagatgtaggggcaatgtggctctactgagttgctctgtgacttgctatagaggaaaataaacag

SEQ ID NO: 4310 - DNA, 601 bp, Bovine  MMBT21790
  misc_feature (1)..(1): n is any nucleotide
natcactttgggacatgaagaaggatgattcctccatgaaaccaccatggaagaaaaactgacacctgggtttctactaactcctgccagcatttttaaatgaaygcacacacaaatatgttctgacagttgcaaaaaaaggataaataatgaagtagatccagaaaaagatatcatcygctaatcctgccctgctgctctctgatgttcccttgcrtgtctgttacaaatggagttggtagtaaatgtagttttcaaggtagcctgacatcttacctgtataacaagctgccacggaatragctggcaggcagtgaaggatggggtgccctgagcctccctccctcctctcccactctatgttcttattatgcagaagggggtcatgaaaattaacagaactttattcaagtgtagagacagacagctgataaattatacacctgcctgggagaagacagaaaatcacaaggtcatgacagaacrcagcagatgaatggtacatcaaggtcaagagccatgactaggtgagcagccatatgccccctctgcytctgaaaagtttgcttttccacagattcaaggaattggagcattggct

SEQ ID NO: 4311 - DNA, 601 bp, Bovine  MMBT21789
  misc_feature (1)..(1): n is any nucleotide
naatagtttcaggaggtttctagtctcatgccttccctagttggctcacctgatgcttctggctttctggactcctgtgggctacatcactttgggacatgaagaaggatgattcctccatgaaaccaccatggaagaaaaactgacacctgggtttctactaactcctgccagcatttttaaatgaaygcacacacaaatatgttctgacagttgcaaaaaaaggataaataatgaagtagatccagaaaaagatatcatcygctaatcctgccctgctgctctctgatgttcccttgcrtgtctgttacaaatggagttggtagtaaatgtagttttcaaggtagcctgacatcttacctgtataacaagctgccacggaatragctggcaggcagtgaaggatggggtgccctgagcctccctccctcctctcccactctatgttcttattatgcagaagggggtcatgaaaattaacagaactttattcaagtgtagagacagacagctgataaattatacacctgcctgggagaagacagaaaatcacaaggtcatgacagaacrcagcagatgaatggtacatcaaggtcaagag

SEQ ID NO: 4312 - DNA, 579 bp, Bovine  MMBT21241
tggtgcgtgaaagcacaaggtagccagtatagtgggcaaggtagaaaaagacacacccaggtcattgacagacagcagagataggaagtagtacattggctggtgcaagctctgctcctcctttatgatgaagagaatgaggctgttkcccagaatggagacagcatacagcagcaagaggagggctgctaaccaatgctccagtccctccatctctgagaagcctgttaaggtgaagctggtcacgctcaagatgttagtttcaaaacttcccatggagtccctgagtatcttttggaraaacacaatcagagtaaagtgaggtcagacaatggaaagaatggtcactgtccagaatggaagggacaaggctacttagattgaacaccaaagatcatgaaaaattagaaggaagcaagctaggtatcattgctcacatctcaggccttctgccatctgatcatttctatagttgggtcatgggctccaattccttccccacaaaaatcctttgagtctattttgaacactgtatcatattcttcctgtttctgtattctttgcagaaatattaaaatc

SEQ ID NO: 4313 - DNA, 600 bp, Bovine  MMBT19313
ggattcactttaagacttttttaattagttgtttaaagtcatgtcctattttagtttccttcctatttacatgttggctttcttatttacttctcctcgagtttcagtaagcgttttctcttgttgccaaaatacgcagtcagcaaacctttaaaataattcatagtgtcctttgtgttgaatccagtcctatccagaggcatccctaccggggtctcygttcttctgcttcagtccctgcgggtttctctgctgcacmactgttactctgggactttgttaactcctgacttgtcaccrctgctttgtgaaccttctcttyttctctttcatagcttatatcctcattgtactaggagtccttgctttagtgtcttcctcagaaatgatgtgtgggaggtaaattttctgagcccttctttgcttaactttactttcacttaattggtaatctggctaaaactctagtttcaaaatagcttttccacagaatttaaaaatcagtgctcttttctagaactcactgttgctgttgagaagtctgatgccagtctaatttttgttcctttgtaactgttcggtttttatctttgaaaatat

SEQ ID NO: 4314 - DNA, 520 bp, Bovine  MMBT21797
ttcaaggtagcctgacatcttacctgtataacaagctgccacggaatragctggcaggcagtgaaggatggggtgccctgagcctccctccctcctctcccactctatgttcttattatgcagaagggggtcatgaaaattaacagaactttattcaagtgtagagacagacagctgataaattatacacctgcctgggagaagacagaaaatcacaaggtcatgacagaacrcagcagatgaatggtacatcaaggtcaagagccatgactaggtgagcagccatatgccccctctgcytctgaaaagtttgcttttccacagattcaaggaattggagcattggctgcaccagaaaagagaacacgctgtgggatggataggtgatgtcatgccaggtagatgtctgtagtgtccccaactccgaaatgtaaggatctaaatcctcctcaggacagatgtaggggcaatgtggctctactgagttgctctgtgacttgctatagaggaaaataaacag

SEQ ID NO: 4315 - DNA, 600 bp, Bovine  MMBT18604
tagtttttaatccttagaattttagcaatattttggatagattagtggttctcaagattagttgcacattagaatcactttggaaagtttttagaaaaaagtaccagttcctgggcttcacttgtgaagattttggtttaattgattttgagggtgtgtttggcagggctgggtgttggtgtttctggattttgtttctaattcttkaaatcagtcatttttggcaccagggactsattttgtggaagacartttttccacagactgagatggggtttagggatggtgtggatggtttykagatgattcaagtgcatacatttattttactaccactgatgtgacaggargcggagctcaggtggtaatgtgagcaataggcagtggctgtaaatacagatgaaacacctcctgctgtgcagcccagttcctaagaagccacggacttgtaccaatctgtgaccyggaagttgtgaacccttgcttccgatgattaaaatctctggctagtcattaaaatctaaccactggaatagatgccccttggaatcctgtataacttgaactacttagatatagtccttatgtttttaggtatca

SEQ ID NO: 4316 - DNA, 600 bp, Bovine  MMBT19247
taacacccgggttgcctgctcctgagagcatctgcatcactaggacagtttgataatgagattttgtataaaagaaatggacattttttgagagaagtcatgatgtaaagtgtattcttagtaagacatataagagaagctgaaataaaatccttgtaaatttcagtggtgagactatttccagaattagagctctctaattaatgattttttggaacttgttttaatygaagtcctcatatgtcaactcataattttactgggacytataatttgcaaagtgcttttaaaatttacyckcctccccccaaatcctatataataaacaactaatttcttctgagataatttattcttagctcaggctaagaatgctgcttaaagttttatgaaacatctacaaacataacagatcatgcycattttcttagcttttattcttactttgttcccttggcctcaaatccataatttcctgagggcatttcagtgcactttaccttagagaaaaactagttaactacgtcctaatctcacgtcatgagaaattcacaaaccccttccagtgaatgcagactaaatgctgtatctggrgatcct

SEQ ID NO: 4317 - DNA, 600 bp, Bovine  MMBT20797
acatgactctccaaagctttagaaataagataacttgagtggctagcagagtcaaaatctttcttaactatgagaacaaaattcaactgatacttgaacaacactttctacgccatttgcagactaaatttttacaatttaaaaaattatgtaatagctgaaagtagattcaatttcaaaacaagtaagtaggttgtaagtaggtttggaaaagatgactagcctatgctttcacttttgctaccttgtcccaaaggatgcaaataataaagttaagcattaagtraggagaaaactttkggccctgtgtttaatatcattttactgttttgcttaagtctatttttaacagagtactcataaggttggggttttcctaattccaaactctttaacagaaaacagaaaccagttaagaatagaaggctctatttgtcctgcttaaggggaaaaaaaaatacttttgaggaaacagatggtatgtagctaaccctaaccacgaaagagaagtgttgccgaacctcagccttggttcatcaaagttgaatagaaactcggagacagagttttgggtgaagtagaaaagagtcaggaagcaac

SEQ ID NO: 4318 - DNA, 600 bp, Bovine  MMBT18600
agcacaaatgttycatgagtctctgagttcattcataaggcagatctccctaatgtcatattcattcactcagtgaatgatcattaaacctgtacaggtgctgtactatttagattataaacaatcctcgctcagaaggggtcacaatatagtgggaaattacaggagacacaggttygatccctgggttgggaagatcccctggagaaggaaatggctacctgytgaagtattcctgtctgggcagaggagcccggtgagctacagtctatagggtcacaagaattgggcccaacttakcgaactaaaccaccaccacatagtataaataaaaatcataataaaacttgattatgctgtaagaatattgtgaattaactgctaaagtgatgcaggagagggagcctgtaattgcctctgactcaggcaagatagggtagcgtcagcctagctcctttctgtgttagtcctacagcaggcctcagagaagcaagaggtaattttggttcctaatttctggttcatttctcagtaacaaactgggacatgttgaaggctatagaaatagatgtttaaataaaatccagtcttttcacccat

SEQ ID NO: 4319 - DNA, 600 bp, Bovine  MMBT16142
tttgcccagaaaaaagttaagatctttcttaggatctcagtgtcactgacttggtccattaaaaaaattcaatgaaatgttaggaagcgaagttcagaaagccttgcatctcaaaccctgggccatgagtgtaataagaatatgaataacactaatactgtaagaaaacatttatagggctaagtttcttttaaacccactattggaattttataaataggaaccccaagccccaaaataggaagtcattttatcttttactgacatattctgatcaaaacagtggtgagaatataagtkttagtttttatcctgcacttaggagaaaaaaggttactactacaggactgtgtacctcaatgttataaaccagcatttgtgaagaaatgttcagtactaatttcaaaacaaacatagtgtttgaaagcaaagcataatggtgacctttctcattagctgttgctcaaacaaagatatgttccagcaatatccgatgcttccttcctgccagggcctccaccctgtgcaatttaaaacacttgtgttacatccaaatcagagctgaggatgtggtagagctgagtttcaacagcattgtgt

SEQ ID NO: 4320 - DNA, 600 bp, Bovine  MMBT22183
ctcctctgacaaatggaatttatttcctgccctattggtaaacataggatgtcacagtcatcagcaattgcagccaccatagacagtgagctggtgatccctgagggaactcagcaagaaagaacacctgccatctagcagccatcagactgcagccacttcccatggtgagccctggagaaactcaggatatgaaaatacaggatactggccccagatagctggggtgcatatcaaaggaatgatttcagtgagcccagactcttgcatcttcccatgcacagaaaatcaccaaactcyttaacctgggttatctggttttctttcattaacaactgttttttgatgttagaccacctgccctttgttgcacaacttctatataacctgacttctccccttgcctccttggagcagttctgtcagttacttagatgctgcctcctaggcttgaagtcctaaaaacacccacctaatgaaacctaactctcaactttgaggttgtgaataagtccacacctccaataragccccatcaagrcccagaccccagggaggcaaatggagacctctgaccttcaggccacgctggaaggtgga

SEQ ID NO: 4321 - DNA, 542 bp, Bovine  MMBT00737
tgtcagaaatgttttaatggattgcagtagtggttgcagaactataaacaactgaaaaccattgaactttatgttaatagtaggtggattattctttaataaaacttttttattttttaaagctgttttttaaaatgcaagtctgtaattattccataactctagggttttgtcttaaaactcaatagatggattgattgaatgtttatcaggtgttaacatgtcctattaagataacttagcatcaacgtacatcacattctttgtgtatgaggaattagcctcatcagataatgaagwagaatggttgtattctgctacaaaacacaaaagttttgtagtacaaaagttctagactttaagtgactgatttttttttcctctgtagctcaacagagcattccaagaggaagactctccagctactttttattgcatcagtatgcaatggtttagagaatgggaaagttttgtgaagggtaaagatggaggtaagtgtttaacagaaagacaaaattctttgcaaattttttacttgacaa

SEQ ID NO: 4322 - DNA, 600 bp, Bovine  MMBT03234
gtgagtctctattacagcccctgccttgtctttccatccaggcagaaaggacaataagtctgctttgggtgacaagaatctttcagctgcaaaagtgtgaaccaggtctccttcagcatctcctctggactaatcacacggtgcccggccaaagagggttttaattacacaatttgcagaactggcccgccttgcagatggatttgaggtcccacaccattgaatggaagggagaacattacagaagcacagccaaatcaattctagtttccatccaatatgagcatctcccagacagcrctcacattaacacctgtgtctacttcaaattcaacccatttatagaactccttctgggtcagatgccactgatatgataaatgaagttgtggaacagttgagaagtgaatatgataaagtcctatcttctttaatgctagcagccctctatctaaaagcgaaacagtgcaggttttaaaaacaacaatttagagccaaatcccagatcctcacttgctagctatgaccaggaaaagctcccgtatctgcataatggatgtcatagtacttaccggccagatgcaagaagctcaaaaacag

SEQ ID NO: 4323 - DNA, 600 bp, Bovine  MMBT09767
gtgaatctgggggttattttgggaaaaataacctactgtgtcatccagtaattgattgacatagtacagtgtacatagaacatggtcagtaaatacttgatgagttgacatgagagggagttagggcaagggctatcaagggtgacctgtagcttggaggaactcataggaataggccatcaaaggagataagttttaaaatgagagtatggctttgttttttggagggggtatcatgatgagcttgaatgacagaggggcaggcaagataagatcctccataagtaagcagaatatggrtcaggcaggactggcaggagtggatctgggagtctcagcacagagctgagcatgagagaagatgggcctgcaaagccagaggtatagaggagtatcttagtagatgcccccagttccggaacggggagcagggataggttatcaaaggacagaattggaacctgagacagaaggaactctggaatattttagtaaaaactgaggaaggagattgcttcgaggaggcatagggtgaggcctgaggcaagaccacactggcttttgtcaggaggaggtctttgtgggagaccagtttcagtg

SEQ ID NO: 4324 - DNA, 600 bp, Bovine  MMBT14461
agagtaaatcttgctattactattgatcatggttttatgcactctggtagatatcagtaaggcattcctgtaactctctggctggatacagaatcagacacaccagacagaatagataagtctcaccatgaagatcaaatgccaaaaagcagggtaatggagtaaaggcagccaccttttaagaaagtaccggctgtgaattgctcctgaagaggggagraaacaattcacatgtcaagtatggtgtgagcaaatcaatgggagcaagaatgagcacatgatcaggagtccttggaattscttggctgaatccggaggttttcctattgggtgttaagaataatcgattaagcagtgggaggtaatggaagaggttagaaagttgtcagaagcctcgagaattcctctacgtgggtgacaagctctctggattcaactttttcttttaggcttggaaggcccacaggaagtgctctttagaataaactgggaggtgggggtgggagaactatgcaaaatacctccgcatttagcactaaatagtattagttccttttccccctcggagattgaaaggttagtttaataaaggggaagggt

SEQ ID NO: 4325 - DNA, 600 bp, Bovine  MMBT19721
aattataagtgtgtactgatgggttaggattatttttctataatgtctcctggaggcacttcacactgtcatttgttcaaasgaaaatgatgtattcttagagtaaagcatcgattattttacaaaaataattcaggccttcttaatttcaggaagtctatagttatatcattaactctgcagcttcttcatcacatsggttttgaaaattgatttatcattttttwaaattaatgtattttatttaactgtgctgggtcttgttgtgcatgcaagacgtgagagctagttccctgaccygggccccctgcattggaagggtggagtcttagccactggaccaccagggaagtccccccaacttgtccttttaatatcaagtaacttctaagtgaaactgacagttatgaaggttaatttttttgacattttagcatgtattgtgggaagatttaccctgaaaacatgtttaamtctttgctaaaagcaaaagtaagtggcttactttccttgtagtcttaagagatttcttggactaaccttgtgacatttctgtcataggagcaccaagtttctttatatattgccctttccacctgg

SEQ ID NO: 4326 - DNA, 600 bp, Bovine  MMBT00739
agaggtctttatctgcaccagctcaccctgggcttgttagtatctacagttttattttcttgagtagaagaattctcccacccctcaatggccccaagatgtctgaggcactggctcttctcagacttcagcccatcttcccaggaaggagaccaaatggggcagcgggggaacaggatgaatatggtctcatttcggcctacgttcctttctgaccaggtgaggctctgcagaaaatggaaaggaatggagtcagtagccacagatcatgagggggctggttcctgtgtgagcgtccaygtaaggaggtgtccagatggaaagagatgacccaattccagatctcctccttgtggccaagaccctrctcatgccaccaagaaaatcaagacaaaagaagaagggaaagcacacactagccaccatgaacacagaaagcacagtggtgaaaacagcctgaaaaaactgaaaacattaattgctcagttatgtctgactctatgcgaccccatagtctgtagcccaccaggctcgtctgtccatgggattctccaggcaagaatactggggtgggtctctatgccctcctccaggggatct

SEQ ID NO: 4327 - DNA, 598 bp, Bovine  MMBT01593
  misc_feature (1)..(102): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcctaaaaataatatatatgttttccatcctttctttttagtctttggaacatatgaaaagtgtattcaccactctccttgcctctaggtgtgcatcatatgaccagaccattctatcggcctatgttctggccaatggaatgtgggagaaatgaggtactcctttcccaacctgaacccactaaaaaagtcttmcagatgtgaaatttttttctttattgaccccatgtgaggacaacatagtgtcctgtggtggaatgwatctgggtttctaagaaatttggggaaattcttcccaggggtagccacccagccaggaatttctgcattggaattagtgtcaacaagaaagtacattgtacactattgagatttttagcattgtcaattattagagctaactgttttaaccctatataacatatatttttttgatttgtgtgggaatggtgatgaccctcaaaggttgagtacctatgaaggagtgagtgta

SEQ ID NO: 4328 - DNA, 600 bp, Bovine  MMBT04004
ttgcatcycctgctttggcaggtgcttctttacygctgtgccacctgggaagactgaggaagaaggcaggagggcaaaaataatttttctgaaattaaagaaattatttaaaaacytcacttcttgaagaagcagtaaaagaagtatttgaacctatcgatgtaatcatttcaaaayacaaataataaacctgatgagagagttaatcttcatagttaaattataagtgtgtactgatgggttaggattatttttctataatgtctcctggaggcacttcacactgtcatttgttcaaasgaaaatgatgtattcttagagtaaagcatcgattattttacaaaaataattcaggccttcttaatttcaggaagtctatagttatatcattaactctgcagcttcttcatcacatsggttttgaaaattgatttatcattttttwaaattaatgtattttatttaactgtgctgggtcttgttgtgcatgcaagacgtgagagctagttccctgaccygggccccctgcattggaagggtggagtcttagccactggaccaccagggaagtccccccaacttgtccttttaatatcaagt

SEQ ID NO: 4329 - DNA, 600 bp, Bovine  MMBT07157
gtctggtcagtcagcctcccggtgctcagcacaaggacaagctctttaaaaacctctttttctcactggagtgaaacagtcccatccctacccccaagcccttttctgactggctgctctgtccctacagcagagcgatgactcctctgatgagggctcactgcacatagacacggacaccaagcccgcccgcaatgccaaagtgaagaaggacagcgggggttcggccgcgggcatcctggacctgcttcaggccagcgaggaggttggcgcactcgagtacaaccccaacaggtaggyctagtgccctcagggaactggggggactgggtgcttccacagagttgggccaaacagggctccatcagcccatgtcctggaggctggacagtcagagtgggacccctgcctggcagaggtggtgccaggtggccagggaggtgagcgggggctggctatgtaggtccttcgtgttgcagagctcctgtgtgaggagtctgtggggcctccatatctgtgtgcctgcgggaaagcaggkccaggctgggtacctggagggtatcagggtttttccagactgggacgtccagctgtctctgc

SEQ ID NO: 4330 - DNA, 600 bp, Bovine  MMBT11878
atttcatcttgctaagagttatattgatatactatatcaatataaattgtattgatatattatattgacataatagatgtaatattagttatattgatataatactaaytgacaaactctattagtcctgaattttaaaatttaagttctcaagtttcctcagctttccttctaagaagcaatatttctgttattctggaatgaacataaatcctcaagatttctttagatgtcatctatctytgttcctccttacatctcttttcatctgaagaacagagtaagtatgggactcttaastccttcgatagcytttggtggagtggaaakamgccyctctctacatgagccaggagacccagattcaataccagggtaaggaagatcccctggaggaggatgacaacccactccagtactcttgcctggagaatcctatggacagaggagcctggtgggctacagtccatggggtcagcaaaagtcagacacgacttagagactaaaccatcaccaccaccacatgagccagaacagccagtatttccaaacacctgagcaggtaagcagatagaagytgtgcctctcatggagccccag

SEQ ID NO: 4331 - DNA, 600 bp, Bovine  MMBT18595
taagtattcgaatattatctgaaagtgaaaatgctttctctgagtaatcttgctcagtcatctgattgtaggagaacattttgtgtcgcacagttatttgtgtgctagctaacttctggcctgggttatttagtattcacaacaactaatgagatagtttgtgtgcttgaaaaagcagagtgggaaaaactattacaattttataattaactcttggttctttgtagtgttctctttgctaagatactgttattaaagaaaataagagattcttayttgtaaagcctagtctgatttttyctaattatttaaaaccttactatgactcattaatgtgttgcaccatcattttcaattcatccatagtcacaacattttgcattgctatgtctatcttaactgtcattaaatttctttgaccaaaggattttgtttttatttatttaccaagatttatccttttctgtcttggtgtcttctatttgaagctgtttttcactatttcaagagcattaattggtagagcccagtattttttcatttttttaattggaatataactgctttgcaatgttgtgttaaaagggaggtccaagaggg

SEQ ID NO: 4332 - DNA, 598 bp, Bovine  MMBT01684
  misc_feature (1)..(39): n is any nucleotide
nnnnnnnnnnnnnnnnnnnnnnnnnnnnnnnnnnnnnnnctgcacaaattttcataaagcacttgcattttgaaagcatttttgacagagttccacatcagcagtaaatggcagagtgataggtgtgggagtcttggaaaagtggaaaattggcttaataaattagatactgaaagcaagaaaccaaaaaacccagagttctagatggatgacactgcattggcaggaaaggtggatatgtggagactgacagccagaagtaaacagatttagatcattctaagtctaacatacaaaaawggagagagaaagaaagggaaactagtcgactagttttaaattagaattgtgtcccaataactgtctgttagcatacctgttgcccatcattcctttgttttctgggtataccaatgactgacgaaatgaactccaagccaatatttggtgggcaaggtcccaagccagtagcaatgtttctttttaaaccgtaaaatgcacttggatttctttagttaccaagtaaagaagaataaagaagaaacacttagttggcacagagtggcttcatttagaaaacacaaatgaatcttctgcc

SEQ ID NO: 4333 - DNA, 600 bp, Bovine  MMBT03239
ctattttcataatgtcttctaagactgtaatttaccaacatttaatgtgacatgtaaaggtcacattattcttccattcactatacgttgartgcctacagtgtgccaggcagcgtaccagctgctagggatgcagtaataaagaatgcaaatgaaataaatttaacaccaaaggagggtatgatttgccttcctggagttagaggtctaccagaggattagacaagcaatgataatcgagtataagttttctgacagagcaagtgctgggaatcttggcagggttatttctccggttgycaggtgggcaggggcagtcctccctacatattacatatggccacttagaacgcagggcattgggctgactrtcctgattcccagtgactgcagaccacaccataaagtagagaagcatcatgctgttcccagtttgcaggcactgaagcaccttatagcttaaattgccrtataatgaggtcttgtttgtacttctggccatcttgacggatatcagatgggatgcctttatatcaaactaccaggtaataaatattgttctaaaattttttactrtattaataagactatttctttttt

SEQ ID NO: 4334 - DNA, 600 bp, Bovine  MMBT19813
ttaagggccatgtgcccaaacctcactatgggtctggagttgttttacatgaaccactcaaccaccctgacccttttacaagtctacttactgaaacgataaattcggtgggaaaagtattaaatccaactgggttttaaactgttgttctggttgtaccatgtaaacccaacttaatagcttctacagtcaactctggtcaagtaagaaatgtcatactcatgcatacgaatcctctactgggatcttttattcacatactattttcatgtcatccaatgcctggttttcagtttctcycaatgtgatttaagagcatgatattttagatttctaatgcattatgaatagaatgaatttaatataaactcccacttgctgaaagataatttctgtttagaaacaaaggaatttcaaatagacaaaaagaaatgaaactcttaaactctcctctcttttgggtattcctgcaatggcaccccactccagtactcttgcctggaaaatcccatggacagaggagcctggtgggctgcagtccatggggtcactaggagtcagacacaactgagcaacgtcactttcacttttcattttcat

SEQ ID NO: 4335 - DNA, 598 bp, Bovine  MMBT11170
  misc_feature (1)..(113): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagagggttgcctttcctcttccgaggaccttccccactcagggattgaactcaggtctctggcactgtgggcatattctttaccatctgagctactgtggctaatccagagagaagacctggaggtaagacagaaccaggagtggcggttggtctctgagctgcttttggcagctgtgcagcartggagaaaacagtcacaacatcagatccaacacagttatcrggaatgtggatcctgttattaagccaaataccccsagggtgaggcttccaagtcctgggctgrgacctggctgccagcctgcccagcacaagtaaggccccactcaccaccagcccctcttcatctttggggatttagtggccctatggaggatgcacaggggcctgagaagggcacaggatcctctacaygcatgtctgagaagccccaaacatgtgactacgcaaagatttatagtgcaaatgatcatgagtgag

SEQ ID NO: 4336 - DNA, 600 bp, Bovine  MMBT01677
agggaaaagtttgagctgatagtattggaaggaagtgtgtctgctggacagaatacagaatgaaacagtaagtaaacagaatacattccaagctgttagagtcagagtgtgagttccaacctgaaataacaagaatatttaataggccaattggataatcaatgaactcacagaaatggctcattttggggtactcgtatgaccatctgccttgaatgcaaatacagattattactgattacatgtcttataattaaggtagatgagacaggtggaaggtggaattaaggaagggaggcrgtcaggatcaaggagatgctcagcagagctctagttcctgaaaaggagactggcaaaaagcacttgcaccagctgagaggatctggtgcacaatgtaagccatcagaatagggaatcagaagccaagaaacaagataagggtaaaggtatgaaactgagtttcaacaaagacaggatattgagattgggtacattctaaattggrttcctgagtggctcagtggtaaagaatctgcctgccaacrcaagagactcagaaaacacagatttgatccctgggttgggaaaatcctctgcagg

SEQ ID NO: 4337 - DNA, 600 bp, Bovine  MMBT22193
tgctccatccctcacgggctgttcaccaaagccaatgccagagctaggcaagtgaggcactcagggcacagatttaagggggcctcctctcagggaaacacaaaattggccccttgctgttcagtctggatgcccctattttcccatctctgccactttgtggggtgagaatgaaggtcacctcctcaaggaagccttccttgatttcaccaggcagagttttaggttctgcctcgacactgawgactctcctgtctcatgatggatatcaactccagcgcaggctggctcctcccaggragaagctactagaaaggagttatgcttctctttgcccctcagaggctgcagtaaggcccagaacacagcaggtgcttagtgcacttgtagtgaacaagcccagggacccaggggtgacagcaggacaggaagatggcaggaacagatggcagcgtgttagcaggggcgcatacgcatactaccctctgtgctggggcccagaatacgggtgtctcgaggtggagggagggatagggtggcttctggacatgtgaggggaagggctcaccctgggtgtccaggaaggtgctggggccgctt

SEQ ID NO: 4338 - DNA, 600 bp, Bovine  MMBT00830
aacattctctgtatgtgcatcagtcttacaatttattcaactcataattcaacacctactggtaatttgtacattgaaaaaatgattagaaagtatcaggcattatcctcatctctatggaactaaaaaccaaaaaaaaaacataacttcctttagaaaggtgtgaaacaaaaggctctagggaaatcttgcaggagctaattaattcagtctgccacaaaaatgttgcaacatttacattataaggcttctttctgcaaaattagatgttagttttgaagtgttaatatattaaaatayatgcaaattatctcaaatagtcactaactactatggattttcattctgttaaaagttataggttytagctaatcaaatatgcaaacactgggtgatctaaggaaaaaattcttaggcatgattaattgccaaattcttttatctggaagaatctagatgaaamtaattttattaagattatttgtgttcatttaaattggtgaattgatataatgaaatttaagtgggctaaagcatagcaaagtattagtgagaccaaagtgtttactatagttattcaggataaaacaatcccctgta

SEQ ID NO: 4339 - DNA, 531 bp, Bovine  MMBT01716
aagcactgattttatgattttctacatataagtttttagtcattaggcatgctaatgatgcaccccattttttcatgtgacaagaatacctggacacagtaagtaaacagaatatggtttaaagacagcactgctctgattctgaccagtaaacctttaaagcaaaacacaaaatgtttaacctcttttcaacaaacttaattttctctcaaaaatcaagaatatttataggaatgcaaaaatattcaaaatccaacaaagtaagattaataacttctgttatccacttgaaaattaccmaaagtaaaaaggaacaggaaaatacaaaccataatgtggatgaaaactgacacatacctgacagaaatgttagaattagcagacaatggcaataaaacaacattattactgcatttcattttttctaacatttaagaatctatagaaaagatactggaaaaaaattcgacttttgcagttgaaaactatacagtgagaggggaaaatagactgcattaatagtagataaca

SEQ ID NO: 4340 - DNA, 600 bp, Bovine  MMBT07797
ggaaccttgtaaagtcctcagtgaatactgtgtgtgtgcgcacgtgcacacccagtcacttagccgtgtccagctctttgcaaccccatggactgtagcctaccaggctcctctgtccattggatttcccaggcaagaacactggagggggttgccatttccttttccaggggatcttgccaacccrgggattgaactcgcggctcctgctgcatctcctgcattgcaggtgaattctttaccactragccaccagggacctttcccastgaatactgaggagtagcaaaggaaacagcyatgagcccagggatgccaggtccacgtctgtgtccccccaccctgggagctcctgcagtacacctcagtgctagctgctaccttctcatgttctcctktggggctttcaacttcatgctcttgcctctccttcacttctagttctgccacagaaccaggaaattatgctgagaatgcagtttctctttgggaacataaagtaatctgggaaggcttccttgaagaagcagtcttcctccacccagaggtgtcctgctgaccagagtgctccagcaggcgcttgggctgctttcctctcct

SEQ ID NO: 4341 - DNA, 600 bp, Bovine  MMBT17599
tgacaagacaactgggccatrtggtgacaatattaattagacaattgctgctgaagaaggcatctgtacagctctccacctgcttccccaccatactcagttcatctacaacaaacagccaaccggggctgacagccccaaacggtacagctgtagttttctccagggtagtagctccagaagaaacrcaagatgcaggagacctgacagagtcttgggatggaatttgccctctagaccttctttgcaaggctgccagatcattgtccagaggttgaacaccaaacccttagctcaacrctgagggctctctggcagttttattagggaagtcaatcagcaacatggccttaggctcagcaaccatgtagagctgggttcaaattccaggcatgccttgtgctagctgtgcratcttcaactatttaatttactatttgaacttcttccyttacttcgagaacattatcaccttcccagtagactgtcccttacggccttcataagagttaaataaaataatatacatgtaacttctctatatcggctgttttcccctctccttaccctctgaagtgctacccacgccagtcgatgaac

SEQ ID NO: 4342 - DNA, 470 bp, Bovine  MMBT23540
tgatgttggggtcccacaggctgcctatcgcacgggcacaacgtgaccaggagtcagagagaggggcgagcgtgcttgcacatgtgcacgtatgtgcatgcttgtgtgtctgtgtgcatgtgtgtgtgacccaagtaaagctcccacacggtcgcccccacggttacctgaactcacacatggcgtggtgtccttcatcctggggtccttgcagtctgtggattgggaagaggtgcaaccatcagcccctgccttggagagcttgtcttayagaacctctaacgccagaggtaacaaccrtctgctttctgggagyctgtctaaaggcggccccttcagaggagccctagaatggacgctgctatgggtcggaggcccgaggcctgrggctgccttggccacctcaccactagtccctccagaaacttccagatccaggcagaagccccctccccagacttgttctaaaa

SEQ ID NO: 4343 - DNA, 600 bp, Bovine  MMBT03675
aaaagacaaaatcaaaacatttttaataatataaaagaaaacaaatccatataattaaatgctacttaggtgaaagaaccttagagggtatatagcatttattttctccacaaaatgtgcatatcttgaatttaatgtaaaacaccttgtttcagttccaaaggaagaatatcataatatagagttcttgatgaatctagatggaatgaatatttaaatagatcccaaagatcaaaacaagcttttatttggtcattgttctaactctttaatgttcattaaattgattcacttagaaaytttagaaataaaactctacaaccaaagcacagaaaattcagctattcctraaaaaaactaaatgcatagtctttagtatatcattaaaatagtggttgtggttaagcaaacaaatgaataaaaattactacaactcatgtatggtaaagttacaaagcaatacattagaagttttatcagatgtatttgcactataataaaagaaatctggataatagtattcagtaaaatgtttttgattattaaaagaaatgaaattcccaattaaccctgggttgtgttaggagcagtgcatttgtc

SEQ ID NO: 4344 - DNA, 600 bp, Bovine  MMBT04319
gtctcgggctaagcagaggagtgcccaagtaggatgcatggctcatcgcatgtcaacatcagttttcygggcttttkgcgcctcatccccagtcttcatcgatggaaaactgtctgmagaaccttggcacaaaaattaccctgtggattccagragggtgtatagctttttgcagcagtttgggattcctactgaaatcgccttactaacctgacctttaaagtccttgggcgagtggatgagaggatggaggtcaaagaaaggagatgatggaggggcgctcacccattgcttcactgyggcgtgtaagaatacgcaagatctgtcacaaagctgcattctaaaagaagcttcgattccttattagaaactgatcaaccaggttccagagcgctaagggaacgcatgtgttctgaaatcggcagatgggtggaaatcttctagaggtagaagccagagagtgtcatatttgtctttgtatcacctatgcgtgagctacgggaagcactcagagttggtggaaaggaaacctatgggggaggggcccatttttggtaaggttgcctaaaaattcctcacactaattaaataaagagaatt

SEQ ID NO: 4345 - DNA, 600 bp, Bovine  MMBT21564
tctatcagcatgcaggaaatgatattggtgacatatttagtatacctggtcttttactgaacagggagcgaccacaagcatcaaggtaaccaattcctacttttcctaccattaacttcatggctgtccatacaattctccttttccgtaagagggctggacgttccttcatttgtaagacctgagtttatctaatggcacctataattaggctcatataaaaatgtagtaarttgcaacaaatacartggcaccacaggaagtaagctttggagctggaagggaacactgtaatattkytgtcgccaaggacagggagaccatcactagcagaaagtatcttttcatgtccctcggcatcctttgggatgtaggtaggggtcgtatgaaagttacacacttgatgaatctccattcctttttttgaactgacttttagctttaacacatgggcaatttatcttggaagatcaaatggttaatctgcctggactaatgagcacagttctggaatgaagaggttctcactgcttcagctatcattatttcacgtactttaaacaaaacgaaaatcaggccacgtgcttagacgtctactct

SEQ ID NO: 4346 - DNA, 598 bp, Bovine  MMBT02277
  misc_feature (1)..(105): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctgctccccttccccgtctgcttgtgcaaatcgaccttgtgctaattcctcagcagaatgtgctgcttgtccttcagacagacagctccttgttgtctgctccttaatttgtgatcatacttccttgttactttctccttcttcccagatcccatcttagttcctgtcttatgtaaactccatgggtaagcrttggtgagttgttaatttgggaaacaaggcctgcaatctgtggagcaacaagaacagctggtgctgctgctgttcagtttttcttggcagatggatgtagagggaattacgaatggggaaatttgcctcagccttggctgctatttygtacagcaatrtaacattgccagctctctctctctcctatgccaccactcctgcaccacagcctgatactttaatgtgttcccctaacttcatgatccaggtcttcctgggtagcctttgttatatgcttcatgcccartatacctttttg

SEQ ID NO: 4347 - DNA, 600 bp, Bovine  MMBT20643
ccacacaccacctgcttgctgacgtctgtggtgttacagaagtcctgcacgggttacagctgaagatcggaatactcaagtaagtgaagggyggccaagggaggggttcagttaggtgtaagttttaattcaagctaagtcagttgttttttgtttctaactaatttttactggagtgtagttgctttactggccaactggaactgatcatgtccttggtagactccatgcatcctggtatcaggcactttggtgtaccttgtttatgtctgtcttcccttactaagccttgagttcctrgaaggttgggattgtgtcttactcatcattttattcctagagcttagtggagggatgagttctcagtaacaaatgaaattcgcttctgttggatgtcataaacctgaagatgaatttcttcataaaaaagtcacacaaatgctaaaactcaagagagaaactaatttataaagttaggctttaaaaaaaaaatgtggttgtccttgatatcaatatgaatttctgaacatttgtaatttcagtaaagatttcaactggacaaattttgcctcatgcctataggttctgtttatgttaatg

SEQ ID NO: 4348 - DNA, 600 bp, Bovine  MMBT15775
acttctatgtgtcaccttccagaatgggggagggagccacctgacctctgtctgcaggctggtatcaaccatcacaggcagaagaagcatttgctaaaggattagacacaggcagatctatggcccaaaccctcaggtgactcacactctccctgctcatccctgacccctcatccctgatatgggctcttatcctattcccaaatgtaggcctcaccatgtaccccatctctgcaaacagaacctaatatagtctttgtccaacaacccagacttagaaacatgtcaatgattctcctycccccagcacagcaaagcccctctgcctacctgttagcctaattcatgccccctgatctgccargatgcactattccgccaaaatgaactgctttcatacccatcccatttaaattcagaatcatttaacttaagtgaaagtaatccacttttaattataatacagacaggaaatccaatactggagagacagaacataatgagttggaagcactaatctggtatattgtgacacctaaacaaatttatagtgatgatatagacatgattttaaaagtcatcatcaaagaactatactat

SEQ ID NO: 4349 - DNA, 600 bp, Bovine  MMBT03865
ccaataagcataatagaatttatgattctatttggttacacaaataattagggtattcttttaggcaacagagactctaggtatgarccctggagctcttccttccagggagcctggttttccagttggtatgtcgtttccatagatactgggcatatagctcaaagtacacagtccggctcaagatggagccctgctttcaagatggagcctgttctgtttcctccttcataataagtaaggaaatcaaatacatactaacttggctattttggaaagaggagtgatgtaagcatgccwtcaaaagaggttaaaaayatctgtatacacaataaatattgtccaaagtcataataaagaaaaatgtaacatttatcatgtgaagaggaggcaacattatttgataataaaaaatgttctcctccctgaaatggctgaaaactactatcttgttagaaaaatatattktaatggatacagttaatcatatataaaatgaagtattatggcatttaaacatgtacacaaatgtatatgttatataccacacatgttattttgcatcttcraatgcaacagatgtttgcaaagtaaactctg

SEQ ID NO: 4350 - DNA, 600 bp, Bovine  MMBT11508
gttaggtccctaccatttctgtcctttattaagcccatctttgcatgaaatgttcccttagtatctctaattttcttgaagaaatctctagtcttccccattctgttgttttcctctatttctttgcatgttgactctaattcccagaaggctaaaaaattgttgattctagaaagtcttgtcttgcccttctttgaaactcacacagcgtctagcatggtaccctgcatgcagttaaggattcaaaggtttaataaactaatttttacagattatgacaaascaagaatgcagagaaaytggaaccctcatacattgctggtagaaatatacaatgrtgcagctgctgtgggaaacggtggttcctcaaagttaaacacagagttagcatacaatctatcatttctattcctaggtgtacagagacaagaaatgaaaacacgtgtccacacaacaasttgtaagtgaatgttcaccrcagttttattcacraaagctacaagaagaaactcaaatgcccatcaacmgatagataagcaaaatgtggtatattcatacaacagaatattattcagctatgaaaatgaatgaagtactgat

SEQ ID NO: 4351 - DNA, 600 bp, Bovine  MMBT12162
tggtttccgtgttctgagggatgtctccatttctcagattcgcattagtcctaaatgagtgggacgtgctgtctggccagtgcctctgttctttcccttttccttgttggtatccccatagctccgccctctttactcttctctcttcacttattgcattgtcttcgggcaacttttgctactcttgtgccctcaggtaccacctctcgacagcttatttccgaagctatccctataagtactcttgtgtattgaacttggatcctgtatcctttttcccactggcagaagccccatgasaacstcaaattcagcttatccaaaccataatttgtytccttctcaaaacctaattattggtgtgtataccctgtttttgtgacaggcattatcatctacctagctgcccatgctggagccctcggggttattaaggtctgtcgggttctccaggagacaggctctgagatgsagatttgcgtaaaagtggaggtttgcatacaaagtgtgttcaggacctgtytcttgccctccacccaactcgctaaaaaagtaaaagtgaaaaccgttttgttgttcactcatgttgttgtggttgtt

SEQ ID NO: 4352 - DNA, 600 bp, Bovine  MMBT13543
tggaaacacacatttgggagctatgagtggaaaaacggtagtgaaagccttgaatgggtgaagtcactctggcacaatataatgttcaaagagaagattactgacagcaaaagtctaggaaaaactgccatttaagggatgactgaggactgagaaacatcaaggaagatcagaagaataagccgaggggcagtggagcaggaacctggtctgaacaagggttggaaagaagtatatacaaagatatgaatggagcttctcaatatcctggatgaggggaatgagggagtggaagggggwgagaatgggtctcaggtttccagcttgcgtgaacagctggctggccaggagaaggaagatgttaggttctagaaataattgtttgacatactagtgagacagccaggagaagaagtgtgggcaactggaattcagaaaagcatccggatagcagtctagccttggagggagtccacacagtggtgatgcttatcattaggggagaagaagagatggttctggaggagccattagctgagactgcagccctaggaatgctctaatttaaggagcaggcagtggaagaggaaccagccaaga

SEQ ID NO: 4353 - DNA, 600 bp, Bovine  MMBT14820
tggaccacagttcacactaaggaaataattgctgggattagccagctgttcagataattgtcaactctcacattcatttggttcctaaaaaaagtgaaaagagatatttccaaaccatctaatgctcagctaggggaaaaaggaccctgggttaagaatgctgccctgttgtgggaccaggctgtaatgcatcaagccrcattcttcatctgtaagaagtaatcaaatgactcctactcatgagacgatgctacaaggacaaataaatcaataagtgagaacagtctacttcagatccayagtatgtggaactcatggatgagaaaaaattttttttcaaaagcaaacaaaatccctttcaacccctgacacagctgtctgagggtcttgtcaccaaaaaatccttcactggtctttttctttagtgccaayctaattcttatttaacataycattattagagcttcccaggtggtgcggtggtaaagaatctacccaccaatgtaggagatacaagagattcagctttgatcccagggttgggaagatccctttgtataggaaatggcaacccactccagtattcttgcctggagaatc

SEQ ID NO: 4354 - DNA, 600 bp, Bovine  MMBT15430
ctgctgctaagtcgcttgagtcgtgtccgactctgtgcgaccccacagagggaagcccaccaggctccaccatccctgggattctccaggcaggaacactggagtgggttgccatttccttctccaatgcatgaaagtgaaaagtgaaagtgaagtcgctcagccgtgtccaactcttagcgactccatggactacagcctaccaggctcctccatccatgggattttccaggcaagagtggccaacaaaaagccaaaaccttttcaggaagttggcaatctgcttccactgcaaagaaracaggctcactctgtcttaggcagacatggtttctccctcaaaaatcctattcactttttcttgttttaggctatttctctaaaacatcctcaagaagagatcattgtttattttgttattgttttaaacaaaatgccaaagatacacggacacataattcctcaattttctacaggcagattactccttaagaggatrtatggggctcacctccataagaacaaacaagccatgtattacttgtaaatacacagccttttccttacgtccaatctcacattaccgttaccctgcttctt

SEQ ID NO: 4355 - DNA, 600 bp, Bovine  MMBT18212
atttaaaaattaacacagatttgacaaagatatacatataaatttgtgaggcagttgctagaatatttacatatttgttactaatatttaacaataaaattggatcatctctgtaattgtgggaacaactagagcctccttccatctaataatagtaaaacatcattgtctttcctctaaacatacaaattcaattaaggttgtgtttaatttaaatatcagtgtggttttttttttaagccaaataaatccaattcattttaaagagcaatttatgtgctgggtaataagaatgacacrttggctcctcaggtgaggcacaaagataaagacagctatatttaatttttaagagatgtgacataataactgaccttaaatagaaaatttttgtgattatataaatcaaagagcttcaaagatatgacttaaaacctctgggtaacaaattttctaagagttatattactgaagtggaaaaaagcaaagccccccaggcaatgagattaagtaaaggacattttgtgtacatcctaatgcttaatttcaagaggcagtgccatgtaacagaggcaccactctttcaatgaaccaaagagc

SEQ ID NO: 4356 - DNA, 600 bp, Bovine  MMBT21105
aatgtattttgtttaaaggtataatctctgtgaaacttaggacagtaacttctaatcaggctacagttctctgaaagggtcagtaaaakcatcatctatgcaactgatgaatctcacaggattccttcacagttttcctgattctttgactaatagtttcaacagtttagcctatagaatcatattctatatttgttattttcattygtgttctgtacatttctaaatcaagcatagccattttttcagaaagtgatagttatatatggaggaaaataggaggcaagccaacccccacckccaaggaaaaaagtatttctaaataacaggtaacttatatctaattggattaatttttcattttaggacttgaatgctgttgcttttaggtttaaagataaagagagaccacggggctatacctctaagattgcaggaatattacatgtaagtttattgttattttactctatactttggcacatagagtgtttcagtgatcctgtatatgttactttcagtactatacaaatcataaaaattgaagctacagtgtaaaactttagacattgtagcaactagtaaagtctgatgtgaaga

SEQ ID NO: 4357 - DNA, 600 bp, Bovine  MMBT06408
ttgactttattacagggacgaacattgtatctgactgggaaacactccccgttaggcatgtaaatccatgtttcaaagtaagattaattgaacatgctaaatgggaactagtaaaactgcttgagcrttcgtggtgtggaacagaagctagagtgctagaagggacaggttctctgtataacagcagtatatgcagcaaactggggcttagggcaaacgtctgtgagcacctctcagcaatgactactgggacttcagactggagaatttccaattaaggggcatttactatcctgccaytggacattattaactgaagccacccctatgacagaaggacataaaatgatcttgaatcgtgaaacagccataatgtctaggatgtctgagaaacactctaatggggaaggcctatccaaaagaataaagtaacaaactggacatggtttatctaagaccatgctgcctggggaatgcaaggaggagattctcaggagtagggagccttttttccctaagactgactctgcaactgtatgaggagttgctggattccaccatcactttggcagttccctataaacagttcttaactgacct

SEQ ID NO: 4358 - DNA, 600 bp, Bovine  MMBT08846
gctgtggctcatgtcaacttctctatggaccaggagagtgtctcactcaccccaaacttccttttgcattaaccagctcttcagttcagttcagtcagtcgctcagttgtgtctgactctgcaaccccatgaaccacagcacgccaggcctccctgtccatcaccaactcccagagtccacccaaacccattttcagttgataccaattacatctgaaaataaacacaagtcaaatttgataacaaaaggaagagtgataatttgacgaactactgtgttcagctgttgcatctatgatraaacttgttttaagatactgcatgcaaaggattatggaaacaacataagacgtaatgatcwtttatcytcatacctacatatgctttctttcacttaaggtagaaaataaattgctttakgaaaagaagaaaaatctgtttgtgttaattactgcagctttctcaacctacatatcaatatagcaatcactataattcttcaccacaacatctgttcagttatctaatttgggacttaatagtaggagaaaagataatctccctttgcagaaggctaggatgaatctcgcagacatggag

SEQ ID NO: 4359 - DNA, 600 bp, Bovine  MMBT17613
aaggaaacaatatatcctcagggttggcttagattgataaccagaaagacattctatcagcatgcaggaaatgatattggtgacatatttagtatacctggtcttttactgaacagggagcgaccacaagcatcaaggtaaccaattcctacttttcctaccattaacttcatggctgtccatacaattctccttttccgtaagagggctggacgttccttcatttgtaagacctgagtttatctaatggcacctataattaggctcatataaaaatgtagtaarttgcaacaaatacartggcaccacaggaagtaagctttggagctggaagggaacactgtaatattkytgtcgccaaggacagggagaccatcactagcagaaagtatcttttcatgtccctcggcatcctttgggatgtaggtaggggtcgtatgaaagttacacacttgatgaatctccattcctttttttgaactgacttttagctttaacacatgggcaatttatcttggaagatcaaatggttaatctgcctggactaatgagcacagttctggaatgaagaggttctcactgcttcagctatcattattt

SEQ ID NO: 4360 - DNA, 600 bp, Bovine  MMBT17632
cccttaaaataccccacttccatcaaagatacattgaatttcatcatccaagtgtagatgttcttgataagttatcttaatccttgtcttaaagcttctgtttcttgggcagccatttctctgtgcctagaagaatatttgcttcatactttggcagtttatatttgcacatggttattatgtcaatccaggcatgttttctctcttttcagatatttttcctaattttggatcattctcatatttgtcacattcagttttcactaaaagacaccatgtcaactcagttgctccagactractgtgcatctggctttcattaaagagtttcctctagtccgagtaattggtcatatactgtgactccatgtttacgtgaaataggcaggctgtttcccctacagaaattcctgctaacagtatcataaaaatatactcaatcaaaaaaaaaaaaagaaaaacaggttgaagctgaacatatatactaacagaagtctcctgaacacaattcttgatttgtggcaagaaatcaaggtggcatggctcaagcctctgtcttaartatcattcttttttcatttttaacctatttgtcattat

SEQ ID NO: 4361 - DNA, 600 bp, Bovine  MMBT16465
tacgaccctggccagagagaatcaggcctccgagaacagagaatggcgataacaccccacttctccagtccctccaggataggccggggacctcaggttgatgtctgcccctgtgtgcacgcacacacggatgctcttgcgcacaccatggctcacgtgcccatgcccgctcgcgcagcctttgctcactctcttttctcatgccgctctccaggcacttgcgaagccggcaggcctggcattgacgccgggtcttctgggtgatctcacaggtgcccttccggaaggggcaccggggcygggcattgcgcttcatggccctcctgcaagaggacagagagcagaagataggccgcatcgtataccctggcttcctgtccgcccctgacacggacactggtcacaccctctacgggctctgcytttgcctctgagttgggtggggttcataggaaaggtacagaccagggctcttcaggcttctgtgggtgcccagaggcctccgagcctgctggaggaggggagccaggtactagactgtcctcagcatccacatgggaagtggacgctgctcagggcctgcaccggagctgctttgtg

SEQ ID NO: 4362 - DNA, 600 bp, Bovine  MMBT17913
acactgctttttttgttgacttgagaaaaccaatggctctgggccagtcctgacccacctcaggcgcacgaccatagacgactaggtgtctggggtccctgcgctcactgctgtcttcccacaggccctggccatcagtgaccattacccggtggaggtgacgctgacataagtcccttctggggtccrgaacctctgccccacgctgggagctgaagacaacaactgacccgtcacagttaagagcggagggcggagcttaaggaacccagtgccgttcgtccccgtgtgccctcaacyaccccacagcagctggaatttgaggagagggatggaaggtaggcttttcctcacctggcccacttccattgtaagtgtggcggtcgtgtcaccagagcaccccactttctcagtctggaaagaaagtctaaaactaagaaatgccttttaatttaaataaagctcaaaagggggtgttgtcattcacgcacccagtcgttccygtgtgtgtccctactccctagtgactggctgcaggccgccttgccccacggttgcgtctgtccccttgtctgcggccatcagtgtcgctccagggcc

SEQ ID NO: 4363 - DNA, 520 bp, Bovine  MMBT21788
aatgagatgggatggtgtctgggtcaggggactggaaagccaaagcaagagaataactgaagaaagataacgcgaagatgtagttccaagactcattttgggtgcaaaagaaaaacatrctctacttagcactctgctttcagtgtggcatcaatgaatgccaagaaagaaacaccatttcagaatatctgaaattcaactgcaaacttgcattaacacttagcaaaaaaggaggggaacacaaagtgacaaatttgcttggagtcttgtgggctctcttgtagccaaatcgctgcttcragacagctcatcatctctgtaagagcagcaactgcagacttgtcacattccccgmtctctgctaatacaagctgagtggttacgtccgctctccccggtcggcagcttgagtcccgttctctgcaacgcagctcgagacgaagagccctctcaggggactaatgaatgactgtcgtcagtgctctggactggagacggggaataagcgttaacgtaggaa

SEQ ID NO: 4364 - DNA, 600 bp, Bovine  MMBT22518
actgcagggactttcctggtggtctagcggctaaggctttgccctcccaatacagagccccaggtttgatccttggtcagggaactagattccatatgtcaaaactaaagatcctgcattcagcaaccaagacctggcacagccaaataaataaatacacattttaaaaacaataacaaaataatgaccacatttgaaattaaaactaagaaattaaaaaaaaattcctccaattgcccacctctctcctccaccaccactcaagtccaagttggccactgtaactgcttgcttgtcacytgcttctccacttgcccccttccaatctgtagccagtatgatctattcaaaatttgaatctgattatgccactccctgcttagcatcctttgatattttaataccttggtctcaggatgaaccagatcaaatccttacctgacccacaagtagggttgccaaataagacacaggatgcccagttaaatttgaatttcagataacacataattttctagtgtaaatgtatcccatgcaattattcattgcttatatgaattaaattcaacctggcatcctgtatttttattcactaaatct

SEQ ID NO: 4365 - DNA, 600 bp, Bovine  MMBT01185
aggtcctgagtcacaggacaaaagttccctaaactcctggcctgagtcacatgcttcaaataaaagactcttatctcatactcccttttattcatgcatctggctttaaagaatttacagtgtgattttgcaacgagaggagaagaaagtgaaatggaaataccatgatcttgatcaggtgcctccaggttgtagccatatcccagcagtgtgcgtacagcctcacggaggctatccttattggatttcttagttcggtcatctagaagggcatarggaacaagccgagggtttcttctrttctttacatcctacaggaaggaaaaaaaaaaatgtatgtgatcatcaaaggacaaccaacagcatttggaaatgacacagccaccaaatacatcaaaatataaagtgtctgaaggtagatattgtaccttccctttgtctttccaggttgtaggagttagtgaaatactcccagtatgaagaatctatcaagtgagtcactgatcaatgtaaatcaggctctctccatgaaaagaaaatgtaaaaataacagcaataacaaaagccaactttaatgatctcaataaccatcatccatct

SEQ ID NO: 4366 - DNA, 600 bp, Bovine  MMBT02590
tttatgatcttttcttgtgatattagatgtttctagtaattaaataccttatcaactgataaacagtgatgagctgttttattaaaaaratatttgtgatgaactaccatgtaccaattatatgctaagtgcagaagatacaggcaaaattgaagactggactcttaatgaactcatagcctggtagctaagtaaatcattaataatgcaccatagactagatatgatgcccaaagaggaattctaaatgtgttttgaataacagtagaattattaaaatattgaaaacttcttaaaagrctattttgaatggacaaaaataaatctacgtttatttggaaatgtggtttctggactgtttagaaaacaaaaaaacagcatagcaagatgcaaaagactcagtccttgaaattctaagatctggcttctagtcctattctttctgtatggtttcaactcttatccactctaggccttagttttctgtgctgtaaaattaagaagtttgacagattagtttctgacatctgggtcaattcaatgaccacaactgcatagaaatcacagacttccttgatttccatctgcaaggtcaatagt

SEQ ID NO: 4367 - DNA, 600 bp, Bovine  MMBT04684
caggcattctttccagccctctcctgctccccgtccgtgtgcctcaatagcctccttcacagagtgagagggctgtggtcctccctcgaccggactaattaaagaaagacacttgtgttcccaagtggtggttttatttttttagtttttatgtttgtatgggaaattgtggataaagtgaaagaactgtaaataaatagtgtatttcctcctccactgctgatttttctgccatggatttgcrtaaccccgaacctaaagtctccttttctcgggctcttcgtgctgatgcctgtaagyatgggggacgagctttctgtagggcaggcacaggatcgacaggaggacgggaggcagcctcagaggatgttggtaaacacttgcgagcacctcctctgtgcagatactgtggacacaaacaagtcacgtgattcgtgattcttcattgctcatgtgtatagggcaccttgccgtgtgcaaagcactgtgaaaagcacttgaggtttatttcrtttatgcaaaaaggagtatatagtctaatggaggttagaaaatggacgggaagttcagcactagatgaaagcctggagacatctagtt

SEQ ID NO: 4368 - DNA, 598 bp, Bovine  MMBT05820
  misc_feature (1)..(53): n is any nucleotide
nnnnnnnnnnnnnnnnnnnnnnnnnnnnnnnnnnnnnnnnnnnnnnnnnnnnntgatgagacacaacacagtccatgtttattttggcagaaaaacacagctgcaaacggtaacaaaaattgctatcacttttttattttttttaagtaacagtacttgctacctattccttttcctctagagcaatagatttttctgtccatttttttcccctcactgctagctgacaaaggctgtgggcagaactgaattcacatctcacaattctcatcacccctccctgacaaagatgcacactcygtatgtttgatgtattatttcctccacagaaaacaaccctgcctcaagaaacaaaatatgatacaaaaggctcagctttgcctggcagacaagaaacaaaactttatgaaaatgaggccagtgaggggaaataatagcagctctatacacattgggataaaacttttttaaraagatgtataatatctagctgaggtaattagtaaaaacaaaaagtaaaaacttttgtttctactaatgacactggaggtaattgataaaaacaaaagctctttagatatatgtgtctgtttatata

SEQ ID NO: 4369 - DNA, 598 bp, Bovine  MMBT12687
  misc_feature (1)..(100): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactttatagctaggaaaattacatgccccagattaaaaaaaaacaggtccttgaaacaaaacccctcaaaactagatggcaaaataggttgagaaatcaaggcctactttgaaaacaccaaacacttgcttaagtgaaaagaataagaagtcaagctatgtgatagcctgaggacaatcaattcagcagataaaaatrcaccttggtgagctccttgccagggagttccaagagcaagaatcaaagtttctttaaatacatcaaaarcaggaaggcatctggagaatcagtgagaccacttgattaaacaaagtacaaaatgtgaataaatgattgcatatgaaagaaatataccatgccagattcaaaattttgttgaagttacttgagttaagcctggaagcagcagagtaaagccttttagcattttagagtcaaactgaagaggaattttwaaaattatttaaaaaataktctatgctctatttgaagtgct

SEQ ID NO: 4370 - DNA, 600 bp, Bovine  MMBT14217
tagacaccttctgcccacataatctgtgaaaccattaaaactacctcagaaacaacgtaacaaaactctaaactgaaaaattttaaattaggcaacatgcttcaaagtgactgtagaacactcaagtgtggacagcaaagatttcctcatccccacacaacacttcatccattgtagcgctctggttatggtagaataagtcaaaagaacagccttcagtgcatttcataaagttcaacaaagcaaagtctgctgtaccaaactcagctgtgttcttcactgtggaaataaatagtaaayggcaactctgcagctaaaagtcactgaggcaggaaaacagcacagaatatggccagtgaccggttctcctgcatacatcagtgtctaaagctcttagtttgggtcaaggcaaattgtgggcctgaggacatcactttccttgtgacctgggaaaggttactatatacaagggtgaactctgtacacaggagaggcttgaaaggaaggaaggaaaggcaagtggacaaggcttctataaatagatcaacagctcacagatacaaggaataacaatcagtgttgctgggtcaaataaacaaa

SEQ ID NO: 4371 - DNA, 600 bp, Bovine  MMBT21856
agagctgattcatttgaaaagaccctgatgctgggaaaggttcagggcaggaggagaagggaacgacagaggatgagatgattggatggcatcaccaacacaatggacatgggtttgggtggactctgggagttggtgatggacagggaggcctggtgtgctgtggttcatggggccacaaagagtcagacatgactgagcaactgaactgaagtgaatgtccattgagtcagagatgctayccaaccatctcatcagctgccacccacttctcctttggccttcaatctttcccgtatrttttaataccagctaagtcattgaagcagtaacatggcaaggaataacttttattaaacttatatacttttttctttgtttatcagatcacaaaggaggaagagcgagagaagaagttttctagaaggctaaatcacagtcctcctcagtcaagctcccgatatagagaaaataggtgattgattctttgaaccatgtttaatttttagacattgcttttctttatatgaatatttagacttgattttcctttacataggggcaagtattatctactgatttattagtgtgggaaagtag

SEQ ID NO: 4372 - DNA, 600 bp, Bovine  MMBT07624
acagaggatgagatggctggatggcatcactgactcaatggacgtgagtctgagtgaactccgggagttggtgatggacagggaggcctggcgtgctgcgattcatggggtcgcagagtcggacacgactgagcgactgaactgaactgattgaaacctcaagtcttagttccctgggcctcgactgttgagcgtatacatacctgctggtgatttttctaagaactgcaaccagcgtctctccccaccctgtacactgttgaacactctatgtatatttagagatttcccttctcagtragtcaaaggaaaatgtttccccttattaggtaggtsttttaacatttaaatttccttttcattcttgtaagttgtatcacatgctttcccttttatttctgatttctatgctcaaggcaggcctacacctttcttcttattttagttctgggaactcacctagtttccatgtgtaagggctgttccctctgagttcaccaaagctcaaattttctgtcctgtttcccttcccgctctcctttctctaaggctgtagtgttgttcttgtgcttctcagaagctttgaggacacagagcttt

SEQ ID NO: 4373 - DNA, 600 bp, Bovine  MMBT21123
acactgtgtcatcctcggaactgagcatttagtgttcagttacgaaccttgtccccatctctatttaggcttcagaacctaactttcaagtcttatgttcaaaataaccaaagactgtctttaactccactatagcttggctacaagaaactagtttcccattcaaccaaactatgataatactccagctttacaatccaatctgggacttgatatctatactgatagttatttatctagaactatctatctataactatgtttgcaggtacttccaatagcttgaaaagaataatatgkatagctcacaaagcccacaatacatgcttgaccttactgcttttatacttgctgatccaccagcaaaggcatgtttctccaattatttgacagttcatcctcttctcaacctctagttaagtcatttctcttcaaacgtattctcgacattattagagagggcgcagagactcttcagaaagccagaaaggataaacaatgagttgctaacacttcctttcaaggggaggaagttaggataaacttgaccctgacattagcttcagcctggaattccatgacacagtagggggctcagaa

SEQ ID NO: 4374 - DNA, 600 bp, Bovine  MMBT21867
gtttaaaagtttcatttcagatgtgtgagtttgtaagagtgtgtcattttcaacgtgtataatttttccttcagtgtgtattactgaaaggactttgttgcaggcaataaaacagcttaacaccttagagtaaaacacctttactcaagcttagatttatactccccttgtgacctttattgtgtattacttttagcctttagaaaatcatgactttttttttataatcccagtatttctctgttactctgttcttaagagtttttttcctatcatctaggtgttctaggcctttctccrcattacttcacttaactgatctccttaatatcttttctctttccatggtaaattttcttttcttggcycagttaatttgtttgtatctattatgaactccttttccttcctctttgagtatccattctcatcttcagcagtgttcactgtataaagccctgttaggccctgttaatggataaaamctaaatgttcatcacagaaaaaataactgtacttgtattgcatatttggttttattggctaaagttttgcatactaagatttcaatgaagaaaataaaaaaatctctcttctata

SEQ ID NO: 4375 - DNA, 598 bp, Bovine  MMBT04973
  misc_feature (1)..(124): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaggaagcctcctgtttcataggagaggcaaataaggaattgtcaggagaactgtagaaaccataacaaagtcataacatctagcctgaattagggaaacaaagaaaaagtgttacttaggcccctggtgggtagtagtgaaaagagttcaacaagaggaaagatgcttgagyatcttggaggattggctggaatttgacatgtaaacatgatcaaggagagcagggcacagggcctggtggagcaaacagcatgtgtgcactcacagaggcaagaaaacagcacagcatgttcaagaatgagtagttgaactgtcactggatttagatacagaacagttgtattaatacattctataatttccttataaataaaccatacattaaagccccattgctgcttttccccatcttttaatactgagaaaaataaatcccatgaattttccttgaaatcttactagatcatcca

SEQ ID NO: 4376 - DNA, 600 bp, Bovine  MMBT10283
acatgtgaattcaaagccctaactggtttgctcttggaacatctgaagcttccagtttgaggaattctcaggtttctctaggaagaggcatgatccatgaattgggaatgacaacagccaagtcaagaggtcccccgaggggcgaggtcagaaccacaagagggtggtccttgagcagggtggagacagaaccaacgggtagacaccaccccttccccagctgtggccactgcaggaaagttcctgagagtcacaggtccactaacctcctcgccatccaagtgactgctcttctactgytttctgtgagatcagtcttaaagaaacagagtctctgtttcacaaacgatggaactctgtaaatacaawaaataaataaataaaaggtaaaatctgcttaatttttatcttagtagtgtagtagtaaaaagttgcaaacaactgaaatgtccgcctaaaagagggtggtttattatttataccccatccttttccaaaatgattttaaggtagctttcacaacataccttattatataaaaataagtgacgaattcaagcagagagaaatctgagggttgggccacagatttcattctga

SEQ ID NO: 4377 - DNA, 600 bp, Bovine  MMBT12352
ttattcctctgtgaaagaatttctccccatttgtgccctgtagtactttaaaatgttcatattgttttttacctctggtattagttttgggtctttaaaagagctccatgaggtagtaagtatttttgtatgaaattttccattctgttattcctattttaagaggtgattttgtgcttcttcccccatcattatatttaggaatattgtccatttttgtaaacagggtctgaaattacctttctttatatgtagctccagcagtcttcctatgtgtctatagcaagcaactccaacttkacaggaacacctggtatccagacccaggcaaggcttccgttcaatgggtgagtgagttatttgaatatgttttaagttgttgcatcaggttaaatgcygcgtgaaatagccatacatatttcaaaatacatgtatttgatttttctcccctcaaagccatgtgagcatgcccctgcagtactttttattttgtaatactttaaacagaaaagttgcaggaatagtcagagaactcccaaattatcttttactcccagtcaccaattcagcgcaggtgttttgttattttctgtctatttt

SEQ ID NO: 4378 - DNA, 598 bp, Bovine  MMBT02936
  misc_feature (1)..(10): n is any nucleotide
nnnnnnnnnntaaagataccaaactgacttctgttaaatcacaaaaataaatattgtctcattctccaccttaagttctaatgacataatgcattttcttgcctttctatttctctcagaaatcgaatgtcctgtgaatcttcctctccattgttctttttaataggcatgtccagacatcctccagctcccgagatccctacgttttatcccctgtctccgggtggtgttggacagattaccccacctcttggctggtaagatccttcttgcaacctgcagccaggcgtctgaacatayatcttctactccccgtttatggaaattagctttatgaataataacacttgtggagttgaagaaacttcaacacatgaggtgctaactttatttcatttcaatttaaaagattaaaagacatacagactttgaaatggactgagtccgtttgctaatatgtgtagaaaatgactgtgtagcattcgctttgaagcttatagttttatggattcagtttgtggctctgggcatttactatgcctgtacaaagtgttcactgtggtctttcttttctagttctttatgaacaacttatrtt

SEQ ID NO: 4379 - DNA, 600 bp, Bovine  MMBT05027
taaggaagactcaagtttcaagactatgagatttagtaataattttttttttccatcctgagctgcctaagtaggctttatatatcaaaaaaagaaacaaaaagaaaggcagcactatggaaatccctgacccttcttattacaattgtgtttttgttagacatctttatttactgtctgtgattgacattagatatatatggtggttaactgaaacatacatgctttaatttttcaaataatgttttaaggttataaaatattatgggaaatttgaaaataattacttctacatctgcyacycagccataactactaataaaatgttgatggacatatttcctcccagcctttttattttcacaattcatatagaatactgggtttatactatatctttttgggcaggtagtcgccaagttgtgtccgactcttttgtgactctatggactgtaacccaccaggctcctctgttcatgggatttcccaggcaagaatactggagtgggttgacatttccttctccaggggatcttctaacccagagattgaatatgcttcccatgcatttgaattctttaccacccaccagggaagccc

SEQ ID NO: 4380 - DNA, 600 bp, Bovine  MMBT07394
atatggtctgagtcggccttggaagcattataaaaggagtgttttataaaaggaggaatcattaaaaggatccacacattcatttgcatgaattagcaaacccaggagagtgtctgaaatggactgcagcgctgacctgaaatggaggttactgttttccccgcaacacccaggcctcagtgggcacaaagcagagtcacatgaacaaacctttccagccagagtccaaagatcatcgcctccaatgatttgcatctcatccatggactggtcattctaaacagaaagggggagataatrttttactatacaagaaaagctgtatacagcacgtttccccatctacccagccaggagctggattgtgccttgcaaatatagcacaaatagctggtcctgattcatggttgcctatggttaccaagagccagtctcctgccaccgtgtttgagacaaagcatcctaatggctgatagccgaggctgtgtggagaggggatggagggagtgggggagaggacaagcaaatctaattttggaacaaaataaaaccatggaaggtgcccgagcctattctgaggcagatggaattggagaagac

SEQ ID NO: 4381 - DNA, 600 bp, Bovine  MMBT13102
ttactttttgatttttgtgtaagagtaagtgtgcatttccgacttatcaaaaatgtccctccagattacttgtatgtctgtcacgatgctttcactttatttttactgtatggagaattaacatggttagaggagccactttaattttcatctaattcttttttttaaaagtgcttgggtaaaaaaatgtacacagcagagtttgattctgttagtttgattcagattaatctgcatgcctaaattatcccttggtaaatttaaaactttcctgtttatttyttttccccattgacttargtaattattaatgtgcckgaatattgtaaaaatcttacctctcaagaataaatggcccattcttgtgatttagttttataatatatgcytttctgttaaaaaataaatgagtgtatctacttttgtatttgacagaaatgaagccctggatgaaatctgttttaaagtctgtgcctgtaacacagtccgtgatgtattagaaggtagaackattagtgttcaatttaaccagctatttcttagacctaataaagagaaaatagactttcttcttgaggtaagacattttcccccctttgg

SEQ ID NO: 4382 - DNA, 598 bp, Bovine  MMBT14471
  misc_feature (1)..(40): n is any nucleotide
nnnnnnnnnnnnnnnnnnnnnnnnnnnnnnnnnnnnnnnnatagtgtttgtctctgcctgagtcttataactagggtctctgtgacattgacaggacttcctgggaaaatcggatccgttcttggagtttttccgtcagggtgatgggaaatggcacctggcatacagatcagaggtgtgagccccctgggattgggtgtgatggagcaggagagaatctcctggggtttgtgactaccaagatttggagcacagggaggagcctgcttatggctagggaaggatggcagctccccacakgccaactcagcactcactggaagctttgtactccaccctcaggtcatcaagaacaacctgaatcctacttggaaacggttctctgttccccttcaacatttctgtgggggagatgccagtacacccatccaggtgaggagcttgccttctgaatggactgagcaggggcagagtctagggagggatgtattctcacctgccacccgcctcctggtctttacatacacacacgccttccctcctaggtgcgatgctccgattatgacagtgatggttcacatgacctcattggtacctt

SEQ ID NO: 4383 - DNA, 600 bp, Bovine  MMBT17091
gttatcttgatgataagataataaggaaacattttttaacatataacagaatatttaattacatcagtctcctatcaacagataagttagttaatgctgtttatattggccatttccattggctggctggaggctcttccactaaaggctcccatggtttccactggatcatttttcttgccagacttagttcgttttcagcctgttaataaaagatttttaaaagatcatttgattatattgtttagtaggtatttaccatagctaataactgaaatataaccatttagaactacttcrtacatgttaatacctaataagctgtttcatcatcaaatgtggaacatacttaaataaattaccttcatcatgagtgagaaaggatggcatttgatttttctgtttaattaaaatttgcttttacagtgttcaaaatttagttggtgagtaaaggatccatgacatacacatataactaaaacaaaactaaaaatatcattacctttactagctgtcatactcaattttctgatgaatgtaaaaaaaaaaaaaaaaactagtcacagtctacctaactgatttcatgatccataataacgt

SEQ ID NO: 4384 - DNA, 600 bp, Bovine  MMBT17207
tataaagcagttagcataatgtccatagttgctgatcaataaaaatgttattttcattaaggaagttggaaagcttggaggttgttctaaggtttamgatttcagatgcagaattactcttttatttattttttttttgaccacactgcgtggcatgtgggatcttcgttctctgaccagggatcaaacccatgccctgtgcagtggaagcaaagagtcttaaccactggactgccaggaagtccccagaattattcttaagtataagtaattgtttcctacacataagtgtttcctaaytttatttcttaaggaaatttccatattattacatcacttgcccattatacatgttttcayactgtatttyaattatttgcttccctagctgaaagctggggtgggcctcattttggttatgttctcagtgcascagcccatagcatttgttgaattgattttggaaatcattcccacagaggcagatgactgaggtaaaggagaaagatctccaggagggaactttgggtcagraactacacactttgctagagactggcagtctacagattggatttctcattaactgtgcacttacar

SEQ ID NO: 4385 - DNA, 598 bp, Bovine  MMBT20030
  misc_feature (1)..(46): n is any nucleotide
nnnnnnnnnnnnnnnnnnnnnnnnnnnnnnnnnnnnnnnnnnnnnntcactcagagtggagcctgtcacaggatctccttcttcctcacaggttaccacagattcgaggaatcacaattagggaagtaaaattcactatgttcatgatagatcttgccacaatatcctatatttaaaaatttttactgttacacgataaatagaactcagatttatgaatcacaaattatatacctcatatttcacatttggttatagcrtttttcttctttctctgattcatatagatgttacatgacrgtgtgggtgggatgtgtgtgtaatgtcatccgaggaaagtgcactctcgtgtgctatctgaaaccactgactgcagccgaccccaatgagatgcttctcactcacaaagcttggagtttgcagggtatgtcacttacaaaaaaggcatgcttccgcagttatctgtagcttggctgataacagcaaagagctttctgcaattgtcattcaacgtgggatccagagaattctcacagttccattagggactgttgagagaactgtttcaggaatatggtatgtgataatcttagataaa

SEQ ID NO: 4386 - DNA, 600 bp, Bovine  MMBT22992
acttgcctgacagtgatttttgttttgatcatcagacttgattgaaccacggggcgattgacatccatgctgtggagtcrtatatttttttcagtgaaacaaattgcatttacccattccaaactggtatggacacttgactgattyctacctaagcatgaatgtaagaatcccagcgcttcagttgtaggctttaccactgagtaaacctctcctggtaggcaggcaacrtgcagaagagaagatccaccttgaaacctgatttgtcgccttcctacctaaagagtggcccccaaaccygcctgaacttcataatgkgatcttattgggaaataggatctttccagatataagtaaggatacagatgagattggactmgattagcaaagaccctaaatccaaggagaccaagaagtacagacagagactcaaatraggtgatgtcaagacagaggcagagatgaacgtgacatagctatatttccaggaaggtaaggattgtggacgaccgcccagagctggatcagaggcatggaatggattctttcacagagctctcagaaccagccctgggacatcttgattttggacttcaggtc

SEQ ID NO: 4387 - DNA, 601 bp, Bovine  MMBT03602
  misc_feature (1)..(1): n is any nucleotide
natggcaacccacttcagtattcttgcctggagaatacaatggacaaaggagcctggaatcacaaagagtcggacatgactgaagcaacttagcagcagcagcagcagacaaattttaagtaacttagtaaacgaagaaaacaattttgtggaatagagatacacaggacttttacataggacaataaagctacataggacttcttttttttttttacttctgtatccaagtagtcaagagctcatgctaaatgctaacagtaaaattctcctttgctaaacacttttaaacattccattwtgttcgagataattttatgctttgagaaaaggggagatgggatcacactgctgatatgggggtagagattactggtgagggtgaccagttcttccatgaactcagtttccagtggggaacaccaagaccccatcctatggacttaccactcctgaattcagtgagtgayctggaatgacctggcacyttagatttttttcttctctagatccatctaggtgacttgtagacgcttctttccacacaaccaaagaaagccatttgggaatgctatttttctctgaataggcctcttgtgtt

SEQ ID NO: 4388 - DNA, 600 bp, Bovine  MMBT04343
gagacaaagcgatggttactaaatttctgcaagttatagagatgaagaccttttgtgcttacaaagcaaattgtgattgagaacttagaagttagggaattggtttattttaagcaatctggagagttccatcgagaacagttttgctccttcagtgcagcaaatttttaatttctggaatttctaataattaggtaattatctcaactgtgtttatttcaataagcagactctgtgtacacaaaactgagcataagaacctataagattcttcctggtgtttgacttcaaatctaagcygagatgatgtgatgttayagtaaaaaacaatactactccccttgttcatatcttctggtaataataatgacctctcacattttgtgaacatgtgatcttttgagtctcacaacttactgagacaagctaggcaggttcactcatctcattctgtatgcaakaaaactgagaccagataagtgatttcacaygtctgaggtcagaaagtgagtcagtggcagaatatggagtagaccagaacccaggtaccctgactccccacccagcaccttgatcaaccccattgtcacagccttggta

SEQ ID NO: 4389 - DNA, 600 bp, Bovine  MMBT10284
agctagtaaactatacctttcccttggggtctcagagccccaagctcagcccattcaccccctaaagatcttaacagcccctcctgctagcatccttgctgggggcttctcactgctctttcttgttctgcactccctcccctgtgcagctactaagagactctttataaaggacaaagccaatcttgtccatgctttgcccaaatttttttgcaccaggtgcaatatagacacttacggaggtatcagctccaagtggaaatcccagttcaactgattaggggtggaactgcatgcagrttattccactttgagttctcacacctaccttacaggaatcttaagaagtgaatgtattatgggtagatgcctggcattcctctcagccctcagaaccacagcttgcagcagggcccccaaggactctcctgctgttcatcctatttcccttgacctgagtccctctccacactacacaaaatctcttcacagctctctgtgcccattctgcaccctttaagaaccaacccaaatactgcctcccaggacagcatccctgatctacccagggggagggctcctggagcacttggttcaggc

SEQ ID NO: 4390 - DNA, 600 bp, Bovine  MMBT16475
gtagtatcatgtgatatataattttttgttttctggcaaaagaaagcacaccaaattcatctgcagagaaactatgttttctagagctaaattccaaaaagttttatgaatccttgaaagcactggcaaattggaaacatcactttcatccttagctgtttataaatagtgtaaattgagaatttataaaggtgtatataattttctttcaaataaactttacacagatgtggttcttattraattcatcaggagaaaaccagcatcactataaagactcatccattcatcaaaaccaakactctaatttcttacttacctccaaaccccttctcctaaacctggtttctagataaaaaattagtatcttcactcatttccactttaaaattcttggccttttcaagaggatttgattagatacataatttaagaamtgggaattccccataatgagtgagcacaatttaactcttgtctccttcaaaatagctaagtcaatatccacagaaacactcaccctggtcattgtatcgagatagatcggcctggctgatgtagaggtcatgatcactatctagttcccagaatttacaataa

SEQ ID NO: 4391 - DNA, 600 bp, Bovine  MMBT22991
rtatatttttttcagtgaaacaaattgcatttacccattccaaactggtatggacacttgactgattyctacctaagcatgaatgtaagaatcccagcgcttcagttgtaggctttaccactgagtaaacctctcctggtaggcaggcaacrtgcagaagagaagatccaccttgaaacctgatttgtcgccttcctacctaaagagtggcccccaaaccygcctgaacttcataatgkgatcttattgggaaataggatctttccagatataagtaaggatacagatgagattggactmgattagcaaagaccctaaatccaaggagaccaagaagtacagacagagactcaaatraggtgatgtcaagacagaggcagagatgaacgtgacatagctatatttccaggaaggtaaggattgtggacgaccgcccagagctggatcagaggcatggaatggattctttcacagagctctcagaaccagccctgggacatcttgattttggacttcaggtctcctaaactccaagacaatacatttctgtattttaaacccttgctgctgctgctgctaagtcgcttcagtcgtgtccga

SEQ ID NO: 4392 - DNA, 600 bp, Bovine  MMBT01393
caaggttcacgtattgctgaagcctggcttggagaattttgagcattactttactagcatgtgagatgagtgcaatcatgtggtagtttaagcattctttggcattgcctttctttgggattggaatgaaaactgaccttttccagtcctatggccactgctgagttttccagatttgctggcatattgagtgcagcactttcacaggatcatctttcaggatttgaaactttttgaatctgattcttcaacatcccaccaactttgtgcaatttcaagtgcttttcaaatatgttcaawtctttcccaattgtccagtctattcattttatatatcataactaaagacaaagctaatagagatgaccaaagcagtatataccaaagttgttacatgagatacaacagatagatgattggaaaaccctaactttacttctcattctgcaatctccagttgtatatggagcagatcattaggtgagcccctttatctcttaaaccttcagggtttttttttttttttaacctgaaaaataatgagaaagtacaggattccttcaacccctaatgttcttagaaggaaaatcagtcacatca

SEQ ID NO: 4393 - DNA, 600 bp, Bovine  MMBT04800
ttataccagcttaccttcaataacatacaaaaattctgctcctttacagctctgtctccactcttttcagttgctgatgtcacaacacctttattgtggatcccaaaacataaactattaattcttttaaatgcatagtctcttaaattatgcagaaaacaagatatggagttacaaagcaaagttatcgtaacactagtttttacactaatagttgaaggttttttcatttaaatgtgttagtctcaaatcaggtagaaagcaaaaagtgcagttccaaattaatgttacaatactacyagcttttataattgcccgtgtaattacctttactgagatctttatatctccatatggctttgagttactgtctgatgtcctttcattttcacttggcaggagaaaccttgggcatttcctgcagggcaggtctagtggtcacaggcttcctcagcttttattaatctggagtcttaatttctctttctctgctgaagggaagttttgccagatgtaggattcttggttgactgttgttttcttttagaactttgaatgtattggttcataggtctttgggcctccaagtttctgatgaga

SEQ ID NO: 4394 - DNA, 600 bp, Bovine  MMBT04948
attaaaaaaatgagtttctaaattcctttaaaattcagctgtagggaaagaattaggaccatagctcataattacttattatgcgagattatgaaatcagaggttactagtatgtcttgccttaagggatggataaatacagacatgccatggcagactgcatacaaggctgaaagaaactcttcagttctactgggagaagagtaggaggaaacaacgctgacctttcatttcctgtaggttgcttgtaatttatgagattctttttttaaaacagcttcaaatatctttaaaccttayrtatactagttaaacttcaataatgaaagctgagatyataaacatcaaaaactccatttagatgtagggtggatttttctaatgtaacctagagggagagcctctcagaagaaggagtttcatgttttgatttttaactgctaatttaaaaattggctgctagagaaaagggtgtgagtttgttttagttttggtctccatttcctgtgtaagtactttgggatggatgttaagttgagatatgaagccactggaaaaaaacaggtaaagagaaaayactatcatgaaaaattaaacact

SEQ ID NO: 4395 - DNA, 598 bp, Bovine  MMBT05777
  misc_feature (1)..(102): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatttgttcatattatcatagttcattgatcatggtagacacttaataaatatttgttaattgtgctattacttacctgactgaaagagaccaatactaatctgacagtcccctccatttttgtctcatgtagaatgtgtccttttatttgtaacttcagtcactatttatagtgcttagtcttggtgtaattttmtctctctgctttatcagccgtctgacctctgttgtgttgtataaatgtgaaacatatgtgaagctgtttttttcatcctcttaagcaactagattttgccagctccctttttttccctgaagacttgtaactgattctttttgccttacagtcagagaaagcaattaccattactctgaaaatagttaatttaaaggaaaaaaaaaaaaaaacagttcaggttagaaatgttcctaatctaaagaagtccatgatcatggtctggcttcagaatatgtgtgtatcttctatttaaata

SEQ ID NO: 4396 - DNA, 600 bp, Bovine  MMBT07384
atggaaatttcattgattctgtactgatttagatttttttttttaaccattttttgctctaaagttttttcttgtgttaaaatcaaaaaggttatacaatatgaaatgtattttacaaggctgggaagtaatatgagtatcctgctgtgtgacaggtgtctttattagagacagtagtatatatggttccagtctttaaactattaaaaaacctgttttttaaaatagggagattcaaagaggttaaagttcaaaggacagatagcatgtatgtgggatcagaacccatgacttccttayttgttcattttccacacgactgtgttactactaccgtggaaaagtccgttttggagggatgatttctacgtttcattccttattagtcctgcctcagaggagtacttctgtctttgtgtactgctgaatttaatataaagcaactaaatgtttaccagtattttcatgtccttacattatgctgaaaagtagccatgctgacttgtagaaaaaaggaataaccatatatactaccttttatctcagttacaatttcagttaagaggagattgtttcaagtgtgggccaaaaatttcttta

SEQ ID NO: 4397 - DNA, 600 bp, Bovine  MMBT21359
agctgacccctgaccacactgctgaccctgccccaggtccggaccaacgtgccttcatggtgtgaccggattctctggaaatcctatccygagacccacatcatctgcaattcctatggtcagagcctcccggacagggtgatgggcgatcccgggtggtccctgacctgactctgccttggctttgggagtcaggagcagagagtaaggagctttcccctgagcccccattcctactcccctcccccaggttgcacagatgacatcgtcaccagcgaccactcccccgtgtttgggacrtttgaggttggagttacctctcagttcatctccaagaaaggtggctattctggctgtgctgtgggtgcggcatccatctgggtgggtgcaggtgctagcctggggggtgtgcatagctttgaatatatctgagtgtgtgtgtgggtgggtgtgtaggggcgggtacatacatgcatgtgcaggaatgtgtctgaatatgtgatgtgtaaagctgtctgtgttcctgagtcaccgtgagaggtatatgcctgtgagcaggtgtgtgcgtatggaggtaattgtgtacatgtttctgcctgc

SEQ ID NO: 4398 - DNA, 600 bp, Bovine  MMBT21361
tagatttgttgtttagtcactaagtcgtgtccaatcttttttgaccccatggactgtagccccccaggctcctctgtccatgggatttcccaggcaagaacactggagagggttgccattcccttctccagaggatcttccctacccagggatcaaacccatgtctcctgcattggcaggtggattctttaccactaagccacctgggaagcccaagtagattaggtgaggtttaaattcaggtctttctggggcaaagctggcttctttgtgccacacgatgtgcctcactatgagccrgaaaggtatcaaacttcatrtggggactgctgtaagaagtcagtaagacactacacagaaagttcggattaccatgcccggcacacagcagccatctcacagacggcagtcacctcattcacttggcagcacaaattgaatccttctgtgatccaggccctgtgctaggtgctggagttacagggatgaatagagcatggtctttgtcactrcttcctcatgtgtggagtaaagagatagaaacaggcagttaaacaagtgctctggaggtgccagggcaacaggctctttagacaattt

SEQ ID NO: 4399 - DNA, 574 bp, Bovine  MMBT22870
aagaattgacctgccgacgcaggagacacaggttcaatctctgggttgggaagatcccctcgagtaggaaatggcaacccactccagtattcttgcctggaaaattacatggacagaggagcctggctggctacagtccatggggtctcaaagagtcagacatgacccagcgactaacactactactactacacttggagtgtgtgtatttgtgtatatatgcctgtatgtgtatgtgtgttggagagagagatatagtctcttatcccaagataagataagatasataaaccccatgargcccamcaactgtggccggagccctgcagtgggagtcgctcctgattctctcgtggacatcccctgtggtttcctctggttttggggtagatggggggtcccttggctcaggtttcagggttgggcacctgtccagtggatgggactcccctctacctcacttgtgcctgcaggtatctgggagatctgctcggccgatggccgggataccctcttcctgagggccaaggatgaggctagcgccaagtcctgggcggctgccatccaagcccag

SEQ ID NO: 4400 - DNA, 600 bp, Bovine  MMBT02675
cgatgctccatttccgcctcattctgttcccacagttttcaaacttcatctgccaaagcattaaaaaaaaaaagataatgataattaaacttaagataaatgttcttaccaccagaatactcttcgaaaatgtatctgaattaatcagaataaaaagctaccttaaatgagacatgatggatagtagcattttatagagggaaagaaaaacaaacccttaagccagtttatttaaaaaatatgaatgaatgaaggtttgcatcacagaaaatgtttcctaatttttcagctttactcttyacagccaaacatgagctgtgtattgtgtaattgcagtggataaaataggaattccccgacagaraggcacttttatactgagaaaagcagagyagtattcattttcaggtagagttaactgatttccctttcaaattgattgcttcttaagttgttaccattaaaaaggtttggtgttaaacaggctgaggaaccatcagaggacaaaattcaaagatatccacttaactgggtttttcaagtcccagttttaaagtcagccttgtgtgggtggggcatcatcttgctcgggctcctaga

SEQ ID NO: 4401 - DNA, 600 bp, Bovine  MMBT19489
tatttccaggaaggattactctggggagtacaccatctacctgatcccttgcacagtgcaacccacgcagccatgggcggacccaggagaaaagcctctggcctgcaccgcacacgccccagagaggtagggagagaggattgatcctcactatttgtgaacttacctactcactgacatttatttgtgaccccgaatccaattttcgtggtgctatcctgatcattccctgaccggcagagtgatgaaatagcggtcatctgagccagattcccagctcagacttctcatcctgtgaayaagtgtcccttttacagtccatttgctgccaggtttttcaaatttttgtccctcgcattggtggttttgctgtttaaaatggctccccagcagagcgccgaagggctctctcgtttcctgcatacaagaaggcggtgatgagccaaatggagtgttagatgagcttcattccatcatgaacttcaggaatcaacagtatatatcaagtaaggtgtctttagacagaaacacgcataaaacagagttaggtattgatcactgatgaaaatgttgagagcagaggctgcaggaacttgaccc

SEQ ID NO: 4402 - DNA, 598 bp, Bovine  MMBT02217
  misc_feature (1)..(55): n is any nucleotide
nnnnnnnnnnnnnnnnnnnnnnnnnnnnnnnnnnnnnnnnnnnnnnnnnnnnnnncgctgtagggacactttcctcccgatggtctccaccacctttcttcctgttgagtttggggcacggtgagggtgtgacacagcgcccgcccccaccccgggcagggggaacctcagagaaacagagtaagatgctgcatttctcccccagctaataagtacggtcaagttcaaggagctggatgcgtccttagtccagtaacattctcaaattctgaacacttaaatcccttctcatttccatasaacttttgcttccaagttcgtttctaaaaagctccaagaaactgtaaaactctcataatcaaatgcaattgaascatcataaaataaaaactctgagacttgtgtgtaagctgtcaggacttggctcattattctcatttacttaataaaacacacttttaaaataactctctattcatatatttatagtaaaaatataacttttttgatttaaataattacctcaacaaaaactatttggaaatatacaaatcatacaacctaaaaacaragaatcattactaacaccctaatgcta

SEQ ID NO: 4403 - DNA, 511 bp, Bovine  MMBT01952
gctgcacacgggaaggggtgagggggtacttgccatatctggaagcgtagtctggtctgggaaccaaaataattttttggtaagctttgcagaaaggttgaagttccgcatcaaaaggtcgctttgtggtccccacaattagaatcctgtcgtctggcttcaggagtttcagcattttgggaagctgctttttcaggcgcttaggttccatctgggagaaacagagaggaaaaaaaaaaatgagcccacatatagaaaacagaattaagagctaaagaaagttcagcctcggacgcaccktgggatgcccttacwaatgtgctttcagggctgctggccatactttcctagagtgtgtcctgggccaggtctcaggacgtgattcctggttggtgtggtctgaattgctggcccttcctttcctcaaatctggtgttcagatttggacagggggaaggagggaagcacctgaccgaacgttctagcatcttagccctaagcatgggaaatg

SEQ ID NO: 4404 - DNA, 600 bp, Bovine  MMBT01412
cagtacactgcttactttgcagctctgtctcttaccagatgctgccacagttacatttgactttagaactcactcagactaggatgagaaaatagctatttcttctccatttgccaatagagtcatatttacattataacagtaataggatacaagagatcacatgtgagtttttaaattctgggtcatgaaacaggcaaagagaagtctaagacaactctaatttcagatgggaagttgtttaccaagttttcttttggcccttagatcttttactgtaactgtgagctagaaggaaayggagtaatatgaatttcatatctcattttcttcttccttgcctgtaattgcagtcctaatgaccaggaggcaggaggtgagaagtcttatggccacatagacaatcttatcttctgaatagctaattttatgttacaccagaataaacatttattctttactttactttcatatgctgagatatagagattaatttcattatttatctgtataggcaatacatgaataacaactgaatatttatattgtatttttctaaaaattaaacaaaaaaacagggatgacctacttgcaaagcac

SEQ ID NO: 4405 - DNA, 598 bp, Bovine  MMBT04089
  misc_feature (1)..(11): n is any nucleotide
nnnnnnnnnnnttgctgcctggcttccctgaaagttgactttggagtatctgctttagatgtccctctattttctcatattctgaagctataatattatctctgcatcaccaatgtttactccttctctgctcatagatgttatatttctggcttatattgatttttattttaaaaatgatgattgactcaaagcattcactatcctttcaacatatcaatcagttcatatgagacttttctaaaccttgagttctagtaggacttcctttactcctatataagtttaagtatatttttwaaaaatgtttagcatttgaagaaaagaaattcaattattgtcttctgscccaatacactctatcttagaaacaagaaaggtactctgtaagtatcagcttctgacaaaaaacttttcctatacrctgacttttttccttttaatataatattttgtagaaggaamtggcaacccactctagtattcttgcctgggaatttccatggacagaggagcctggtggactacagtccatgggatcacaaaagagttggacacgactgaaagactaacaygcacastgccctacttgcaggac

SEQ ID NO: 4406 - DNA, 600 bp, Bovine  MMBT09025
tgcctttccttgcggggatgggaaggagtggggtgctggagaagggctgggatccgaggtgccaccagaatgggtggcctgagtcagcggagctgttctgggtctcggggatttccagggggaactgcgtggacagaattcccctgggatgatggtctagacagggctcacccttccctctgttcaccagggccttctgcttcccctttaggaagaggaaacaccccagatgtttattttggggttgaggatctgttgtgaataagccccaggatggatctcaggacaagtctttgcacrtgtggggtatctcaggaaccagacagcccttgtcacagagctccagaaggaccattgatcaagtagggaagtaaaggaagggacaatgcctgagattaaatctagtaaataagaaaaagtaatttaagaaaagtaaataaaagaagattagaattcttgctaattttccccatcttaaaaccaagctatttttattaaaaaaaaaaaaaaaatcccatagccactgacagccattattggagtaaattccaagtacaaattaacataaagagctaggcttatattatacatggaaagtga

SEQ ID NO: 4407 - DNA, 600 bp, Bovine  MMBT10136
gctgcttacctcagttcaggtaccaggagacattttaaaaatcccaaaactgcccttagacataggccaggtataatctatttcctccaaagagatgaccctgagctctcatgcacacccatccttcccgtgatggacccacgagcccctcccccaacttcttttttaaataatacatttaacttttatcattgacaaaatttttgtagtagcaagaataaaaacaacctgcatgacccaaggcacacgtgccaaccacttctcctaaaggcgtctgtgcctacttgtccacttgcattygaggggggtccgcaygtcagggttcatctttatgatgcaataccgagggagaccggtgttcggtcccacatgaaagtgcacgcaaacatattgtaaatgtggcctctgccagaacactgaagactgattagtaaatgattcagaggaaccccgggtgaggtgagggaaagggaaggagtgaagggaggaggtggagggccacagcgtgtctgcgtaaagggcgcactaccgacgacaagacatccaaacctgaccccagaccttccacgctacaggatggcaaatctccggaaatgcccg

SEQ ID NO: 4408 - DNA, 600 bp, Bovine  MMBT09909
aaagattccctctgggttctcataagtgtgtgggtgtatcatcctcagaatgtatatattcacactcaagcccagaagtcagcattccagtacacattagaaagctgtcattcattgagctgtgttgaagacagatttacttcctcagcaatgtgatggaggcagctccgtgagctgcctctactgtggccgagataacaagcctgcagggagaggctgcgtcacacgctcctctgtgaaacagctgctccttattcagaatcagtgtgtgcagctttttaaacagcgcgttttcattcygggacgcatgacaggccttggttttgttttttacatttctctgctgctcttgggtcaagcaaaygtctgcgtgactttgcaaataacacttgatttctgttttcttaaaagaaattggaaagctggacagccagataactggggtcatggccacgggcctggagaagattgcgctggactgattaattttgggcagtggaacgatttcccatgtgaagacatgaatcacttcatctgcgagaaagacagggagagaggtaagcagtggaagggatttaagagagcacagcagagcttata

SEQ ID NO: 4409 - DNA, 600 bp, Bovine  MMBT06795
tctcagcaagctggagttaaaattggatgtgctggagcaggtaagcggtgcagctgtcacggattggaaacattttcagcctgtttagaagtaatctggtctttcctgcattttgattttatgctttaaaaccttcgtttttctgctaatgtatttagggctatcttgaaactagagaccctcttcagaatttttttcttttacggtttgttgctagtgatgrattgttagaatcgtaatcccccaaattgccgcaaccgaaaaacaatttcattgttcttgtcagaattcttccagaaycgaatatgctaatttacactgytaggattctaaatgatgctggaaaatattatattccttttttcccttttggggaatgaaggggtcctgaagacaacaaggttagatcttgaggaaagttctctttgtaggaaagatgacattacccatggaatcctcagaatattgagtagacaaagattgaaaatgccagcataattgaaaactttcttaatcacttttaaaattttcttttcaacgtgagaatggtcggatgcgaattaactgtaacttcaaagtttttatattaggtcatttagt

SEQ ID NO: 4410 - DNA, 600 bp, Bovine  MMBT07427
ctcaactgaatacattatgctcagctaacaagaaaaaaatcacaggacttgacaaaaagcaaaaaaagcacaatttagacatagcaaacatcagaattagacacaacaaggatattggatagatcagacctggaatttgcagcaacagttattgatatgctaagtgtgccaatgaataaagtaaatggcaagcagcagcagatggtcactggaagcagagtgaaaatgttaagaaagagtcaaaaagaaatactagagataaaaaccactataatagaaatgaagaatgcctttgatggrctgaacacaaatgagtaaagaatctctgagcttgaggatgtctcaataaaatccttatgaatgaaaagcaaagagaaaaaagattaaaaaaatagaaattccaagtactgtgggacaactacaaaaggtataagatgaatttaatgagaataccagcaggagaagaaacagagaaaggaaaagaatatttgaaataatagtgacagagaattccctcaaattaagttaatgtcagataccaaactacatggggcttcccagatagctcagttggtaaagaatgtgtctgccaaagcagga

SEQ ID NO: 4411 - DNA, 600 bp, Bovine  MMBT11224
atgctggtgttcaagtttgcaaagcccacttccctgcatcctctctgtttccatgtgaaatctgtcttgttgaagcccatctgagcggccagtgcagccctgagtcctgtcttctagagctcacagtatctttcttctcttaggaaagttaagtgttaacattgccctgaccgcatttgcctttcaggaagattaatgaagttcagcctgcagaagataagcttgtctgggaagagtaggcaagagctaagctgtgtcaacacggcctaagggcaggagagaaccagattgattacttargttatcttcactctcctcctccctcccccatccatttataattctaatacaatttgatgtctgtataaatgtgaagaaagataaagaagcaagcttatggaacagctgcttacagtcctagtctttaccaggtgctaaacgcactagaaatacagcaaaatggataaaattgagttctcggggatagcactcctkaaatttgtgraggattgggggagaggatgtaggggcaaacagacartatgagacccccctcaaggggtctgcttgagtgctaatgattattaaaaaattacttcc

SEQ ID NO: 4412 - DNA, 600 bp, Bovine  MMBT12095
ggaagaagttgatttttttccttcattagcaagcaattaaattaattcaattttcttttacctaattttacagttatttaatccattaatwctaggtctgttaaattaaagatcctgaaatttgtttgatcacttaatgcttttgttgggagataaaagttaagctctgatgtctctaaactgagaagaagcaaaaagtcatttttcacagtccatttgctccttcaatcactttatatgtccctcaaggaagtgtgtctatrtatsttgtccatcataacccagctaattcctcatccygtatgtttattcccaatgagatgaatagatcaagggcctctctgaggtgttacccagggccccataaccattaatcttgaactacctcctttctgtgctggcatttgcygccaattagagtttagattcgacaagatgcttccaattcaccttcattatagactaaccaaaagtagagagtttgtatgttgacactttactttaaaaacaacaataaaactaacaaggaaaacaaaatacaagataaagtccacaagtkttgacgtcaaactagagtttatagattggttctcagtctac

SEQ ID NO: 4413 - DNA, 600 bp, Bovine  MMBT13105
tcagttgcatgtttctactttgtttattgattgttatacatactaatcattgttaaaaagcaatgaggaaattaacctcaaatatataatgtaaaaatgttttgttcatattataacttttatgttatttgttatgtattataacttttttccatttagtgttctaataaagattttttggggacagctttttttccctgtgacttagattccgttttagtttttcctgctgattgttagtgtttttctcttcaattagatagaggagatcatatcaaaaagtttatttataccgatggyggactgaatattagtctttatttcaatccttataaatttttcatctgataatagtttctgacccttgttttccttagataactttataagacttaatttgcttatctattagtttattggtttagggaattttagctgtctatggtttcaaaatgtgattataaccttaagaatatgtgaatgtttcagtaatatcttttgatccacatgaaaatttgttctccaggtattggccaatatttttagtgtgtatcattattctctaagggtaaattttgtgttgttttattgcataaaaat

SEQ ID NO: 4414 - DNA, 600 bp, Bovine  MMBT13644
atgtgtctctgatctcctaaagtttttgtttctatttttcagatccttatgtgaagattcatctgatgcagaatggcaagaggctgaagaagaaaaagacaacaattaaaaagaatacacttaacccctactacaatgagtcattcagctttgaagtaccctttgagcaaatccaggtaatgttaaacatattttgtcttccccttcgatttcgtttcttcagaccgcataaattaaacacacagaccttgtaaactctcagtgcacatgtctctacttgaactgccatccttactccaygcacattagatgctcaagctacrtgaagagggaaatgatgaaatacacagcataggatacgctgcttcatcagcaaaagcagcagcattctggtgagcagaaataaagtaggaaaaagaacaccaacagaacaactctgctaattcaaaaagtacatccacaaccgttaaaaggtcaagaaaaaatgagctttaacttttgactctcaagccacagtatttctcattatcacctctttgtagcaaaaaataaaaataaaaagtgagaaaagaaatatcttggttgatgctagatatgcag

SEQ ID NO: 4415 - DNA, 598 bp, Bovine  MMBT05249
  misc_feature (1)..(78): n is any nucleotide
nnnnnnnnnnnnnnnnnnnnnnnnnnnnnnnnnnnnnnnnnnnnnnnnnnnnnnnnnnnnnnnnnnnnnnnnnnnnnnggaaaaaaatcaatcctcattacctttttgtgaaaaaatcttttggtgatgattaagaactttcgaaattgtggaagcagctactcaattgaaactattttattacaatagtgagaaactgatcaacaaagcaagtaacacaggcgtatttaatggataacaccacctacgaaacacagcatatccaggcaacaggctgtagttaaagcaacaaaaatttcrttataacgaactaactcagaatcttctgtctctgagtaatgttgaatgaagtgtatccggaaggcatgatggggtataaaacaaaccactattatgaggaggaagaagaagctcttgatttgagctctgtactcttgatgggtccacatgtctggccaaagagcctttaccagttgaacaatgacccacatctgtatcagaaagagggtcacaactgttgtcatcataatgacaatcatagagtagttcaagataataaactccttgcgtttgaggtctttgtagaactcaaaacact

SEQ ID NO: 4416 - DNA, 600 bp, Bovine  MMBT16173
tgaaccacatatgtattttaaaatttcctaggagccacgtgaaaaaggaaaaacagatgcaagtgagtctttgaaatgtggtatgtattttacaactataatattaaatcagttcagactagcaacagttcaagtgttcaaccacaccatactgaacagtatagtcctcgatcagggatcagcaattttttttctgtaatgggccagagagaactttaggtttggggggccacatggtccagaagcgctacaggcataaatgaatgaaagtggttgtgtatgacaacttctgttctagayggctaaatttactctaagtctggctgacatacacgcacagtttctttttataatctcatgggactatggtgaacaaggctggtgcttccctcacaagggtatgtgtctcattccccttgccagagactgcttcaagaatgggcacgagtactcagttagagatggcccacttatagttactgagaagagtttagaaggaacttttttataaatgtgtcaacaaatttaagaaaaacaacaaaagatggtgtagattttagggctagtaacacacaaccaaaaactgctactatcctgaaa

SEQ ID NO: 4417 - DNA, 600 bp, Bovine  MMBT15363
agtatcaataggatgtaactaactaaagccataggaggtgacattccaggaagaggaaatagcaccaggagacccaagatcatgagaakagaattttctgagaactaaacagactttggtgtgatgaaaagtggttcaggaaactgacaggactccagcctgggatctagtgtggggacaccatgagccataccccacagtttggaaytttggaggcaaaaggaagaggagagatctgtaagcagaactagaaaataactatgatacccggtggaggatgaaatggaaaccaagtatcargtaagacaatatatccagattaaaataataatagcagtttttattattaaaggactctgaatcaggattgtggtttaggagtttcaaacaacataaccccctgagctgagcatcgctgtgactggtgagagagtatcctgcttaccaagggtgttggaacaaataggctgaaagctgccatgggagccacagtgtatcttccctgcagtccaaaaggatatctgtggatgagagaagagatggaagcaggatatgagctagctattgtaaaagaacacatttgaaacattyastcatcaa

SEQ ID NO: 4418 - DNA, 600 bp, Bovine  MMBT22827
ctgttgcaaataaggctttaataatgagttggtaaagtgttggggagtgaaagtgttcttaggtcttaattagatctcagtagttggctgagtctctatctggattgtggtactttgcttgtgcttttcagtgcttcccaccccttaggtagaatgaagttgcatatttcccttccaccaggtcagttagastctaataaaacccaatatgttggcctctggttaactagtttctcctyagagaaaaacttaagaaaaatagaatgctctagcattatttaaaaatggttcattttcccmctccctgctggaagcatgagggaattttycctccgatattctctttgaggtaaaagaagaatggggattctgtagtgactggctccccctggattctttttatttttaatctcttagacttgtccacactgagcctccaacaatttgtcaattacagctccggtttctccactcagcactgattcctgtggagactgctgcttatgggtttctgctccgctaagttgtgattctcaatgtttgtctgttggtatctccaatttggagggcagtagtttgccctgtgatctcacttcttct

SEQ ID NO: 4419 - DNA, 600 bp, Bovine  MMBT18531
ccatcactgccagcctggtggtgccgtcctctgcctgcagaggcgtcacagctcacagggcatgaatgtcaccccagcactgccagcgccgggcacagccacacgttgccccagtgacaaacaccgctggccccaggaggtggaggcgcacagggctctgggcgtgaccttggtccctggacaccaggaggggcggcgccatggcctttctcctgggtagtccggggccaggaggatgagtaccgggaagaaggcaggccgcctgggcatggacaacctgaaaatgccaccttcccaagsagcgctcccccccatttctaatagaacgtagttgctttgkggggaatagaatgcagaggccaacgaggttgtcctggccctaaggcctgaggagcaggtcctaacaggacttctcggaggctgtggagtcaggtggggtaggggtggctgtcaccacacgctggggggcccaggatrgacagggtgggatgatcgcttcagacacccactgcggccagaggagcccctctttcttaccaaggccccctctccaattcaggccacagagcctgacaaggaggccaaagtccaggggcatga

SEQ ID NO: 4420 - DNA, 598 bp, Bovine  MMBT22551
  misc_feature (1)..(8): n is any nucleotide
nnnnnnnnacgctggtcctgggctggacccggaaagagcccgcacagctaaatgtgccctttcctgatgctttgggactcgcctctctaaatggggtttggctcttatgaggctacccaaacccctcagaggtctgggcccaaccccagggcgaggctgcactctgcatgaggtggtgccatcgagcacccagcagggaggtgggacctgaacctcaccaaggaggaagggcagggcccagcggccgggagatcatgatttgctctaggaggcaccgttctccaaaggacataacaaggygggtacctgggatcttctcaggaaggggctctgaaggaaccgctggcagctctatctgttcctgcgggagacagagggtaaaggccgtgagacactcccgccccatccttgtcccgggaaggacagcatcccgtccacctggctgctctcagcggagtttagacggcacgtgacgccgcagcatgcacacccttggcttctggcgtttctgtcactcagatcggtggccacaaaaggtggctgctcccaatgacccggagcctgaggggttccccgcccagagttctgttctgagtct

SEQ ID NO: 4421 - DNA, 598 bp, Bovine  MMBT19858
  misc_feature (1)..(55): n is any nucleotide
nnnnnnnnnnnnnnnnnnnnnnnnnnnnnnnnnnnnnnnnnnnnnnnnnnnnnnntaatcatcacctattaaaaaattctgtgttttttttttatgctattaactcaatgttatccctcatttggggggggggccagtaatttgtagcctcatttatcacatctaattcacaattctactccaatcatttctcaaattgtgatacccagatgggcatcatcaagggcatccatgtgaacttgtgacacatgcacatttttggtctgtatccaaaaggtaatgaattagaaaccctagggyggggtctaaccatctatgttttgataaatcctcccagtgatattaacacattctgtttgaaaaccactgctcttgaattatttttcccatgagattagagaccttgatttggttgtcaaattaaataccactttttagctttcctcataattgatatttagaaaatattcaggtgagccttgcaggacaggagccatggagctggcactgagagaggctgctgccagagcaagtgggagagacaaaggctatgacaggaccagttatgtgtgtgtgtgtgtgtatttttaagtaaatc

SEQ ID NO: 4422 - DNA, 600 bp, Bovine  MMBT01446
cctgtaatggtgctgttaattacttcagactgtgcagctcatgaaaaattttaagggatagataattttacttttcttgcctctccctgtctggctccttcacctctcacacaattcctttgaacaattttagttgtcttctgtggtcaccagtgtctgagatactcagaaaccctttcagagagcaaggtgtgagtggagtaaataaaatcatgtttcactgttggtatatcaaccctcctaggtagttttcctgccagccaacctgcgtgctgttaaggcccataaaattatgcaatrgtgacttctttggaggttctttaatcagataatggccggtgttaggagggaagggcccagggcgatgttgctggcacttaacactgggctcggtcattacttgtctggtagagaccaataaacagctgattactatcctataaggagccaatattttacatttatcccagttattttcttcttctctttgcaacttctcataacaacaagcatttgtcaagaagacctacgagcggtaacctcacaggccccttaaaaattagaattttcctagcgtgaaatgatgccttttgtgaaatg

SEQ ID NO: 4423 - DNA, 600 bp, Bovine  MMBT00606
caaaaaagtaatcctgatttggtaactcggtgtctttaaacttcaaactaatccttcccagttcagaactagagccattttccctttttaaaaggatttgtagtcgtttgtctcaacagctggtctttagagctgccctatctatttcttctgtgttccaccatcactaggctacttctgtgataatgtaatatggagaatgtctaaacgccaacggatgttcagatctgaaggtctgtgggagcccgccttccaatgaggttgtttgtcagtgacaccaaatgagttggagtacaagcrgtagggttactgcaggttctgaccaacttggattcaaaggacagccctcccgaagaatcaggagtgtctggaatgtcaagtggttgaaagtctccctgtgaaggaggaaggattctggttgtgctctccctgagctggcccttgaggtaacctttaggaggtaatgcctggttttcactttctgcagagggaccccgggtagcccgaggccacttcggtttccaggtgcagttagctggcagagagaaagctgtttggggtgactgtcccacgtggttgttaagctctatagcatcacct

SEQ ID NO: 4424 - DNA, 600 bp, Bovine  MMBT01290
cttaataaacttattcaaccagtgtcacatacctacatggcatactgtacttgactttagagacactggtgaagaaaacattctgcccaccatcatcaaatttgactttttttgtggtaaatacagacaagtaaaccagtgattgcagtataatgattataatgctgttgacttacttattttatttaacgtagtgatcctctcccttagaattattatctttcctttatgggtttttttgtaccaagttaaccacagactagattatattagagttgtttgggattttatttgctctcyaataaattagaaataagaaagttaagaccatgctccacagctttgaagagtacagttgacccttgaaaaacacaggtttgagctgctcaggtccgcttatacatggattgtttctgttcaaatcctaaaagatgatgttgtgaaagtgctgcactcagtatgccagcaaatttggaaaactcagcagtagccacaggactggaaaaggtcagtttccattccagtccccaaaaaaggcaatgccaaagaatgctcaaactaccacacaattgcactcatctcacacactagcaaagwaat

SEQ ID NO: 4425 - DNA, 600 bp, Bovine  MMBT04636
taactagaccgcatcagccaaagtgtagattacagaacatgcttcatcacctccgttgtaattataaccttgattatctgagagatgtttcctggagacagcctgatatttccatctgaaattttcatggtttggaaatttgcagttcaaaggaaatgtttgacaaattggcccccaaattaacttggcatctgttttaggtcattggcaactatctgcctggcatggtttttctcttgccttgcattttaccctaattcctcatacaaccccttcttgtgtgtttttaagctaataagmcatgtgacatttttgtggcagaaagaggggttttattcatagcttcctgtaatctgttcctttctctgaaaacgttataatttgcagacttccagattttaggtattttcttcttaaatttacagagactagagaaatgatttttcaagaagatcccagatatgatgtgtttaataaaagactagcctactgccccacttttcggcctattccaaagacccactgaataatcttctttgttgaaaacactaattcattatctcttcttacctcctatagagtgaggattgaacctaaatc

SEQ ID NO: 4426 - DNA, 600 bp, Bovine  MMBT04775
ctgtagccccccaggctcctttttccatgggatttcccaggcaaaaatactgtactgggttgccatccccttctccagaggatcttctctgacccagggattgaacctgtgtctgcagtttctcttgcattgcaggcagattctttaytgctgagccaccagggaagcccataaaagccttaggaacaacctaagtctgcattcctgtttccttttagtgggagggttaaaaatggaatgatgaggactgcagaaagaaaagagtaagcaagctgtgtttgggagatttgcaagctttaytgcaaagagtgccgggtgagaaggatccctagggaggaggtccaggaagggaggtagtgtgaccctgaggagggggtgaagggcttggaggagcacttggatcttcttagaaatagaacaaggagctgcaggagggtgctggctgaggacatttgtagctaaacatgatgtsacatgagctctttcgcctccatcatcgtggcggcagctgcggtggccgcgcrgtttagtcgcgcatgtgcagtgtgtggtctacgcctgggagcggcacacccttgaggtgactggcaggagatggtt

SEQ ID NO: 4427 - DNA, 600 bp, Bovine  MMBT06378
tattgtgagcaaaactattagattaagaaaggatcaccctataatctaaaatgctcccaaggaggccagatagccatttgtcagggacgccaccaaggcaattcccgcattcagtgggaagtgaataactgatctttattttccaagttccaggatggttttactccatgctcctgaacttagtatccttaaaggaatacataaggttttactacagaaatggcaatgtcacatagttcaatctaaaaggtctgactttcccaggctgacatgagccagtatcactcaccaatgagcaayaccaggcaamtatatgttcacttagaaactaagggcgtcaaactcactcttccctacgtacatcagttcagttcagtagctcrgttgtgtccgactctttgcgaccccatagactgcagcatgccaggcctccctgtccttcaccaaatcctggagtttacccaaactcatgtccattgagtcagtggtgccatccaaccatctcctcctctgtcatccccttctcctcctgccctcaatctttcccagcatcagggtcttttcaaatgagtcagctcttcacatcaggkggccaaagta

SEQ ID NO: 4428 - DNA, 600 bp, Bovine  MMBT08230
ttgagagaagaggtttctcttctttctcaggatgccctgtggagaaacaggatttgtatagacttccttgctctggtggggatggacaacaagatcacatgaatccttcatagcagtagctagcaaagaagcaggatgaagggttctattaactgtttatttagaacttgaagtatgaaatcrtgtttcatgggcagttttgggacctttgtgcaggggtggctgggagtcaggcatgygacctcttggagaaggaaaagtcacgtggtgggatctaaaagcactgaatcaaatgttatyaactggaagactaggatgaagccacacaaatgaaaaaggaagatgagagaagtgttcatatgagaagmgagttgaaggacaatatatgcagctttgtcagcaggggattgaaattccacagatgaaggcttattttcatatacttacactgtgggggctgaagcccctcaggagaggccctaaatgtgtccttccagaaagacgactctagtgtggaccaacatctttagtgtctctgatgggtaatataatagaggtgggaaagatataggtttcatggaaccaaaagcgtaaacagtt

SEQ ID NO: 4429 - DNA, 600 bp, Bovine  MMBT07833
aaacctgtcagaaataaygcatggaccaaagatctgcatgaaaacataatcacacatttttaaagtatacacctcaaagagcacaggttcaaggggagagagagcaacagaggttgtatgatgtgaatgcttattgcctcttcataaccacaaactgtggttcttaacctggaaacatgcatctgattattgtttgcctcagaaaagccataaacatcaggagaaggaaatgatccaaaaaatgtggcgtgttcactctaaggggtaaactggaaataacaatgaactgtgagtattgayttaatgtctactcatcattaaacaagatgcctgtggacttgtaattattggtttagaagggcagcagtgatacatatgaatctctcatactggaaacttaagtttttgcattaacatttgtctcagggaccacagtatctgtacatcatcaatataaagagttatactcagagattgtccacatgtgcactctaaaaaaagactacactgtgttcagagcagtcaagaaatacttaaaaaaagatagcacaaaagaagaggaagatataggctttattatggcaacatggaaaagactga

SEQ ID NO: 4430 - DNA, 600 bp, Bovine  MMBT06564
tactgctgttgatggggctgctgctcagctgggagagtggctgggcaatctcggacaaagagctccagggtaagtgaccaggcccccaggggtcagagaccatttcttccctgtgcattggatctggtttgctctgctcaggcccctctctgagccctctgtcgccagcccaggctctttgtggtcaaattgtcttccaggcactttcagatggaacccaagccctttctgactgctgcatctccttcagctgttcccttcccagtctgcttggcccagcgcccacacctcccccatgaygctccttgaagcctggaccactggggcctctgtggacttcccttggagtttccataaagctcactacctgtatctgccaccttgccacctagaaaaccaatgctctggattcaggaaagaggaaatatcatttattaggagggcttgtcatccttcaaagcccggcttttgcttcccctcttctgctaggtccttcttgacacctgtcttccctctgcttcactctcgtcccgcgagctgaccagctctccggggtagtagttagaaaccctaatattgagatcagaggtgggtgggagt

SEQ ID NO: 4431 - DNA, 598 bp, Bovine  MMBT05278
  misc_feature (1)..(70): n is any nucleotide
nnnnnnnnnnnnnnnnnnnnnnnnnnnnnnnnnnnnnnnnnnnnnnnnnnnnnnnnnnnnnnnnnnnnnntatataaataatggatttggaatgcttaagattagaatatttgccagaatcgtaaatcactgatagaaaacaatggtctttattactttaaaaattaaactaaatctaggctatttaactatgaataaaaataaaaatgagtttggatgggttggagtttatttcagataaacatctttcttttaaaaattttatcccaaacttctctgtgtccagaaggaggcttgcartctgatcagcacggggtttcccgtgaagctgtgttgctcttcctgtttactctccaagcgcacttgcacaaggcagctgtttaggacgaaggcttttctccagttggtctcagattgctaattagattggtaagggagagatgaaatggcccaaatggttttcagccccaagttgtttgaattaaagaaacactacatacaattatcagtgattttgtaaaactcttttaatgaatcaacttttcatatgaatatataaatacaatcgttgtttgttgtttagtcggcaagttgtgtc

SEQ ID NO: 4432 - DNA, 600 bp, Bovine  MMBT07935
atcacaatgataattaccaatttctggaragagggataagagaaataaaaacaagtcatcattacaaaccaccaaaaagccggagtcagccatccaaaacccacctctgcaccggaagcctcttatsrccccagagagagtgaaatgaamagctgacatcgctacataaagacgttccactgggctctcgtgtttaagttgcctctgcactagcagtgccagcaggtgcaaatacggagcctccatcagctccgagctcacgctgcagccctcacgtgtggacagacgtggccacaaccrtcacggggtgtctaagcagcagtaaaccaagatacaacgtgactgagattttccttttcaggggggaatatgaagacatatttgacacagtcctcctaaatgcaaactgccatccatctctccccsaaagaacactcccacctgtcaaacccaggacagtgactgagggtctgaaagtacaggtcctgttgtgaacaggacaggattcatcatgtgaaataacttcccagctccctagacacctgcccaagcaacaggtaaagttgggaaaaaargaactgaagaatgaaaatatcagag

SEQ ID NO: 4433 - DNA, 439 bp, Bovine  MMBT09732
aggacttcataacgatgccctgtttccaccccttgccgccacctgggaagtagctctggtgttctcagaagttcccactgtgagagcagacccagggcccagggtggggcgtggggttgaggagggggtatttgagagcagttttcttccagtttgtacttctttctgcaagtagccagtggtggtgcagctgagcccagtgctcttccagaaggacatggctttctctggccaacggggagctttggggtcccctggagcgtgacatttggtagccctcctttaaaaagctgtgtgctrtttattggacagtgaagaatgytcatttcactcgcttccttcttagaaaggtcagtttcttttcatcaagaggctacctttacccaaactagctctgtgcccagcgattcggagatgcattaggacaagccaaatgaaa

SEQ ID NO: 4434 - DNA, 600 bp, Bovine  MMBT08739
ataaaagtaaaccattagctgcttaaaataaatgaaaatatttctatttaaaattaaataaaaatactgcagtccctcaggagagattcttagattttacttttccaagtgacctactttttaagcagttgtaattacttccaatcatctttctattcaatttattaaatgaaggctttgctttttaatggataatctgcattctattaaagattgaaagcaatgcctatggcttagttattcttcactgaagcaaactctttttggggactcaatgcttatcttatagttaaaatgcayatttcaggaaattaatttcaggcttgaaagacaagaggcatgcatatatccratatggttacagcacaagaaagcaagcaactttgatttctaaagtactaattgtcaygttctggaactccyttgagataatgtaagttagatcctaattttcaaagaagcctacatagaaataataagtacaaaataacagacccagtatgtgtgsttgatgtcattagaatgctaataggaaatgcttcagttaatgaaaggcaagagttcacatcatatttaaacaaaggcactgtgaacaattaa

SEQ ID NO: 4435 - DNA, 600 bp, Bovine  MMBT04219
tctctctggcttctcccagaagttagataacaaaatatgtaatagcttcaaagtccctgtgcaggccttttggtttagaaaaatgtgcttgtttttgttagagtttttttttttttttttttttaagaataaggtaaaaaatagaagcttgtccttttcagtcctaaagaaagtaaaaatgatgtgattggactcaccactgaacttttacctaatgatgtaggggacctgtggttgcctagcatcattagcctacaacttcaggcctgggaaagaaagagatgtggcgttcttcatttktcccctccctccagagaattgtcctactggcagaggctaaatttcaggtatcaggtttcaggtagtctctttattatacattcccaaatgccaaccctgctgtaaggttctgaactttttttaagactgttactttcctcagaagagcatgttactgcttagtatcacatatgtctgaagaataaaggcagagcccgatttctttacatttttggtgggacaggggtaatgattttagttattaagaatcaaggtagggtttggcccagaagggagcctctcaaattttgataaatcata

SEQ ID NO: 4436 - DNA, 598 bp, Bovine  MMBT06379
  misc_feature (1)..(203): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgcaccctggcaatatgaaggcaaagatcaggctgagagaggtaaggaggcaggagacggtagagaggttggagaatggctgggagtgtaacakcctatcttcacacagtgagggaatcagaccaagagcagagasatctcagtatcacaatgcaactcagaaacagagtggaaaggaagtacagcgaggtaaaatgccccaagcttgataaatcaagaaaaagtagtacaggtatgttttctaaagttatggaggtaatactgtttgataataactattaacaaaatagttaaaactataaacagaaacagttaaagtaacttgtctctgaacagtgggactaggtgcaggtgaagagtgtggcaaaaggccactgattttttattataaa

SEQ ID NO: 4437 - DNA, 600 bp, Bovine  MMBT12936
ccgcagctgtaaaagtccagatctgtatccactgcccaatgtgaatgcacaatgtctccttagggagaggatcatgctgaaaattagtgttacgtaaataccgttaccttttctggtgaaaaactccttggaatatttccccaacatagcgtattttcgagggactttccccagcagttcaatgatcaatgctatgtgatctgcattgggaaacattgccagcaaaacagaaacacacgacagtttaatcagtacactgcatgcagacaccgctatcgcccgcgcagacagaaacagagygccgcccgcacagagcacaggctctgtctgaaggcccctcggaggagatgcacagggggccgcagcctggggccaaatgcggtctccttctcaactttgagatcagcacaagaattctgctgggttgctttgggaatttaagagaaatgcctttgtcaccattaatgctaccatcagcagctgctattccgtttctgtctgcatcgtggcgcttttcaaaaagaagaggtactacctctgcgattgaagaattcccgagaatattttccagatagagcaaagtgccttgggatactgcct

SEQ ID NO: 4438 - DNA, 600 bp, Bovine  MMBT13099
ctggttgaaattatagtttcataaatgaatgtcagtggtatacaagtaataataactttttgttacaaagtaggattttgctctatatgtaatgagtaaaattattaaatgcaatcttatgtttcattactgacagcttgttataaaaaaggaattaagactgaaattttaattattttcataaagtagatcagctttttcactcatgtgtagtgaaacctactcgactgagactcttttgaaggaagccctcattamattacatcactaaatacaggactgacagttcatattccaaaytattccctccctaaactcttcaaytttaaaggaatctaggaaaatattaagttcaacataactataactattaagttaacataactatacaaaatgaaaacattgaatgcatatctttggcactatttggaatgcagtatttggaaagaattttatgagactatttcattggtagtaccaagtaccatcaacatagatgttacgatccaagttggtggtaactaaaaaggactaatttttgttgttgctttgragcattatatccttagtagttaatacttaagtatcaattacttgaag

SEQ ID NO: 4439 - DNA, 600 bp, Bovine  MMBT11529
agaataccagatttcaacactgggtcaaggcagaaatgacataacaaatagcagcttctacatgtgacacgtaggtatattttcctagaatttaactggggatggttttcatttataaacaaaggtatgaacatcccacaaccatgggattgctgggtttcttcatttataaatgttgacactgacaggtaatggctgtttataagacttggatgtgtttatttactcagtctattaaaatcagtctcacaatttctacatgtaagtaaacatgtgtcatttgacttgtattatgcatamaattgttccaaataatctcctgagcttctgaaaataccccaaggacaaactttgatagaatctacttcaaccttctgaaactcatatttggttccagaccactaaatgctgatttcttgtgatcggtctcaggaatttactccctggactcattaagtgttagaaaagtttaactttactgttaaatgcgttaaatgcatgagtaaataaaaggcactaatgtcgttgtattggtattaatatttgctggaaagtgtgtgttacttccagtgccacttgtaacatgaatcgtccttggga

SEQ ID NO: 4440 - DNA, 600 bp, Bovine  MMBT12011
cttagtaccaggacaaagtccctgcctcattaggcaatatccgagcaacctcatcttctcgttccctgggagagcttttgcttttgtttatccacccgccaaatgggtgcatcacgcagtgtgtgcagcactcagcagataaagggtgctgacccacagctcctctggtcagttctttcaccaatcagcgcgggatcctaagcagggcccaccctggccggcctttgggtctcttgcctgttagatggggatgacaacaccgtccctgactccgccagccccaccaggattcttgggagwatttaagcagccaaaggctgggaaagccctttgcaaagtgtaaggtgctatataatcttggaaggtcattattatcctctttgcttaatggaatggagtcaaaactaaaccgctgcatactactgcttgttaattattagcaacaatagttactgcatactacttarttaccacaatatctattttacctttattacaatatctattgtttattttaaaatraaattgaaatgataggcatgtatctaygtatattaagcattcgtgcaygtgtactaagtcacttcagtcatgtctgac

SEQ ID NO: 4441 - DNA, 600 bp, Bovine  MMBT15879
ggggagctgattctggtttgtaaggcttaagatcagtttgggattctttgacaaaagaaatgctgctcatcaggcctgctctcttccaggcactttgagaagcagccagcaaggcgcagattcgaacctgttggagtctcattaaatgggaccccagtgcatctgtttgcacacaaacaacagcaatgcagttagagagagagtgtgtgtgtgtgcgtgtgtgtgtgtgtgcgcgtgtgtgcaaatccctgatgatttgtttaaagggcagggggcgcaacaaaaccacaaggacttcgstctctttctcttttccttccctttttsgcattttccttgggtggcatgtgcctctctccccagcatgaattcatgagagacctcaggggctgctgagaacaactgtggtttgaatgaattcttttacggatatcagtccggaggtcgccgttggctggagctggcaagcagcatttccctgttggtggtggtggtggttttccctgatggtggccagttyagctcaacagcccaagtcttggaaaggccacgccttgacacaggagaagacacgtccatgtacccctgaaaataaataat

SEQ ID NO: 4442 - DNA, 417 bp, Bovine  MMBT18005
tttccaccccttgccgccacctgggaagtagctctggtgttctcagaagttcccactgtgagagcagacccagggcccagggtggggcgtggggttgaggagggggtatttgagagcagttttcttccagtttgtacttctttctgcaagtagccagtggtggtgcagctgagcccagtgctcttccagaaggacatggctttctctggccaacggggagctttggggtcccctggagcgtgacatttggtagccctcctttaaaaagctgtgtgctrtttattggacagtgaagaatgytcatttcactcgcttccttcttagaaaggtcagtttcttttcatcaagaggctacctttacccaaactagctctgtgcccagcgattcggagatgcattaggacaagccaaatgaaa

SEQ ID NO: 4443 - DNA, 600 bp, Bovine  MMBT06664
tgatgctttmtaaggcccacttgacttcacattccaggatgtctggctctaggtcagtgatcacaccatcgtgattatctgggtcatgaagatcttttttgtacagttcttctgtgtattcttatagctgtgattatttttctcatcactctatgttacaaatttctaaaatggaaaccataggacttacataaaaaaaatgacttggtagaaatatgaccacaggtaaatgttagtagcttcagtttatgcagttttccctagaggtaacacttatttcataatgaaaaagcattaatrtatctgtaatgtcctaagaggtaggtaaaccaacatctttacattgctggagagagctaatttattttcaacataaagcatttcaaatatattctctcagtcaacatctactttagacatcaatttaagaaaaaaattcaaaataaaaatcaatgaagtttaagcactatttgagatactttaaaaagccaaattgtaactaatgtattaaattatactattcattgttctttatccatagtagatgtttacatctctctataaaaaatattgggctctcttcttctcttttctcttact

SEQ ID NO: 4444 - DNA, 600 bp, Bovine  MMBT13691
aaatgactataattaacattttgctgtttgtcctcctagggacctatctctgtgtgtgtatcttatttccttgatcttggaagcttttgtttttaagacacattatcaatttaataacatttttaccaagaaaagagaagtatacaaattttcctttgtaacaaattgaaaacagattaaaagaaatatatatatgactcataatgcattcctgtaagccttctgctttaatttaaatattgttataaattgctytgtgctatcatcatcagcagtccctggcagcagggatcattactrctggcagcctgtaatcattaccacttcatcccttttggaactgaaaatatacctttgagatatatttttgaaatatcaggatttttctgcatttcctattcggttaaagttagtccaagtttttccttatgcagttcctcttggtcttcggtctgagctcttgacatgtagctattcaggcctgagcaaaagtccttcacaatactcacttggtcatgccatctctcctagttttgaaaattttaaggccaggataatttctgtaggctttattgccatcacctaatgtgtggccaagtg

SEQ ID NO: 4445 - DNA, 600 bp, Bovine  MMBT15267
tcagtgattaaaaattcaattcagacatgcaagtggttggaacttgccatgggttgccagaagaatacatcatgtgacagtcaacagtggtgaaaatcatggaaaatgaaagcatctcaaaatggaaaaatataagttttcaaaacaggaaattaacttctgaaataaacaagaaagaatgaatatacatgagagtagtaagcaggtatgcagtgactacttagaaaaaaaaagtagtatttcatgtctcactatgataactatattgacattaaaaattatcttactcatatgtgtgcrgagagagctcttggtttagtaggtgyttcaccttacctctcccctcaaaaggtaggttgacttagagagccagatggcctacattcaggactagttcatcttagtggactcaaatgccatatggtccatttcttatctgctttaaagtataatgtattagtagaaaattggagatgtaacaaggccaacagatcagaagatgattgtcattataaaggtagggtttttttaagtttttttattatttattttgacagaaaacagcaacattctataaatatagtttttcattcacagttc

SEQ ID NO: 4446 - DNA, 600 bp, Bovine  MMBT13190
acttctaaaggaaatgaaaagaatttaacacctctttaattttgtttatgtaattcttttgcttaaaaatctcccccactaccacttcacgttgatactgctaaggtaaacattaacttctccgtctcactttaatatcaaagaatttgagaaacagcagcgtctgaattgtcgaggtttactacatttaagtcagggattgagttcaaccatcctctgaaatgaagcatcatcttgaaaggtttgtccatcaaccctaagtcataaatgaatctattgataacttgaatttaaaaagcrccaaaaagtattgggtgtgtctgtgataatcttgaattgaaatttggcactatcctctcctgtgaataaacaaatgcaacgtagcatagcttgtttggaatatagtgtatatttaaaaataaagtctggtgacagaagcttttctctttaggtggttaggcaggctgaccctgtgttagttgttgtgaaagtgaaagtgaagtcaactctgtcgtgtccaactttctgcgaccccatggactgtaacctattcggctcctctgtccatgggattttccaggcaagagtactggagtgggt

SEQ ID NO: 4447 - DNA, 600 bp, Bovine  MMBT15539
aatatacccatgaaatgatgggctggctggattaacaggcgagatgggtcacagagggccttgggtttcatctgatgagcctctcaaggactgatgtggaggccttgggtttctcaaggccacaaccccaagatgtggcatcttgggtttctcagcatygctgtagtgaatgattggagggcagggacaacactgggcacccaggtggctccagcagatcaggcagaaaagggcaagcgtctgaactgaggcagcttcctgggggatggacagaagtgggtgggcgcaagaagtyaaggrctaaccggagagtgactggctgtgtgagaaggggaaggaggagwccaggatggtcttgctttccaattcaggagaaggtggcgatttgctgaggagggtgagggtcaggaggaggagcaggttttcaagggtgtaggcaatggatatgtgggtgggatgggttgaagcatcaagctgagagcactcaggatatttagttcttaggtgtctcctgctgtggggcgagtctggggggcaggaggaccgtgggcatgcatgcacatactctcccatggtacgtactccttgcacccctcttca

SEQ ID NO: 4448 - DNA, 600 bp, Bovine  MMBT11962
gatcttccgtccctaaggactggccattgccctgtcccgctgaacttcacccacccagccatatacacagagagaacccccagacagaaggatgcttgcaatttattccacctgtttctctccacttctatcaactctaaccttcttatgaaactctctggagaagagattctcatcacctcctccagttatctacttctgccctcaataccggaaattcatatatttatctgccaggatttacccaagtaacacttttctgagaataaacagaacgtaaagagtgctgctttatggggraaaaaagtgggggaggggttcctttcattttgaagctgataatgaaggaagccaaaggtaatgttcagctgtttatccaaaatgttatctaatttattcacatctttctggcatttagattagcatgaaaatctgtcttctgaaaagttcaaaatctgctttgagataaacccttcctgttttcagtaaatgactgttgtagctttaagaagggtggtctcgccatcattctcacaccaaatctctctcttatattccgagacctcaagaagctgagccggtacagataagccactgggg

SEQ ID NO: 4449 - DNA, 598 bp, Bovine  MMBT20184
  misc_feature (1)..(20): n is any nucleotide
nnnnnnnnnnnnnnnnnnnnctttcctggtggctcggacagtaaagaatctgcatgcaatgcaggagacctgggtttgatccctgggtggggaagatcccctggagaagggaatggaaagccatgccagtattcttgcctgggaaatcccatgggcagaggagcctggtgggctacagtccatggggttgcaaagagtcgatatgactgagtgactaacactttgactttcaagcatgacaatatctcagtttattagagtgaatttacagagttgattatagaaattttggaaggagaycatcactggaggaagtaacgctgacttaatcaaataacctctttcagtctaaggattgaatttgtagcagctgaaagtggtacacaaatacatttgtagctttgagtttcaccagaggatggcgcccatacttctctgataggttttgccaagttggtttggcatcctttcaagccgtatccgagagacgttttagagactggttacctaaactgttaaccaaattaaggcctttattattaattcagttaaaatgagtgtaagtgtataacatcttcagaacaatttatgccaaaga

SEQ ID NO: 4450 - DNA, 598 bp, Bovine  MMBT20513
  misc_feature (1)..(4): n is any nucleotide
nnnntctttggtgagactggggttagagatataggctatggaaggaaggaaaagttaaataacacttatcggataaaagtaagacctttctcagaattacagtgtgttctaatgaaataagatgtgcatttcaatcaaggttctttaggaaataaacaactattaatatgatgatctggatggatgaaaagggcaaaaaagagacgatcatatgttaattcagtgacaaaaacttttttgagggttaccatgtgccaagcgctgcatacagtatctcatttcttctttacaaggaacccyatggaagcaggaatcctattatccccattttacagatgaggaaattaaagcccagaaaagttaagaaacttgcacaaggtcacatgatttactaaccagaaaaagtgagatttaccccgttctgtcaaatgacatgctcacccttaacaaacacccttctacaccacatgccaagctctctgctgtgctgaggacacagcaatgggcaaaacagaaaccctttttgacctcaggaaatccaaaaataagcagaaatctttgagcctccacttcaaaccttcaattaaacaagaaaaaa

SEQ ID NO: 4451 - DNA, 598 bp, Bovine  MMBT20846
  misc_feature (1)..(82): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnatctctgactagtgatctcgsctgtcagagcctcagtatctcccccttaaagaggaacttagaatccttacctccctgacagatggcaagtatgatgctcacaagaggaagagggagtagatgtgcttggtaaaccctgcgtgcatgctgcatgcgtgccaagtcactttactcatgtctgactttgtgaccctgtggacrgtcctctgtcaatrggrttctccaggcagaaatactggagtgggttaccatgccctcctccaagggatcttcctgacccagggattgaacccttgtctcttgtagctccttcayygcaggcagattctttyactgctgagccgccggggaagcccaaagcctgcacctttgtgtaaatatgggccctattgttcctgttactggcacccaggaactggcttggattccttccactgctctgatggaagataagtgctttggtacctaatcactgcatatgaatagcctgatttcaaaatatcattttaggataac

SEQ ID NO: 4452 - DNA, 600 bp, Bovine  MMBT20676
ttgaatttgaatttcaagcccattacagcaagtgtgactcagcagtgtgatatagctcagtcaaattggggaaatgggaattggttcttttacgggtaaagaaattgagtcaggggacaatgataggtcatctgtattagggaaactcccaagcaggttgtaaatcttctgtttctaaaggagctttctggatatagtattcagtccatatacaaattttaaaaagaaagcatagaaccagctcaaaacaagcaactgtaaaaacaagtttcagggtatgcagatgggcagaaaaagtgrcgttgtcaaggagctgatggttggagaggatggaaagctggtgagtgccctctgccctctccacccttccggaaatgaaaatgattgcagcacaaatgcatgctcattaagcagcaggcctaatgaagggcagacttttttggccctgtctgcaatgccagggaccttgctccagtgttgtcatggggaagttattgtcatcctcctggcaacaggttacctaggtgaataccacacagcctcacctggcccagtaagaagtggggcccatgctgtgcgccatccccaggctgctttgcc

SEQ ID NO: 4453 - DNA, 600 bp, Bovine  MMBT19830
ctgtgtgtgtgtgtattttaattctcagtgctatgcaagggacaagacatcggcctaccgaaccctacaaaatttgggcyttggttactttaaaaattcctttctccatagcacttcacagcaacaaagatrttctacgtttctcctgttaatgagatccaggtttaaaatttcagaaggaaccttttcagarcaagaaccccaacttaggggcatccagtcactagaaccataatgcagttatgtttattcataaagttaagtctattcataaagaaggaaaatgaaatgcaagaatcragtaaaaattaacttaaaattcaatgcttatacaacatatatgcatcataagatatataaaattattatttattgaatctgaagcagtccaaatgattayactggctaactgtaaaaaataaaatcctggtcatgtattttaaattataatgtgcttatttttattaaatccaagttcagaaaaatagattattatggatacttgtcaattcttccaattaaaatgtaccaacttaataaccaaaagaggaaataaagtctcttaaaataaatatctcttttttttctgaagaggagtaa

SEQ ID NO: 4454 - DNA, 600 bp, Bovine  MMBT22126
cagcttttgtttaaaaaacatatttattgaggtatacttcatatgccataaatttcactcatttcaagtgtcaattcagtgagttttagtaaaattacagagctgtacaaccatgtctcctcccgtgtgtcaggctacccatgmaatcttcactgttgaaccaatttctcattcgttgcttctagttttctgtattaaaattgtgggtaaaaggtaaaacaagagttaccagcctctgagcaaaaatttttttccccagggaggaaaggatacaagctgtagtgtatagattgtggcatktatattgtttgcttagagaccctttaamatatttctccaggtcttctgttctgattcatatagacaagtccactccatgtaactgctattcaaccctgctttctccacacccagtactagagcaaagtttaggctcttattaaggccctaggctcgcaacaattcaactatgcctacattgtcagggtacataaaaaatttcttttaaagaaaacaccaaatatatacaaaagtagaaagaaaggcaccatgaacctccaagyatccaacttccaacttcagcaaataacatgtaaccac

SEQ ID NO: 4455 - DNA, 537 bp, Bovine  MMBT03275
tcacacgttcgcaggaggccgtaaggaaaggtgctcctcatccgccatagcaaaggacacagccttgctccttctggatgcaaaccccaggcttctcccagaacctaggaatccccaacccaccctgtaccctaaaccggccaggccccaaactggcacttgctctgttgggtcaaaggcacgttccccacctttttcctaagcactgcaacaatgtctgcctaatgccacctccaccagcaaggcttctttgactattctgtccccttatgaacatgtttattcttgaaaacattccayctggtactcagccagatgagggctccgtactgctgtccctggggtctgggtaaatgtgacttccaacatagcagcaatccacttaaggccagaatcacatgaggacacagcccaggcaaccctggatccatgcaaagagcgggaaatgaaatccacacaggagtccatgtgacagacacacactggagcaccaggaaccaggaaggctcccgggcatggccttcctcttccctctgt

SEQ ID NO: 4456 - DNA, 598 bp, Bovine  MMBT05481
  misc_feature (1)..(5): n is any nucleotide
nnnnntaaaggtacatgtgcctatgggtatgaggaaagtgggagtctgtgtattgttcgaagttgttgtgtgtgtgctgttgtgggtgtgtgtgaacatgtgtgttgtgtttgaagtgtgcagttttggtgcatatctgcattcatgcaactgtggtgtgtggatgtgtgtgcctgctgctcagcaagtgttcgctgagcacctactgtgtgcgagggcagcagtgaaccaatgaagtgcacccattcagcactttctcttatgggaggaaactgatggtgacaggcagtcatatctttrtgcatgcacaagtgctcctgtgtgtgtctgcatgcgggggatgtgctgagtgtgtgtcctgccaccttgcgaaggctcactaatctgagtgtggctctggttgtacgcatgtacacagggcttcacatccagaatctgtggtgtcttgtgtactgctggtcttttgcatgtagatattctctttcttgtatgttgtatgaggttctcacctgtgacccaagctgcagtccagaggctccagtgggaattggcatcaggagggctgagtggtgatggctggggaggttgaggcggagta

SEQ ID NO: 4457 - DNA, 598 bp, Bovine  MMBT11276
  misc_feature (1)..(58): n is any nucleotide
nnnnnnnnnnnnnnnnnnnnnnnnnnnnnnnnnnnnnnnnnnnnnnnnnnnnnnnnnnattatttaatcaattcatttaataaacatttattgaatgtcctgactgtcctatagctcggttctaagcctggcagactgggatgtgtgcttgccttatccctggtgccatggactgttcacttggaactatctcaaagtsaagtgtctctgttctcagtaaacaatgatccctgaggtttctatagacaggaaaaacctgtatcaaacttacctgtttcatttttttattgtaatgatggratatttcaaacagaacaaagaatttggagataaagccaaatacccaccatccaaaaataacatatgtgaacatttaatcatattttctcataaaacctttctttttgcttttgtaaaatttaaaaattaacataagtgaatccatgctataaatattctgcaacttgctttttaaaaatcaaacattatgttttataaatttatccatactgataatacaggtcaagtacattcatcgttttaaaaacatatccccttacttatttatttacttatttagctgtgctgggtgttagtt

SEQ ID NO: 4458 - DNA, 600 bp, Bovine  MMBT06411
ttatgttttgtttctttcctttcttgtttcatcaccttgctgctgttttgtttccttcaggtcatatttatattttcctttgataactcctgttgggataaaggactgtacatgttatttaatagataattttcaaaattgatttaaaagttcctttaagctttaaaatgtatcctttcattctaatgcctcctaagtatgatgaattgttttgtattcattctgtccatgtttttcgattaatcatgtctcagcctttatagccaggataaaatatcttggtttcaaagtttgcaaaaygtcatcccttctacattttttcttgaccttcagggcaaatctgtgtctaatatttcagctgtaatgtactctcattttaattactgcttgaagatggtacgtcagttaaagcatttagcctttttttccatgaactttctagtcagttgttcataattagattatgtgtagctccttgttttgttttttttgtatattgaaatgtatctatctatctatctatctatatatatatatatatgaagtgtgtctgtgaaatagtaagcttgagtaaaagatgtgatgtgtctttttgtttat

SEQ ID NO: 4459 - DNA, 600 bp, Bovine  MMBT11026
tgcatgtccacacagcaccccgaaggtgacaccctacagaacaaccgcttaccagaccaccaccaacccttggaacagtccccgtgaggtggctcctgccacccccatttcagaggagcctcaggctcacagctaaatgacaccccaggcacaggctggcgatgcggcagaacctgcacaccagctcaggggcacctggctcacagtccttgttctgtctgcactgactgcctccccgcagcaccccgacggggctgccggttactgctcatccacagggaccacgtaccacgcgattamccgatcccccttctagtgccttctggcagcctgtggcccctgaggagaggaaggggcaggtctgggcggagacctcaggactcaccatctcctctggcgtgaggtactcggaggcaagtcgtggtccgaccgtgctcagggactgggcctgcagccgcagcttggcacggatctcctctagctcccgctcccggaggccatcagccacgccgccctgctccagtcggaaggactgcggccgctcgcctttcgagttcctcgtcgtacttggacaggatagagcgaggtttgtgctgcaag

SEQ ID NO: 4460 - DNA, 600 bp, Bovine  MMBT22197
ttggatttkatccctgagttgggaagatcccctggaggagggcatggcaacccactccagtattcttgcctggagaatcccatggrcagaagactgtgggctacagtccatggggttgcaaagagtagaacatgactgaagcgaaagcatgcacgtacgcacgcatgccccagaacctaaacacttgacaattatcgagatctttggaatcacagtgctaygtcctgtgtggtctctagsaaattgatgctatgaacattctggaagtttggggtgaagataccaaaagcaagagatgaraccaactgacctggatctcttgggagtccccagatggtctcctgttttagatcgttctctctttccccagctcacgttcatcgggtaccacaccttctccactagctgccctccaccccacccgctgacttgatggagcacaagttcctgggcaatgaccagcagcatcttcccttccccagcatgccagtctgcagagatggagccactgtcctgggggatgstgtgttgtgattgtcctgtctctttgaactcctcaccctggccagtcagggcttttgttacatgtaagataactga

SEQ ID NO: 4461 - DNA, 600 bp, Bovine  MMBT01387
ctcaaggacttaaaaaacagctaatgcaaggaggcactgaactcctcctatctgcctaaagacagatcctgcaaaaggacctcaattatcagaaaacctctcccagagagcttcatcaaccaggaaaaactggctcttgccacaggaaagaagactagaagctgatgccacaccatatatgcatacatgaggtatatatgttaatacccttctctagttaatctgttttttaattgtttttctctagttaatctgccttttattataggggtcctagcttagaactcagaagggtttagrgaaagttattttccctgaaaatcactgatcctctgtcatcyagtcactgcattcagtgtaatgatattgcactgatcactgaaggtacatatatggacccctgtcaaggggatggaaaggaatagctttggaagaaggaatgctggacctttggatatcttgctattacccatataggaaaattagtcaaggattttgtgctttggggaaagactgaaacaggattttgaactcctatgacctgtagggtcttatgctggttttatgaaagcatttgagaaagggatgatccacgtttct

SEQ ID NO: 4462 - DNA, 600 bp, Bovine  MMBT02429
gacaatccaccttgtagccatctccaaagaagactgtgtggctctattaagtctgcaatttgctttttaaaagtgactaaatatgctttttcacaacaacgacaagtcatctccctcctggagccaacagagtttgtcacccagcttcaccggctkttcaaagccagccatcaaaaagcaaaggaaatgtcatgactttggagcggtcagaagctcttaagtcgcagtgcaggctatttctccttttgtgrcacagaaaagagtggacagacacaatgaataaataatcccattgtactyacacacgagtaacaatccttcaaaatgaggtgaggaacaaagataggagatagcggtgcagccctggtcttaacagaacagcttgcaattccagggcctaaactgcttttgcaaacaaacacacatgcggtgaccctgagaaaataaaatttaaaaatggcatccgattcagaatgccaataggctcagcctaaatggccttctgcataattcactttggacatcttcaggctccgtggctaaaaggcagttggtctgggccaaggttaacgccttaaaccattcaaaataactgacttt

SEQ ID NO: 4463 - DNA, 600 bp, Bovine  MMBT09397
cctctagcaatcaggcgtcccaccagccaggaacgagaaactcgagggctttattctgctctgggaaaagacagcacgcatgctcaatggtgacgttgccaaggtccaggaggggcccacctaccagtttcttatcccaagtccagacactgcttgccagctgtgcccctgcccacccaccaggcacaaagggcacttgggagtggcagcaggtcttgggactatggctgtgaggatcagggccttctagggagatgggcaaaacaaagagctcgaagtaattttaaatgggcaaagacyggacttgagtcctctagagccacggtgcccacaaggatgggtttggccaaaaccctggcgggcagcgctgccctcagcctttcctctgtcggagcttctccaagtacgcctgcagcgacttctggatggagtctctgcagacgaagctgacaaagttctgggtgtcggcgtcgcgctgcctcagcaggcggtcggcggtggcctttcgcatcatgttcttggtcagctggcgcgcgtgatctgaagaagatggggcccacctgtgaggacccgggctctgtgccggggagcggtattgct

SEQ ID NO: 4464 - DNA, 600 bp, Bovine  MMBT13722
ccaggagggctctgggttcaatgcatggagtggcccatttcttccccacctcaggttcccacattggacgccaaagccggagctcagagccaagacagcagaaattcaacctttattcatcctggaacacaaacaagccaccacactcccctaaccaccctggccccctcccctcccctcctcaaggtcactctaaaggccctgggccttcttgaactaacyggtgagtcacagtgccctttgcacagaggactttggatcaagagaggattctgaaaggttggggaagaaatatactcmtttccacactggctgcagagcctcccatctcttaatcccactcccaccagtgttcttctttctcctctatgctcagtcatgtctgactctgcggccccgtggactgtagccctgcagggtcctctgcccagggattctccaggcaagaatactggagtgggttgccatgccctcctccagaagatcttcccaactcaggaatccaacctctgtctcctttcttgtgtctcctgcattgcaggtggattttttactgctgagttataggggaagcccttctttccccactgctgctgctac

SEQ ID NO: 4465 - DNA, 600 bp, Bovine  MMBT16431
tttccatttaaaaggcatgcacaactggtaatggatcttctggtaagcatttcacagaacaggggccccaggtcatgtttgttttatctgtatttcctaaaggctttccagtggcatcatgaaatacctgatggagcttttacctctgtacaatagaatgtaacatttctgtcttgctctctcttaggttactcaccagctgaggacactcaagcaatcctggagagaggtctatgaggtgagggactgagaccacctgccaaaagctggcactactttggtagccatggaaagatgccrttttggaggtggatcctccagtcctcaccaactcttcagatatagccctagccaataccttgactgcagtcttatcagagagaccctgagtctgaactgagacaggcttgttgctgaaattcagcctctgtccactggtgctgaattaaatctcagagacagagctttgggtgaaatagttattgctttgccaggcaaaggggcaacagcagaataatgcccttaagactgtgagtcccactctggagtgggtagcgaggagccttatcatgtttaaggaatagggcgtgatcagcttgt

SEQ ID NO: 4466 - DNA, 600 bp, Bovine  MMBT12497
aaggtcagcaattaggcartctagttcttgcctgaatgtatttttaaagcttatattcaggttagccatgaagttcacacccaaatgaactttttggccaacccaatatataaatgttgtcaaattaaacaaaactgaaaattactgaaaagtgtgtgaacacctgaatgttttgccttcaytgcaccagatacctggatatttagaggcaaaataaaggtagggcttgagggaattattaggaggaaataacagattatgyaagaggaatgtgttattgaaatgaaagcactccataartattaagaaagaaggtgagtaatcttggatagctccttttgtgcccagtaccccctccccagaccctttaactcactagacagacaatcttttgtagcacaaagactgtgtctgtacaaagtctaccacctgcctttcaccctgctgagctattaggctgagtggagaagtatttataatgcactttctggattcttagatgaaatgtgtttatcaagtaaagcctacttccaagtgtttcaatctcagcttgaaagtcatttcctagatcaaagagatgtacatcaacttggcaggggg

SEQ ID NO: 4467 - DNA, 476 bp, Bovine  MMBT19127
agctgagacttgggcttttctttgaagcccagcacaaaacccaactctcccaggaggttttcctggcctgctgcaccctcgtaataatcctttctttggaatctctgccattctagagcctgggctacacacactgaccccrtgttgacagcctgggccagtccctccaacctcacgttacactggaatcgttcagtaaaatgtttgcagaaaraaaaagaaacgacctcaagttgttcctgcatcatcctaggtatgccctcctggtcgcttcaattaaargatacatttttgagagtycaagctcttctttatccttgcttccctttgctgctcatcaaggcacttagatgaactaccccatctcccttcagcttgattcagcaataattcacttatacctctatcattaaaaagggaataaccaatcatctttttcatgtttcctcaccataactccccaaacttaaaacatc

SEQ ID NO: 4468 - DNA, 600 bp, Bovine  MMBT21425
ctgtcttctgtatgccctgacatcccactrctgtcatgggatgccttttctggcaccycatggcacttctgaccagttcgcacaatatctggggtgcctccagagctgctctcaatggcttcaaaatgtttgccagtaagcattagatttttyccccatttcttactgcaaatgtgttagacaagccgcaaggttaaaagtaaactggattcatgatgacatagaatgttaacaagctcctgakctgtctcaccacacatccctccaacccacactcagcaaccaaactctaaatcaacytgccagaagaaagaaatgttaaaggaagtctttgtcagcccctataactatcatgtgaataaagttaagtcaaccaaaaataagacttttagaatttattttagcttctatttgtgatactgcatttaatccttgactgagactgaagtgacaaatgttataatatttctagcatttgagataagccaagatcttccaactgctgaggatttgaaaccaagtcaattaagagtgtcatatttcaaacaattccattggttgagtgttcctcaaacttgccttctgaattagtcccaaggg

SEQ ID NO: 4469 - DNA, 600 bp, Bovine  MMBT22345
acataactacataactatgatctggctttttgtttttttttaagggcaatggacctcaggtgctaattcagtgtgaaagaccaggtaaagaaaagagctcagatgtaaatgaccttggagataagatagctagactgaaaagtcctcagggcagggatggcatctgtgtggtgtgtgtgtgtgtgtgtgtttagttctctctcattgtttgctcagtaagcgctcttgaatgaccagtgggagaactttctattatttctcctacccaaggaggcagaagtggaaacagagggagcagargtgggaagtggacagtgaatcccttacgtggctgctgttcatcatggcctcctccacacagagctgattctcctgcaaggtcttcccytgtctcttgcagacattgtgtagattcttgatgtcagcttgcaggctcaagagcttgctgttcagactgcttacgtctctgtctctctcccccacctcggcagtcagaaaaacaaaagcatcaattatgaactatcaagaaaatgcttactttcgttcactggttgacagagactttaaatttgctggaaatttgtccatcaacccttcact

SEQ ID NO: 4470 - DNA, 600 bp, Bovine  MMBT02084
tactcctactgttaaaaartatcagttaaactgataagagaaaagtagtgactattcattaagtgctttcaatatattatttcatttatgaaataggtcttagcatttccatttaacagatgggaaagacaagctcagagataatattactcaattgtgttgagcttttactatatgccaaagcatttctacacgttttatctgcattcataaattaatttaatcatcaagacttgactaggggaggacccacttccaagcttggtcataggagaattgtcaggactcatgtctttactygctgttggccagagacagctcctcactaaatgggcctctccatagcaggctcacagcatggcacctcgatcttctgagagcaatgcctgagagagacagacacagagagagatggaagttaaagaagttaaagtctttgtracatagtctcaggggtgatttcctatcacatcattatcattttttaataaacatttgtttttaatttatctagctgcaccgggtctttgttgaggtatgtgagatctagttccctgaccagggattgcgcccaggccccctgcggtgggagcagagtct

SEQ ID NO: 4471 - DNA, 600 bp, Bovine  MMBT00612
tgaacatacgaatatgacattaaatggtagtctagtgtcagtattaatcattgtacatatattcattttacatagtgggatgggcaaattacaatccttgggctaaatgcaaaccaacacttgtcttttaaataaagttgattggagcagttayaccaattcattcatgtcagtggttcccaactaggaattatcttgccctccccaggtctggggaaatttctggttgtcactgtggagcggggaactactgacatccagtggccagctgctactgctgctaaacatcctacaaagcargatagccacctacaacaaagcatcccaaaacattagcagtgccacagatgagatacccatatattgtctctggatacttctgcactaaaatgatagagttgagtagttctgacagaggtcatatggcctacaacacctaacatstttattatgtggccctttacagaaaacatttgccaatttttctctatgaaaccaaaaaatgtaagtacctcatgtttagctggttacctattaagtctagaaaacgctctttaacattatttctagaatgagacaattgacatttttatttctacc

SEQ ID NO: 4472 - DNA, 600 bp, Bovine  MMBT04674
gcgactgaactgaatagtgaatgttatctgcacttggattccagataaatttactattttttacagaatgttttaaagaacagctacacaagttcttggacataaggaccctataaaatgttttaaaagatgagtaaagccgagtatgaggtgaaataacttgttcaaattaagtcaacaaactaccacaaggccaagcactagtagtttcaattccttgagctttaaagtcatttacccttaagctcatttttttcctgcacagctcaaaatactgctaaaaagaaagaacaaataaaygaaaacagtcagtttacaaaattccttcattttctagctaaccaggttgcttatttaacaaaagaggaaattccctgccaagtacaaggactgtgctatgaaaagatattctgcaatttttacttcggtaggaacaaggtattttaagaacagatatcactccttagtatgcgtcccaggtatggagtatactgctagagttctaagtgattgagtgtcctgccctgtttccaaatgaacgtccatacgttaacacactgcactgtatattacctggtaatgactttttaattttgaaaa

SEQ ID NO: 4473 - DNA, 600 bp, Bovine  MMBT04682
atgacaatggagaaatgcctccaaagttctgagcaaaagaaagtgtgatgcaagaatactttactcagccaagttgtgttcaagcataaagaccacagagacattctcaaatgcagaaaacacagcatttatgagccattccctgaaaaacttaatgatgattcagccaaccaagagtttgaaaacaactcaggaatgagaagtgatggtaaaagtactgctggtgagtcacagatcagtttaaatataaaatgaaggctaaataattctgggaatgatgatttcagagcagaaggaaaytcaacagtgataatatccatgtagctgtaattcatacagattgaaaagtagaggaagagataaggttggagaaggaatgagctatttttttatcttcagaaccttgaaacatatcgcctagaaatgaaactttattgcgaacagttccagttttttcaatgtttctcataatcttaacttcagagaggtttttaaggaatcaattttttgtgtgggggagaaagaaatgtctacttcactttctttttcttctatcataattatataaaattgatatagcatttttattctttgatatga

SEQ ID NO: 4474 - DNA, 600 bp, Bovine  MMBT04088
gcttgcacgagcatctcagacacaaatagggatgccagtctattctagaaaatagacaaaaaggagaaaatataaaagtcatgtattagaagtgaaaacaagaacaaacattaagcttgaaaagatatataaaatatagtcataagatctctatataaaatatgtagacatctgtatctatatagatatacattcataagaaggtaaagagaaacccaaaacccccaaacgctagatgagagggataaaagctgaaaataaagatatacatctatgaatttttatgactaccttgtgagyttacttgctgtcaaactgttctgaagacatttatttgagcagctatagaaactcctacaatgccgttttcatcttgatacttctattttaaccttgaacagtctgtcaggcctcctacatttctctctgtcatagcyatgatgcctcttttggcaataaacatcagtaaacttaagtgccatgagtcatattgtcaatgtttaattaaatcatggtctagctagggtttgatttatttaggcctgaattcatttagaccctggtcctcataaatttacatagcttatttaacaagctcat

SEQ ID NO: 4475 - DNA, 600 bp, Bovine  MMBT04090
aggrtatatttattttttaaatatagcagctctatgtgaaggtcagcaattaggcartctagttcttgcctgaatgtatttttaaagcttatattcaggttagccatgaagttcacacccaaatgaactttttggccaacccaatatataaatgttgtcaaattaaacaaaactgaaaattactgaaaagtgtgtgaacacctgaatgttttgccttcaytgcaccagatacctggatatttagaggcaaaataaaggtagggcttgagggaattattaggaggaaataacagattatgyaagaggaatgtgttattgaaatgaaagcactccataartattaagaaagaaggtgagtaatcttggatagctccttttgtgcccagtaccccctccccagaccctttaactcactagacagacaatcttttgtagcacaaagactgtgtctgtacaaagtctaccacctgcctttcaccctgctgagctattaggctgagtggagaagtatttataatgcactttctggattcttagatgaaatgtgtttatcaagtaaagcctacttccaagtgtttcaatctcagcttgaaagtcatt

SEQ ID NO: 4476 - DNA, 600 bp, Bovine  MMBT02987
tgaaatgacctcacactaacatgagcctgaataatagtttacactgtgtggagcatggagcctgtgggccaatgctgtgtttccagaaatctcccccygccccccrgagtctagggaatgtcacagttccgggcccatcccctgccactatttttagtggtgatctggaggaaggaggactttcctggacttgccttcagagtctggaaaacaaacaccaccccctccccaccctcrccctcccagttcccctggcaggaagcgggagcccggattcccgggcctgccactcaccctccrtgcttctgcttgagctctgagctcttcagagctgagggacgggcggcagcaacagtgtgcccctgccctcaggtaggacctcagacagcctgcracaggtcccctctgccccctacagtatctcttyttattacactgtctgcgggtgtctgatcccctcctgagggttggccttgccctccgtctcaagtgtttcccagggccccaggacttccctgatggtccagtggttaagactccgctttccaatgcatggggtgagggttcaatctctcattagggaataacgtcccacatgct

SEQ ID NO: 4477 - DNA, 600 bp, Bovine  MMBT04270
atataaaatgacragatgagctacaaatatttttttaaaagagagagaaaatagattacaaagatgaaatgaggtgtgtagtatattaaaagtcatgctatgaaatcccacacacttgctaagagtgtgtcacaaattaggctataaattttcattcaatgagaaaaggaaaacagaatctctttacatagctaccagcaaccaaagggttaaaaacatattagcttcttttaatttgatttccacaagttcagcctggaatctgttcacattcagagaggagccaaggggttagatgcrgtggaagaaatgaactatcagttataacatgcctgcctggtgccagacaccacccccatactttcagatttggtattcaaacaactttgttcttagtccagatcctgtgggctttccatcatcctctgctttccctcaggaagaagaagctcctgtgtactttgctgtctgctgaatccttagtacaaaacgcaggttgattcccctggtgtgtatcgataatttgtgaaggaatcttccatgagatgtgaatcaaaggactttatccaagatgattgatactcgcagctgtcttttaag

SEQ ID NO: 4478 - DNA, 600 bp, Bovine  MMBT10396
ttacattgattttagtacacttcacgcctagatttgagaaatagtaatgtgcagttatgtgtcttatgaaaatctgctttttggcaatttaaatgctattttccctctgacttctgacctgtggaacttaccttctgctcctcactagctatagggtttctcaggcctgccccctgaaatgtaaaccatctgtaagccaacatttccatggaccgggggagctattagaatctaggccctaggaaggcatccgatgtccagcttataaccaggcatccattttgaactgatttcttggcragaaggccgcctgcagatttaaatgggytccyccacctcgggttctgggaagtctgcaggcagcygccctaaaagtgagttatgtcagcattccagaattcctaatgaattctcctgaacaaaaaaaacgctgttgcaccccttccctcaagtcacatttctagttgattcatgagcaaaggcacggaagaaaaaatctatggctttgagggaatcaggaagagtgaaatcatttctgctctaagaaatcactgcgccccaattattttatttgttaggaaaaaggaacctcgttttcca

SEQ ID NO: 4479 - DNA, 600 bp, Bovine  MMBT11821
aggtagtgagttttccacatttgattattttggactgcctttaatataaaattgttagtttggcttattctgtgsaatcagtatctaaatgggatttgacttttaaacattttgaggggaaagtaaaaggagtttatactaccttcayttacttgctttttagttcatagtttatggcttattgtacaatgtaagtcaattgaaagtattgtcrttatagaggctgacaggatagttctggctgggacccacagaatggttgtaccttgtgaagaactgagatctggggttctcactctyaactttgcacatttagraactgaaaaatgattaggctttttggggagatgatttatattaatcagactcacaaaagacttactcattcactgtcagtccatttgacatactttcactgaactgtgtgctggcagctcttatgggataagttattctaagccccaaatgattttatttggccttagtaagaattataatcgaaatcctaggccacaactttcaaaaatacttagttagaagactattgacactatgatacactcagaatgcagagtttgttatttttattttattttgttt

SEQ ID NO: 4480 - DNA, 600 bp, Bovine  MMBT18284
ccaaattatggcctgattcctattgactcacagtttgccttgaccaggtcactggcccctgtcgacatctgtgtcttttctagctgggacaaaccatgattctataggtctactcttcttgaatgactgtattggtgtracatctctctgcaaccaaaaggtaaaatgaagtcccaattccttagcttggtgttcaaatcctttggccatttcaccttgcttctcttccagaaagaaagtcttatagtcactttggacccctctgtcttcccagaacacaacaagtcttcctcacagcartgcttttgttcaggcaattgctctgtttgggaggcttctccactcactcctaccccttcagcaatttacatcctcccaggtccagtttaagtgggaaaatgaagggctccttctttggtctgcaggacgattgtcagttcccacagtacctctgttcctccaaatattagtggaatatttgaatgtctcctggatgcaaagataagtgttgaattgtaaacataagaaatacctatgattgacttccttcacatagggccttcccccttccatctagaccatgccactaagggttcattt

SEQ ID NO: 4481 - DNA, 598 bp, Bovine  MMBT21583
  misc_feature (1)..(188): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataatgctgatttaatcactaaaatattccaaaaggggtgggaggaattccaataaataaatagtacttggatattactccagggcttcataccataaggtagtgaacamgtagtgatctatttggatagtgctgacaaagggtgactcattttggcttaaaggtttgctagacctccaaacagacagggaagagcttaagtactaatttaaagcctgatgagattttaaagatcctaaggctcaggttaagtaatttaaaaaatacacacatctcaaacttaagtttaaaggttttaaattgtgaaacaaaggagctgcatgtacatttaatttttggtacctgaattactaacctaagacatcaaaagacaatgtacaacatgtgtctttataccattaaaaaaat

SEQ ID NO: 4482 - DNA, 600 bp, Bovine  MMBT22830
tatagttacagtgtccataagatacaagcaagtcaactgtttagagagtcaactttgcagctattctaataaagagatatttaaagtgacaagccaataccaccaccatactcaatgcaatggtggggtttgttaaaatgagattggctcagaaagcgcagggccacttcatcaacaaattattttcccttcaggaaaaaagggtggcattcctaaagaggaaaaatgaaacaagttcagctaaagtttgcctagagggacagccattaaagagaaaatgttaccgttctctacatctamaatccaccaagagattctggaacacagtgaacaagacaactgctacatcagtgattaccccaagtggggaggttgatcagctgagttttaaaggattttacagagaaagtcctcatcttcaatgtttgtgagagacagggttttcattaagattgtttataaaccatgagaakactcatttatcttgtttgtctgtaggctccttgagtgggtctattattttgggggacaaagcatccgggcagtttaaagtcatctcctggggaaagtgactatattcaaagagaattcagtgctcct

SEQ ID NO: 4483 - DNA, 600 bp, Bovine  MMBT22737
acaagattgcaaacccggcccatctccctgaggccacgccctttactccccgtgacttcgtagctcctcccatcaggggggtgtggtccagtttccccaccacttggwtctaagctttgytaagtttggctgatagaacacaacagacatgaaatgaggcaagaagaaaccttgcagcttcctgttctggttcttggaatgttccagcttgctctgtgagtcttccctagactcccaagtgatgaggggccaagtggastsagaagtccagctgacagacagcatcaaggccccagacaygtgaggagaccatcttggaccctccagctgccagataactatagtcatttaagaaatgcaargggagaccaacagaaggatacccctgctgagcccagccaattcatggactctagaaaaataataagttattgttgtttttaaacattaattttgggagtggtttgttaaacatccttagataactgacacggtctccaaatctccagttttccaggaacgtctctatgataccagagaccaccacagtgggtgtgactatcatgaataatccctgaaaacataaatgtgcctttttct

SEQ ID NO: 4484 - DNA, 601 bp, Bovine  MMBT21404
  misc_feature (1)..(1): n is any nucleotide
nccgacatgcgggctttgaccttgagtttccagaattgccaggagaatcatctgactgggaatacagtaactcgaagcttaaaggtgatgagctgagtaacttttctcttttgcatcagtcggctcatgggcacgtgcacagaggccayggttaaataaatgcgtatttgcactctctgcatatgagcgaatctctgtgtccacagtttctggtgacatacggygttggtgtgtctcatccactcagaygtatttttcagttgtttcactcatgttcagtccacttctttataggagtcartgtttccacaagtttgtggttaaaacaaacaaacaaaaattcckattcattctcaagcttcctgagtaaactgtacactcatacacttcacagatttttcagcttttctcctcttcctatctcttagtcagacctactcatggaaacattatctgcactgtggtcttgaaataaatgaatttcactaaggctgcttgggagaatgaaatctttggtatgttccttatgtaagaaacccatttgcaagaatcacagagaaaatgacagactaatggtctagaatagaatcgctgctacact

SEQ ID NO: 4485 - DNA, 600 bp, Bovine  MMBT19872
agcccatgagcccagcactgacctggagcatgccatatactctgcacaacagcccagtgaggtcactgtcagggttatccctggtgtccagatgaggacaccgtgactcagggaggctgtccaatgtcaaacagctagtaagttctagagccaggacttgaatccagggccggaggactcctttctctccatcacaccacagcccaatccagcaggctggctgcttctacaacatgctcctccttccaatgctgctgctgctcattttcttctttaaaaaatgctacatggcatgcaggrtcttagtttccagagcaggaaccaaacctgcgttctctgcagtggaagtactagacatgcaagagtcttcaccactgaaccgccaagaagtcccactgctcattttctactgatgcagctcagtgtaaccttgttgcattaatgccagcaagaatgatgtgatttccaattcactgaattctttttagaaatcacggactgtcattcccattttcaagaagacagaccgaggctaacaagggtcacactgacagaactcagaacttaggtctccctgactctagattcaaagctcttcca

SEQ ID NO: 4486 - DNA, 600 bp, Bovine  MMBT20062
actgggtcagaagcattagtatattttcaagaaaagtctatgcaaagagggtccaaggaaacaggaakgtgaaatctggaggggttgtgaagaktcttgagaatttaggaaaatggaagcttctgccattaaaagtcctagacaaaacaaaaagtatgatggtgcattattacatattatggttatatattatatttaatacatgctatatgtgtgtatattcagcattccaaaataactatatgaatctatattttaacatctttcttgcttttcacaactttgcatsacatcaaagtytgggaatcagtggaatttcatttcactttcaaaattctaatgactctttcataatcctcacagtggaatagtaggaaatgtgctgcttaaatgtaaaagaaaataatatrcaatattcttaataatgtatgtagttataaataaagtgtttttttagaccaatgacatgctaacaaagagattacctactctgctatttgagatgtgaatttaatattcagtgttcttttatttattttttgtttcattttctttaaaacattctcctgttatttattcttgagtttatttctctcacaa

SEQ ID NO: 4487 - DNA, 600 bp, Bovine  MMBT03712
taatgagtgacttacaggaaaagaatcagaagtagcaggatgcaaattttagagcaacaggaaaatatgttatgagtgtctatttttaccaaagttttcttaattaaaaaagttgtatttttttatcatgtcactggaagatgtcacatgcagataaaatcctcagtgtacctcagaaagaaaaaatatcactctttggttaggtaattgtatagaatgatcctggacttgaaatcagggaaagtttcttggtggaagtgggcagagtgaaatttaaaagaggtgaggttggaaacatgrgtggacactagacttgggggattttgtaaatcacaacagaaaaagttggaatttatctgaccctttttggaaagagcagctagaaaggaggaagacacgtagaaaaatgtggtgtcatagtaatccatggtaaggaccttcaagaaaaagcaaatgatcatcagtgatcaagcaggataggtctggaaaaggatctgttgtgtttgggaatatttactttaaaaaatacttgacaagaacaaattccatccatagtaaggatagaagtcaggtttctcagggttgaaaaatggcccgtgg

SEQ ID NO: 4488 - DNA, 600 bp, Bovine  MMBT18039
tgcttagtaaagcattttgaagatttagaaagtgactgctcagtctgcttaggatttatatcccaaacagatgtgccaagaagtcataggaatcaaactgctgttctgtgagtagaataatatattaacttgccttttagtagtgtcgattacacagctgtacaaattgcaatggagtcttcacagcttaagttgcttttatcaaaaatacatcacttcttcaggctggaagttttaacattgcaggcatctcgatgggcatgcatccttgcaaaatacttattatttgagaggaaaacrgtccagaaaattgagatatggcagtgcttaacttaccttgaggaattatctgctctctttttgaactggatcatttcatgatgaaaataaggagtgcctaaataacagtaccatcatctcatacttctagtttttctgagtcttaatgtcctcaactcttatgtcaggatattagcatccattttattgggttgctgtaaggagccaatgagagttttataaagagctcagcaaattgctaaacataggaaatgctcaataaatggtagttactattagtaacattgtattttgtttctc

SEQ ID NO: 4489 - DNA, 598 bp, Bovine  MMBT17873
  misc_feature (1)..(67): n is any nucleotide
nnnnnnnnnnnnnnnnnnnnnnnnnnnnnnnnnnnnnnnnnnnnnnnnnnnnnnnnnnnnnnnnnnntggcttttttttttccttttccttctcaaagataacaaataaattaatgcggaaagccacatccatattggaaaggcttgtctctttttccacataccctcagcgatatcgagggctttgtgataaataagtttgtcaggagttcttttcaggaaactcaaccacaattttagtcttgtctattcaacacattgttcagaaatgttttggtaacctttaaagtcctactctargagagagtttcccatacccttcaattaagttttttcctattttgaaggtcattaagactttggaagatattcttatacgtgactttgagtcatgagtccgtgtcctcagctgaagaggcaggaaggtccacgcttgtgaggaaacgttccaccaaactgtgctgttccagggcctcgctggtcaggaaggggagcctgggggtgttggacacagctgcctactagcaagggctcactgatgagggggggcttcatctgctgtggtcgatgccagggtgtgaccagacctaaagtaatg

SEQ ID NO: 4490 - DNA, 600 bp, Bovine  MMBT08214
catgatgctatcagacttttttggttctaggcccattttcatgagtctaccgagtgatggctcccatgatctgctctagtatttttttttttctcctgctgagaacatgactctgattcaagtaccattgttcaatgagaaataccctgatagtcttcacacattcagcgaatatttattgaggccttaatgtgttccaaactctgggtgaggtgtaggggatatgaaaatatataacatgacattcttgccctcaaagaactcacaggtattcataaaacatccctcacactccaactyactgttgttgactgacactgttttattagcaaagatcctgtcattagcttttagggaaagataggtagatatggaaggtcttattctggtgtccagcatagctgttctgtgtagctggttaggcaaagggtgaggatttttttactctatgtcaggagtgataggcagtcttcaccctaaaccagtacagcacaaggcctggtgcacagtgggttctcactacacattagtttgtgctgtgctgtgctaagtagctcatcatgtctgactctttgtgaccctgtgggctgtagcccacca

SEQ ID NO: 4491 - DNA, 600 bp, Bovine  MMBT00065
aggccctcagaaggagcatagagttctaaccattggaccaccagggaattctggaactcaggtttcttacaattccctccagggactagagagagactacaaagttctgcctcccctgaggatattagagtaactaagctggtagagttgagatgttttcagccacaggcatcgatcctaaaaaattcagcaagggacccgagcaggtctgaaagtgcaacatagcttctgaaagcttcccctgtacatggcgttcataaactctctctcaactggcagtgtctagacatacacggttcracacatgatttgacgtctccctctctacaggaagtcacagagctcttcccgtgagtcctgctgtgttaaaagcactcctaaagccttcctgcagcatgaactttctggtgcctaatgaggtgggagcttaagctatatgatttcccacactcattgcattcatatggcctctctccagtgtgaactttttggtgccgaacaaggtgggaggttctgatgaaatctttcccgcatttgctgcacacaaaaggcctttcacctgtgtgaactctctggtgtgcaataaagtcagagcttcga

SEQ ID NO: 4492 - DNA, 598 bp, Bovine  MMBT07195
  misc_feature (1)..(105): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagcagttgagattatgaattggagaattttaaagctacctaggttagttgttttccactctaatttgtcctgctaattagaagacttctcacaatgcacatactcatggaggaatcatctagccccgtgggcattctgttctgtttaaggaatgaaaaggtaagctgtagcttttctttgaactagacatcrtgaaataggatgagaagttattccctttcaaagcacattttattttttgctctatttgtaaaatataatttacatggcctaaccatttttatttgcacatgtgattattggatattaagtaaagggcttccctggtggctcagctggtaaagaatcygcctgcaatgcaggagacatgggttcgatcccttggtcaggaaaatcccctggagaagggtagggtacccactccagtattctggcctggagaactccattkactgcataatccatggggttgcaaagagttggacacaac

SEQ ID NO: 4493 - DNA, 600 bp, Bovine  MMBT10385
tagttagcaggtgatgaaactagcttgaggtccagagggtagagggaccatgtgttatgttatttgactgcatgaaactaactggactctataactgggaaaaaataacttgggggatgaatacaagatggctcacagaactgcacgtgaggctgaaaatccaacttggacacaaaggcaaatagagttccgaggggtctgggtggtagaaacaagaattagggtgacagcttgggtcatgaactcattccgtggttaaaggagggctggacgccttgactgacagtctctctaaagttkattgggaagaatgtcttttttaaaaatttattgtatcgaagtatagttgatttacaatgctgtgttaatttccactgtacagcaaagtcattcagttatacatatatgtgtgtgtgtgcgtgtgtatacatgtatacattctttttcatgttcttttccattatggtttatcacaggataatatacagtgatacagttccctgtgctatacagtaggaccttgttgtttattcatgctctatgtaatagtttgcatcttctagccccaaactcccagtccatccctctcgcatcttcctc

SEQ ID NO: 4494 - DNA, 601 bp, Bovine  MMBT06254
  misc_feature (1)..(1): n is any nucleotide
ncctagagcacaatttgataaaccgcaattccaaagattgaaaaagcaatagcaatgaataactcactggtgatagggctcaagtggagtatcagcccactgaatatacctcctatattactcttttatgggcagtgtttccctgacacctggcagggtgaaccacacaggcaaaaagccactgaaggagcccaggagaggaatgaagcaagatttactcacgggagaagcgggcaagtggcctggcagtcttatctccggcttcatttgcaactggaaaaaaaaaaaaaacagaagatgsagttaagtacaaggcatgtgtgtctacagaagatgccaacctacagctaatcctcaggatgattcactattaagctgtgtttgaaagtcattgtaagaggataaaagcaacttcactccctctctatatttccagtgccgctctcactgcctaaatgaagccaaatgtcttcatcattttgattaaaacagtgaattaagctggcaacctaaacagtacctagtttactgggcttaggggagttaactggcctgcaggcagagtaagaggtgtgcacgcctggcttccaagccagtgcac

SEQ ID NO: 4495 - DNA, 600 bp, Bovine  MMBT13431
gcgcactttatccctggagtgaaaaggaattgaacctcgtcaaggcactcagcaggtggcgctatgtgcacagctaaaaacaagtcaggggcgccatttccagcacaatctccctgccctgaatatcctcctttattgtactctcccatgactcaactgcttgaaattagggattcaattcttcactgaaatattatcctctctgaaagcagcctcttctgaaaagtctatgatatgcctctcttcttcatacaatagggagttcctttaaagtagaatcaaaactgacccattttggtygtaatagagatgaagatcaataaatactactgggtgaagaaatgagctaataaatgtacagtcgagcctgggcccaccccgtctccttcacagaagactgagcatcttgaaggcgacaatcagttaccatcagaagaaaagcaggcagtctgaccacagcttcggatctacgcagctgtgtgactgtggacaagtctgttccctggaccaggcctgtttcttcctttttaagtgggactcaaaattcctgcttgcctcaaagaattatcttgaaacccagtgaaatcttaactggaatgc

SEQ ID NO: 4496 - DNA, 600 bp, Bovine  MMBT17486
ggacatgtgagggaaaggccccactgagcaagctcactttccctccctgaacctctgagacaattcaggtcatgggtgtccctccccaaaggctgggctgccttgggctcccatcccaagctactaaccttactagagagcctgtttgcctttagagatgatcctctgatgcatggtgcgaaagaaaattcagtagtgaacaggccaggtggatgcaggtactcctccccttccccccgcccactgccctcagcctgggcctttgagcatgagatttacagcatcctctagtacccccamaccactttgatcctgtccatctgtacttggaagggcagtctccctgtctaggcttctggatgaaaatgaggatgaggatgaaaatgagcaactctgctgagtgataacactaggaaargctgtccttttgtgaaagagaaaggaacagacttcaaggataaccatccagaggtccaaggggcagaactagaaagactggtatccggagtgacrcaggaccaaaaggaagcaacagggtaagctgcagctcagaggccaggactaaaccgtggtcacaacttcagagatgacaggtgcttc

SEQ ID NO: 4497 - DNA, 598 bp, Bovine  MMBT21233
catatgcccagaagtggaattgctgcagcatatggtaattctatttttagttcccagacaccattttagcctcacaggaaatgcaacaggctccgagagtctcaaggtcttggtgtgaattggtaatagactcttgcttcctgcctccaagaccccagctctttgtaccaaatgggttttgcacccatacccccaaagaaatcacatggtagctaagagaaatgatgcacttgaatttaaaagagctgtattaagcttgatttactttcctcttttgtgttcttttacacaaatgagtgmgcaggcaggtggactgggtcagggagaaattataaacttatagtctgagatcaatttaggctacagatgcgctttatgtggcctataaagggtttcatacctttaaagggctgaatcatttttttgtctttaaaaatttttttaatttaatttttatattggtgtataactgacttacaatgttgtgttcatttcaggtgtacagcaaatatacactttgttcagttgtacatatacatatatccgttcttttagagattcttttcccataaaggttattacagaatatttttttata

SEQ ID NO: 4498 - DNA, 600 bp, Bovine  MMBT11611
ctagtccagccaaatacctactcatatcgagttttacatagctaagtaaaacaccacagtaaaattctcccatccctagaaagggtgatctaaaactaagtaaaaaagagggtttttctgttttctttccttttgcactctcaaaagcatgtttgcttaccaaaaaccagaatgaggcttttgttttaatttcaatgagacaaatgctagagtattactactcatcaacaggaagcaaaattactcatccattccactgagatatctaagactagaagactcaacatattttctcccttyttaaaggattctatgtgacrggattaaatttcacaaattccagaatacatttacatatgggatttaaaattttaatcccgttgccattcactttagttttaaacagcttgcttatcttctttctgatagcacaaaattcggtgcagaaatggaaaccagatttctttacgtagtgaatttcatgtggtttccacatttctccaggcagtcatttcccagcagacattcatctaaaatattcttccatgagtgatttttaagtaagatggcatctgtagcatttgtggcacgttctaagta

SEQ ID NO: 4499 - DNA, 598 bp, Bovine  MMBT15746
  misc_feature (1)..(106): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgctgtgcgtggcctgaagcccctctcccctgcccccctgtgtggacacctcctctcagctcctgcctgcctctggctggtgtgagcacccttcctgccccctctaccccgcccccgccccccgacaccagcagggacgtgtttcactcattcctccatgaagcattcatgaggagcctgcctgagagackgatggggtgctggggctaggtcttggtgacaagcgggcctggtttcagtgctgcccccggagtggggtgttctgtcatcgtgtgctcagggctaggccaagggagcccagaggaagcaccaatccaggagggcttccaggaagagggggccctgtggcattgggggacaaaactggggctaggtgtccatatgctcttctctgcttaagggccccttgcctgtatcctggctcacctggatgtccctcacccccaaggtgggtgatgggtgggaccctccgggaccccagaaaggaca

SEQ ID NO: 4500 - DNA, 598 bp, Bovine  MMBT23193
  misc_feature (1)..(15): n is any nucleotide
nnnnnnnnnnnnnnnaaatgctgaaacattgagccagaagataaatgaccagaaaattaaccaatgatgacaagtcaaggtgtactcaatttttttgtcatgtaaagtagaggagtgtgagaagaaggcattgaacaggtggcaggaaaaggggtagaatgagaaaccaagaggaaggaaaataaatatgtacataaattcaaggagaaaataaagtgattaaaggcataggctggggaggagacatcctagtttcaaatcagggctctgacatttactagctgcatgatggtaggcaakttacttaytgactctctaagtggagagaagtcctaactttatggagtttgtgtgaggattatggacagagcatgcttgtgatatacttgccatagtgcctggagtgtgaagagccctggataactatcagctgttattttgttggtataagcctttcctcatttctcccgcctctgcttctcctagctattcccaggcaggttcactgtggccaacttggttcaccatagtaacccctgaaccagtcctgtctgaggcaaggaatatcccatcagctttagcagacccaggagctgga

SEQ ID NO: 4501 - DNA, 548 bp, Bovine  MMBT01611
atgccaaatgagtctgacatatatgtcagtctctctgttttgtatgagatagcacttggatttttaatctgcagaaataagctttggtgtgttcagtgatgccagtcaaagttgtttttatttatttttaaagcattcaatggaaaagtaatccacaattctctttcatttgccagatcttctaacgtctgtatttctaaattgggagtttatatcttcaagaaaataagtaactcaaagggagtgcattttaaacaccacagtggtcagagagaacatgagggttttgcagtgtgcttyctctatgcccatatgagataaaatcatgtctaagcacaaggctctaaagtaggaatcagcgacaaaggtctgtgggagaaatccatcctggtgcctgattttgtagggtccatgagttcaaaatagtttatacattttaatggtttggaaaaaaaataagcagcttatttggtgacataagaaaattatataaaattcaaacttaagtttccatacaaagtgtttattggaacaagtaatgctcattt

SEQ ID NO: 4502 - DNA, 600 bp, Bovine  MMBT02110
ccaccgggacgtcctcctttctttctatcaaagaaagaaaaagtgaaagtgttagtcgttcagttgtgtccgactctgtgaccccattgactgtggctccccaggctctctgtccatgggattctccaggcaaraatactkgcgtgaggagccattcccttctccaggggatcttcccgacccagggatcgaacctgggtctcctgcactgtgggcagattctttcccgtctgagccatcagggaagccctcctatcacagagtttctccaaataagcacatttatagagtcccgtcacrggctgattgcagcttccacccagcactgacagtgcctgagggcagamgtycttgtagagtaaataggacgccagcctcacagaaagaagtcacctctatcctagaccaacggtatgaccttggttagtgtcctggatgaatccgcacttacaaccccacctccacaaaatgtagggagatggtggcttcctgcccagctggcaagatccctgcttacaaagaacgctgtgctggggaaacgaaggtcctcacactattaccagcactatttaaatatgcttggccgagagccttgcccgt

SEQ ID NO: 4503 - DNA, 600 bp, Bovine  MMBT17611
gaaaactgttcttgaacattctgtgactttcttagattagaaggttgctgtgtaattttatattaagtgttttactgtacatataattatcttaagagtgattttcaggccactcttgcacagtgttgaacatctttctggtactcaaaaaataattgcttagatatgttcgttaacaattatttttaagtgcctttgaatagcaggaaatataaagggaaatctactttatggcttttagatgggcgatacagtctttaaacacttgggttcttaacttcaatcataatttctatacaygaaagctttactaacagttttctgtgtctatgtgcttttgtgctcagtctctcagtcgtgtccaattcttggcaaccccatgggctgtagcctgccaggcttctctgtccatgggatttcccaggaaagaatactgcagtattggcagaaatggcagtttcctcttccaggggattttccagacccagggttcgaacctgtgtctcctgcattgacaggcagattctttaccactgagccatttggctagcccttttctaagtctacagtagtactttttccagaaagcttaacaggttg

SEQ ID NO: 4504 - DNA, 598 bp, Bovine  MMBT06242
  misc_feature (1)..(35): n is any nucleotide
nnnnnnnnnnnnnnnnnnnnnnnnnnnnnnnnnnncctctgaaactagagtcttttaacatatgcagctcagctaacatgtgcacataaaatgcagtctgactgaaggaaggataaaatctttcatctcaagtactcagaaaggctcaacaaaagataacagaaaaagatgatcaagtgaaaggtacagaagaagatctcgtagataccttctttgaagctgaaatgcaaaaggacatttgtcatgacctactgtgctgtgcacttctctcaaagatgaagaaggattcctaagggcttwgtgtgaggtcttmttgtrtttattgctacctcctggagatttccagaacaagatcatgtgatctttgtcaggaaaatccttgcatgggaaatccttcttccattaataaatcaactcaatgtcctgattatattaatcaatatatcttatggatgatctgtgattctgattgaaagtatgaggactttattaacatcattaaattgagcaacaatattggagagctagaagctgtcagaagtaaagcagcagaagaattacagtatcttcgatctctagatacagctggtaatgatat

SEQ ID NO: 4505 - DNA, 600 bp, Bovine  MMBT10530
gctctgtgagcgtcccctgcccctcaccatggtgcccagtgagccacaggccagccaaggggtgacacacaggctcaccccagccacctgcgaggacagggcgcctcggcgtccagtggacccaaggtgcaagactgtgctaaggctgcaagtgtaaaaggtacccacccaggaccccccagctgtgggctcttctcctaaagagacgtgtgaccaggacagtcacagggaaagggtagcaacgacagcaacagcccccaaaacaccagtgtagacacaggacactggagaacctggcargcaccccagcttcctgttccccccgaaccccgggacacagcctctrgcatggatgtaatcaggctgaaaggggttgcagccgtctcccctcttcccagcttggggcatagcagggtccagcccccttacctgccactggccgcccacgggcctgtagagcacaagagggtcctcccggcagtcttgcaggacccacagcccgtggccctcctcaaaggcggcgtcccacacccggtgctggaaagtcagcagctgccttggaaccagctgtcgctgggcagcatccagctggaagatgta

SEQ ID NO: 4506 - DNA, 600 bp, Bovine  MMBT06978
ataacaatttgtctaggcatttagactaaaacttgcagctcacagtgaatgaatcatcaggctctgtcaacttttttaaatgcaacctaactatcagtgtttatttatctctgtttcagctgccactacttaggtaattgttttataattgttttattggcttcattaaaaagtgatctttttgattcttgtttttttctttatttataaaatgttatgaaagattgttacctaataaatctgaaaacacctctttgtgtataatcagctatacccccaaccatctatgtccaatacaarcaagggaaaattctaccctataattaatttktattacttgaaatccaaaatagaaataataagatgtgttttaaaattcaagagactgtcctttattagctagactactaaaatgatctttattccatcctaacttcttgaaatctatattttcattgtagtcagttcaatttgatctctataccacctttcctgaagtcttaaatcacagtggttattacatcaccatccatggtgtaagtacagaaactctttacaatcaggttttaagtccttacaatataaagggcagactttgat

SEQ ID NO: 4507 - DNA, 600 bp, Bovine  MMBT11974
gaaatactgaaagtcttgaaatatatagtatatataaaaatttaaaaaaaacctcttcgctttagttagtagagaaaagcagtggaggagtagagatgtgatgggaactttttaaagcggaggatttgacggatgagggaccatcactcatggtgtcggaaagcttgagtcaaggttaggccagagtgagaagacgtctccttggacagtcatgccaggcaccgtaggaacttccccagtgtgagctggtgcagtgaaggctgaccatgcaagtagacctagaggctgctagggagcccrtgagaagagtccgtggagttttgaccaggatggcggcctgaagaattttgtcatttttaatttaagttgactcctttaaacatgtccctcttgcgtttcacgtttgtaggtttaagaaaatctaccaagaagcgcagcgaatccccgcctgccgagctccccagtttgaggcggagcacacgccaaaagaccacgggctcctgcgctagtgccaggtaataatttgggcctgtcagtgtgatattagttcatttcctgggtccagctttccccaaaggccttcattttatgagttttaaa

SEQ ID NO: 4508 - DNA, 600 bp, Bovine  MMBT01651
tgtacaggagaaactaacgcaacatttgaaatcaactaatacgccaataaaaaaaatttttagtcttcactgagctccaatttcttcacctataaaatgtcacagaacaatccttgcagattgctgaaggagacactcttgaaagcacttaacaccattcctggctcaaaggaaatagtcaataaaatgaaaaccatcattattatttattgacttgatttatactggaagcactcatgacaaaaaaaaatctaagcatctatagaagaactttctgctaaattataagaaatccccaawtagcattaaaaagaaagaggcaacactctgaaggactcagaacactgtttggctgaaaagtgagatgacattcctgtatctaccagtattacactataaaatttatcatctagttgatgtataaacaccactcatgagtctaggaaacaaacctatcagtgtttcaagtaaaaaaaaaaaaaaaaaaacccagagaaaatatgcttagtttagtccacaggtagaatgaaaaaactagcaaaacatgactaatgaagatctgacttagagatacaacaagtaaccctaccattaattttg

SEQ ID NO: 4509 - DNA, 600 bp, Bovine  MMBT08438
aacctgcaagtttcagcctctttatcatggtaaacctactaagggatataataaatcctatcccgtgagggccccaggggggacagccagtcctcattctcccaaaagacgagatacatcaacatcatcattagcatttccttcccttttgacatctctaggggacaaagaggtaacagaagcgaccggattctaatcctgactgtgctgtgctaacataaccggagccaatcactctccttcctcattcccagttcttcatggataaaacggaggagctgggctcaatgatctgataaycccttcttatctacaccactggctgtctatcctgttcaacacacctccctcaccctccacaagcactttccagttttacatttcttgctcttagcattgcttctgtttctctgactggctcccccatccactttctgtctctccacccatcccaggaaagtctggggtcctctactccgacctcagcaacactcagttatgactctagatctgttctcgtataaacactactatgctccccattatactgagcctagcatggtatctgtatatacttgtggtattgaaaagctgtgcctt

SEQ ID NO: 4510 - DNA, 600 bp, Bovine  MMBT11644
aaagcatgatgtagaacccatagtaccgtatgtagtatatgtaactcacatgggggagtcttcaacagttattgacagttacagggtctctttctttaaaagactggaaaccagttatctgttctacagtggagcatattatcaaacagttgaaacataaaaatgagtttgaaagacaaacttagtgattgattttggatatcacgtattttggaaagagattggtttcaggtttacagttacaggaggaaagttaaaagtatcactttgctgtaattttgccacatttaaatactaatmtttataagctacatttttctttttattttcctttttaaacttgtaaaagacttcagatttgaggaaagcagactgaagagaaaattttcttacatgatttaaattatcagtgttgttaggtgctggttaaaatgataaaaaatctcatgtttgacatgaattattatagattttgtagtgtaattttctccttctttgagcttaattaaacaaataggggtactaggtttctgacttttcttttaagcattgtgaaagccagattctcagtatctccgaaatatttaattttgtcaggga

SEQ ID NO: 4511 - DNA, 600 bp, Bovine  MMBT09142
tttgcaggtaacaatactaagtttcgtatgccagatggtttacctttctggtgagaacttcaagtcaccatagtcttctaagaacttcctacagattctgcatctgggaggagcacagattcacctgatgaatgtgttgccttttgtgttccgcctgacttatctaaaggaccttttctggggtgtttttcaagttgaaattctcctttactgttcttaagattcttaggttctgaggggttggttttttgatcagtgttttttttcaatcagttacttctttggaaagcccatgttttmttttagaataattttaacatcaacagactarttacaaaaaatagtacagagagttctcacgtgtctctcaccaaatgtgtcctaatgtaagtgtattacatttccatggtacacaatcaaaactgagaagccagctttaagactgccacgaacaaaattccagacattatttagcttctactggtctttccaccagagaaggcaatggcaccccactccagtactcttgcctggaaaatccaatggacggacgagcctggtaggctgcagtccatggggtcgctaggagtcggacacgac

SEQ ID NO: 4512 - DNA, 598 bp, Bovine  MMBT02076
  misc_feature (1)..(104): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacagaacaagtgctaaatattcaaaaggaaaaaaaaaacaaaacagtttgattgagaaagattctagttgcttcttggaaagtctcatttttccaaaactgattttcagtgtgttttgctgacaatcagattgttatttctttaaagagcttattcttggatgggacacygatgaattctgctttttgagatgggtactgtccttgcctaatttatcttatagtgtctggatcttaactccttgccgctggatctagataggctctattactctgctgtactttgcactcctctttttattgtctgcacataaaaaggtgaatatcgtgagaacagacagacagggrtttattggtctgcaygttcatctctttgrcataatgttgctcctctctctaggggaagtgtgcaggggtttatcagkcctactgtgatagagaggtataatacagtctgtaatgtttaatc

SEQ ID NO: 4513 - DNA, 600 bp, Bovine  MMBT05710
agaggtcggccggccgctgcttagacaagtttcaggaaacaaggatttccggagaaaacaatcaataagtaaattcaaggcccacgggggtgtagacagcctccaaagactcagtttgaattcagttctttcccactggttttgcaaaagcgccttggaggaygtgagcgatcrttcactaactcactcatttgttcattccaaaacagtactggtctgccgggcagacgacctggtttgtttcagaaacaaaaggcacagaaataaaaaggggggatacgttacaaattcaaagacccracttwtaagtcagatggaatatgcgagtctggcacagatcctggtttgattaaatgaggtgtggggagaggaaggcacctatcctgagcaggaataagtgaatgcactctgagttggaaaatattaaggaattactgtcattcttcagacacaataatggttttgtggttactttttaaaattcgtatctgtaaagtctgggattttctttcctggaaattattccaggtaaccccccgactcctaaccccccacaacacacacacacagattcgacttgaggaygaaataagatcagca

SEQ ID NO: 4514 - DNA, 600 bp, Bovine  MMBT04130
gaacaatttctgtctccctctgagctagtctcatcaaggtcagttttatggagaattccctagtggtccagtggttagcacttgacgctttcactgctggagccccaggttcaatccctggttggggaactaagatcctgcaacatgtgcagcatgccaaaagaaaaaaacattagctttatcccagtggtcaaaaccactgcatgacctttatccttcactgctctagatgcctttagcactgttgagccctcctgatgaacactgacgactccctcattctccatgaagcaagatgtyctggttctcttggtgactctgtgagactgctcacttgcagtctcctccacagtcagctgtcactagcccattacctggactaacaccatatgaagatacagaacatctggctgtttctacttcctgcgatggcaccagacacacggggtcaagggcaggtggacagagaaggggctcagaaaagctggtgatgctctttattcctgacttgaaaaccctcagtgctctggatctggaggagtcaagtggctgagggatctttttagcacttagtttttttcaagtctcacccaactgtgg

SEQ ID NO: 4515 - DNA, 598 bp, Bovine  MMBT18672
  misc_feature (1)..(210): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttattagtcagaggaaagactttttattccctaagttcatctttagaataagtggtaaaaatattccttccagattctgttattattktgtatggaattttatttttacagttgtgaattttcatgttgttctgtgttcctgttgatattttaagaggaagtttggaaagactgccccaaggactgcttgttgtatgccatttaaagccagacatcctgaattatttattaacaaaagaaaaaaacttacatccaggtgctactgcatacctgctaccttgttaatgtcaatttagggctttgtcatttgactgcatatgtgtgactcatgaacacatttacaattatgtgctcaaagggatcatgatcttctacccagtttataa

SEQ ID NO: 4516 - DNA, 600 bp, Bovine  MMBT02419
gagagcagtggttaactgaatcaaaaggtgctgagagatcaagtgagaagaggattagccagtgggcttggcaatgaggaggtcactgatgatcatgggaagagccacataccaagcctctggtccctatttcctgagacaggggcacctgctttaatagccagaaggagactgtggcatggacagggcgggtgctacgcgtgctgacatccagggctcctctggctcaggcgaacttactttctggggtagatgaccatcttggagtcaaggtcagatctgccagcccctcttttaccrttgaggagcctgctccccaggctggggcctttgattcccctctttggtggggctcagagagcacgcyttccagggagmaccagcttgagttaytggtgtttccagttgggaagggacttggggcactttaatcctcatcccttattcacagaagtggaaaccaacccagggagagccagggctgattagaagcagagcttctggggcagaaacccacttctgcaaggggcaataaaccagcgcagttaagacagggcactttaaactcaggtcgtcctggtttgagccacctcctgacct

SEQ ID NO: 4517 - DNA, 602 bp, Bovine  MMBT02633
  misc_feature (1)..(2): n is any nucleotide
nnatagaaaaactgttactgtgaaaggaattaaataatgatattgccttttttgggggtattgtgtttttagattaacttctctgtaagaaattattacagttataatttaaatctctggaggttgttcgtctaggtagaagacatttaaaattagcatattctaaggtcagtttggaaaatttaaggaaactaaagggctatatggacacttagatttttcacttaatgtagagaaattgtacagtatacttgtcctaaacctttataaatttccttttatctgattttcaggtgttctakcgcacctgcgaactaaggtgaaaagtacacaaaacctctcggctcttcagaagcctctctctgcggcgctgtgcctcctttagaggagccrctgtctctccctgcagcagctttgggactaatcttattaaatctgagctcacttcttgtttacagtccgtgtgggagaaatccagaaagatgtgaaatttttttgaagtcttccttgatagtggtggctttgattttttaaagtatggattggtaataagacccagaagtaatcttaaggcttatcttaatttcatgggctcctttatt

SEQ ID NO: 4518 - DNA, 600 bp, Bovine  MMBT05626
aaattcttctcctcctctctacatgcctcattacacagagatagaggattcaatgtttgaaaaattatcatttttgtaggttttatttgtgggacgtgagaactgggaaatatagagctcaatttaacagatgccatctctgcctttacaaacgccccactcctgctatcacacaatcagatgtgtgtgtgtgtgtataaatgcatatgcatatatatgtatatgtatttaaagcaatacatcagagttactatgttgtaaagattttagaactctattcgatgctcagttagacacacwtattctgtgagtcaggataccggccaacaccagtgtcatgaagaccataactaagggataattggctggttgtcaagatgcatttttagatgaaaagtccacaatagcaaatacggtggggctgccctgtgagaagaggaagtgtggtgtcttggggtgagccacagaccctgagaggagctgctgaatcccattgtctcaccactaatttaccatctgccctgagtcaccaaaattaccctcaggcctctattaagtgggagtaataagcacattttatcgcagcattaaaagagggcc

SEQ ID NO: 4519 - DNA, 600 bp, Bovine  MMBT03685
ggtgggattattgagtcataggccaagtgtwacttttgtctaactacgcatagcaaattgctcctccaggtgattatrccagttacagtcccaccrtaagtatttgaaggttcttgcccatctttggaactgctgttatttaaatgtttgccaatttgaagcccgtggaatgatttcttgttgtcatttggtttcccttattaattttgaggctgaccttccttccttactttgttggccatcggtttttctttctttttagcaacattctatgtcctttgatcacttaaaaaatattcktttccattatggtttatcacaagatattaaatctagttccctgtgctctacagtagggccttgttgttgtctattctgcatgtaatagtttgcatctgctaatcccaaactcccaatccgtccctcctccatcccacctccccctggcaaccacaggtctgttctctatgtctgttgatcactttcttaatgggtttttagccttttcctgtttggtttattctcattttagcttttaaaaaacaagaaaaagaaatccatctacccatccattaaacacttttttaaaaagtgaaaatt

SEQ ID NO: 4520 - DNA, 600 bp, Bovine  MMBT06995
tgattttgaataaaccccacatagacaagtaagtttgtgtagaaataaattctttctttttagctggggctgtagtaaaaaaggtgactaataaaatattctagttatgagagccctacaataggatctgttaaaatacataaatttaaattccatcccatgaaagcaattgttatatatctatatgctgatgtgtgaaccaaccacttttagtgtgtataattcagtggctattgattttttattttatatgtgtaataacatgctcctaagttcaaaagaatcaaaacactgatgttmggcaattttcaccttcaaagaccagtaccaatgcaagtaatgaaagctcaggygttactgcccggtgactcagawgaggtctaggtgctgaaagcagagygcaaggctggcggcccagagcaaaccaccttgtgggactgacttgcctctgtctccttccctcctgaaatgaatggctcactccagggtaacggcagcagaagcaccaaaggaatgaagtgaatttgtgtgtgcacagttagacaaagatggactccaggtggggccttgagtctgggtcactattgtgtctggcctgtg

SEQ ID NO: 4521 - DNA, 600 bp, Bovine  MMBT04841
acttgccccaggccctttgcaggacacatcatgaattcaaaacaatgtgacattccatttacatatcaaataataaatggagagtgtggaagtataaaacccatatcctagagtcacggtacttggcttcggaatcgactcctctctactagcattgtagccttcggcaatgtattaacctccttggccttagtctccttagctatgaaatgaagataaagataggaaggtttcttctgggtgtccctgaaaagagtaagtgaaaacaaaatccatgtaaagtggtgaacacaattagaygcaagtgttcattgcagtggttgatawttcttttacctgccctgagcactaagtgactgagaatttatttctcatgactgatgacgmatctccagcckcccactgtgccaaccctctgtcttcctgcaagtatcacactgacaaatttcactggctcagcattttcccttgcatgcagttgttctggggcttcatgtccttaaagagagccatgtttactgtttccattatttttccaaaatcagtaggcaaaacatttacttaaatttttgtactgaaaaacagcacagtctgaaggac

SEQ ID NO: 4522 - DNA, 598 bp, Bovine  MMBT07515
  misc_feature (1)..(114): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttttcatgtgagagcccagagacagattggtgatccaggtttggtaagtgactctgcaattttcacacatgacttatgtttctaagtcccagagtgttccatctttcaaccagttgacaggaaacaagatgaaggggatatatgttcaactgtactgtgcacctaaaattttgttgggttctyaaatagaacaatactcagaaatggcacagattgcttcagctcacatcacagtggctaggatttagtcacttggttatacttagctgccaaggaagctgagaaatagaatatttacttgggggaaacatggccctaattaagacaacrtttaaatggaaaagaagaagascaattattaaggagcaaataatagtctagcatagtctagcatggttgagataccatctttagagcaaatccttcttgtatcactatatataagtctcttatgttattagcctcttatgttattagtttt

SEQ ID NO: 4523 - DNA, 598 bp, Bovine  MMBT08587
  misc_feature (1)..(92): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacttgtttataataaaaacatttggtttgacttccacagaatccagcctatgatgcaaatgcttaagcgtgttagcccacattccttgtcgtccccagagaagttctgttcagaaagcgagaggggtggaaacaaacagttcctgggagtgtctccagtcagcgcccttgcatttagtctgagccatgcaaataatttggatgcyaaaactcaagccctacgtggaccttttaaatgacaaagcaattatgtgtgtctgaggagacagacagtgtctctttaaacgttctttctgttcctcgggtgtgttgtaatcagcagatggccggccctaccttccccagggccccccttgcagcagactcttctaatagctaatatcctgcagcgaccaaggccattagaaggattaagccattaccctcctgtccagcaaacacacaacgctcacaagggccgccttttcctcttcggttgttgttttcatggatgaatcagggcct

SEQ ID NO: 4524 - DNA, 600 bp, Bovine  MMBT04831
tttgacttccaaaatttcccccaacatttcaccctgaaaaatatcaagcatatagcaaagttaaaagaattttatggtcagcatcacctggattatatcattaacatttgctctctcatataactatccattggtccaaccgtcaatctacctgtcaatttatcttatttttatgcatttgaaagtaaattatagatattagttcataacctcctaaatatttcagcatgcatatctttagctggggatttacataaatccccatttacataacagggmacataaaccatgagatatttrtatcaaagcatcccctccccatgaagataatttgtttcatartaagtgtccaggtagcatattttccccaggcatttcagtaaataaccaaaatagaagacagaaatgttagtactcaggaaggagatggcaaacaatgggaggagatgaaacaagagccggtggaaaccagcaaagaactggaaaagaaaaaccatagaaataaggcaaatttggaggaaacgcaaatcaaatggacactgtaacaaaaaaaaaattctttgaaagttgaaaagaattggaaagaaaatgataaagaaa

SEQ ID NO: 4525 - DNA, 600 bp, Bovine  MMBT04186
aacagtaaatcttaagaattcaggattaataagaaccaggcaaccaacacagtagaaaaattggcaaagatataaacaagcagttcacagaagaggaaataaaaatgaccaatagactattaaagaacacttaccattctagcaaccagtgaaatacaaattaaaagatagtaaaagatttatttcaataagtcaaagatgttaatggacaattaacagaagaagagatgcacactgaccaagaagcataaaaagatgctccttggcactagtcagcaggaaactacagatatagagacrtcatttctcaccagtcagatcggtgaaattactatgttggcaaggatryggagaaatagatatacaaggacatgtgatatactgcaggygggattgtaaattgtattctggagggcaacttatcagyatgtatcaaaagtttcatcagtatatgttaaaattttcatcaatttgaaaatttatgtggcatcagaactgttttataatttcattttctcctgaggcatcttatcagagcaagttagaacatctgtaggctaatgagtgatgtttcagtaaaactttatttggtggtgctca

SEQ ID NO: 4526 - DNA, 600 bp, Bovine  MMBT08606
acgtttttccccactaggcctgttatctgacacacactgatatctccactagacataaggggattatgttaaactgaggcagaaccaggataattatgtcaggatattggcaaacactatttagcagttattttttgtttgattttatagcgacaagctttccatctcatagataatgtgaaatagtcctgtcctaggcacaataaccccccaaatatcatcaaaatgtctctttcatgtttcataggtgctcactgaatgagtgaattaggtaaatgaatgcataaatgtggtaaacartcccaggagtggactaatacatggagaagtataagaagtttaggaagagatttcagcccaggaacttatcatttagaagtatttgaacaatatgttatataataaggttttgaactgtgaggaatggaaaattggagataaggcaaaaggaggtgctaattatttaggcaggggagttcagacagaaatgtttttaatttattttctgtttttgttttttaagacaagaaagatcacagtcctcagattctcaatatatctcaggaaagaaaggcagaatagttatttctcatattgcta

(The sequence listing continues in the following parts.)

What is claimed is:

1. A method for inferring a trait of a bovine subject from a nucleic acid sample of the bovine subject, comprising identifying in the nucleic acid sample, a nucleotide occurrence of a single nucleotide polymorphism (SNP) at position 300 of SEQ ID NO:21645, thereby inferring the trait, wherein the trait is marbling, tenderness, fat thickness, red meat yield, or average daily weight gain.

2. The method of claim 1, wherein the nucleotide occurrence of at least 2 SNPs is determined to infer the trait, wherein one of the SNPs is at position 300 of SEQ ID NO:21645 and the remaining SNP or SNPs are at position 300 of any of SEQ ID NO:19473 to SEQ ID NO:21644, or SEQ ID NO:21646 to SEQ ID NO:21982.

3. The method of claim 2, wherein the nucleotide occurrences of at least 2 SNPs comprise a haplotype allele, and wherein the method infers the trait using the identified haplotype allele.

4. The method of claim 2, wherein at least 2 SNPs are related by dominance and/or epistasis.

5. The method of claim 4, further comprising identifying a diploid pair of haplotype alleles and inferring the trait using the diploid pair of haplotype alleles.

6. The method of claim 2, wherein the remaining SNP or SNPs is associated with a trait selected from the group consisting of marbling, tenderness, quality grade, muscle content, fat thickness, feed efficiency, red meat yield, average daily weight gain, disease resistance, disease susceptibility, feed intake, protein content, bone content, maintenance energy requirement, mature size, amino acid profile, fatty acid profile, milk production, a milk quality susceptibility to the buller syndrome, stress susceptibility and response, temperament, digestive capacity, production of calpain, caplastatin and myostatin, pattern of fat deposition, ribeye area, fertility, ovulation rate, conception rate, and susceptibility to infection with and shedding of pathogens.

7. The method of claim 2, wherein the trait is fat thickness.

8. The method of claim 7, wherein at least one SNP and at least one nucleotide occurrence are selected from at least one of the SNPs and nucleotide occurrences indicated in Table 1A as associated with high fat thickness.

9. The method of claim 7, wherein at least one SNP and at least one nucleotide occurrence are selected from at least one of the SNPs and nucleotide occurrences indicated in Table 1A as associated with low fat thickness.

10. The method of claim 2, wherein the trait is retail yield.

11. The method of claim 10, wherein at least one SNP and at least one nucleotide occurrence are selected from at least one of the SNPs and nucleotide occurrences indicated in Table 1A as associated with high retail yield.

12. The method of claim 10, wherein at least one SNP and at least one nucleotide occurrence are selected from at least one of the SNPs and nucleotide occurrences indicated in Table 1A as associated with low retail yield.

13. The method of claim 2, wherein the trait is tenderness.

14. The method of claim 13, wherein at least one SNP and at least one nucleotide occurrence are selected from at least one of the SNPs and nucleotide occurrences indicated in Table 1A as associated with high tenderness.

15. The method of claim 13, wherein at least one SNP and at least one nucleotide occurrence are selected from at least one of the SNPs and nucleotide occurrences indicated in Table 1A as associated with low tenderness.

16. The method of claim 2, wherein the trait is marbling.

17. The method of claim 16, wherein at least one SNP and at least one nucleotide occurrence are selected from at least one of the SNPs and nucleotide occurrences indicated in Table 1A as associated with more abundant marbling.

18. The method of claim 16, wherein at least one SNP and at least one nucleotide occurrence are selected from at least one of the SNPs and nucleotide occurrences indicated in Table 1A as associated with less abundant marbling.

19. The method of claim 2, wherein the trait is average daily gain.

20. The method of claim 19, wherein at least one SNP and at least one nucleotide occurrence are selected from at least one of the SNPs and nucleotide occurrences indicated in Table 1A as associated with a high daily gain.

21. The method of claim 19, wherein at least one SNP and at least one nucleotide occurrence are selected from at least one of the SNPs and nucleotide occurrences indicated in Table 1A as associated with low daily gain.

22. A method for determining a nucleotide occurrence of a polymorphism in a bovine sample, comprising:

a) contacting a bovine polynucleotide in the sample with an oligonucleotide that binds to a target region, wherein the target region comprises a position at position 300 of SEQ ID NO:21645 or wherein the target region is within 3000 nucleotides of a nucleotide at position 300 of SEQ ID NO:21645, and b) determining the nucleotide occurrence of a single nucleotide polymorphism (SNP) at position 300 of SEQ ID NO:21645, wherein the determination comprises analyzing binding of the oligonucleotide or detecting an amplification product generated using the oligonucleotide, thereby determining the nucleotide occurrence of the polymorphism.

23. The method of claim 22, wherein the oligonucleotide binds to a target sequence that comprises a single nucleotide polymorphism (SNP) at position 300 of SEQ ID NO:21645 and the nucleotide occurrence is determined based on the binding of the oligonucleotide to the target sequence.

24. The method of claim 22, wherein the bovine polynucleotide is contacted with a pair of oligonucleotides that comprise a primer pair, and the nucleotide occurrence is determined using an amplification product generated using the primer pair.

25. The method of claim 22, wherein the terminal nucleotide of the oligonucleotide binds to the SNP.

26. The method of claim 24, wherein the polynucleotide is contacted with a pair of oligonucleotides each comprising a different detectable label.

27. The method of claim 26, wherein the terminal nucleotide of each oligonucleotide pair is complementary to a different nucleotide at position 300 of SEQ ID NO:21645, or a complement thereof.

28. A method for identifying a bovine single nucleotide polymorphism (SNP) associated with a trait, comprising identifying a test SNP that is in disequilibrium with a SNP position at position 300 of SEQ ID NO:21645.

29. The method of claim 28, wherein the test SNP is in a target region of a bovine genome, wherein the target region is within about 500,000 nucleotides from a SNP position at position 300 of SEQ ID NO:21645.

30. The method of claim 29, wherein the target region consists of at least 20 contiguous nucleotides of SEQ ID NOS:24493 to 64886.

31. The method of claim 29, wherein the target region consists of at least 20 contiguous nucleotides of SEQ ID NOS:19473 to 21982.

32. The method of claim 28, wherein the trait is marbling, tenderness, quality grade, muscle content, fat thickness, feed efficiency, red meat yield, average daily weight gain, disease resistance, disease susceptibility, feed intake, protein content, bone content, maintenance energy requirement, mature size, amino acid profile, fatty acid profile, milk production, a milk quality susceptibility to the buller syndrome, stress susceptibility and response, temperament, digestive capacity, production of calpain, caplastatin and myostatin, pattern of fat deposition, ribeye area, fertility, ovulation rate, conception rate, or susceptibility to infection with and shedding of pathogens.

33. The method of claim 32, wherein the trait is fat thickness, retail yield, tenderness, marbling, or average daily gain.

* * * * *

UNITED STATES PATENT AND TRADEMARK OFFICE
CERTIFICATE OF CORRECTION

| | | |
|---|---|---|
| PATENT NO. | : 7,468,248 B2 | Page 1 of 1 |
| APPLICATION NO. | : 10/750623 | |
| DATED | : December 23, 2008 | |
| INVENTOR(S) | : Sue K. DeNise et al. | |

It is certified that error appears in the above-identified patent and that said Letters Patent is hereby corrected as shown below:

In the Specification:

In Columns 41 and 42, please insert the following page-wide LENGTHY TABLES statement so that it immediately precedes the page-wide SEQUENCE LISTING statement:

---

LENGTHY TABLES

The patent contains a lengthy table section. A copy of the table is available in electronic form from the USPTO web site (http://seqdata.uspto.gov/?pageRequest=docDetail&DocID=US07468248B2). An electronic copy of the table will also be available from the USPTO upon request and payment of the fee set forth in 37 CFR 1.19(b)(3).

---

Signed and Sealed this

Sixth Day of October, 2009

David J. Kappos
*Director of the United States Patent and Trademark Office*